US007709616B2

(12) United States Patent
Bentwich et al.

(10) Patent No.: US 7,709,616 B2

(45) Date of Patent: May 4, 2010

(54) MICRORNAS AND USES THEREOF

(75) Inventors: Itzhak Bentwich, Misgav (IL); Amir Avniel, New York, NY (US); Yael Karov, Tel Aviv (IL); Ranit Aharonov, Tel Aviv (IL)

(73) Assignee: Rosetta Genomics Inc., Rehovot (IL)

( * ) Notice: Subject to any disclaimer, the term of this patent is extended or adjusted under 35 U.S.C. 154(b) by 1029 days.

(21) Appl. No.: 11/130,645

(22) Filed: May 16, 2005

(65) Prior Publication Data

US 2007/0050146 A1 Mar. 1, 2007

Related U.S. Application Data

(63) Continuation of application No. PCT/US2005/016986, filed on May 14, 2005, which is a continuation-in-part of application No. 10/709,577, filed on May 14, 2004, now Pat. No. 7,687,616, and a continuation-in-part of application No. 10/709,572, filed on May 14, 2004.

(60) Provisional application No. 60/666,340, filed on Mar. 30, 2005, provisional application No. 60/665,094, filed on Mar. 25, 2005, provisional application No. 60/662,742, filed on Mar. 17, 2005, provisional application No. 60/593,329, filed on Jan. 6, 2005, provisional application No. 60/593,081, filed on Dec. 8, 2004, provisional application No. 60/522,860, filed on Nov. 15, 2004, provisional application No. 60/522,457, filed on Oct. 4, 2004, provisional application No. 60/522,452, filed on Oct. 3, 2004, provisional application No. 60/522,449, filed on Oct. 3, 2004.

(51) Int. Cl.

| | |
|---|---|
| ***C07H 21/02*** | (2006.01) |
| ***C07H 21/04*** | (2006.01) |
| *C12Q 1/68* | (2006.01) |
| *C12N 5/00* | (2006.01) |
| *A01N 43/04* | (2006.01) |
| *A61K 31/70* | (2006.01) |

(52) U.S. Cl. ........................ 536/23.1; 536/24.5; 435/6; 435/375; 514/44

(58) Field of Classification Search ............... 536/23.1, 536/24.5; 435/6, 375

See application file for complete search history.

(56) References Cited

U.S. PATENT DOCUMENTS

| | | | |
|---|---|---|---|
| 6,573,099 | B2 | 6/2003 | Graham |
| 6,720,138 | B2 | 4/2004 | Sharma et al. |
| 6,753,139 | B1 | 6/2004 | Baulcombe et al. |
| 2002/0086356 | A1 | 7/2002 | Tuschl et al. |
| 2003/0108923 | A1 | 6/2003 | Tuschl et al. |
| 2003/0228691 | A1 | 12/2003 | Lewis et al. |
| 2004/0053411 | A1 | 3/2004 | Cullen et al. |
| 2004/0086884 | A1 | 5/2004 | Beach et al. |
| 2004/0106566 | A1 | 6/2004 | Lin et al. |
| 2004/0152112 | A1 | 8/2004 | Croce et al. |
| 2004/0171037 | A1 | 9/2004 | Li et al. |
| 2004/0175732 | A1 | 9/2004 | Rana |
| 2004/0210951 | A1 | 10/2004 | Baulcombe et al. |
| 2004/0221337 | A1 | 11/2004 | Baulcombe et al. |
| 2004/0229266 | A1 | 11/2004 | Tuschl et al. |
| 2004/0253604 | A1 | 12/2004 | Lin et al. |
| 2004/0259247 | A1 | 12/2004 | Tuschl et al. |
| 2004/0259248 | A1 | 12/2004 | Tuschl et al. |
| 2004/0268441 | A1 | 12/2004 | Vance et al. |
| 2005/0026278 | A1 | 2/2005 | Tuschl et al. |
| 2005/0037988 | A1 | 2/2005 | Zamore et al. |
| 2005/0059005 | A1 | 3/2005 | Tuschl et al. |
| 2005/0059011 | A1 | 3/2005 | Sin et al. |
| 2005/0074788 | A1 | 4/2005 | Dahlberg et al. |
| 2005/0075492 | A1 | 4/2005 | Chen et al. |
| 2005/0079614 | A1 | 4/2005 | Reinhart et al. |
| 2005/0182005 | A1 * | 8/2005 | Tuschl et al. .................. 514/44 |

FOREIGN PATENT DOCUMENTS

| | | |
|---|---|---|
| WO | WO 01/68836 | 9/2001 |
| WO | WO 02/44321 | 6/2002 |
| WO | WO 02/094185 | 11/2002 |
| WO | WO 01/75164 | 2/2003 |
| WO | WO 03/029459 | 4/2003 |
| WO | WO 03/070884 | 8/2003 |
| WO | WO 03/070903 | 8/2003 |
| WO | WO 03/070918 | 8/2003 |
| WO | WO 03/074654 | 9/2003 |
| WO | WO 2004/009779 | 1/2004 |

(Continued)

OTHER PUBLICATIONS

Lee, R. C., R. L. Feinbaum and V. Ambros. The *C. elegans* heterochronic gene lin-4 encodes small RNAs with antisense complementarity to lin-14 Cell Dec. 3, 1993 843-854 75.

Wightman, B., I. Ha and G. Ruvkun. Posttranscriptional regulation of the heterochronic gene lin-14 by lin-4 mediates temporal pattern formation in *C. elegans* Cell Dec. 3, 1993 855-862 75.

Gallinaro, H., L. Domenjoud and M. Jacob. Structural study of the 5' end of a synthetic premessenger RNA from adenovirus. Evidence for a long-range exon-intron interaction J Mol Biol Jul. 15, 1994 205-225 240.

Lu, C. and R. Bablanian. Characterization of small nontranslated polyadenylylated RNAs in vaccinia virus-infected cells Proc Natl Acad Sci U S A Mar. 5, 1996 2037-2042 93.

(Continued)

*Primary Examiner*—J. E Angell
*Assistant Examiner*—Dana Shin
(74) *Attorney, Agent, or Firm*—Polsinelli Shughart PC; Teddy C. Scott, Jr.

(57) ABSTRACT

Described herein are polynucleotides associated with prostate and lung cancer. The polynucleotides are miRNAs and miRNA precursors. Related methods and compositions that can be used for diagnosis, prognosis, and treatment of those medical conditions are disclosed. Also described herein are methods that can be used to identify modulators of prostate and lung cancer.

9 Claims, 5 Drawing Sheets

FOREIGN PATENT DOCUMENTS

| | | |
|---|---|---|
| WO | WO 2004/031412 | 4/2004 |
| WO | WO 2004/057017 | 7/2004 |
| WO | WO 2004/066183 | 8/2004 |
| WO | WO 2004/072248 | 8/2004 |
| WO | WO 2004/111191 | 12/2004 |
| WO | WO 2005/012523 | 2/2005 |
| WO | WO 2005/017111 | 2/2005 |
| WO | WO 2005/019453 | 3/2005 |
| WO | WO 2005/023986 | 3/2005 |
| WO | WO 2005/033271 | 4/2005 |
| WO | WO 2005/035769 | 4/2005 |
| WO | WO 2005/041859 | 5/2005 |
| WO | WO 2005/042705 | 5/2005 |
| WO | WO 2006119266 A2 * | 11/2006 |

OTHER PUBLICATIONS

Crawford, E. D., E. P. Deantoni, R. Etzioni, V. C. Schaefer, R. M. Olson and C. A. Ross. Serum prostate-specific antigen and digital rectal examination for early detection of prostate cancer in a national community-based program. The Prostate Cancer Education Council Urology Jun. 1996 863-869 47.

Engdahl HM, Hjalt TA, Wagner EG. A two unit antisense RNA cassette test system for silencing of target genes. Nucleic Acids Res. Aug. 15, 1997 3218-27 25.

Dsouza, M., N. Larsen and R. Overbeek. Searching for patterns in genomic data Trends Genet Dec. 1997 497-498 13.

Moss, E. G., R. C. Lee and V. Ambros. The cold shock domain protein Lin-28 controls developmental timing in *C. elegans* and is regulated by the lin-4 RNA Cell 1997 637 88.

Fire, A., S. Xu, M. K. Montgomery, S. A. Kostas, S. E. Driver and C. C. Mello. Potent and specific genetic interference by double-stranded RNA in *Caenorhabditis elegans* Nature Feb. 19, 1998 806-811 391.

Waterhouse, P. M., M. W. Graham and M. B. Wang. Virus resistance and gene silencing in plants can be induced by simultaneous expression of sense and antisense RNA Proc Natl Acad Sci U S A Nov. 10, 1998 13959-13964 95.

Ngo, H., C. Tschudi, K. Gull and E. Ullu. Double-stranded RNA induces mRNA degradation in *Trypanosoma brucei* Proc Natl Acad Sci U S A Dec. 8, 1998 14687-14692 95.

Verma, S. and F. Eckstein. Modified oligonucleotides: synthesis and strategy for users Annu Rev Biochem *No date in Pubmed* 1998 99-134 67.

Wuchty, S., W. Fontana, I. L. Hofacker and P. Schuster. Complete suboptimal folding of RNA and the stability of secondary structures Biopolymers Feb. 1999 145-165 49.

Mathews, D. H., J. Sabina, M. Zuker and D. H. Turner. Expanded sequence dependence of thermodynamic parameters improves prediction of RNA secondary structure J Mol Biol May 21, 1999 911-940 288.

Chang, P. L. Encapsulation for somatic gene therapy Ann N Y Acad Sci Jun. 18, 1999 146-158 875.

Zhang, M. Q. Large-scale gene expression data analysis: a new challenge to computational biologists Genome Res Aug. 1999 681-688 9.

Grisaru, D., M. Sternfeld, A. Eldor, D. Glick and H. Soreq. Structural roles of acetylcholinesterase variants in biology and pathology Eur J Biochem Sep. 1999 672-686 264.

Fire, A. RNA-triggered gene silencing Trends Genet Sep. 1999 358-363 15.

Tabara, H., M. Sarkissian, W. G. Kelly, J. Fleenor, A. Grishok, L. Timmons, A. Fire and C. C. Mello. The rde-1 gene, RNA interference, and transposon silencing in *C. elegans* Cell Oct. 15, 1999 123-132 99.

Ryo, A., Y. Suzuki, K. Ichiyama, T. Wakatsuki, N. Kondoh, A. Hada, M. Yamamoto and N. Yamamoto. Serial analysis of gene expression in HIV-1-infected T cell lines FEBS Lett Nov. 26, 1999 182-186 462.

Olsen, P. H. and V. Ambros. The lin-4 regulatory RNA controls developmental timing in *Caenorhabditis elegans* by blocking Lin-14 protein synthesis after the initiation of translation Dev Biol Dec. 15, 1999 671-680 216.

Tuschl, T., P. D. Zamore, R. Lehmann, D. P. Bartel and P. A. Sharp. Targeted mRNA degradation by double-stranded RNA in vitro Genes Dev Dec. 15, 1999 3191-3197 13.

Reinhart, B. J., F. J. Slack, M. Basson, A. E. Pasquinelli, J. C. Bettinger, A. E. Rougvie, H. R. Horvitz and G. Ruvkun. The 21-nucleotide let-7 RNA regulates developmental timing in *Caenorhabditis elegans* Nature Feb. 24, 2000 901-906 403.

Pitt, J. N., J. A. Schisa and J. R. Priess. *P. granules* in the germ cells of *Caenorhabditis elegans* adults are associated with clusters of nuclear pores and contain RNA Dev Biol Mar. 15, 2000 315-333 219.

Hammond, S. M., E. Bernstein, D. Beach and G. J. Hannon. An RNA-directed nuclease mediates post-transcriptional gene silencing in *Drosophila* cells Nature Mar. 16, 2000 293-296 404.

Slack, F. J., M. Basson, Z. Liu, V. Ambros, H. R. Horvitz and G. Ruvkun. The lin-41 RBCC gene acts in the *C. elegans* heterochronic pathway between the let-7 regulatory RNA and the LIN-29 transcription factor Mol Cell Apr. 2000 659-669 5.

Fortier, E. and J. M. Belote. Temperature-dependent gene silencing by an expressed inverted repeat in *Drosophila* Genesis Apr. 2000 240-244 26.

Mourrain, P., C. Beclin, T. Elmayan, F. Feuerbach, C. Godon, J. B. Morel, D. Jouette, A. M. Lacombe, S. Nikic, N. Picault, K. Remoue, M. Sanial, T. A. Vo and H. Vaucheret. *Arabidopsis* SGS2 and SGS3 genes are required for posttranscriptional gene silencing and natural virus resistance Cell May 26, 2000 533-542 101.

Sijen, T. and J. M. Kooter. Post-transcriptional gene-silencing: RNAs on the attack or on the defense? Bioessays Jun. 2000 520-531 22.

Brenner, S., M. Johnson, J. Bridgham, G. Golda, D. H. Lloyd, D. Johnson, S. Luo, S. McCurdy, M. Foy, M. Ewan, R. Roth, D. George, S. Eletr, G. Albrecht, E. Vermaas, S. R. Williams, K. Moon, T. Burcham, M. Pallas, R. B. Dubridge, J. Kirchner, K. Fearon, J. Mao and K. Corcoran. Gene expression analysis by massively parallel signature sequencing (MPSS) on microbead arrays Nat Biotechnol Jun. 2000 630-634 18.

Ryo, A., Y. Suzuki, M. Arai, N. Kondoh, T. Wakatsuki, A. Hada, M. Shuda, K. Tanaka, C. Sato, M. Yamamoto and N. Yamamoto. Identification and characterization of differentially expressed mRNAs in HIV type 1-infected human T cells AIDS Res Hum Retroviruses Jul. 1, 2000 995 1005 16.

Nilsson, M., G. Barbany, D. O. Antson, K. Gertow and U. Landegren. Enhanced detection and distinction of RNA by enzymatic probe ligation Nat Biotechnol Jul. 2000 791-793 18.

Kent, W. J. and A. M. Zahler. Conservation, regulation, synteny, and introns in a large-scale *C. briggsae-C. elegans* genomic alignment Genome Res Aug. 2000 1115-1125 10.

Kennerdell, J. R. and R. W. Carthew. Heritable gene silencing in *Drosophila* using double-stranded RNA Nat Biotechnol Aug. 2000 896-898 18.

Smith, N. A., S. P. Singh, M. B. Wang, P. A. Stoutjesdijk, A. G. Green and P. M. Waterhouse. Total silencing by intron-spliced hairpin RNAs Nature Sep. 21, 2000 319-320 407.

Voinnet, O., C. Lederer and D. C. Baulcombe. A viral movement protein prevents spread of the gene silencing signal in *Nicotiana benthamiana* Cell Sep. 29, 2000 157-167 103.

Mette MF, Aufsatz W, van der Winden J, Matzke MA, Matzke AJ. Transcriptional silencing and promoter methylation triggered by double-stranded RNA. EMBO J. Oct. 2, 2000 5194-201 19.

Yang, D., H. Lu and J. W. Erickson. Evidence that processed small dsRNAs may mediate sequence-specific mRNA degradation during RNAi in *Drosophila* embryos Curr Biol Oct. 5, 2000 1191-1200 10.

Anandalakshmi, R., R. Marathe, X. Ge, J. M. Herr, Jr., C. Mau, A. Mallory, G. Pruss, L. Bowman and V. B. Vance. A calmodulin-related protein that suppresses posttranscriptional gene silencing in plants Science Oct. 6, 2000 142-144 290.

Fagard, M., S. Boutet, J. B. Morel, C. Bellini and H. Vaucheret. AGO1, QDE-2, and RDE-1 are related proteins required for post-transcriptional gene silencing in plants, quelling in fungi, and RNA interference in animals Proc Natl Acad Sci U S A Oct. 10, 2000 11650-11654 97.

Pasquinelli, A. E., B. J. Reinhart, F. Slack, M. Q. Martindale, M. I. Kuroda, B. Maller, D. C. Hayward, E. E. Ball, B. Degnan, P. Muller, J. Spring, A. Srinivasan, M. Fishman, J. Finnerty, J. Corbo, M. Levine, P. Leahy, E. Davidson and G. Ruvkun. Conservation of the sequence and temporal expression of let-7 heterochronic regulatory RNA Nature Nov. 2, 2000 86-89 408.
Llave, C., K. D. Kasschau and J. C. Carrington. Virus-encoded suppressor of posttranscriptional gene silencing targets a maintenance step in the silencing pathway Proc Natl Acad Sci U S A Nov. 21, 2000 13401-13406 9.
Cogoni, C. and G. Macino. Post-transcriptional gene silencing across kingdoms Curr Opin Genet Dev Dec. 2000 638-643 10.
Elbashir, S. M., W. Lendeckel and T. Tuschl. RNA interference is mediated by 21- and 22-nucleotide RNAs Genes Dev Jan. 15, 2001 188-200 15.
Bernstein, E., A. A. Caudy, S. M. Hammond and G. J. Hannon. Role for a bidentate ribonuclease in the initiation step of RNA interference Nature Jan. 18, 2001 363-366 409.
Vaucheret, H. and M. Fagard. Transcriptional gene silencing in plants: targets, inducers and regulators Trends Genet Jan. 2001 29-35 17.
Thomas, C. L., L. Jones, D. C. Baulcombe and A. J. Maule. Size constraints for targeting post-transcriptional gene silencing and for RNA-directed methylation in *Nicotiana benthamiana* using a potato virus X vector Plant J Feb. 2001 417-425 25.
Galyam, N., D. Grisaru, M. Grifman, N. Melamed-Book, F. Eckstein, S. Seidman, A. Eldor and H. Soreq. Complex host cell responses to antisense suppression of ACHE gene expression Antisense Nucleic Acid Drug Dev Feb. 2001 51-57 11.
Sharp, P. A. RNA interference—2001 Genes Dev Mar. 1, 2001 485-490 15.
Mallory, A. C., L. Ely, T. H. Smith, R. Marathe, R. Anandalakshmi, M. Fagard, H. Vaucheret, G. Pruss, L. Bowman and V. B. Vance. HC-Pro suppression of transgene silencing eliminates the small RNAs but not transgene methylation or the mobile signal Plant Cell Mar. 2001 571-583 13.
Matzke, M. A., A. J. Matzke, G. J. Pruss and V. B. Vance. RNA-based silencing strategies in plants Curr Opin Genet Dev Apr. 2001 221-227 11.
Schisa, J. A., J. N. Pitt and J. R. Priess. Analysis of RNA associated with *P granules* in germ cells of *C. elegans* adults Development Apr. 2001 1287-1298 128.
Di Serio, F., H. Schob, A. Iglesias, C. Tarina, E. Bouldoires and F. Meins, Jr. Sense- and antisense-mediated gene silencing in tobacco is inhibited by the same viral suppressors and is associated with accumulation of small RNAs Proc Natl Acad Sci U S A May 22, 2001 6506-6510 98.
Elbashir, S. M., J. Harborth, W. Lendeckel, A. Yalcin, K. Weber and T. Tuschl. Duplexes of 21-nucleotide RNAs mediate RNA interference in cultured mammalian cells Nature May 24, 2001 494-498 411.
Piccin, A., A. Salameh, C. Benna, F. Sandrelli, G. Mazzotta, M. Zordan, E. Rosato, C. P. Kyriacou and R. Costa. Efficient and heritable functional knock-out of an adult phenotype in *Drosophila* using a GAL4-driven hairpin RNA incorporating a heterologous spacer Nucleic Acids Res Jun. 15, 2001 E55-55 29.
Vance, V. and H. Vaucheret. RNA silencing in plants—defense and counterdefense Science Jun. 22, 2001 2277-2280 292.
Argaman, L., R. Hershberg, J. Vogel, G. Bejerano, E. G. Wagner, H. Margalit and S. Altuvia. Novel small RNA-encoding genes in the intergenic regions of *Escherichia coli* Curr Biol Jun. 26, 2001 941-950 11.
Grishok, A., A. E. Pasquinelli, D. Conte, N. Li, S. Parrish, I. Ha, D. L. Baillie, A. Fire, G. Ruvkun and C. C. Mello. Genes and mechanisms related to RNA interference regulate expression of the small temporal RNAs that control *C. elegans* developmental timing Cell Jul. 13, 2001 23-34 106.
Hutvagner, G., J. McLachlan, A. E. Pasquinelli, E. Balint, T. Tuschl and P. D. Zamore. A cellular function for the RNA-interference enzyme Dicer in the maturation of the let-7 small temporal RNA Science Aug. 3, 2001 834-838 293.
Hammond, S. M., S. Boettcher, A. A. Gaudy, R. Kobayashi and G. J. Hannon. Argonaute2, a link between genetic and biochemical analyses of RNAi Science Aug. 10, 2001 1146-1150 293.
Vaucheret, H., C. Beclin and M. Fagard. Post-transcriptional gene silencing in plants J Cell Sci Sep. 2001 3083-3091 114.
Wesley, S. V., C. A. Helliwell, N. A. Smith, M. B. Wang, D. T. Rouse, Q. Liu, P. S. Gooding, S. P. Singh, D. Abbott, P. A. Stoutjesdijk, S. P. Robinson, A. P. Gleave, A. G. Green and P. M. Waterhouse. Construct design for efficient, effective and high-throughput gene silencing in plants Plant J Sep. 2001 581-590 27.
Mattick, J. S. and M. J. Gagen. The evolution of controlled multitasked gene networks: the role of introns and other noncoding RNAs in the development of complex organisms Mol Biol Evol Sep. 2001 1611-1630 18.
Carter, R. J., I. Dubchak and S. R. Holbrook. A computational approach to identify genes for functional RNAs in genomic sequences Nucleic Acids Res Oct. 1, 2001 3928-3938 29.
Moss, E. G. RNA interference: it's a small RNA world Curr Biol Oct. 2, 2001 R772-775 11.
Ketting, R. F., S. E. Fischer, E. Bernstein, T. Sijen, G. J. Hannon and R. H. Plasterk. Dicer functions in RNA interference and in synthesis of small RNA involved in developmental timing in *C. elegans* Genes Dev Oct. 15, 2001 2654-2659 15.
Ruvkun, G. Molecular biology. Glimpses of a tiny RNA world Science Oct. 26, 2001 797-799 294.
Lee, R. C. and V. Ambros. An extensive class of small RNAs in *Caenorhabditis elegans* Science Oct. 26, 2001 862-864 294.
Lau, N. C., L. P. Lim, E. G. Weinstein and D. P. Bartel. An abundant class of tiny RNAs with probable regulatory roles in *Caenorhabditis elegans* Science Oct. 26, 2001 858-862 294.
Lagos-Quintana, M., R. Rauhut, W. Lendeckel and T. Tuschl. Identification of novel genes coding for small expressed RNAs Science Oct. 26, 2001 853-858 294.
Itaya, A., A. Folimonov, Y. Matsuda, R. S. Nelson and B. Ding. Potato spindle tuber viroid as inducer of RNA silencing in infected tomato Mol Plant Microbe Interact Nov. 2001 1332-1334 14.
Mattick, J. S. Non-coding RNAs: the architects of eukaryotic complexity EMBO Rep Nov. 2001 986-991 2.
Elbashir, S. M., J. Martinez, A. Patkaniowska, W. Lendeckel and T. Tuschl. Functional anatomy of siRNAs for mediating efficient RNAi in *Drosophila melanogaster* embryo lysate Embo J Dec. 3, 2001 6877-6888 20.
Ambros, V. microRNAs: tiny regulators with great potential Cell Dec. 28, 2001 823-826 107.
Blaszczyk, J., J. E. Tropea, M. Bubunenko, K. M. Routzahn, D. S. Waugh, D. L. Court and X. JI. Crystallographic and modeling studies of RNase III suggest a mechanism for double-stranded RNA cleavage Structure Dec. 2001 1225-1236 9.
Crete, P., S. Leuenberger, V. A. Iglesias, V. Suarez, H. Schob, H. Holtorf, S. Van Eeden and F. Meins. Graft transmission of induced and spontaneous post-transcriptional silencing of chitinase genes Plant J Dec. 2001 493-501 28.
Smallridge, R. A small fortune Nat Rev Mol Cell Biol Dec. 2001 867 2.
Eddy, S. R. Non-coding RNA genes and the modern RNA world Nat Rev Genet Dec. 2001 919-929 2.
Lu, C. M. miRNA bead detection Genaco Biomedical Products PHS 398 2001 1.
Matzke, M., A. J. Matzke and J. M. Kooter. RNA: guiding gene silencing 2001 1080 293.
Grosshans, H. and F. J. Slack. Micro-RNAs: small is plentiful J Cell Biol Jan. 7, 2002 17-21 156.
Meshorer, E., C. Erb, R. Gazit, L. Pavlovsky, D. Kaufer, A. Friedman, D. Glick, N. Benarie and H. Soreq. Alternative splicing and neuritic mRNA translocation under long-term neuronal hypersensitivity Science Jan. 18, 2002 508-512 295.
Paddison, P. J., A. A. Caudy and G. J. Hannon. Stable suppression of gene expression by RNAi in mammalian cells Proc Natl Acad Sci U S A Feb. 5, 2002 1443-1448 99.
Moss, E. G. MicroRNAs: hidden in the genome Curr Biol Feb. 19, 2002 R138-140 12.
Banerjee, D. and F. Slack. Control of developmental timing by small temporal RNAs: a paradigm for RNA-mediated regulation of gene expression Bioessays Feb. 2002 119-129 24.
Elbashir, S. M., J. Harborth, K. Weber and T. Tuschl. Analysis of gene function in somatic mammalian cells using small interfering RNAs Methods Feb. 2002 199-213 26.
Han, Y. and D. Grierson. Relationship between small antisense RNAs and aberrant RNAs associated with sense transgene mediated gene silencing in tomato Plant J Feb. 2002 509-519 29.

Nicholson, R. H. and A. W. Nicholson. Molecular characterization of a mouse cDNA encoding Dicer, a ribonuclease III ortholog involved in RNA interference Mamm Genome Feb. 2002 67-73 13.
Puerta-Fernandez, E., A. Barroso-Deljesus and A. Berzal-Herranz. Anchoring hairpin ribozymes to long target RNAs by loop-loop RNA interactions Antisense Nucleic Acid Drug Dev Feb. 2002 1-9 12.
Giordano, E., R. Rendina, I. Peluso and M. Furia. RNAi triggered by symmetrically transcribed transgenes in *Drosophila melanogaster* Genetics Feb. 2002 637-648 160.
Martens, H., J. Novotny, J. Oberstrass, T. L. Steck, P. Postlethwait and W. Nellen. RNAi in Dictyostelium: the role of RNA-directed RNA polymerases and double-stranded RNase Mol Biol Cell Feb. 2002 445-453 13.
Mourelatos, Z., J. Dostie, S. Paushkin, A. Sharma, B. Charroux, L. Abel, J. Rappsilber, M. Mann and G. Dreyfuss. miRNPs: a novel class of ribonucleoproteins containing numerous microRNAs Genes Dev Mar. 15, 2002 720-728 16.
Seggerson, K., L. Tang and E. G. Moss. Two genetic circuits repress the *Caenorhabditis elegans* heterochronic gene lin-28 after translation initiation Dev Biol Mar. 15, 2002 215-225 243.
Morel, J. B., C. Godon, P. Mourrain, C. Beclin, S. Boutet, F. Feuerbach, F. Proux and H. Vaucheret. Fertile hypomorphic Argonaute (ago1) mutants impaired in post-transcriptional gene silencing and virus resistance Plant Cell Mar. 2002 629-639 14.
Catalanotto, C., G. Azzalin, G. Macino and C. Cogoni. Involvement of small RNAs and role of the qde genes in the gene silencing pathway in Neurospora Genes Dev Apr. 1, 2002 790-795 16.
Boutla, A., K. Kalantidis, N. Tavernarakis, M. Tsagris and M. Tabler. Induction of RNA interference in *Caenorhabditis elegans* by RNAs derived from plants exhibiting post-transcriptional gene silencing Nucleic Acids Res Apr. 1, 2002 1688-1694 30.
Pasquinelli, A. E. and G. Ruvkun. Control of developmental timing by micrornas and their targets Annu Rev Cell Dev Biol Epub 2002 Apr. 2, 2002 495-513 18.
Paddison, P. J., A. A. Caudy, E. Bernstein, G. J. Hannon and D. S. Conklin. Short hairpin RNAs (shRNAs) induce sequence-specific silencing in mammalian cells Genes Dev Apr. 15, 2002 948-958 16.
Beclin, C., S. Boutet, P. Waterhouse and H. Vaucheret. A branched pathway for transgene-induced RNA silencing in plants Curr Biol Apr. 16, 2002 684-688 12.
Eddy, S. R. Computational genomics of noncoding RNA genes Cell Apr. 19, 2002 137-140 109.
Lagos-Quintana, M., R. Rauhut, A. Yalcin, J. Meyer, W. Lendeckel and T. Tuschl. Identification of tissue-specific microRNAs from mouse Curr Biol Apr. 30, 2002 735-739 12.
Kent, W. J. Blat—the Blast-like alignment tool Genome Res Apr. 2002 656-664 12.
Hutvagner, G. and P. D. Zamore. RNAi: nature abhors a double-strand Curr Opin Genet Dev Apr. 2002 225-232 12.
Nilsson, M., J. Baner, M. Mendel-Hartvig, F. Dahl, D. O. Antson, M. Gullberg and U. Landegren. Making ends meet in genetic analysis using padlock probes Hum Mutat Apr. 2002 410-415 19.
Pasquinelli, A. E. MicroRNAs: deviants no longer Trends Genet Apr. 2002 171-173 18.
Lai, E. C. Micro RNAs are complementary to 3' UTR sequence motifs that mediate negative post-transcriptional regulation Nat Genet Apr. 2002 363-364 30.
Schwarz, D. S. and P. D. Zamore. Why do miRNAs live in the miRNP? Genes Dev May 1, 2002 1025-1031 16.
Brantl, S. Antisense-RNA regulation and RNA interference Biochim Biophys Acta May 3, 2002 15-25 1575.
Li, H., W. X. Li and S. W. Ding. Induction and suppression of RNA silencing by an animal virus Science May 17, 2002 1319-1321 296.
Zamore, P. D. Ancient pathways programmed by small RNAs Science May 17, 2002 1265-1269 296.
Chen, S., E. A. Lesnik, T. A. Hall, R. Sampath, R. H. Griffey, D. J. Ecker and L. B. Blyn. A bioinformatics based approach to discover small RNA genes in the *Escherichia coli* genome Biosystems Mar.-May 2002 157-177 65.
Lee, N. S., T. Dohjima, G. Bauer, H. Li, M. J. Li, A. Ehsani, P. Salvaterra and J. Rossi. Expression of small interfering RNAs targeted against HIV-1 rev transcripts in human cells Nat Biotechnol May 2002 500-505 20.
Draghici, S. Statistical intelligence: effective analysis of high-density microarray data Drug Discov Today Jun. 1, 2002 S55-63 7.
Silhavy, D., A. Molnar, A. Lucioli, G. Szittya, C. Hornyik, M. Tavazza and J. Burgyan. A viral protein suppresses RNA silencing and binds silencing-generated, 21- to 25-nucleotide double-stranded RNAs Embo J Jun. 17, 2002 3070-3080 21.
Ayash-Rashkovsky, M., Z. Weisman, J. Diveley, R. B. Moss, Z. Bentwich and G. Borkow. Generation of Th1 immune responses to inactivated, gp120-depleted HIV-1 in mice with a dominant Th2 biased immune profile via immunostimulatory [correction of imunostimulatory] oligonucleotides—relevance to AIDS vaccines in developing countries Vaccine Jun. 21, 2002 2684-2692 20.
Tabara, H., E. Yigit, H. Siomi and C. C. Mello. The dsRNA binding protein RDE-4 interacts with RDE-1, DCR-1, and a DExH-box helicase to direct RNAi in *C. elegans* Cell Jun. 28, 2002 861-871 109.
Bettencourt, R., O. Terenius and I. Faye. Hemolin gene silencing by ds-RNA injected into *Cecropia pupae* is lethal to next generation embryos Insect Mol Biol Jun. 2002 267-271 11.
Hooper, N. M. and A. J. Turner. The search for alpha-secretase and its potential as a therapeutic approach to Alzheimer s disease Curr Med Chem Jun. 2002 1107-1119 9.
Liu, Q., S. Singh and A. Green. High-oleic and high-stearic cottonseed oils: nutritionally improved cooking oils developed using gene silencing J Am Coll Nutr Jun. 2002 205S-211S 21.
Zeng, Y., E. J. Wagner and B. R. Cullen. Both natural and designed micro RNAs can inhibit the expression of cognate mRNAs when expressed in human cells Mol Cell Jun. 2002 1327-1333 9.
McManus, M. T., C. P. Petersen, B. B. Haines, J. Chen and P. A. Sharp. Gene silencing using micro-RNA designed hairpins Rna Jun. 2002 842-850 8.
Reinhart, B. J., E. G. Weinstein, M. W. Rhoades, B. Bartel and D. P. Bartel. MicroRNAs in plants Genes Dev Jul. 1, 2002 1616-1626 16.
McCaffrey, A. P., L. Meuse, T. T. Pham, D. S. Conklin, G. J. Hannon and M. A. Kay. RNA interference in adult mice Nature Jul. 4, 2002 38-39 418.
Hannon, G. J. RNA interference Nature Jul. 11, 2002 244-251 418.
Dennis, C. The brave new world of RNA Nature Jul. 11, 2002 122-124 418.
Jacque, J. M., K. Triques and M. Stevenson. Modulation of HIV-1 replication by RNA interference Nature Jul. 25, 2005 435-438 418.
Cullen, B. R. RNA interference: antiviral defense and genetic tool Nat Immunol Jul. 2002 597-599 3.
Ma, C. and A. Mitra. Intrinsic direct repeats generate consistent post-transcriptional gene silencing in tobacco Plant J Jul. 2002 37-49 31.
Novina, C. D., M. F. Murray, D. M. Dykxhoorn, P. J. Beresford, J. Riess, S. K. Lee, R. G. Collman, J. Lieberman, P. Shankar and P. A. Sharp. siRNA-directed inhibition of Hiv-1 infection Nat Med Jul. 2002 681-686 8.
Pomerantz, R. J. RNA interference meets HIV-1: will silence be golden? Nat Med Jul. 2002 659-660 8.
Zeng, Y. and B. R. Cullen. RNA interference in human cells is restricted to the cytoplasm Rna Jul. 2002 855-860 8.
Xiang, C. C., O. A. Kozhich, M. Chen, J. M. Inman, Q. N. Phan, Y. Chen and M. J. Brownstein. Amine-modified random primers to label probes for DNA microarrays Nat Biotechnol Jul. 2002 738-742 20.
Llave, C., K. D. Kasschau, M. A. Rector and J. C. Carrington. Endogenous and silencing-associated small RNAs in plants Plant Cell Jul. 2002 1605-1619 14.
Rhoades, M. W., B. J. Reinhart, L. P. Lim, C. B. Burge, B. Bartel and D. P. Bartel. Prediction of plant microRNA targets Cell Aug. 23, 2002 513-520 110.
Hipfner, D. R., K. Weigmann and S. M. Cohen. The bantam gene regulates *Drosophila* growth Genetics Aug. 2002 1527-1537 161.
Liu, Q., S. P. Singh and A. G. Green. High-stearic and High-oleic cottonseed oils produced by hairpin RNA-mediated post-transcriptional gene silencing Plant Physiol Aug. 2002 1732-1743 129.
Stoutjesdijk, P. A., S. P. Singh, Q. Liu, C. J. Hurlstone, P. A. Waterhouse and A. G. Green. hpRNA-mediated targeting of the *Arabidopsis* FAD2 gene gives highly efficient and stable silencing Plant Physiol Aug. 2002 1723-1731 129.
Suzuma, S., S. Asari, K. Bunai, K. Yoshino, Y. Ando, H. Kakeshita, M. Fujita, K. Nakamura and K. Yamane. Identification and characterization of novel small RNAs in the aspS-yrvM intergenic region of the *Bacillus subtilis* genome Microbiology Aug. 2002 2591-2598 148.
Milligan, L., T. Forne, E. Antoine, M. Weber, B. Hemonnot, L. Dandolo, C. Brunel and G. Cathala. Turnover of primary transcripts is a major step in the regulation of mouse H19 gene expression EMBO Rep Aug. 2002 774-779 3.
Hamilton, A., O. Voinnet, L. Chappell and D. Baulcombe. Two classes of short interfering RNA in RNA silencing Embo J Sep. 2, 2002 4671-4679 21.
Lee, Y., K. Jeon, J. T. Lee, S. Kim and V. N. Kim. MicroRNA maturation: stepwise processing and subcellular localization Embo J Sep. 2, 2002 4663-4670 21.
Klahre, U., P. Crete, S. A. Leuenberger, V. A. Iglesias and F. Meins, Jr. High molecular weight RNAs and small interfering RNAs induce systemic posttranscriptional gene silencing in plants Proc Natl Acad Sci U S A Sep. 3, 2002 11981-11986 99.
Park, W., J. Li, R. Song, J. Messing and X. Chen. Carpel Factory, a Dicer homolog, and HEN1, a novel protein, act in microRNA metabolism in *Arabidopsis thaliana* Curr Biol Sep. 3, 2002 1484-1495 12.
Jiang, M. and J. Milner. Selective silencing of viral gene expression in HPV-positive human cervical carcinoma cells treated with siRNA, a primer of RNA interference Oncogene Sep. 5, 2002 6041-6048 21.
Martinez, J., A. Patkaniowska, H. Urlaub, R. Luhrmann and T. Tuschl. Single-stranded antisense siRNAs guide target RNA cleavage in RNAi Cell Sep. 6, 2002 563-574 110.
Allshire, R. Molecular biology. RNAi and heterochromatin—a hushed-up affair Science Sep. 13, 2002 1818-1819 297.
Reinhart, B. J. and D. P. Bartel. Small RNAs correspond to centromere heterochromatic repeats Science Sep. 13, 2002 1831 297.
Volpe, T. A., C. Kidner, I. M. Hall, G. Teng, S. I. Grewal and R. A. Martienssen. Regulation of heterochromatic silencing and histone H3 lysine-9 methylation by RNAi Science Sep. 13, 2002 1833-1837 297.
Baulcombe, D. DNA events. An RNA microcosm Science Sep. 20, 2002 2002-2003 297.
Llave, C., Z. Xie, K. D. Kasschau and J. C. Carrington. Cleavage of Scarecrow-like mRNA targets directed by a class of *Arabidopsis* miRNA Science Sep. 20, 2002 2053-2056 297.
Mochizuki, K., N. A. Fine, T. Fujisawa and M. A. Gorovsky. Analysis of a piwi-related gene implicates small RNAs in genome rearrangement in tetrahymena Cell Sep. 20, 2002 689-699 110.
Hutvagner, G. and P. D. Zamore. A microRNA in a multiple-turnover RNAi enzyme complex Science Sep. 20, 2002 2056-2060 297.
Coburn, G. A. and B. R. Cullen. Potent and specific inhibition of human immunodeficiency virus type 1 replication by RNA interference J Virol Sep. 2002 9225-9231 76.
Caudy, A. A., M. Myers, G. J. Hannon and S. M. Hammond. Fragile X-related protein and VIG associate with the RNA interference machinery Genes Dev Oct. 1, 2002 2491-2496 16.
Ishizuka, A., M. C. Siomi and H. Siomi. A *Drosophila* fragile X protein interacts with components of RNAi and ribosomal proteins Genes Dev Oct. 1, 2002 2497-2508 16.
Voinnet, O. RNA silencing: small RNAs as ubiquitous regulators of gene expression Curr Opin Plant Biol Oct. 2002 444-451 5.
Golden, T. A., S. E. Schauer, J. D. Lang, S. Pien, A. R. Mushegian, U. Grossniklaus, D. W. Meinke and A. Ray. Short Integuments1/Suspensor1/Carpel Factory, a Dicer homolog, is a maternal effect gene required for embryo development in *Arabidopsis* Plant Physiol Oct. 2002 808-822 130.
Merkle, I., M. J. Van Ooij, F. J. Van Kuppeveld, D. H. Glaudemans, J. M. Galama, A. Henke, R. Zell and W. J. Melchers. Biological significance of a human enterovirus B-specific RNA element in the 3' nontranslated region J Virol Oct. 2002 9900-9909 76.
Froeyen, M. and P. Herdewijn. RNA as a target for drug design, the example of Tat-TAR interaction Curr Top Med Chem Oct. 2002 1123-1145 2.
Carmell, M. A., Z. Xuan, M. Q. Zhang and G. J. Hannon. The Argonaute family: tentacles that reach into RNAi, developmental control, stem cell maintenance, and tumorigenesis Genes Dev Nov. 1, 2002 2733-2742 16.
Provost, P., D. Dishart, J. Doucet, D. Frendewey, B. Samuelsson and O. Radmark. Ribonuclease activity and RNA binding of recombinant human Dicer Embo J Nov. 1, 2002 5864-5874 21.
Zhang, H., F. A. Kolb, V. Brondani, E. Billy and W. Filipowicz. Human Dicer preferentially cleaves dsRNAs at their termini without a requirement for ATP Embo J Nov. 1, 2002 5875-5885 21.
Mallory, A. C., B. J. Reinhart, D. Bartel, V. B. Vance and L. H. Bowman. A viral suppressor of RNA silencing differentially regulates the accumulation of short interfering RNAs and micro-RNAs in tobacco Proc Natl Acad Sci U S A Nov. 12, 2002 15228-15233 99.
Gottesman, S. Stealth regulation: biological circuits with small RNA switches Genes Dev Nov. 15, 2002 2829-2842 16.
Calin, G. A., C. D. Dumitru, M. Shimizu, R. Bichi, S. Zupo, E. Noch, H. Aldler, S. Rattan, M. Keating, K. Rai, L. Rassenti, T. Kipps, M. Negrini, F. Bullrich and C. M. Croce. Frequent deletions and down-regulation of micro-RNA genes miR15 and miR16 at 13q14 in chronic lymphocytic leukemia Proc Natl Acad Sci U S A Nov. 26, 2002 15524-15529 99.
Gaudilliere, B., Y. Shi and A. Bonni. RNA interference reveals a requirement for myocyte enhancer factor 2A in activity-dependent neuronal survival J Biol Chem Nov. 29, 2002 46442-46446 277.
Jones, L. Revealing micro-RNAs in plants Trends Plant Sci Nov. 2002 473-475 7.
Schauer, S. E., S. E. Jacobsen, D. W. Meinke and A. Ray. DICER-LIKE1: blind men and elephants in *Arabidopsis* development Trends Plant Sci Nov. 2002 487-491 7.
Okazaki, Y., M. Furuno, T. Kasukawa, J. Adachi, H. Bono, S. Kondo, et al. Analysis of the mouse transcriptome based on functional annotation of 60,770 full-length cDNAs Nature Dec. 5, 2002 563-573 420.
Dennis, C. Small RNAs: the genome's guiding hand? Nature Dec. 19-26, 2002 732 420.
Uchida, N., S. Hoshino, H. Imataka, N. Sonenberg and T. Katada. A novel role of the mammalian GSPT/eRF3 associating with poly(A)-binding protein in Cap/Poly(A)-dependent translation J Biol Chem Dec. 27, 2002 50286-50292 277.
Huttenhofer, A., J. Brosius and J. P. Bachellerie. RNomics: identification and function of small, non-messenger RNAs Curr Opin Chem Biol Dec. 2002 835-843 6.
Wood, N. T. Unravelling the molecular basis of viral suppression of PTGS Trends Plant Sci 2002 384 7.
Cohen, O., C. Erb, D. Ginzberg, Y. Pollak, S. Seidman, S. Shoham, R. Yirmiya and H. Soreq. Neuronal overexpression of "readthrough" acetylcholinesterase is associated with antisense-suppressible behavioral impairments Mol Psychiatry *No date in pubmed* 2002 874-885 7.
Mlotshwa, S., O. Voinnet, M. F. Mette, M. Matzke, H. Vaucheret, S. W. Ding, G. Pruss and V. B. Vance. RNA silencing and the mobile silencing signal Plant Cell *No date in pubmed* 2002 S289-301 14 Suppl.
Tang, G., B. J. Reinhart, D. P. Bartel and P. D. Zamore. A biochemical framework for RNA silencing in plants Genes Dev Jan. 1, 2003 49-63 17.
Kawasaki, H. and K. Taira. Short hairpin type of dsRNAs that are controlled by tRNA(Val) promoter significantly induce RNAi-mediated gene silencing in the cytoplasm of human cells Nucleic Acids Res Jan. 15, 2003 700-707 31.
Ashrafi, K., F. Y. Chang, J. L. Watts, A. G. Fraser, R. S. Kamath, J. Ahringer and G. Ruvkun. Genome-wide RNAi analysis of *Caenorhabditis elegans* fat regulatory genes Nature Jan. 16, 2003 268-272 421.
Kamath, R. S., A. G. Fraser, Y. Dong, G. Poulin, R. Durbin, M. Gotta, A. Kanapin, N. Le Bot, S. Moreno, M. Sohrmann, D. P. Welchman, P. Zipperlen and J. Ahringer. Systematic functional analysis of the *Caenorhabditis elegans* genome using RNAi Nature Jan. 16, 2003 231-237 421.
Tuschl, T. Functional genomics: RNA sets the standard Nature Jan. 16, 2003 220-221 421.
Iyer, L. M., E. V. Koonin and L. Aravind. Evolutionary connection between the catalytic subunits of DNA-dependent RNA polymerases and eukaryotic RNA-dependent RNA polymerases and the origin of RNA polymerases BMC Struct Biol Jan. 28, 2003 1 3.
Shi, Y. Mammalian RNAi for the masses Trends Genet Jan. 2003 9-12 19.

Cerutti, H. RNA interference: traveling in the cell and gaining functions? Trends Genet Jan. 2003 39-46 19.
Zeng, Y. and B. R. Cullen. Sequence requirements for micro RNA processing and function in human cells Rna Jan. 2003 112-123 9.
Kawasaki, H., E. Suyama, M. Iyo and K. Taira. siRNAs generated by recombinant human Dicer induce specific and significant but target site-independent gene silencing in human cells Nucleic Acids Res Feb. 1, 2003 981-987 31.
Reiner, A., D. Yekutieli and Y. Benjamini. Identifying differentially expressed genes using false discovery rate controlling procedures Bioinformatics Feb. 12, 2003 368-375 19.
Doench, J. G., C. P. Petersen and P. A. Sharp. siRNAs can function as miRNAs Genes Dev Feb. 15, 2003 438-442 17.
Gupta, V., A. Cherkassky, P. Chatis, R. Joseph, A. L. Johnson, J. Broadbent, T. Erickson and J. Dimeo. Directly labeled mRNA produces highly precise and unbiased differential gene expression data Nucleic Acids Res Feb. 15, 2003 e13 31.
Boffelli, D., J. McAuliffe, D. Ovcharenko, K. D. Lewis, I. Ovcharenko, L. Pachter and E. M. Rubin. Phylogenetic shadowing of primate sequences to find functional regions of the human genome Science Feb. 28, 2003 1391-1394 299.
Kasschau, K. D., Z. Xie, E. Allen, C. Llave, E. J. Chapman, K. A. Krizan and J. C. Carrington. P1/HC-Pro, a viral suppressor of RNA silencing, interferes with *Arabidopsis* development and miRNA unction Dev Cell Feb. 2003 205-217 4.
Carmell, M. A., L. Zhang, D. S. Conklin, G. J. Hannon and T. A. Rosenquist. Germline transmission of RNAi in mice Nat Struct Biol Feb. 2003 91-92 10.
Dostie, J., Z. Mourelatos, M. Yang, A. Sharma and G. Dreyfuss. Numerous microRNPs in neuronal cells containing novel microRNAs Rna Feb. 2003 180-186 9.
Lagos-Quintana, M., R. Rauhut, J. Meyer, A. Borkhardt and T. Tuschl. New microRNAs from mouse and human Rna Feb. 2003 175-179 9.
Wilson, J. A., S. Jayasena, A. Khvorova, S. Sabatinos, I. G. Rodrigue-Gervais, S. Arya, F. Sarangi, M. Harris-Brandts, S. Beaulieu and C. D. Richardson. RNA interference blocks gene expression and RNA synthesis from hepatitis C replicons propagated in human liver cells Proc Natl Acad Sci U S A Mar. 4, 2003 2783-2788 100.
Lim, L. P., M. E. Glasner, S. Yekta, C. B. Burge and D. P. Bartel. Vertebrate microRNA genes Science Mar. 7, 2003 1540 299.
Maniataki, E., A. E. Martinez De Alba, R. Sagesser, M. Tabler and M. Tsagris. Viroid RNA systemic spread may depend on the interaction of a 71-nucleotide bulged hairpin with the host protein VirP1 Rna Mar. 2003 346-354 9.
Ambros, V., B. Bartel, D. P. Bartel, C. B. Burge, J. C. Carrington, X. Chen, G. Dreyfuss, S. R. Eddy, S. Griffiths-Jones, M. Marshall, M. Matzke, G. Ruvkun and T. Tuschl. A uniform system for microRNA annotation Rna Mar. 2003 277-279 9.
Findley, S. D., M. Tamanaha, N. J. Clegg and H. Ruohola-Baker. Maelstrom, a *Drosophila* spindle-class gene, encodes a protein that colocalizes with Vasa and RDE1/AGO1 homolog, Aubergine, in nuage Development Mar. 2003 859-871 130.
Hershberg, R., S. Altuvia and H. Margalit. A survey of small RNA-encoding genes in *Escherichia coli* Nucleic Acids Res Apr. 1, 2003 1813-1820 31.
Zhou, A., S. Scoggin, R. B. Gaynor and N. S. Williams. Identification of NF-kappa B-regulated genes induced by TNFalpha utilizing expression profiling and RNA interference Oncogene Apr. 3, 2003 2054-2064 22.
Brennecke, J., D. R. Hipfner, A. Stark, R. B. Russell and S. M. Cohen. bantam encodes a developmentally regulated microRNA that controls cell proliferation and regulates the proapoptotic gene hid in *Drosophila* Cell Apr. 4, 2003 25-36 113.
Lim, L. P., N. C. Lau, E. G. Weinstein, A. Abdelhakim, S. Yekta, M. W. Rhoades, C. B. Burge and D. P. Bartel. The microRNAs of *Caenorhabditis elegans* Genes Dev Apr. 15, 2003 991-1008 17.
Xu, P., S. Y. Vernooy, M. Guo and B. A. Hay. The *Drosophila* microRNA Mir-14 suppresses cell death and is required for normal fat metabolism Curr Biol Apr. 29, 2003 790-795 13.
Xie, Z., K. D. Kasschau and J. C. Carrington. Negative feedback regulation of Dicer-Like1 in *Arabidopsis* by microRNA-guided mRNA degradation Curr Biol Apr. 29, 2003 784-789 13.
Carmichael, G. G. Antisense starts making more sense Nat Biotechnol Apr. 2003 371-372 21.
Yelin, R., D. Dahary, R. Sorek, E. Y. Levanon, O. Goldstein, A. Shoshan, A. Diber, S. Biton, Y. Tamir, R. Khosravi, S. Nemzer, E. Pinner, S. Walach, J. Bernstein, K. Savitsky and G. Rotman. Widespread occurrence of antisense transcription in the human genome Nat Biotechnol Apr. 2003 379-386 21.
Boutet, S., F. Vazquez, J. Liu, C. Beclin, M. Fagard, A. Gratias, J. B. Morel, P. Crete, X. Chen and H. Vaucheret. *Arabidopsis HEN1*: a genetic link between endogenous miRNA controlling development and siRNA controlling transgene silencing and virus resistance Curr Biol May 13, 2003 843-848 13.
Ambros, V., R. C. Lee, A. Lavanway, P. T. Williams and D. Jewell. MicroRNAs and other tiny endogenous RNAs in *C. elegans* Curr Biol May 13, 2003 807-818 13.
Liang, X. S., J. Q. Lian, Y. X. Zhou, Q. H. Nie and C. Q. Hao. A small yeast RNA inhibits HCV IRES mediated translation and inhibits replication of poliovirus in vivo World J Gastroenterol May 2003 1008-1013 9.
Grad, Y., J. Aach, G. D. Hayes, B. J. Reinhart, G. M. Church, G. Ruvkun and J. Kim. Computational and experimental identification of *C. elegans* microRNAs Mol Cell May 2003 1253-1263 11.
Abrahante, J. E., A. L. Daul, M. Li, M. L. Volk, J. M. Tennessen, E. A. Miller and A. E. Rougvie. The *Caenorhabditis elegans* hunchback-like gene lin-57/hbl-1 controls developmental time and is regulated by microRNAs Dev Cell May 2003 625-637 4.
Lin, S. Y., S. M. Johnson, M. Abraham, M. C. Vella, A. Pasquinelli, C. Gamberi, E. Gottlieb and F. J. Slack. The *C elegans* hunchback homolog, hbl-1, controls temporal patterning and is a probable microRNA target Dev Cell May 2003 639-650 4.
Zamvil, S. S. and L. Steinman. Diverse targets for intervention during inflammatory and neurodegenerative phases of multiple sclerosis Neuron Jun. 5, 2003 685-688 38.
Ambros, V. MicroRNA pathways in flies and worms: growth, death, fat, stress, and timing Cell Jun. 13, 2003 673-676 113.
Moss, E. G. and L. Tang. Conservation of the heterochronic regulator Lin-28, its developmental expression and microRNA complementary sites Dev Biol Jun. 15, 2003 432-442 258.
Smalheiser, N. R. EST analyses predict the existence of a population of chimeric microRNA precursor-mRNA transcripts expressed in normal human and mouse tissues Genome Biol Epub 2003 Jun. 18, 2003 403 4.
Kawasaki, H. and K. Taira. Hes1 is a target of microRNA-23 during retinoic-acid-induced neuronal differentiation of NT2 cells nature Jun. 19, 2003 838-842 423.
Lai, E. C., P. Tomancak, R. W. Williams and G. M. Rubin. Computational identification of *Drosophila* microRNA genes Genome Biol Epub 2003 Jun. 30, 2003 R42 4.
No author listed. Whither RNAi? Nat Cell Biol Jun. 2003 489-490 5.
Bartel, B. and D. P. Bartel. MicroRNAs: at the root of plant development? Plant Physiol Jun. 2003 709-717 132.
Dykxhoorn, D. M., C. D. Novina and P. A. Sharp. Killing the messenger: short RNAs that silence gene expression Nat Rev Mol Cell Biol Jun. 2003 457-467 4.
Saunders, L. R. and G. N. Barber. The dsRNA binding protein family: critical roles, diverse cellular functions Faseb J Jun. 2003 961-983 17.
Steinman, L. and S. Zamvil. Transcriptional analysis of targets in multiple sclerosis Nat Rev Immunol Jun. 2003 483-492 3.
Qi, Y. and B. Ding. Inhibition of cell growth and shoot development by a specific nucleotide sequence in a noncoding viroid RNA Plant Cell Jun. 2003 1360-1374 15.
Jackson, A. L., S. R. Bartz, J. Schelter, S. V. Kobayashi, J. Burchard, M. Mao, B. Li, G. Cavet and P. S. Linsley. Expression profiling reveals off-target gene regulation by RNAi Nat Biotechnol Jun. 2003 635-637 21.
Bashirullah, A., A. E. Pasquinelli, A. A. Kiger, N. Perrimon, G. Ruvkun and C. S. Thummel. Coordinate regulation of small temporal RNAs at the onset of *Drosophila* metamorphosis Dev Biol Jul. 1, 2003 1-8 259.
Sempere, L. F., N. S. Sokol, E. B. Dubrovsky, E. M. Berger and V. Ambros. Temporal regulation of microRNA expression in *Drosophila melanogaster* mediated by hormonal signals and broad-Complex gene activity Dev Biol Jul. 1, 2003 9-18 259.

Heetebrij, R. J., E. G. Talman, M. A. V Velzen, R. P. Van Gijlswijk, S. S. Snoeijers, M. Schalk, J. Wiegant, F. V D Rijke, R. M. Kerkhoven, A. K. Raap, H. J. Tanke, J. Reedijk and H. J. Houthoff. Platinum(II)-based coordination compounds as nucleic acid labeling reagents: synthesis, reactivity, and applications in hybridization assays Chembiochem Jul. 7, 2003 573-583 4.
Borodina, T. A., H. Lehrach and A. V. Soldatov. Ligation-based synthesis of oligonucleotides with block structure Anal Biochem Jul. 15, 2003 309-313 318.
Johnson, S. M., S.Y. Lin and F. J. Slack. The time of appearance of the *C. elegans* let-7 microRNA is transcriptionally controlled utilizing a temporal regulatory element in its promoter Dev Biol Jul. 15, 2003 364-379 259.
Carrington, J. C. and V. Ambros. Role of microRNAs in plant and animal development Science Jul. 18, 2003 336-338 301.
Smale, S. T. The establishment and maintenance of lymphocyte identity through gene silencing Nat Immunol Jul. 2003 607-615 4.
Bridge, A. J., S. Pebernard, A. Ducraux, A. L. Nicoulaz and R. Iggo. Induction of an interferon response by RNAi vectors in mammalian cells Nat Genet Jul. 2003 263-264 34.
Seitz, H., N. Youngson, S. P. Lin, S. Dalbert, M. Paulsen, J. P. Bachellerie, A. C. Ferguson-Smith and J. Cavaille. Imprinted microRNA genes transcribed antisense to a reciprocally imprinted retrotransposon-like gene Nat Genet Jul. 2003 261-262 34.
Zeng, Y., R. Yi and B. R. Cullen. MicroRNAs and small interfering RNAs can inhibit mRNA expression by similar mechanisms Proc Natl Acad Sci U S A Aug. 19, 2003 9779-9784 100.
Schramke, V. and R. Allshire. Hairpin RNAs and retrotransposon LTRs effect RNAi and chromatin-based gene silencing Science Aug. 22, 2003 1069-1074 301.
Wiznerowicz, M. and D. Trono. Conditional suppression of cellular genes: lentivirus vector-mediated drug-inducible RNA interference J Virol Aug. 2003 8957-8961 77.
Lau, N. C. and D. P. Bartel. Censors of the genome Sci Am Aug. 2003 34-41 289.
Houbaviy, H. B., M. F. Murray and P. A. Sharp. Embryonic stem cell-specific MicroRNAs Dev Cell Aug. 2003 351-358 5.
Aravin, A. A., M. Lagos-Quintana, A. Yalcin, M. Zavolan, D. Marks, B. Snyder, T. Gaasterland, J. Meyer and T. Tuschl. The small RNA profile during *Drosophila melanogaster* development Dev Cell Aug. 2003 337-350 5.
McManus, M. T. MicroRNAs and cancer Semin Cancer Biol Aug. 2003 253-258 13.
Baner, J., A. Isaksson, E. Waldenstrom, J. Jarvius, U. Landegren and M. Nilsson. Parallel gene analysis with allele-specific padlock probes and tag microarrays Nucleic Acids Res Sep. 1, 2003 e103 31.
Boutla, A., C. Delidakis and M. Tabler. Developmental defects by antisense-mediated inactivation of micro-RNAs 2 and 13 in *Drosophila* and the identification of putative target genes Nucleic Acids Res Sep. 1, 2003 4973-4980 31.
Palatnik, J. F., E. Allen, X. Wu, C. Schommer, R. Schwab, J. C. Carrington and D. Weigel. Control of leaf morphogenesis by microRNAs Nature Sep. 18, 2003 257-263 425.
Klein, R. J. and S. R. Eddy. Rsearch: finding homologs of single structured RNA sequences BMC Bioinformatics Sep. 22, 2003 44 4.
Caudy, A. A., R. F. Ketting, S. M. Hammond, A. M. Denli, A. M. Bathoorn, B. B. Tops, J. M. Silva, M. M. Myers, G. J. Hannon and R. H. Plasterk. A micrococcal nuclease homologue in RNAi effector complexes Nature Sep. 25, 2003 411-414 425.
Lee, Y., C. Ahn, J. Han, H. Choi, J. Kim, J. Yim, J. Lee, P. Provost, O. Radmark, S. Kim and V. N. Kim. The nuclear RNase III Drosha initiates microRNA processing Nature Sep. 25, 2003 415-419 425.
Sledz, C. A., M. Holko, M. J. De Veer, R. H. Silverman and B. R. Williams. Activation of the interferon system by short-interfering RNAs Nat Cell Biol Sep. 2003 834-839 5.
Bergmann, A. and M. E. Lane. HIDden targets of microRNAs for growth control Trends Biochem Sci Sep. 2003 461-463 28.
Khvorova, A., A. Reynolds and S. D. Jayasena. Functional siRNAs and miRNAs exhibit strand bias Cell Oct. 17, 2003 209-216 115.
Schwarz, D. S., G. Hutvagner, T. Du, Z. Xu, N. Aronin and P. D. Zamore. Asymmetry in the assembly of the RNAi enzyme complex Cell Oct. 17, 2003 199-208 115.
Abbott, A. L. Heterochronic genes Curr Biol Oct. 28, 2003 R824-825 13.
Hake, S. MicroRNAs: a role in plant development Curr Biol Oct. 28, 2003 R851-852 13.
Carthew, R. W. Making and breaking with nucleases and small RNAs Nat Struct Biol Oct. 2003 776-777 10.
Krichevsky, A. M., K. S. King, C. P. Donahue, K. Khrapko and K. S. Kosik. A microRNA array reveals extensive regulation of microRNAs during brain development Rna Oct. 2003 1274-1281 9.
Mattick, J. S. Challenging the dogma: the hidden layer of non-protein-coding RNAs in complex organisms Bioessays Oct. 2003 930-939 25.
Nelson, P., M. Kiriakidou, A. Sharma, E. Maniataki and Z. Mourelatos. The microRNA world: small is mighty Trends Biochem Sci Oct. 2003 534-540 28.
Michael, M. Z., O. C. SM, N. G. Van Holst Pellekaan, G. P. Young and R. J. James. Reduced accumulation of specific microRNAs in colorectal neoplasia Mol Cancer Res Oct. 2003 882-891 1.
Allinson, T. M., E. T. Parkin, A. J. Turner and N. M. Hooper. ADAMs family members as amyloid precursor protein alpha-secretases J Neurosci Res Nov. 1, 2003 342-352 74.
Kawasaki, H. and K. Taira. Retraction: Hes1 is a target of microRNA-23 during retinoic-acid-induced neuronal differentiation of NT2 cells Nature Nov. 6, 2003 100 426.
Saxena, S., Z. O. Jonsson and A. Dutta. Small RNAs with imperfect match to endogenous mRNA repress translation. Implications for off-target activity of small inhibitory RNA in mammalian cells J Biol Chem Nov. 7, 2003 44312-44319 278.
Basyuk, E., F. Suavet, A. Doglio, R. Bordonne and E. Bertrand. Human let-7 stem-loop precursors harbor features of RNase III cleavage products Nucleic Acids Res Nov. 15, 2003 6593-6597 31.
Stevenson, M. Dissecting HIV-1 through RNA interference Nat Rev Immunol Nov. 2003 851-858 3.
Wienholds, E., M. J. Koudijs, F. J. Van Eeden, E. Cuppen and R. H. Plasterk. The microRNA-producing enzyme Dicer1 is essential for zebrafish development Nat Genet Nov. 2003 217-218 35.
Gibbs, W. W. The unseen genome: gems among the junk Sci Am Nov. 2003 26-33 289.
Chang, J., P. Provost and J. M. Taylor. Resistance of human hepatitis delta virus RNAs to dicer activity J Virol Nov. 2003 11910-11917 77.
Wang, D., A. Urisman, Y. T. Liu, M. Springer, T. G. Ksiazek, D. D. Erdman, E. R. Mardis, M. Hickenbotham, V. Magrini, J. Eldred, J. P. Latreille, R. K. Wilson, D. Ganem and J. L. Derisi. Viral discovery and sequence recovery using DNA microarrays PLoS Biol Nov. 2003 E2 1.
Aukerman, M. J. and H. Sakai. Regulation of flowering time and floral organ identity by a MicroRNA and its APETALA2-like target genes Plant Cell Nov. 2003 2730-2741 15.
Finnegan, E. J. and M. A. Matzke. The small RNA world J Cell Sci Dec. 1, 2003 4689-4693 116.
Enright, A. J., B. John, U. Gaul, T. Tuschl, C. Sander and D. S. Marks. MicroRNA targets in *Drosophila* Genome Biol Epub 2003 Dec. 12, 2003 R1 5.
Rosok, O. and M. Sioud. Systematic identification of sense-antisense transcripts in mammalian cells Nat Biotechnol Jan. (Epub Dec. 14, 2003) 2004 104-108 22.
Yi, R., Y. Qin, I. G. Macara and B. R. Cullen. Exportin-5 mediates the nuclear export of pre-microRNAs and short hairpin RNAs Genes Dev Dec. 15, 2003 3011-3016 17.
Cao, X., W. Aufsatz, D. Zilberman, M. F. Mette, M. S. Huang, M. Matzke and S. E. Jacobsen. Role of the DRM and CMT3 methyltransferases in RNA-directed DNA methylation Curr Biol Dec. 16, 2003 2212-2217 13.
Ye, K., L. Malinina and D. J. Patel. Recognition of small interfering RNA by a viral suppressor of RNA silencing Nature Dec. 18, 2003 874-878 426.
Johnston, R. J. and O. Hobert. A microRNA controlling left/right neuronal asymmetry in *Caenorhabditis elegans* Nature Dec. 18, 2003 845-849 426.
Xayaphoummine, A., T. Bucher, F. Thalmann and H. Isambert. Prediction and statistics of pseudoknots in RNA structures using exactly clustered stochastic simulations Proc Natl Acad Sci U S A Dec. 23, 2003 15310-15315 100.

Lewis, B. P., I. H. Shih, M. W. Jones-Rhoades, D. P. Bartel and C. B. Burge. Prediction of mammalian microRNA targets Cell Dec. 26, 2003 787-798 115.

Robinson, W. H., P. J. Utz and L. Steinman. Genomic and proteomic analysis of multiple sclerosis. Opinion Curr Opin Immunol Dec. 2003 660-667 15.

Gibbs, W. W. The unseen genome: beyond DNA Sci Am Dec. 2003 106-113 289.

Stark, A., J. Brennecke, R. B. Russell and S. M. Cohen. Identification of *Drosophila* MicroRNA targets PLoS Biol Dec. 2003 E60 1.

Stein, T. D. and J. A. Johnson. Genetic programming by the proteolytic fragments of the amyloid precursor protein: somewhere between confusion and clarity Rev Neurosci *no date in pubmed* 2003 317-341 14.

Szymanski, M., M. Z. Barciszewska, M. Zywicki and J. Barciszewski. Noncoding RNA transcripts J Appl Genet *No Datein Pubmed* 2003 1-19 44.

Griffiths-Jones, S. The microRNA Registry Nucleic Acids Res Jan. 1, 2004 D109-111 32.

Chen, C. Z., L. Li, H. F. Lodish and D. P. Bartel. MicroRNAs modulate hematopoietic lineage differentiation Science Jan. 2, 2004 83-86 303.

Kim, J., A. Krichevsky, Y. Grad, G. D. Hayes, K. S. Kosik, G. M. Church and G. Ruvkun. Identification of many microRNAs that copurify with polyribosomes in mammalian neurons Proc Natl Acad Sci U S A Jan. 6, 2004 360-365 101.

Ohno, M., E. A. Sametsky, L. H. Younkin, H. Oakley, S. G. Younkin, M. Citron, R. Vassar and J. F. Disterhoft. BACE1 deficiency rescues memory deficits and cholinergic dysfunction in a mouse model of Alzheimer's disease Neuron Jan. 8, 2004 27-33 41.

Vella, M. C., E. Y. Choi, S. Y. Lin, K. Reinert and F. J. Slack. The *C. elegans* microRNA let-7 binds to imperfect let-7 complementary sites from the lin-41 3'UTR Genes Dev Jan. 15, 2004 132-137 18.

Kao, S. C., A. M. Krichevsky, K. S. Kosik and L. H. Tsai. BACE1 suppression by RNA interference in primary cortical neurons J Biol Chem Jan. 16, 2004 1942-1949 279.

Hofacker, I. L., B. Priwitzer and P. F. Stadler. Prediction of locally stable RNA secondary structures for genome-wide surveys Bioinformatics Jan. 22, 2004 186-190 20.

Ruvkun, G., B. Wightman and I. Ha. The 20 years it took to recognize the importance of tiny RNAs Cell Jan. 23, 2004 S93-96, 92 p following S96 116.

Bartel, D. P. MicroRNAs: genomics, biogenesis, mechanism, and function Cell Jan. 23, 2004 281-297 116.

Han, M. H., S. Goud, L. Song and N. Fedoroff. The *Arabidopsis* double-stranded RNA-binding protein HYL1 plays a role in microRNA-mediated gene regulation Proc Natl Acad Sci U S A Jan. 27, 2004 1093-1098 101.

Hartig, J. S., I. Grune, S. H. Najafi-Shoushtari and M. Famulok. Sequence-specific detection of MicroRNAs by signal-amplifying ribozymes J Am Chem Soc Jan. 28, 2004 722-723 126.

Nishitsuji, H., T. Ikeda, H. Miyoshi, T. Ohashi, M. Kannagi and T. Masuda. Expression of small hairpin RNA by lentivirus-based vector confers efficient and stable gene-suppression of HIV-1 on human cells including primary non-dividing cells Microbes Infect Jan. 2004 76-85 6.

Ota, T., Y. Suzuki, T. Nishikawa, T. Otsuki, T. Sugiyama, R. Irie, A., et al. Complete sequencing and characterization of 21,243 full-length human cDNAs Nat Genet Jan. 2004 40-45 36.

Colciaghi, F., E. Marcello, B. Borroni, M. Zimmermann, C. Caltagirone, F. Cattabeni, A. Padovani and M. Di Luca. Platelet App, ADAM 10 and BACE alterations in the early stages of Alzheimer disease Neurology Feb. 10, 2004 498-501 62.

Boden, D., O. Pusch, R. Silbermann, F. Lee, L. Tucker and B. Ramratnam. Enhanced gene silencing of HIV-1 specific siRNA using microRNA designed hairpins Nucleic Acids Res Feb. 13, 2004 1154-1158 32.

Sempere, L. F., S. Freemantle, I. Pitha-Rowe, E. Moss, E. Dmitrovsky and V. Ambros. Expression profiling of mammalian microRNAs uncovers a subset of brain-expressed microRNAs with possible roles in murine and human neuronal differentiation Genome Biol Epub 2004 Feb. 16, 2004 R13 5.

Scacheri, P. C., O. Rozenblatt-Rosen, N. J. Caplen, T. G. Wolfsberg, L. Umayam, J. C. Lee, C. M. Hughes, K. S. Shanmugam, A. Bhattacharjee, M. Meyerson and F. S. Collins. Short interfering RNAs can induce unexpected and divergent changes in the levels of untargeted proteins in mammalian cells Proc Natl Acad Sci U S A Feb. 17, 2004 1892-1897 101.

Xie, Z., L. K. Johansen, A. M. Gustafson, K. D. Kasschau, A. D. Lellis, D. Zilberman, S. E. Jacobsen and J. C. Carrington. Genetic and functional diversification of small RNA pathways in plants PLoS Biol May (Epub Feb. 18, 2004) 2004 E104 2.

Cawley, S., S. Bekiranov, H. H. Ng, P. Kapranov, E. A. Sekinger, D. Kampa, A. Piccolboni, V. Sementchenko, J. Cheng, A. J. Williams, R. Wheeler, B. Wong, J. Drenkow, M. Yamanaka, S. Patel, S. Brubaker, H. Tammana, G. Helt, K. Struhl and T. R. Gingeras. Unbiased mapping of transcription factor binding sites along human chromosomes 21 and 22 points to widespread regulation of noncoding RNAs Cell Feb. 20, 2004 499-509 116.

Dandekar, D. H., K. N. Ganesh and D. Mitra. HIV-1 Tat directly binds to NFkappaB enhancer sequence: role in viral and cellular gene expression Nucleic Acids Res Feb. 23, 2004 1270-1278 32.

Hutvagner, G., M. J. Simard, C. C. Mello and P. D. Zamore. Sequence-specific inhibition of small RNA function PLoS Biol Apr. (Epub Feb. 24, 2004) 2004 E98 2.

Schmittgen, T. D., J. Jiang, Q. Liu and L. Yang. A high-throughput method to monitor the expression of microRNA precursors Nucleic Acids Res Feb. 25, 2004 e43 32.

Stremlau, M., C. M. Owens, M. J. Perron, M. Kiessling, P. Autissier and J. Sodroski. The cytoplasmic body component TRIM5alpha restricts HIV-1 infection in Old World monkeys Nature Feb. 26, 2004 848-853 427.

Bohnsack, M. T., K. Czaplinski and D. Gorlich. Exportin 5 is a RanGTP-dependent dsRNA-binding protein that mediates nuclear export of pre-miRNAs Rna Feb. 2004 185-191 10.

Demidov, V. V. and M. D. Frank-Kamenetskii. Two sides of the coin: affinity and specificity of nucleic acid interactions Trends Biochem Sci Feb. 2004 62-71 29.

Maquat, L. E. Nonsense-mediated mRNA decay: splicing, translation and mRNP dynamics Nat Rev Mol Cell Biol Feb. 2004 89-99 5.

Nijholt, I., N. Farchi, M. Kye, E. H. Sklan, S. Shoham, B. Verbeure, D. Owen, B. Hochner, J. Spiess, H. Soreq and T. Blank. Stress-induced alternative splicing of acetylcholinesterase results in enhanced fear memory and long-term potentiation Mol Psychiatry Feb. 2004 174-183 9.

Sengupta, P. Taking sides in the nervous system with miRNA Nat Neurosci Feb. 2004 100-102 7.

Zerhouni, B., J. A. Nelson and K. Saha. Isolation of CD4-independent primary human immunodeficiency virus type 1 isolates that are syncytium inducing and acutely cytopathic for CD8+ lymphocytes J Virol Feb. 2004 1243-1255 78.

Jin, P., D. C. Zarnescu, S. Ceman, M. Nakamoto, J. Mowrey, T. A. Jongens, D. L. Nelson, K. Moses and S. T. Warren. Biochemical and genetic interaction between the fragile X mental retardation protein and the microRNA pathway Nat Neurosci Feb. 2004 113-117 7.

Lai, E. C., C. Wiel and G. M. Rubin. Complementary miRNA pairs suggest a regulatory role for miRNA:miRNA duplexes Rna Feb. 2004 171-175 10.

Metzler, M., M. Wilda, K. Busch, S. Viehmann and A. Borkhardt. High expression of precursor microRNA-155/BIC RNA in children with Burkitt lymphoma Genes Chromosomes Cancer Feb. 2004 167-169 39.

Doench, J. G. and P. A. Sharp. Specificity of microRNA target selection in translational repression Genes Dev Mar. 1, 2004 504-511 18.

Liang, X. S., J. Q. Lian, Y. X. Zhou and M. B. Wan. Inhibitor RNA blocks the protein translation mediated by hepatitis C virus internal ribosome entry site in vivo World J Gastroenterol Mar. 1, 2004 664-667 10.

Calin, G. A., C. Sevignani, C. D. Dumitru, T. Hyslop, E. Noch, S. Yendamuri, M. Shimizu, S. Rattan, F. Bullrich, M. Negrini and C. M. Croce. Human microRNA genes are frequently located at fragile sites and genomic regions involved in cancers Proc Natl Acad Sci U S A Mar. 2, 2004 2999-3004 101.

Juarez, M. T., J. S. Kui, J. Thomas, B. A. Heller and M. C. Timmermans. microRNA-mediated repression of rolled leaf1 specifies maize leaf polarity Nature Mar. 4, 2004 84-88 428.
Kidner, C. A. and R. A. Martienssen. Spatially restricted microRNA directs leaf polarity through ARGONAUTE1 Mature Mar. 4, 2004 81-84 428.
Zamore, P. D. Plant RNAi: How a viral silencing suppressor inactivates siRNA Curr Biol Mar. 9, 2004 R198-200 14.
Wang, J. F., H. Zhou, Y. Q. Chen, Q. J. Luo and L. H. Qu. Identification of 20 microRNAs from *Oryza sativa* Nucleic Acids Res Mar. 12, 2004 1688-1695 32.
Jack, T. Molecular and genetic mechanisms of floral control Plant Cell Epub 2004 Mar. 12, 2004 S1-17 16 Suppl.
Roth, M. E., L. Feng, K. J. McConnell, P. J. Schaffer, C. E. Guerra, J. P. Affourtit, K. R. Piper, L. Guccione, J. Hariharan, M. J. Ford, S. W. Powell, H. Krishnaswamy, J. Lane, L. Guccione, G. Intrieri, J. S. Merkel, C. Perbost, A. Valerio, B. Zolla, C. D. Graham, J. Hnath, C. Michaelson, R. Wang, B. Ying, C. Halling, C. E. Parman, D. Raha, B. Orr, B. Jedrzkiewicz, J. Liao, A. Tevelev, M. J. Mattessich, D. M. Kranz, M. Lacey, J. C. Kaufman, J. Kim, D. R. Latimer and P. M. Lizardi. Expression profiling using a hexamer-based universal microarray Nat Biotechnol Apr. (Epub Mar. 14, 2004) 2004 418-426 22.
Rajewsky, N. and N. D. Socci. Computational identification of microRNA targets Dev Biol Mar. 15, 2004 529-535 267.
Winkler, W. C., A. Nahvi, A. Roth, J. A. Collins and R. R. Breaker. Control of gene expression by a natural metabolite-responsive ribozyme Nature Mar. 18, 2004 281-286 428.
Kuwabara, T., J. Hsieh, K. Nakashima, K. Taira and F. H. Gage. A small modulatory dsRNA specifies the fate of adult neural stem cells Cell Mar. 19, 2004 779-793 116.
Chen, X. A microRNA as a translational repressor of APETALA2 in *Arabidopsis* flower development Science Mar. 26, 2004 2022-2025 303.
Carmell, M. A. and G. J. Hannon. RNase III enzymes and the initiation of gene silencing Nat Struct Mol Biol Mar. 2004 214-218 11.
Davidson, B. L. and H. L. Paulson. Molecular medicine for the brain: silencing of disease genes with RNA interference Lancet Neurol Mar. 2004 145-149 3.
Kawasaki, H., R. Wadhwa and K. Taira. World of small RNAs: from ribozymes to siRNA and miRNA Differentiation Mar. 2004 58-64 72.
Meister, G., M. Landthaler, Y. Dorsett and T. Tuschl. Sequence-specific inhibition of microRNA- and siRNA-induced RNA silencing Rna Mar. 2004 544-550 10.
Nelson, P. T., A. G. Hatzigeorgiou and Z. Mourelatos. miRNP:mRNA association in polyribosomes in a human neuronal cell line Rna Mar. 2004 387-394 10.
Floyd, S. K. and J. L. Bowman. Gene regulation: ancient microRNA target sequences in plants Nature Apr. 1, 2004 485-486 428.
Lee, Y. S., K. Nakahara, J. W. Pham, K. Kim, Z. He, E. J. Sontheimer and R. W. Carthew. Distinct roles for *Drosophila* Dicer-1 and Dicer-2 in the siRNA/miRNA silencing pathways Cell Apr. 2, 2004 69-81 117.
Tijsterman, M. and R. H. Plasterk. Dicers at RISC; the mechanism of RNAi Cell Apr. 2, 2004 1-3 117.
MacDiarmid, R. RNA Silencing in Productive Virus Infections Annu Rev Phytopathol Apr. 12, 2004.
Chen, J., W. X. Li, D. Xie, J. R. Peng and S. W. Ding. Viral virulence protein suppresses RNA silencing-mediated defense but upregulates the role of microrna in host gene expression Plant Cell May (Epub Apr. 20, 2004) 2004 1302-1313 16.
Yekta, S., I. H. Shih and D. P. Bartel. MicroRNA-directed cleavage of HOXB8 mRNA Science Apr. 23, 2004 594-596 304.
Lamontagne, B., R. N. Hannoush, M. J. Damha and S. Abou Elela. Molecular requirements for duplex recognition and cleavage by eukaryotic RNase III: discovery of an RNA-dependent DNA cleavage activity of yeast Rnt1p J Mol Biol Apr. 23, 2004 401-418 338.
Barrick, J. E., K. A. Corbino, W. C. Winkler, A. Nahvi, M. Mandal, J. Collins, M. Lee, A. Roth, N. Sudarsan, I. Jona, J. K. Wickiser and R. R. Breaker. New RNA motifs suggest an expanded scope for riboswitches in bacterial genetic control Proc Natl Acad Sci U S A Apr. 27, 2004 6421-6426 101.
Pfeffer, S., M. Zavolan, F. A. Grasser, M. Chien, J. J. Russo, J. Ju, B. John, A. J. Enright, D. Marks, C. Sander and T. Tuschl. Identification of virus-encoded microRNAs Science Apr. 30, 2004 734-736 304.
Dorsett, Y. and T. Tuschl. siRNAs: applications in functional genomics and potential as therapeutics Nat Rev Drug Discov Apr. 2004 318-329 3.
Mallory, A. C. and H. Vaucheret. MicroRNAs: something important between the genes Curr Opin Plant Biol Apr. 2004 120-125 7.
Ogita, S., H. Uefuji, M. Morimoto and H. Sano. Application of RNAi to confirm theobromine as the major intermediate for caffeine biosynthesis in coffee plants with potential for construction of decaffeinated varieties Plant Mol Biol Apr. 2004 931-941 54.
Storz, G., J. A. Opdyke and A. Zhang. Controlling mRNA stability and translation with small, noncoding RNAs Curr Opin Microbiol Apr. 2004 140-144 7.
Kim, V. N. MicroRNA precursors in motion: exportin-5 mediates their nuclear export Trends Cell Biol Apr. 2004 156-159 14.
Jabri, E. RISCy business Nat Struct Mol Biol Apr. 2004 300 11.
Nakahara, K. and R. W. Carthew. Expanding roles for miRNAs and siRNAs in cell regulation Curr Opin Cell Biol Apr. 2004 127-133 16.
Ota, A., H. Tagawa, S. Karnan, S. Tsuzuki, A. Karpas, S. Kira, Y. Yoshida and M. Seto. Identification and characterization of a novel gene, C13orf25, as a target for 13q31-q32 amplification in malignant lymphoma Cancer Res May 1, 2004 3087-3095 64.
Marillonnet, S., A. Giritch, M. Gils, R. Kandzia, V. Klimyuk and Y. Gleba. In planta engineering of viral RNA replicons: efficient assembly by recombination of DNA modules delivered by Agrobacterium Proc Natl Acad Sci U S A May 4, 2004 6852-6857 101.
Kiriakidou, M., P. T. Nelson, A. Kouranov, P. Fitziev, C. Bouyioukos, Z. Mourelatos and A. Hatzigeorgiou. A combined computational-experimental approach predicts human microRNA targets Genes Dev May 15, 2004 1165-1178 18.
Vaucheret, H., F. Vazquez, P. Crete and D. P. Bartel. The action of ARGONAUTE1 in the miRNA pathway and its regulation by the miRNA pathway are crucial for plant development Genes Dev May 15, 2004 1187-1197 18.
Bejerano, G., M. Pheasant, I. Makunin, S. Stephen, W. J. Kent, J. S. Mattick and D. Haussler. Ultraconserved elements in the human genome Science May 28, 2004 1321-1325 304.
Tanzer, A. and P. F. Stadler. Molecular evolution of a microRNA cluster J Mol Biol May 28, 2004 327-335 339.
Pooggin, M. and T. Hohn. Fighting geminiviruses by RNAi and vice versa Plant Mol Biol May 2004 149-152 55.
Bartel, D. P. and C. Z. Chen. Micromanagers of gene expression: the potentially widespread influence of metazoan microRNAs Nat Rev Genet May 2004 396-400 5.
Dunoyer, P., C. H. Lecellier, E. A. Parizotto, C. Himber and O. Voinnet. Probing the microRNA and small interfering RNA pathways with virus-encoded suppressors of RNA silencing Plant Cell May (Epub 2004 Apr. 14,(2004 1235-1250 16.
Arias, C. F., M. A. Dector, L. Segovia, T. Lopez, M. Camacho, P. Isa, R. Espinosa and S. Lopez. RNA silencing of rotavirus gene expression Virus Res Jun. 1, 2004 43-51 102.
Takamizawa, J., H. Konishi, K. Yanagisawa, S. Tomida, H. Osada, H. Endoh, T. Harano, Y. Yatabe, M. Nagino, Y. Nimura, T. Mitsudomi and T. Takahashi. Reduced expression of the let-7 microRNAs in human lung cancers in association with shortened postoperative survival Cancer Res Jun. 1, 2004 3753-3756 64.
Ge, Q., L. Filip, A. Bai, T. Nguyen, H. N. Eisen and J. Chen. Inhibition of influenza virus production in virus-infected mice by RNA interference Proc Natl Acad Sci U S A Jun. 8, 2004 8676-8681 101.
Suh, M. R., Y. Lee, J. Y. Kim, S. K. Kim, S. H. Moon, J. Y. Lee, K. Y. Cha, H. M. Chung, H. S. Yoon, S. Y. Moon, V. N. Kim and K. S. Kim. Human embryonic stem cells express a unique set of microRNAs Dev Biol Jun. 15, 2004 488-498 270.
Cole, K., V. Truong, D. Barone and G. McGall. Direct labeling of RNA with multiple biotins allows sensitive expression profiling of acute leukemia class predictor genes Nucleic Acids Res Jun. 17, 2004 e86 32.
Jones-Rhoades, M. W. and D. P. Bartel. Computational identification of plant microRNAs and their targets, including a stress-induced miRNA Mol Cell Jun. 18, 2004 787-799 14.

Mallory, A. C., D. V. Dugas, D. P. Bartel and B. Bartel. MicroRNA regulation of NAC-domain targets is required for proper formation and separation of adjacent embryonic, vegetative, and floral organs Curr Biol Jun. 22, 2004 1035-1046 14.

Liu, C. G., G. A. Calin, B. Meloon, N. Gamliel, C. Sevignani, M. Ferracin, C. D. Dumitru, M. Shimizu, S. Zupo, M. Dono, H. Alder, F. Bullrich, M. Negrini and C. M. Croce. An oligonucleotide microchip for genome-wide microRNA profiling in human and mouse tissues Proc Natl Acad Sci U S A Jun. 29. 2004 9740-9744 101.

Brandenberger, R., H. Wei, S. Zhang, S. Lei, J. Murage, G. J. Fisk, Y. Li, C. Xu, R. Fang, K. Guegler, M. S. Rao, R. Mandalam, J. Lebkowski and L. W. Stanton. Transcriptome characterization elucidates signaling networks that control human ES cell growth and differentiation Nat Biotechnol Jun. 2004 707-716 22.

Engstrom, E. M., A. Izhaki and J. L. Bowman. Promoter bashing, microRNAs, and Knox genes. New insights, regulators, and targets-of-regulation in the establishment of lateral organ polarity in Arabidopsis Plant Physiol Jun. 2004 685-694 135.

Murchison, E. P. and G. J. Hannon. miRNAs on the move: miRNA biogenesis and the RNAi machinery Curr Opin Cell Biol Jun. 2004 223-229 16.

Novina, C. D. and P. A. Sharp. The RNAi revolution Nature Jul. 8, 2004 161-164 430.

Ji, Y., X. Xu and G. D. Stormo. A graph theoretical approach for predicting common RNA secondary structure motifs including pseudoknots in unaligned sequences Bioinformatics Jul. 10, 2004 1591-1602 20.

Okamura, K., A. Ishizuka, H. Siomi and M. C. Siomi. Distinct roles for Argonaute proteins in small RNA-directed RNA cleavage pathways Genes Dev Jul. 15, 2004 1655-1666 18.

Karlas, A., R. Kurth and J. Denner. Inhibition of porcine endogenous retroviruses by RNA interference: increasing the safety of xenotransplantation Virology Jul. 20, 2004 18-23 325.

Kent, O. A. and A. M. MacMillan. RNAi: running interference for the cell Org Biomol Chem Jul. 21, 2004 1957-1961 2.

Souret, F. F., J. P. Kastenmayer and P. J. Green. AtXRN4 degrades mRNA in Arabidopsis and its substrates include selected miRNA targets Mol Cell Jul. 23, 2004 173-183 15.

Meister, G., M. Landthaler, A. Patkaniowska, Y. Dorsett, G. Teng and T. Tuschl. Human Argonaute2 mediates RNA cleavage targeted by miRNAs and siRNAs Mol Cell Jul. 23, 2004 185-197 15.

Allawi, H. T., J. E. Dahlberg, S. Olson, E. Lund, M. Olson, W. P. Ma, T. Takova, B. P. Neri and V. I. Lyamichev. Quantitation of microRNAs using a modified Invader assay Rna Jul. 2004 1153-1161 10.

Hall, J. Opinion: Unravelling the general properties of siRNAs: strength in numbers and lessons from the past Nat Rev Genet Jul. 2004 552-557 5.

Silvestri, L. S., Z. F. Taraporewala and J. T. Patton. Rotavirus replication: plus-sense templates for double-stranded RNA synthesis are made in viroplasms J Virol Jul. 2004 7763-7774 78.

He, L. and G. J. Hannon. MicroRNAs: small RNAs with a big role in gene regulation Nat Rev Genet Jul. 2004 522-531 5.

Achard, P., A. Herr, D. C. Baulcombe and N. P. Harberd. Modulation of floral development by a gibberellin-regulated microRNA Development Jul. 2004 3357-3365 131.

McHale, N. A. and R. E. Koning. MicroRNA-directed cleavage of Nicotiana sylvestris Phavoluta mRNA regulates the vascular cambium and structure of apical meristems Plant Cell Jul. (Epub Jun. 11, 2004) 2004 1730-1740 16.

Bonnet, E., J. Wuyts, P. Rouze and Y. Van De Peer. Detection of 91 potential conserved plant microRNAs in *Arabidopsis thaliana* and *Oryza sativa* identifies important target genes Proc Natl Acad Sci U S A Aug. 3, 2004 11511-11516 101.

Calin, G. A., C. G. Liu, C. Sevignani, M. Ferracin, N. Felli, C. D. Dumitru, M. Shimizu, A. Cimmino, S. Zupo, M. Dono, M. L. Dell'Aquila, H. Alder, L. Rassenti, T. J. Kipps, F. Bullrich, M. Negrini and C. M. Croce. MicroRNA profiling reveals distinct signatures in B cell chronic lymphocytic leukemias Proc Natl Acad Sci U S A Aug. 10, 2004 11755-11760 101.

Chang, S., R. J. Johnston, Jr., C. Frokjaer-Jensen, S. Lockery and O. Hobert. MicroRNAs act sequentially and asymmetrically to control chemosensory laterality in the nematode Nature Aug. 12, 2004 785-789 430.

Mallory, A. C., B. J. Reinhart, M. W. Jones-Rhoades, G. Tang, P. D. Zamore, M. K. Barton and D. P. Bartel. MicroRNA control of PHABULOSA in leaf development: importance of pairing to the microRNA 5' region Embo J Aug. 18, 2004 3356-3364 23.

Kurihara, Y. and Y. Watanabe. *Arabidopsis* micro-RNA biogenesis through Dicer-like 1 protein functions Proc Natl Acad Sci U S A Aug. 24, 2004 12753-12758 101.

Famulok, M. Chemical biology: green fluorescent RNA Nature Aug. 26, 2004 976-977 430.

Morris, K. V., S. W. Chan, S. E. Jacobsen and D. J. Looney. Small interfering RNA-induced transcriptional gene silencing in human cells Science Aug. 27, 2004 1289-1292 305.

Miska, E. A., E. Alvarez-Saavedra, M. Townsend, A. Yoshii, N. Sestan, P. Rakic, M. Constantine-Paton and H. R. Horvitz. Microarray analysis of microRNA expression in the developing mammalian brain Genome Biol Epub 2004 Aug. 31, 2004 R68 5.

Wang, X. J., J. L. Reyes, N. H. Chua and T. Gaasterland. Prediction and identification of *Arabidopsis thaliana* microRNAs and their mRNA targets Genome Biol Epub 2004 Aug. 31, 2004 R65 5.

Bagasra, O. and K. R. Prilliman. RNA interference: the molecular immune system J Mol Histol Aug. 2004 545-553 35.

He, Z. and E. J. Sontheimer. "siRNAs and miRNAs": a meeting report on RNA silencing Rna Aug. 2004 1165-1173 10.

Luciano, D. J., H. Mirsky, N. J. Vendetti and S. Maas. RNA editing of a miRNA precursor Rna Aug. 2004 1174-1177 10.

Levanon, E. Y., E. Eisenberg, R. Yelin, S. Nemzer, M. Hallegger, R. Shemesh, Z. Y. Fligelman, A. Shoshan, S. R. Pollock, D. Sztybel, M. Olshansky, G. Rechavi and M. F. Jantsch. Systematic identification of abundant A-to-I editing sites in the human transcriptome Nat Biotechnol Aug. 2004 1001-1005 22.

Friedrich, I., A. Shir, S. Klein and A. Levitzki. RNA molecules as anti-cancer agents Semin Cancer Biol Aug. 2004 223-230 14.

Mathews, D. H. Using an RNA secondary structure partition function to determine confidence in base pairs predicted by free energy minimization Rna Aug. 2004 1178-1190 10.

Aravin, A. A., M. S. Klenov, V. V. Vagin, F. Bantignies, G. Cavalli and V. A. Gvozdev. Dissection of a natural RNA silencing process in the *Drosophila melanogaster* germ line Mol Cell Biol Aug. 2004 6742-6750 24.

Sunkar, R. and J. K. Zhu. Novel and stress-regulated microRNAs and other small RNAs from *Arabidopsis* Plant Cell Aug. (Epub Jul. 16, 2004) 2004 2001-2019 16.

Yoo, B. C., F. Kragler, E. Varkonyi-Gasic, V. Haywood, S. Archer-Evans, Y. M. Lee, T. J. Lough and W. J. Lucas. A systemic small RNA signaling system in plants Plant Cell Aug. (Epub Jul. 16, 2004) 2004 1979-2000 16.

Gooch, B. D. and P. A. Beal. Recognition of duplex RNA by helix-threading peptides J Am Chem Soc Sep. 1, 2004 10603-10610 126.

Liu, J., M. A. Carmell, F. V. Rivas, C. G. Marsden, J. M. Thomson, J. J. Song, S. M. Hammond, L. Joshua-Tor and G. J. Hannon. Argonaute2 is the catalytic engine of mammalian RNAi Science Sep. 3, 2004 1437-1441 305.

Sontheimer, E. J. and R. W. Carthew. Molecular biology. Argonaute journeys into the heart of RISC Science Sep. 3, 2004 1409-1410 305.

Song, J. J., S. K. Smith, G. J. Hannon and L. Joshua-Tor. Crystal structure of Argonaute and its implications for RISC slicer activity Science Sep. 3, 2004 1434-1437 305.

Zeng, Y. and B. R. Cullen. Structural requirements for pre-microRNA binding and nuclear export by Exportin 5 Nucleic Acids Res Sep. 8, 2004 4776-4785 32.

Parizotto, E. A., P. Dunoyer, N. Rahm, C. Himber and O. Voinnet. In vivo investigation of the transcription, processing, endonucleolytic activity, and functional relevance of the spatial distribution of a plant miRNA Genes Dev Sep. 15, 2004 2237-2242 18.

Ambros, V. The functions of animal microRNAs Nature Sep. 16, 2004 350-355 431.

Baulcombe, D. RNA silencing in plants Nature Sep. 16, 2004 356-363 431.

Meister, G. and T. Tuschl. Mechanisms of gene silencing by double-stranded RNA Nature Sep. 16, 2004 343-349 431.

Kasashima, K., Y. Nakamura and T. Kozu. Altered expression profiles of microRNAs during TPA-induced differentiation of HL-60 cells Biochem Biophys Res Commun Sep. 17, 2004 403-410 322.

Smalheiser, N. R. and V. I. Torvik. A population-based statistical approach identifies parameters characteristic of human microRNA-mRNA interactions BMC Bioinformatics Sep. 28, 2004 139 5.
Baba, S., M. Kajikawa, N. Okada and G. Kawai. Solution structure of an RNA stem-loop derived from the 3' conserved region of eel Line UnaL2 Rna Sep. 2004 1380-1387 10.
Bowman, J. L. Class III HD-Zip gene regulation, the golden fleece of ARGONAUTE activity? Bioessays Sep. 2004 938-942 26.
Ohler, U., S. Yekta, L. P. Lim, D. P. Bartel and C. B. Burge. Patterns of flanking sequence conservation and a characteristic upstream motif for microRNA gene identification Rna Sep. 2004 1309-1322 10.
Simmonds, P., A. Tuplin and D. J. Evans. Detection of genome-scale ordered RNA structure (GORS) in genomes of positive-stranded RNA viruses: Implications for virus evolution and host persistence Rna Sep. 2004 1337-1351 10.
Seitz, H., H. Royo, M. L. Bortolin, S. P. Lin, A. C. Ferguson-Smith and J. Cavaille. A large imprinted microRNA gene cluster at the mouse Dlk1-Gtl2 domain Genome Res Sep. 2004 1741-1748 14.
Hobert, O. Common logic of transcription factor and microRNA action Trends Biochem Sci. Sep. 2004 462-468 29.
Laufs, P., A. Peaucelle, H. Morin and J. Traas. MicroRNA regulation of the CUC genes is required for boundary size control in *Arabidopsis* meristems Development Sep. 2004 4311-4322 131.
Rye, P. D. and T. Stigbrand. Interfering with cancer: a brief outline of advances in RNA interference in oncology Tumour Biol Sep.-Dec. 2004 329-336 25.
Sigova, A., N. Rhind and P. D. Zamore. A single Argonaute protein mediates both transcriptional and posttranscriptional silencing in *Schizosaccharomyces pombe* Genes Dev Oct. 1, 2004 2359-2367 18.
Lee, Y., M. Kim, J. Han, K. H. Yeom, S. Lee, S. H. Baek and V. N. Kim. MicroRNA genes are transcribed by RNA polymerase II Embo J Oct. 13, 2004 4051-4060 23.
Nelson, P. T., D. A. Baldwin, L. M. Scearce, J. C. Oberholtzer, J. W. Tobias and Z. Mourelatos. Microarray-based, high-throughput gene expression profiling of microRNAs Nat Methods Oct. 21, 2004 155-161 1.
Kadotani, N., H. Nakayashiki, Y. Tosa and S. Mayama. One of the two Dicer-like proteins in the filamentous fungi *Magnaporthe oryzae* genome is responsible for hairpin RNA-triggered RNA silencing and related small interfering RNA accumulation J Biol Chem Oct. 22, 2004 44467-44474 279.
Duensing, S., A. Duensing, D. C. Lee, K. M. Edwards, S. O. Piboonniyom, E. Manuel, L. Skaltsounis, L. Meijer and K. Munger. Cyclin-dependent kinase inhibitor indirubin-3'-oxime selectively inhibits human papillomavirus type 16 E7-induced numerical centrosome anomalies Oncogene Oct. 28, 2004 8206-8215 23.
Antonarakis, S. E., R. Lyle, E. T. Dermitzakis, A. Reymond and S. Deutsch. Chromosome 21 and down syndrome: from genomics to pathophysiology Nat Rev Genet Oct. 2004 725-738 5.
Altuvia, S. Regulatory small RNAs: the key to coordinating global regulatory circuits J Bacteriol Oct. 2004 6679-6680 186.
Bracht, J., S. Hunter, R. Eachus, P. Weeks and A. E. Pasquinelli. Trans-splicing and polyadenylation of let-7 microRNA primary transcripts Rna Oct. 2004 1586-1594 10.
Cobb, J. and D. Duboule. Tracing microRNA patterns in mice Nat Genet Oct. 2004 1033-1034 36.
Duxbury, M. S., E. Matros, H. Ito, M. J. Zinner, S. W. Ashley and E. E. Whang. Systemic siRNA-mediated gene silencing: a new approach to targeted therapy of cancer Ann Surg Oct. 2004 667-674; discussion 675-666 240.
Dugas, D. V. and B. Bartel. MicroRNA regulation of gene expression in plants Curr Opin Plant Biol Oct. 2004 512-520 7.
Howard, M. T., R. F. Gesteland and J. F. Atkins. Efficient stimulation of site-specific ribosome frameshifting by antisense oligonucleotides Rna Oct. 2004 1653-1661 10.
Isken, O., C. W. Grassmann, H. Yu and S. E. Behrens. Complex signals in the genomic 3' nontranslated region of bovine viral diarrhea virus coordinate translation and replication of the viral RNA Rna Oct. 2004 1637-1652 10.
Mansfield, J. H., B. D. Harfe, R. Nissen, J. Obenauer, J. Srineel, A. Chaudhuri, R. Farzan-Kashani, M. Zuker, A. E. Pasquinelli, G. Ruvkun, P. A. Sharp, C. J. Tabin and M. T. McManus. MicroRNA-responsive 'sensor' transgenes uncover Hox-like and other developmentally regulated patterns of vertebrate microRNA expression Nat Genet Oct. 2004 1079-1083 36.
Opdyke, J. A., J. G. Kang and G. Storz. GadY, a small-RNA regulator of acid response genes in *Escherichia coli* J Bacteriol Oct. 2004 6698-6705 186.
Rehmsmeier, M., P. Steffen, M. Hochsmann and R. Giegerich. Fast and effective prediction of microRNA/target duplexes Rna Oct. 2004 1507-1517 10.
Rodriguez, A., S. Griffiths-Jones, J. L. Ashurst and A. Bradley. Identification of mammalian microRNA host genes and transcription units Genome Res Oct. 2004 1902-1910 14.
Pillai, R. S., C. G. Artus and W. Filipowicz. Tethering of human Ago proteins to mRNA mimics the miRNA-mediated repression of protein synthesis Rna Oct. 2004 1518-1525 10.
Stix, G. Hitting the genetic off switch Sci Am Oct. 2004 98-101 291.
Chen, S., A. Zhang, L. B. Blyn and G. Storz. MicC, a second small-RNA regulator of Omp protein expression in *Escherichia coli* J Bacteriol Oct. 2004 6689-6697 186.
Gebauer, F. and M. W. Hentze. Molecular mechanisms of translational control Nat Rev Mol Cell Biol Oct. 2004 827-835 5.
Jones, S. W., P. M. Souza and M. A. Lindsay. siRNA for gene silencing: a route to drug target discovery Curr Opin Pharmacol Oct. 2004 522-527 4.
Mattick, J. S. The hidden genetic program of complex organisms Sci Am Oct. 2004 60-67 291.
Trainor, P. A. Developmental biology is "Cruzing" Dev Cell Oct. 2004 481-486 7.
Arai, R., K. Ito, M. Wakiyama, E. Matsumoto, A. Sakamoto, Y. Etou, M. Otsuki, M. Inoue, Y. Hayashizaki, M. Miyagishi, K. Taira, M. Shirouzu and S. Yokoyama. Establishment of stable hFis1 knock-down cells with an siRNA expression vector J Biochem (Tokyo) Oct. 2004 421-425 136.
Thomson, J. M., J. Parker, C. M. Perou and S. M. Hammond. A custom microarray platform for analysis of microRNA gene expression Nat Methods Oct. (Epub Sep. 29, 2004) 2004 47-53 1.
Krol, J., K. Sobczak, U. Wilczynska, M. Drath, A. Jasinska, D. Kaczynska and W. J. Krzyzosiak. Structural features of microRNA (miRNA) precursors and their relevance to miRNA biogenesis and small interfering RNA/short hairpin RNA design J Biol Chem Oct. 1, (Epub Aug. 2, 2004) 2004 42230-42239 279.
Shen, B. and H. M. Goodman. Uridine addition after microRNA-directed cleavage Science Nov. 5, 2004 997 306.
Davidson, T. J., S. Harel, V. A. Arboleda, G. F. Prunell, M. L. Shelanski, L. A. Greene and C. M. Troy. Highly efficient small interfering RNA delivery to primary mammalian neurons induces MicroRNA-like effects before mRNA degradation J Neurosci Nov. 10, 2004 10040-10046 24.
Ying, S. Y. and S. L. Lin. Intron-derived microRNAs—fine tuning of gene functions Gene Nov. 10, 2004 25-28 342.
Denli, A. M., B. B. Tops, R. H. Plasterk, R. F. Ketting and G. J. Hannon. Processing of primary microRNAs by the Microprocessor complex Nature Nov. 11, 2004 231-235 432.
Gregory, R. I., K. P. Yan, G. Amuthan, T. Chendrimada, B. Doratotaj, N. Cooch and R. Shiekhattar. The Microprocessor complex mediates the genesis of microRNAs Nature Nov. 11, 2004 235-240 432.
Poy, M. N., L. Eliasson, J. Krutzfeldt, S. Kuwajima, X. Ma, P. E. MacDonald, S. Pfeffer, T. Tuschl, N. Rajewsky, P. Rorsman and M. Stoffel. A pancreatic islet-specific microRNA regulates insulin secretion Nature Nov. 11, 2004 226-230 432.
Soutschek, J., A. Akinc, B. Bramlage, K. Charisse, R. Constien, M. Donoghue, S. Elbashir, A. Geick, P. Hadwiger, J. Harborth, M. John, V. Kesavan, G. Lavine, R. K. Pandey, T. Racie, K. G. Rajeev, I. Rohl, I. Toudjarska, G. Wang, S. Wuschko, D. Bumcrot, V. Koteliansky, S. Limmer, M. Manoharan and H. P. Vornlocher. Therapeutic silencing of an endogenous gene by systemic administration of modified siRNAs Nature Nov. 11, 2004 173-178 432.
Couzin, J. Molecular biology. RNAi shows cracks in its armor Science Nov. 12, 2004 1124-1125 306.
Rao, M. Conserved and divergent paths that regulate self-renewal in mouse and human embryonic stem cells Dev Biol Nov. 15, 2004 269-286 275.

Tomari, Y., C. Matranga, B. Haley, N. Martinez and P. D. Zamore. A protein sensor for siRNA asymmetry Science Nov. 19, 2004 1377-1380 306.
Belostotsky, D. mRNA turnover meets RNA interference Mol Cell Nov. 19, 2004 498-500 16.
Bonnet, E., J. Wuyts, P. Rouze and Y. Van De Peer. Evidence that microRNA precursors, unlike other non-coding RNAs, have lower folding free energies than random sequences Bioinformatics Nov. 22, 2004 2911-2917 20.
Koziczak, M. and N. E. Hynes. Cooperation between fibroblast growth factor receptor-4 and ErbB2 in regulation of cyclin D1 translation J Biol Chem Nov. 26, (Epub Sep. 17, 2004) 2004 50004-50011 279.
Esquela-Kerscher, A. and F. J. Slack. The age of high-throughput microRNA profiling Nat Methods Nov. 2004 106-107 1.
Jackson, A. L. and P. S. Linsley. Noise amidst the silence: off-target effects of siRNAs? Trends Genet Nov. 2004 521-524 20.
Huang, M., Y. Wang, M. Collins and L. M. Graves. CPEC induces erythroid differentiation of human myeloid leukemia K562 cells through CTP depletion and p38 Map kinase Leukemia Nov. 2004 1857-1863 18.
Lovett-Racke, A. E., A. E. Rocchini, J. Choy, S. C. Northrop, R. Z. Hussain, R. B. Ratts, D. Sikder and M. K. Racke. Silencing T-bet defines a critical role in the differentiation of autoreactive T lymphocytes Immunity Nov. 2004 719-731 21.
Jin, P., R. S. Alisch and S. T. Warren. RNA and microRNAs in fragile X mental retardation Nat Cell Biol Nov. 2004 1048-1053 6.
John, B., A. J. Enright, A. Aravin, T. Tuschl, C. Sander and D. S. Marks. Human MicroRNA targets PLoS Biol Nov. 2004 e363 2.
Bao, N., K. W. Lye and M. K. Barton. MicroRNA binding sites in *Arabidopsis* class III HD-ZIP mRNAs are required for methylation of the template chromosome Dev Cell Nov. 2004 653-662 7.
Eshed, Y. and J. L. Bowman. MicroRNAs guide asymmetric DNA modifications guiding asymmetric organs Dev Cell Nov. 2004 629-630 7.
Babak, T., W. Zhang, Q. Morris, B. J. Blencowe and T. R. Hughes. Probing microRNAs with microarrays: tissue specificity and functional inference Rna Nov. 2004 1813-1819 10.
Chattopadhyay, S., Y. Wang, R. Zhao and I. D. Goldman. Lack of impact of the loss of constitutive folate receptor alpha expression, achieved by RNA Interference, on the activity of the new generation antifolate pemetrexed in HeLa cells Clin Cancer Res Dec. 1, 2004 7986-7993 10.
O'Loghlen, A., V. M. Gonzalez, M. Salinas and M. E. Martin. Suppression of human Mnk1 by small interfering RNA increases the eukaryotic initiation factor 4F activity in HEK293T cells FEBS Lett Dec. 3, 2004 31-35 578.
Esau, C., X. Kang, E. Peralta, E. Hanson, E. G. Marcusson, L. V. Ravichandran, Y. Sun, S. Koo, R. J. Perera, R. Jain, N. M. Dean, S. M. Freier, C. F. Bennett, B. Lollo and R. Griffey. MicroRNA-143 regulates adipocyte differentiation J Biol Chem Dec. 10, 2004 52361-52365 279.
Valoczi, A., C. Hornyik, N. Varga, J. Burgyan, S. Kauppinen and Z. Havelda. Sensitive and specific detection of microRNAs by northern blot analysis using LNA-modified oligonucleotide probes Nucleic Acids Res Dec. 14, 2004 e175 32.
Landthaler, M., A. Yalcin and T. Tuschl. The human DiGeorge syndrome critical region gene 8 and Its *D. melanogaster* homolog are required for miRNA biogenesis Curr Biol Dec. 14, 2004 2162-2167 14.
Bennasser, Y., S. Y. Le, M. L. Yeung and K. T. Jeang. HIV-1 encoded candidate micro-RNAs and their cellular targets Retrovirology Dec. 15, 2004 43 1.
Han, J., Y. Lee, K. H. Yeom, Y. K. Kim, H. Jin and V. N. Kim. The Drosha-DGCR8 complex in primary microRNA processing Genes Dev Dec. 15, 2004 3016-3027 18.
Omoto, S., M. Ito, Y. Tsutsumi, Y. Ichikawa, H. Okuyama, E. A. Brisibe, N. K. Saksena and Y. R. Fujii. HIV-1 nef suppression by virally encoded microRNA Retrovirology Dec. 15, 2004 44 1.
Jin, W. and G. J. Cote. Enhancer-dependent splicing of FGFR1 alpha-exon is repressed by RNA interference-mediated down-regulation of SRp55 Cancer Res Dec. 15, 2004 8901-8905 64.
Cullen, B. R. Transcription and processing of human microRNA precursors Mol Cell Dec. 22, 2004 861-865 16.
Sun, Y., S. Koo, N. White, E. Peralta, C. Esau, N. M. Dean and R. J. Perera. Development of a micro-array to detect human and mouse microRNAs and characterization of expression in human organs Nucleic Acids Res Dec. 22, 2004 e188 32.
Kittler, R., G. Putz, L. Pelletier, I. Poser, A. K. Heninger, D. Drechsel, S. Fischer, I. Konstantinova, B. Habermann, H. Grabner, M. L. Yaspo, H. Himmelbauer, B. Korn, K. Neugebauer, M. T. Pisabarro and F. Buchholz. An endoribonuclease-prepared siRNA screen in human cells identifies genes essential for cell division Nature Dec. 23, 2004 1036-1040 432.
Bignold, L. P. The cell-type-specificity of inherited predispositions to tumours: review and hypothesis Cancer Lett Dec. 28, 2004 127-146 216.
Rapozzi, V. and L. E. Xodo. Efficient silencing of bcr/abl oncogene by single- and double-stranded siRNAs targeted against b2a2 transcripts Biochemistry Dec. 28, 2004 16134-16141 43.
Kanatsu-Shinohara, M., K. Inoue, J. Lee, M. Yoshimoto, N. Ogonuki, H. Miki, S. Baba, T. Kato, Y. Kazuki, S. Toyokuni, M. Toyoshima, O. Niwa, M. Oshimura, T. Heike, T. Nakahata, F. Ishino, A. Ogura and T. Shinohara. Generation of pluripotent stem cells from neonatal mouse testis Cell Dec. 29, 2004 1001-1012 119.
Agrawal, S. and E. R. Kandimalla. Role of Toll-like receptors in antisense and siRNA [corrected] Nat Biotech Dec. 2004 1533-1537 22.
Bantounas, I., L. A. Phylactou and J. B. Uney. RNA interference and the use of small interfering RNA to study gene function in mammalian systems J Mol Endocrinol Dec. 2004 545-557 33.
Barad, O., E. Meiri, A. Avniel, R. Aharonov, A. Barzilai, I. Bentwich, U. Einav, S. Gilad, P. Hurban, Y. Karov, E. K. Lobenhofer, E. Sharon, Y. M. Shiboleth, M. Shtutman, Z. Bentwich and P. Einat. MicroRNA expression detected by oligonucleotide microarrays: system establishment and expression profiling in human tissues Genome Res Dec. 2004 2486-2494 14.
Komano, J., K. Miyauchi, Z. Matsuda and N. Yamamoto. Inhibiting the Arp2/3 complex limits infection of both intracellular mature vaccinia virus and primate lentiviruses Mol Biol Cell Dec. 2004 5197-5207 15.
Lu, S. and B. R. Cullen. Adenovirus VA1 noncoding RNA can inhibit small interfering RNA and MicroRNA biogenesis J Virol Dec. 2004 12868-12876 78.
Ostberg, Y., I. Bunikis, S. Bergstrom and J. Johansson. The etiological agent of Lyme disease, *Borrelia burgdorferi*, appears to contain only a few small RNA molecules J Bacteriol Dec. 2004 8472-8477 186.
Shi, H., N. Chamond, C. Tschudi and E. Ullu. Selection and characterization of RNA interference-deficient trypanosomes impaired in target mRNA degradation Eukaryot Cell Dec. 2004 1445-1453 3.
Tan, F. L. and J. Q. Yin. RNAi, a new therapeutic strategy against viral infection Cell Res Dec. 2004 460-466 14.
Vella, M. C., K. Reinert and F. J. Slack. Architecture of a validated microRNA:target interaction Chem Biol Dec. 2004 1619-1623 11.
Allen, E., Z. Xie, A. M. Gustafson, G. H. Sung, J. W. Spatafora and J. C. Carrington. Evolution of microRNA genes by inverted duplication of target gene sequences in *Arabidopsis thaliana* Nat Genet Dec. 2004 1282-1290 36.
Xu, P., M. Guo and B. A. Hay. MicroRNAs and the regulation of cell death Trends Genet Dec. 2004 617-624 20.
Cai, X., C. H. Hagedorn and B. R. Cullen. Human microRNAs are processed from capped, polyadenylated transcripts that can also function as mRNAs Rna Dec. (Epub Nov. 3, 2004) 2004 1957-1966 10.
Chang, J., E. Nicolas, D. Marks, C. Sander, A. Lerro, M. Annick Buendia, C. Xu, W. S. Mason, T. Moloshok, R. Bort, K. S. Zaret and J. M. Taylor. miR-122, a Mammalian Liver-Specific microRNA, is Processed from hcr mRNA and May Downregulate the High Affinity Cationic Amino Acid Transporter CAT-1 2004 106 1.
Gershon, D. Microarrays go mainstream Nature Methods 2004 263 1.
Joseph, R., A. Krichevsky, K. S. Kosik and R. Manchanda. Validation of miRNA microarray data using MICROMAX ASAP miRNA chemical labeling kit by Northern blot analysis PerkinElmer Life and Analytical Sciences 2004 1 6938.

Lund, E., S. Guttinger, A. Calado, J. E. Dahlberg and U. Kutay. Nuclear export of microRNA precursors Science Jan. 2, (Epub Nov. 20, 2003) 2004 95-98 303.

Matzke, M., W. Aufsatz, T. Kanno, L. Daxinger, I. Papp, M. F. Mette and A. J. Matzke. Genetic analysis of RNA-mediated transcriptional gene silencing 2004 129 1677.

Paradigmgenetics, I. Market Exploration: MicroRNAs Final Report 2004 1.

Soreq, H. and S. Seidman. Antisense approach to isoform specific blockade of acetylcholinesterase 2004 1.

Wang, L. C., O. C. Yen and E. Zandi. TNFa-dependent drug resistance to purine and pyrimidine analogues in human colon tumor cells mediated through IKK J.Biol Chem. 2004.

Hardy, J. Toward Alzheimer therapies based on genetic knowledge Annu Rev Med 2004 15-25 55.

Shabalina, S. A. and N. A. Spiridonov. The mammalian transcriptome and the function of non-coding DNA sequences Genome Biol 2004 105 5.

Gustafson, A. M., E. Allen, S. Givan, D. Smith, J. C. Carrington and K. D. Kasschau. ASRP: the *Arabidopsis* Small RNA Project Database Nucleic Acids Res Jan. 1, 2005 D637-640 33.

Pang, K. C., S. Stephen, P. G. Engstrom, K. Tajul-Arifin, W. Chen, C. Wahlestedt, B. Lenhard, Y. Hayashizaki and J. S. Mattick. RNAdb—a comprehensive mammalian noncoding RNA database Nucleic Acids Res Jan. 1, 2005 D125-130 33.

Einav, Y., R. Agami and D. Canaani. shRNA-mediated RNA interference as a tool for genetic synthetic lethality screening in mouse embryo fibroblasts FEBS Lett Jan. 3, 2005 199-202 579.

Sugiyama, T., H. Cam, A. Verdel, D. Moazed and S. I. Grewal. RNA-dependent RNA polymerase is an essential component of a self-enforcing loop coupling heterochromatin assembly to siRNA production Proc Natl Acad Sci U S A Jan. 4, 2005 152-157 102.

Huppi, K., S. E. Martin and N. J. Caplen. Defining and assaying RNAi in mammalian cells Mol Cell Jan. 7, 2005 1-10 17.

Zeng, Y., R. Yi and B. R. Cullen. Recognition and cleavage of primary microRNA precursors by the nuclear processing enzyme Drosha Embo J Jan. 12, 2005 138-148 24.

Tops, B. B., H. Tabara, T. Sijen, F. Simmer, C. C. Mello, R. H. Plasterk and R. F. Ketting. RDE-2 interacts with MUT-7 to mediate RNA interference in *Caenorhabditis elegans* Nucleic Acids Res Jan. 13, 2005 347-355 33.

Elmen, J., H. Thonberg, K. Ljungberg, M. Frieden, M. Westergaard, Y. Xu, B. Wahren, Z. Liang, H. Orum, T. Koch and C. Wahlestedt. Locked nucleic acid (LNA) mediated improvements in siRNA stability and functionality Nucleic Acids Res Jan. 14, 2005 439-447 33.

Lewis, B. P., C. B. Burge and D. P. Bartel. Conserved seed pairing, often flanked by adenosines, indicates that thousands of human genes are microRNA targets Cell Jan. 14, 2005 15-20 120.

Berezikov, E., V. Guryev, J. Van De Belt, E. Wienholds, R. H. Plasterk and E. Cuppen. Phylogenetic shadowing and computational identification of human microRNA genes Cell Jan. 14, 2005 21-24 120.

Tanzer, A., C. T. Amemiya, C. B. Kim and P. F. Stadler. Evolution of microRNAs located within Hox gene clusters J Exp Zoolog B Mol Dev Evol Jan. 15, 2005 75-85 304.

Yun, M. S., S. E. Kim, S. H. Jeon, J. S. Lee and K. Y. Choi. Both ERK and Wnt/beta-catenin pathways are involved in Wnt3a-induced proliferation J Cell Sci Jan. 15, 2005 313-322 118.

Watanabe, T., A. Takeda, K. Mise, T. Okuno, T. Suzuki, N. Minami and H. Imai. Stage-specific expression of microRNAs during *Xenopus* development FEBS Lett Jan. 17, 2005 318-324 579.

Ying, S. Y. and S. L. Lin. Intronic microRNAs Biochem Biophys Res Commun Jan. 21, 2005 515-520 326.

Tomari, Y. and P. D. Zamore. MicroRNA biogenesis: drosha can't cut it without a partner Curr Biol Jan. 26, 2005 R61-64 15.

Fan, Q. W. and W. A. Weiss. RNA interference against a glioma-derived allele of EGFR induces blockade at G2M Oncogene Jan. 27, 2005 829-837 24.

Liang, R. Q., W. Li, Y. Li, C. Y. Tan, J. X. Li, Y. X. Jin and K. C. Ruan. An oligonucleotide microarray for microRNA expression analysis based on labeling RNA with quantum dot and nanogold probe Nucleic Acids Res Jan. 31, 2005 e17 33.

Akaneya, Y., B. Jiang and T. Tsumoto. RNAi-induced gene silencing by local electroporation in targeting brain region J Neurophysiol Jan. 2005 594-602 93.

Adai, A., C. Johnson, S. Mlotshwa, S. Archer-Evans, V. Manocha, V. Vance and V. Sundaresan. Computational prediction of miRNAs in *Arabidopsis thaliana* Genome Res Jan. 2005 78-91 15.

Alibu, V. P., L. Storm, S. Haile, C. Clayton and D. Horn. A doubly inducible system for RNA interference and rapid RNAi plasmid construction in *Trypanosoma brucei* Mol Biochem Parasitol Jan. 2005 75-82 139.

Alsford, S., L. Glover and D. Horn. Multiplex analysis of RNA interference defects in *Trypanosoma brucei* Mol Biochem Parasitol Jan. 2005 129-132 139.

Bedell, J. A., M. A. Budiman, A. Nunberg, R. W. Citek, D. Robbins, J. Jones, E. Flick, T. Rholfing, J. Fries, K. Bradford, J. McMenamy, M. Smith, H. Holeman, B. A. Roe, G. Wiley, I. F. Korf, P. D. Rabinowicz, N. Lakey, W. R. McCombie, J. A. Jeddeloh and R. A. Martienssen. Sorghum genome sequencing by methylation filtration PLoS Biol Jan. 2005 e13 3.

Hansen, K. R., G. Burns, J. Mata, T. A. Volpe, R. A. Martienssen, J. Bahler and G. Thon. Global effects on gene expression in fission yeast by silencing and RNA interference machineries Mol Cell Biol Jan. 2005 590-601 25.

Soldan, S. S., M. L. Plassmeyer, M. K. Matukonis and F. Gonzalez-Scarano. La Crosse virus nonstructural protein NSs counteracts the effects of short interfering RNA J Virol Jan. 2005 234-244 79.

Taylor, J. A. and N. V. Naoumov. The potential of RNA interference as a tool in the management of viral hepatitis J Hepatol Jan. 2005 139-144 42.

Wu, C. J., H. W. Huang, C. Y. Liu, C. F. Hong and Y. L. Chan. Inhibition of SARS-CoV replication by siRNA Antiviral Res Jan. 2005 45-48 65.

Weber, M. J. New human and mouse microRNA genes found by homology search Febs J Jan. 2005 59-73 272.

Zhang, Y. Q. and K. Broadie. Fathoming fragile X in fruit flies Trends Genet Jan. 2005 37-45 21.

Gitlin, L., J. K. Stone and R. Andino. Poliovirus escape from RNA interference: short interfering RNA-target recognition and implications for therapeutic approaches J Virol Jan. 2005 1027-1035 79.

Kan, L. and J. A. Kessler. New tool for an old problem: can RNAi efficiently resolve the issue of genetic redundancy? Bioessays Jan. 2005 14-16 27.

Pfeffer, S., A. Sewer, M. Lagos-Quintana, R. Sheridan, C. Sander, F. A. Grasser, L. F. Van Dyk, C. K. Ho, S. Shuman, M. Chien, J. J. Russo, J. Ju, G. Randall, B. D. Lindenbach, C. M. Rice, V. Simon, D. D. Ho, M. Zavolan and T. Tuschl. Identification of microRNAs of the herpesvirus family Nat Methods Feb. 16, 2005 269-276 2.

Saito, Y. and S. Dzik. Gene knockdown: RNA-interference is coming of age Transfusion Jan. 2005 111-114 45.

Scherr, M., K. Battmer, B. Schultheis, A. Ganser and M. Eder. Stable RNA interference (RNAi) as an option for anti-bcr-abl therapy Gene Ther Jan. 2005 12-21 12.

Sumimoto, H., S. Yamagata, A. Shimizu, H. Miyoshi, H. Mizuguchi, T. Hayakawa, M. Miyagishi, K. Taira and Y. Kawakami. Gene therapy for human small-cell lung carcinoma by inactivation of Skp-2 with virally mediated RNA interference Gene Ther Jan. 2005 95-100 12.

Zhang, W., H. Yang, X. Kong, S. Mohapatra, H. San Juan-Vergara, G. Hellermann, S. Behera, R. Singam, R. F. Lockey and S. S. Mohapatra. Inhibition of respiratory syncytial virus infection with intranasal siRNA nanoparticles targeting the viral NS1 gene Nat Med Jan. 2005 56-62 11.

Bitko, V., A. Musiyenko, O. Shulyayeva and S. Barik. Inhibition of respiratory viruses by nasally administered siRNA Nat Med Jan.; Epub 2004 Dec 26, 2005 50-55 11.

Article Weber, W., L. Malphettes, M. Rinderknecht, R. G. Schoenmakers, M. Spielmann, B. Keller, P. Van De Wetering, C. C. Weber and M. Fussenegger. Quorum-sensing-based toolbox for regulatable transgene and siRNA expression in mammalian cells Biotechnol Prog Jan.-Feb. 2005 178-185 21.

Dresios, J., A. Aschrafi, G. C. Owens, P. W. Vanderklish, G. M. Edelman and V. P. Mauro. Cold stress-induced protein Rbm3 binds 60S ribosomal subunits, alters microRNA levels, and enhances global protein synthesis Proc Natl Acad Sci U S A Feb. 8, 2005 1865-1870 102.
Yu, B., Z. Yang, J. Li, S. Minakhina, M. Yang, R. W. Padgett, R. Steward and X. Chen. Methylation as a crucial step in plant microRNA biogenesis Science Feb. 11, 2005 932-935 307.
Kanellopoulou, C., S. A. Muljo, A. L. Kung, S. Ganesan, R. Drapkin, T. Jenuwein, D. M. Livingston and K. Rajewsky. Dicer-deficient mouse embryonic stem cells are defective in differentiation and centromeric silencing Genes Dev Feb. 15, 2005 489-501 19.
Lim, L. P., N. C. Lau, P. Garrett-Engele, A. Grimson, J. M. Schelter, J. Castle, D. P. Bartel, P. S. Linsley and J. M. Johnson. Microarray analysis shows that some microRNAs downregulate large numbers of target mRNAs Nature Feb. 17, 2005 769-773 433.
Xiao, Z., J. Xue, T. J. Sowin, S. H. Rosenberg and H. Zhang. A novel mechanism of checkpoint abrogation conferred by Chk1 downregulation Oncogene Feb. 17, 2005 1403-1411 24.
Shah, S., S. Rangarajan and S. H. Friedman. Light-activated RNA interference Angew Chem Int Ed Engl Feb. 18, 2005 1328-1332 44.
Karube, Y., H. Tanaka, H. Osada, S. Tomida, Y. Tatematsu, K. Yanagisawa, Y. Yatabe, J. Takamizawa, S. Miyoshi, T. Mitsudomi and T. Takahashi. Reduced expression of Dicer associated with poor prognosis in lung cancer patients Cancer Sci Feb. 2005 111-115 96.
Teixeira, M. R. and S. Heim. Multiple numerical chromosome aberrations in cancer: what are their causes and what are their consequences? Semin Cancer Biol Feb. 2005 3-12 15.
Kidner, C. A. and R. A. Martienssen. The developmental role of microRNA in plants Curr Opin Plant Biol Feb. 2005 38-44 8.
Li, Y., W. Li and Y. X. Jin. Computational identification of novel family members of microRNA genes in *Arabidopsis thaliana* and *Oryza sativa* Acta Biochim Biophys Sin (Shanghai) Feb. 2005 75-87 37.
Robb, G. B., K. M. Brown, J. Khurana and T. M. Rana. Specific and potent RNAi in the nucleus of human cells Nat Struct Mol Biol Feb. 2005 133-137 12.
Tang, G. siRNA and miRNA: an insight into RISCs Trends Biochem Sci Feb. 2005 106-114 30.
Westhof, E. and W. Filipowicz. From RNAi to epigenomes: how RNA rules the world Chembiochem Feb. 2005 441-443 6.
Kim, D. H., M. A. Behlke, S. D. Rose, M. S. Chang, S. Choi and J. J. Rossi. Synthetic dsRNA Dicer substrates enhance RNAi potency and efficacy Nat Biotechnol Feb. 2005 222-226 23.
Leonard, J. N. and D. V. Schaffer. Computational design of antiviral RNA interference strategies that resist human immunodeficiency virus escape J Virol Feb. 2005 1645-1654 79.
Siolas, D., C. Lerner, J. Burchard, W. Ge, P. S. Linsley, P. J. Paddison, G. J. Hannon and M. A. Cleary. Synthetic shRNAs as potent RNAi triggers Nat Biotechnol Feb. 2005 227-231 23.
Yi, R., B. P. Doehle, Y. Qin, I. G. Macara and B. R. Cullen. Overexpression of exportin 5 enhances RNA interference mediated by short hairpin RNAs and microRNAs Rna Feb. (Epub Dec. 21, 2004) 2005 220-226 11.
Tomari, Y. and P. D. Zamore. Perspective: machines for RNAi Genes Dev Mar. 1, 2005 517-529 19.
Cheng, A. M., M. W. Byrom, J. Shelton and L. P. Ford. Antisense inhibition of human miRNAs and indications for an involvement of miRNA in cell growth and apoptosis Nucleic Acids Res Mar. 1, 2005 1290-1297 33.
Onishi, K. and S. Ueda. Molecular evolution of a microRNA cluster in the PWS/AS region among mammals Gene Mar. 1, 2005.
Wei, J. H., Y. F. Chou, Y. H. Ou, Y. H. Yeh, S. W. Tyan, T. P. Sun, C. Y. Shen and S. Y. Shieh. TTK/hMps1 participates in the regulation of DNA damage checkpoint response by phosphorylating CHK2 on threonine 68 J Biol Chem Mar. 4, (Epub Dec. 23, 2004) 2005 7748-7757 280.
Eis, P. S., W. Tam, L. Sun, A. Chadburn, Z. Li, M. F. Gomez, E. Lund and J. E. Dahlberg. Accumulation of miR-155 and BIC RNA in human B cell lymphomas Proc Natl Acad Sci U S A Mar. 8, 2005 3627-3632 102.
Kang, W., O. Nielsen, C. Fenger, R. G. Leslie, U. Holmskov and K. B. Reid. Induction of DMBT1 expression by reduced ERK activity during gastric mucosa differentiation-like process and its association with human gastric cancer Carcinogenesis Mar. 10, 2005.
Kessler, P. S. and M. Parsons. Probing the role of compartmentation of glycolysis in procyclic form *Trypanosoma brucei*: RNA interference studies of PEX14, hexokinase, and phosphofructokinase J Biol Chem Mar. 11, 2005 9030-9036 280.
Jing, Q., S. Huang, S. Guth, T. Zarubin, A. Motoyama, J. Chen, F. Di Padova, S. C. Lin, H. Gram and J. Han. Involvement of microRNA in AU-rich element-mediated mRNA instability Cell Mar. 11, 2005 623-634 120.
Johnson, S. M., H. Grosshans, J. Shingara, M. Byrom, R. Jarvis, A. Cheng, E. Labourier, K. L. Reinert, D. Brown and F. J. Slack. RAS is regulated by the let-7 microRNA family Cell Mar. 11, 2005 635-647 120.
Yang, W. J., D. D. Yang, S. Na, G. E. Sandusky, Q. Zhang and G. Zhao. Dicer is required for embryonic angiogenesis during mouse development J Biol Chem Mar. 11, (Epub Dec. 21, 2004) 2005 9330-9335 280.
Robins, H., Y. Li and R. W. Padgett. Incorporating structure to predict microRNA targets Proc Natl Acad Sci U S A Mar. 15, 2005 4006-4009 102.
Giraldez, A. J., R. M. Cinalli, M. E. Glasner, A. J. Enright, M. J. Thomson, S. Baskerville, S. M. Hammond, D. P. Bartel and A. F. Schier. MicroRNAs Regulate Brain Morphogenesis in Zebrafish Science Mar. 17, 2005.
Xie, X., J. Lu, E. J. Kulbokas, T. R. Golub, V. Mootha, K. Lindblad-Toh, E. S. Lander and M. Kellis. Systematic discovery of regulatory motifs in human promoters and 3' UTRs by comparison of several mammals Nature Mar. 17, 2005 338-345 434.
Best, A., L. Handoko, E. Schluter and H. U. Goringer. In vitro synthesized siRNAs elicit RNA interference in African trypanosomes—an in vitro and in vivo analysis J Biol Chem Mar. 21, 2005.
Lolle, S. J., J. L. Victor, J. M. Young and R. E. Pruitt. Genome-wide non-mendelian inheritance of extra-genomic information in *Arabidopsis* Nature Mar. 24, 2005 505-509 434.
Cai, X., S. Lu, Z. Zhang, C. M. Gonzalez, B. Damania and B. R. Cullen. Kaposi's sarcoma-associated herpesvirus expresses an array of viral microRNAs in latently infected cells Proc Natl Acad Sci U S A Mar. 30, 2005.
Rivas, F. V., N. H. Tolia, J. J. Song, J. P. Aragon, J. Liu, G. J. Hannon and L. Joshua-Tor. Purified Argonaute2 and an siRNA form recombinant human RISC Nat Struct Mol Biol Mar. 30, 2005.
Ma, J. B., Y. R. Yuan, G. Meister, Y. Pei, T. Tuschl and D. J. Patel. Structural basis for 5'-end-specific recognition of guide RNA by the *A. fulgidus* Piwi protein Nature Mar. 31, 2005 666-670 434.
Omoto, S. and Y. R. Fujii. Regulation of human immunodeficiency virus 1 transcription by nef microRNA J Gen Virol Mar. 2005 751-755 86.
Grosshans, H., T. Johnson, K. L. Reinert, M. Gerstein and F. J. Slack. The Temporal Patterning MicroRNA let-7 Regulates Several Transcription Factors at the Larval to Adult Transition in *C. elegans* Dev Cell Mar. 2005 321-330 8.
Lu, P. Y., F. Y. Xie and M. C. Woodle. Modulation of angiogenesis with siRNA inhibitors for novel therapeutics Trends Mol Med Mar. 2005 104-113 11.
Smirnova, L., A. Grafe, A. Seiler, S. Schumacher, R. Nitsch and F. G. Wulczyn. Regulation of miRNA expression during neural cell specification Eur J Neurosci Mar. 2005 1469-1477 21.
Voinnet, O. Induction and suppression of RNA silencing: insights from viral infections Nat Rev Genet Mar. 2005 206-220 6.
Guarguaglini, G., P. I. Duncan, Y. D. Stierhof, T. Holmstrom, S. Duensing and E. A. Nigg. The forkhead-associated domain protein Cep170 interacts with Polo-like kinase 1 and serves as a marker for mature centrioles Mol Biol Cell Mar. 2005 1095-1107 16.
Holway, A. H., C. Hung and W. M. Michael. Systematic, RNA-interference-mediated identification of mus-101 modifier genes in *Caenorhabditis elegans* Genetics Mar. 2005 1451-1460 169.
Mollinari, C., J. P. Kleman, Y. Saoudi, S. A. Jablonski, J. Perard, T. J. Yen and R. L. Margolis. Ablation of PRC1 by small interfering RNA demonstrates that cytokinetic abscission requires a central spindle bundle in mammalian cells, whereas completion of furrowing does not Mol Biol Cell Mar. 2005 1043-1055 16.
Tanno, B., V. Cesi, R. Vitali, F. Sesti, M. L. Giuffrida, C. Mancini, B. Calabretta and G. Raschella. Silencing of endogenous IGFBP-5 by micro RNA interference affects proliferation, apoptosis and differentiation of neuroblastoma cells Cell Death Differ Mar. 2005 213-223 12.

Brennecke, J., A. Stark, R. B. Russell and S. M. Cohen. Principles of microRNA-target recognition PLoS Biol Mar. 2005 e85 3.

Bakerville, S. and D. P. Bartel. Microarray profiling of microRNAs reveals frequent coexpression with neighboring miRNAs and host genes Rna Mar. 2005 241-247 11.

Legendre, M., A. Lambert and D. Gautheret. Profile-based detection of microRNA precursors in animal genomes Bioinformatics Apr. 1, 2005 841-845 21.

Walters, D. K., E. P. Stoffregen, M. C. Heinrich, M. W. Deininger and B. J. Druker. RNAi-induced down-regulation of FLT3 expression in AML cell lines increases sensitivity to MLN518 Blood Apr. 1, 2005 2952-2954 105.

Krek, A., D. Grun, M. N. Poy, R. Wolf, L. Rosenberg, E. J. Epstein, P. MacMenamin, I. Da Piedade, K. C. Gunsalus, M. Stoffel and N. Rajewsky. Combinatorial microRNA target predictions Nat Genet Apr. 3, 2005.

Vermeulen, A., L. Behlen, A. Reynolds, A. Wolfson, W. S. Marshall, J. Karpilow and A. Khvorova. The contributions of dsRNA structure to Dicer specificity and efficiency Rna Apr. 5, 2005.

Bahramian, M. B. and H. Zarbl. Gene impedance: a natural process for control of gene expression and the origin of RNA interference J Theor Biol Apr. 7, 2005 301-314 233.

Mattick, J. S. and I. V. Makunin. Small regulatory RNAs in mammals Hum Mol Genet Apr. 15, 2005 R121-132 14 Suppl 1.

Brown, J. R. and P. Sanseau. A computational view of microRNAs and their targets Drug Discov Today Apr. 15, 2005 595-601 10.

Lai, E. C., B. Tam and G. M. Rubin. Pervasive regulation of *Drosophila* Notch target genes by GY-box-, Brd-box-, and K-box-class microRNAs Genes Dev Apr. 15, 2005.

Kim, V. N. MicroRNA biogenesis: coordinated cropping and dicing Nat Rev Mol Cell Biol Apr. 15, 2005.

Lecellier, C. H., P. Dunoyer, K. Arar, J. Lehmann-Che, S. Eyquem, C. Himber, A. Saib and O. Voinnet. A cellular microRNA mediates antiviral defense in human cells Science Apr. 22, 2005 557-560 308.

Couzin, J. Molecular biology. Human RNA slows down a primate retrovirus Science Apr. 22, 2005 480-481 308.

Lee, Y. S., H. K. Kim, S. Chung, K. S. Kim and A. Dutta. Depletion of human micro-RNA miR-125b reveals that it is critical for the proliferation of differentiated cells but not for the down-regulation of putative targets during differentiation J Biol Chem Apr. 29, 2005 16635-16641 280.

Teixeira, D., U. Sheth, M. A. Valencia-Sanchez, M. Brengues and R. Parker. Processing bodies require RNA for assembly and contain nontranslating mRNAs Rna Apr. 2005 371-382 11.

Orban, T. I. and E. Izaurralde. Decay of mRNAs targeted by RISC requires XRN1, the Ski complex, and the exosome Rna Apr. 2005 459-469 11.

O'Toole A, S., S. Miller and M. J. Serra. Stability of 3' double nucleotide overhangs that model the 3' ends of siRNA Rna Apr. 2005 512-516 11.

Neilson, J. R. and P. A. Sharp. Herpesviruses throw a curve ball: new insights into microRNA biogenesis and evolution Nat Methods Apr. 2005 252-254 2.

Pasquinelli, A. E., S. Hunter and J. Bracht. MicroRNAs: a developing story Curr Opin Genet Dev Apr. 2005 200-205 15.

Chen, C. Z. and H. F. Lodish. MicroRNAs as regulators of mammalian hematopoiesis Semin Immunol Apr. 2005 155-165 17.

Knott, J. G., M. Kurokawa, R. A. Fissore, R. M. Schultz and C. J. Williams. Transgenic RNA interference reveals role for mouse sperm phospholipase Czeta in triggering Ca2+ oscillations during fertilization Biol Reprod Apr. 2005 92-996 72.

Latchoumycandane, C., V. Anantharam, M. Kitazawa, Y. Yang, A. Kanthasamy and A. G. Kanthasamy. Protein kinase Cdelta is a key downstream mediator of manganese-induced apoptosis in dopaminergic neuronal cells J Pharmacol Exp Ther Apr. 2005 46-55 313.

Gregory, R. I. and R. Shiekhattar. MicroRNA biogenesis and cancer Cancer Res May 1, 2005 3509-3512 65.

Jaronczyk, K., J. B. Carmichael and T. C. Hobman. Exploring the functions of RNA interference pathway proteins: some functions are more RISCy than others? Biochem J May 1, 2005 561-571 387.

Cheng, L. C., M. Tavazoie and F. Doetsch. Stem Cells From Epigeneticsto microRNAs Neuron May 5, 2005 363-367 46.

Liao, H. and J. H. Wang. Biomembrane-Permeable and Ribonuclease-Resistant siRNA with Enhanced Activity Oligonucleotides May 5, 2005.

Altuvia, Y., P. Landgraf, G. Lithwick, N. Elefant, S. Pfeffer, A. Aravin, M. J. Brownstein, T. Tuschl and H. Margalit. Clustering and conservation patterns of human microRNAs Nucleic Acids Res May 12, 2005 2697-2706 33.

Schubert, S., A. Grunweller, V. A. Erdmann and J. Kurreck. Local RNA Target Structure Influences siRNA Efficacy: Systematic Analysis of Intentionally Designed Binding Regions J Mol Biol May 13, 2005 883-893 348.

Overhoff, M., M. Alken, R. K. Far, M. Lemaitre, B. Lebleu, G. Sczakiel and I. Robbins. Local RNA Target Structure Influences siRNA Efficacy: A Systematic Global Analysis J Mol Biol May 13, 2005 871-881 348.

Brown, K. M., C. Y. Chu and T. M. Rana. Target accessibility dictates the potency of human RISC Nat Struct Mol Biol May 2005 469-470 12.

Bennasser, Y., S. Y. Le, M. Benkirane and K. T. Jeang. Evidence that HIV-1 Encodes an siRNA and a Suppressor of RNA Silencing Immunity May 2005 607-619 22.

Kong, Y. and J. H. Han. MicroRNA: biological and computational perspective Genomics Proteomics Bioinformatics May 2005 62-72 3.

Yu, L., X. Yu, R. Shen and Y. He. HYL1 gene maintains venation and polarity of leaves Planta May 2005 231-242 221.

Gong, H., C. M. Liu, D. P. Liu and C. C. Liang. The role of small RNAs in human diseases: potential troublemaker and therapeutic tools Med Res Rev May 2005 361-381 25.

* cited by examiner

A

B

C

MICRORNAS AND USES THEREOF

CROSS REFERENCE TO RELATED APPLICATIONS

The present application is a continuation of the International Application No. PCT/US2005/16986, filed May 14, 2005, which is a continuation-in-part of U.S. application Ser. No. 10/709,577, filed May 14, 2004 now U.S. Pat. No. 7,687, 616, and U.S. application Ser. No. 10/709,572, filed May 14, 2004, and which claims the benefit of U.S. Provisional Application No. 60/666,340, filed Mar. 30, 2005, U.S. Provisional Application No. 60/665,094, filed Mar. 25, 2005, U.S. Provisional Application No. 60/662,742, filed Mar. 17, 2005, U.S. Provisional Application No. 60/593,329, filed Jan. 6, 2005, U.S. Provisional Application No. 60/593,081, filed Dec. 8, 2004, U.S. Provisional Application No. 60/522,860, filed Nov. 15, 2004, U.S. Provisional Application No. 60/522, 457, filed Oct. 4, 2004, U.S. Provisional Application No. 60/522,452, filed Oct. 3, 2004, and U.S. Provisional Application No. 60/522,449, filed Oct. 3, 2004, the contents of which are incorporated herein by reference.

FIELD OF THE INVENTION

The invention relates in general to microRNA molecules as well as various nucleic acid molecules relating thereto or derived therefrom.

BACKGROUND OF THE INVENTION

MicroRNAs (miRNAs) are short RNA oligonucleotides of approximately 22 nucleotides that are involved in gene regulation. MicroRNAs regulate gene expression by targeting mRNAs for cleavage or translational repression. Although miRNAs are present in a wide range of species including *C. elegans, Drosophilla* and humans, they have only recently been identified. More importantly, the role of miRNAs in the development and progression of disease has only recently become appreciated.

As a result of their small size, miRNAs have been difficult to identify using standard methodologies. A limited number of miRNAs have been identified by extracting large quantities of RNA. MiRNAs have also been identified that contribute to the presentation of visibly discernable phenotypes. Expression array data shows that miRNAs are expressed in different developmental stages or in different tissues. The restriction of miRNAs to certain tissues or at limited developmental stages indicates that the miRNAs identified to date are likely only a small fraction of the total miRNAs.

Computational approaches have recently been developed to identify the remainder of miRNAs in the genome. Tools such as MiRscan and MiRseeker have identified miRNAs that were later experimentally confirmed. Based on these computational tools, it has been estimated that the human genome contains 200-255 miRNA genes. These estimates are based on an assumption, however, that the miRNAs remaining to be identified will have the same properties as those miRNAs already identified. Based on the fundamental importance of miRNAs in mammalian biology and disease, the art needs to identify unknown miRNAs. The present invention satisfies this need and provides a significant number of miRNAs and uses therefore.

SUMMARY OF THE INVENTION

The present invention is related to an isolated nucleic acid comprising a sequence of a pri-miRNA, pre-miRNA, miRNA, miRNA*, anti-miRNA, or a miRNA binding site, or a variant thereof. The nucleic acid may comprise the sequence of a hairpin referred to in Table 1; the sequence of sequence identifiers 6757248-6894882 of the Sequence Listing of U.S. patent application Ser. No. 10/709,572, which is incorporated herein by reference; the sequence of sequence identifiers 1-6318 or 18728-18960 of the Sequence Listing of U.S. Provisional Patent Application No. 60/655,094, which is incorporated herein by reference; the sequence of a miRNA referred to in Table 1; the sequence of sequence identifiers 1-117750 or 6894883-10068177 of the Sequence Listing of U.S. patent application Ser. No. 10/709,572, which is incorporated herein by reference; the sequence of sequence identifiers 6319-18727 or 18961-19401 of the Sequence Listing of U.S. Provisional Patent Application No. 60/655,094, which is incorporated herein by reference; the sequence of a target gene binding site referred to in Table 4; the sequence of sequence identifiers 117751-6757247 of the Sequence Listing of U.S. patent application Ser. No. 10/709,572, which is incorporated herein by reference; a complement thereof; or a sequence comprising at least 12 contiguous nucleotides at least 60% identical thereto. The isolated nucleic acid may be from 5-250 nucleotides in length.

The present invention is also related to a probe comprising the nucleic acid. The probe may comprise at least 8-22 contiguous nucleotides complementary to a miRNA referred to in Table 2 as differentially expressed in prostate cancer or lung cancer.

The present invention is also related to a plurality of the probes. The plurality of probes may comprise at least one probe complementary to each miRNA referred to in Table 2 as differentially expressed in prostate cancer. The plurality of probes may also comprise at least one probe complementary to each miRNA referred to in Table 2 as differentially expressed in lung cancer.

The present invention is also related to a composition comprising a probe or plurality of probes.

The present invention is also related to a biochip comprising a solid substrate, said substrate comprising a plurality of probes. Each of the probes may be attached to the substrate at a spatially defined address. The biochip may comprise probes that are complementary to a miRNA referred to in Table 2 as differentially expressed in prostate cancer. The biochip may also comprise probes that are complementary to a miRNA referred to in Table 2 as differentially expressed in lung cancer.

The present invention is also related to a method of detecting differential expression of a disease-associated miRNA. A biological sample may be provide and the level of a nucleic acid measured that is at least 70% identical to a sequence of a miRNA referred to in Table 1; the sequence of sequence identifiers 1-117750 or 6894883-10068177 of the Sequence Listing of U.S. patent application Ser. No. 10/709,572, which is incorporated herein by reference; the sequence of sequence identifiers 6319-18727 or 18961-19401 of the Sequence Listing of U.S. Provisional Patent Application No. 60/655,094, which is incorporated herein by reference; or variants thereof. A difference in the level of the nucleic acid compared to a control is indicative of differential expression.

The present invention is also related to a method of identifying a compound that modulates a pathological condition. A cell may be provided that is capable of expressing a nucleic acid at least 70% identical to a sequence of a miRNA referred to in Table 1; the sequence of sequence identifiers 1-117750 or 6894883-10068177 of the Sequence Listing of U.S. patent application Ser. No. 10/709,572, which is incorporated herein by reference; the sequence of sequence identifiers 6319-18727 or 18961-19401 of the Sequence Listing of U.S. Provisional Patent Application No. 60/655,094, which is incorporated herein by reference; or variants thereof. The cell may be contacted with a candidate modulator and then measuring the level of expression of the nucleic acid. A difference in the level of the nucleic acid compared to a control identifies the compound as a modulator of a pathological condition associated with the nucleic acid.

May 12, 2005); TABLE 2.TXT (1.327 MB, May 12, 2005); TABLE 4.TXT (10.857 MB, May 12, 2005); and TABLE 5.TXT (986 KB, May 12, 2005), the contents of which are incorporated by reference herein.

LENGTHY TABLES

The patent contains a lengthy table section. A copy of the table is available in electronic form from the USPTO web site (http://seqdata.uspto.gov/?pageRequest=docDetail&DocID=US07709616B2). An electronic copy of the table will also be available from the USPTO upon request and payment of the fee set forth in 37 CFR 1.19(b)(3).

The present invention is also related to a method of inhibiting expression of a target gene in a cell. Into the cell, a nucleic acid may be introduced in an amount sufficient to inhibit expression of the target gene. The target gene may comprise a binding site substantially identical to a binding site referred to in Table 4; a sequence of sequence identifiers 117751-6757247 of the Sequence Listing of U.S. patent application Ser. No. 10/709,572, which is incorporated herein by reference; or a variant thereof. The nucleic acid may comprise a sequence of SEQ ID NOS: 1-760616; a sequence of sequence identifiers 1-117750 and 6757248-10068177 of the Sequence Listing of U.S. patent application Ser. No. 10/709,572, which is incorporated herein by reference; a sequence set forth on the Sequence Listing of U.S. Provisional Patent Application No. 60/655,094, which is incorporated herein by reference; or a variant thereof. Expression of the target gene may be inhibited in vitro or in vivo.

The present invention is also related to a method of increasing expression of a target gene in a cell. Into the cell, a nucleic acid may be introduced in an amount sufficient to inhibit expression of the target gene. The target gene may comprise a binding site substantially identical to a binding site referred to in Table 4; a sequence of sequence identifiers 117751-6757247 of the Sequence Listing of U.S. patent application Ser. No. 10/709,572, which is incorporated herein by reference; or a variant thereof. The nucleic acid may comprise a sequence substantially complementary to SEQ ID NOS: 1-760616; a sequence of sequence identifiers 1-117750 and 6757248-10068177 of the Sequence Listing of U.S. patent application Ser. No. 10/709,572, which is incorporated herein by reference; a sequence set forth on the Sequence Listing of U.S. Provisional Patent Application No. 60/655,094, which is incorporated herein by reference; or a variant thereof. Expression of the target gene may be inhibited in vitro or in vivo. Expression of the target gene may be increased in vitro or in vivo.

The present invention is also related to a method of treating a patient with a disorder set forth on Table 6 comprising administering to a patient in need thereof a nucleic acid comprising a sequence of SEQ ID NOS: 1-760616; a sequence set forth on the Sequence Listing of U.S. patent application Ser. No. 10/709,572, which is incorporated herein by reference; a sequence set forth on the Sequence Listing of U.S. Provisional Patent Application No. 60/655,094, which is incorporated herein by reference; or a variant thereof.

BRIEF DESCRIPTION OF SEQUENCE LISTING AND TABLES

Reference is made to the appendix submitted on the compact disc submitted herewith. The compact disc contains "Seq.List.txt" 168,151 KB, Apr. 29, 2009), which is a Sequence Listing in accordance with 37 C.F.R. §§1.821-1.825, and the following tables: TABLE 1.TXT (968 KB,

760675), hsa-miR-302d (SEQ ID NO: 760676), and hsa-miR-A-3p (consensus)(SEQ ID NO: 760677).

Figure 5:
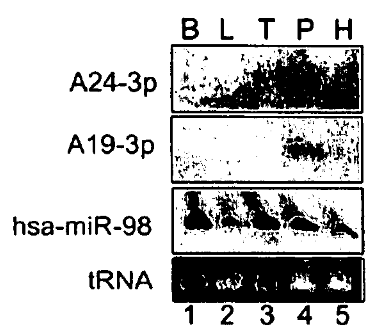
Figure 5:
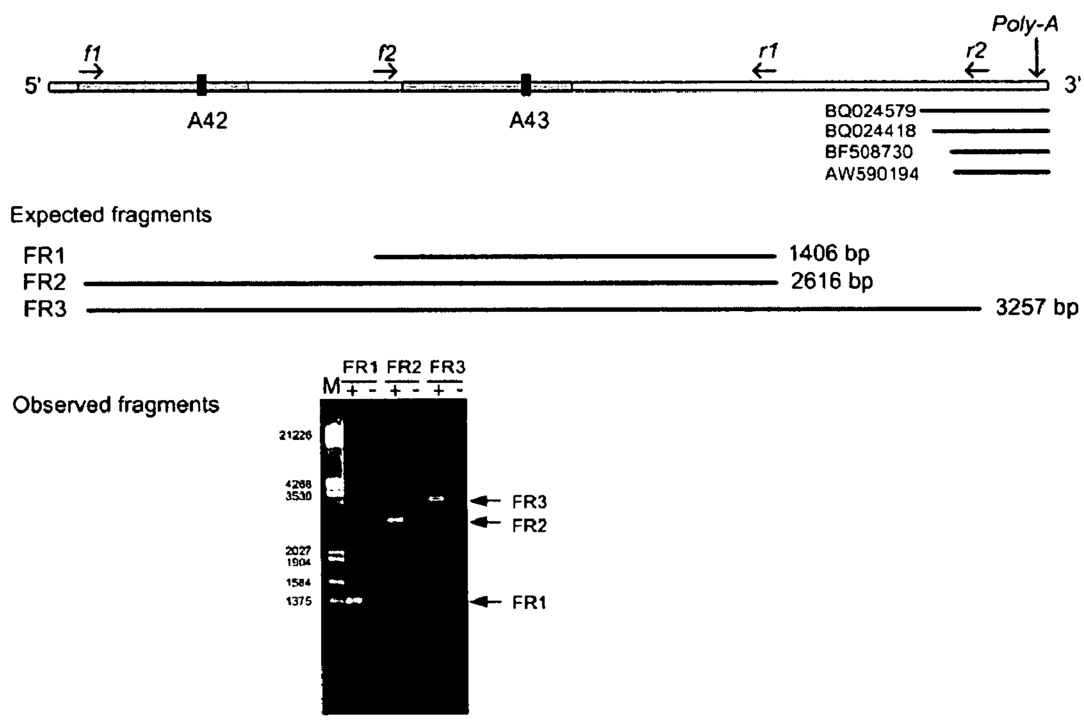
Figure 5:
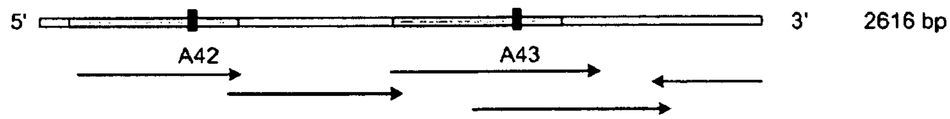

FIG. 5 shows expression analysis of the MC19-1 miRNAs. Panel A shows a Northern blot analysis of two selected A-type miRNAs. Expression was analyzed using total RNA from human brain (B), liver (L), thymus (T), placenta (P) and HeLa cells (H). The expression of mir-98 and ethidium bromide staining of the tRNA band served as control. Panel B shows RT-PCR analysis of the mRNA transcript containing the A-type miRNA precursors. Reverse transcription of 5ÿg total RNA from placenta was performed using oligo-dT. This was followed by PCR using the denoted primers (indicated by horizontal arrows). The region examined is illustrated at the top. Vertical black bars represent the pre-miRNA; shaded areas around the pre-miRNAs represent the repeating units; the location of four ESTs is indicted at the right side; the poly-A site, as found in the ESTs and located downstream to a AATAAA consensus, is indicated by a vertical arrow. The fragments expected from RT-PCR using three primer combinations are indicated below the illustration of the cluster region. The results of the RT-PCR analysis are presented below the expected fragments. Panel C shows the sequencing strategy of the FR2 fragment. The fragment was cloned into the pTZ57R\T vector and sequenced using external and internal primers.

DETAILED DESCRIPTION

The present invention provides nucleotide sequences of miRNAs, precursors thereto, targets thereof and related sequences. Such nucleic acids are useful for diagnostic purposes, and also for modifying target gene expression. Other aspects of the invention will become apparent to the skilled artisan by the following description of the invention.

1. Definitions

Before the present compounds, products and compositions and methods are disclosed and described, it is to be understood that the terminology used herein is for the purpose of describing particular embodiments only and is not intended to be limiting. It must be noted that, as used in the specification and the appended claims, the singular forms “a,” “an” and “the” include plural referents unless the context clearly dictates otherwise.

a. Animal

“Animal” as used herein may mean fish, amphibians, reptiles, birds, and mammals, such as mice, rats, rabbits, goats, cats, dogs, cows, apes and humans.

b. Attached

“Attached” or “immobilized” as used herein to refer to a probe and a solid support may mean that the binding between the probe and the solid support is sufficient to be stable under conditions of binding, washing, analysis, and removal. The binding may be covalent or non-covalent. Covalent bonds may be formed directly between the probe and the solid support or may be formed by a cross linker or by inclusion of a specific reactive group on either the solid support or the probe or both molecules. Non-covalent binding may be one or more of electrostatic, hydrophilic, and hydrophobic interactions. Included in non-covalent binding is the covalent attachment of a molecule, such as streptavidin, to the support and the non-covalent binding of a biotinylated probe to the streptavidin. Immobilization may also involve a combination of covalent and non-covalent interactions.

c. Biological Sample

“Biological sample” as used herein may mean a sample of biological tissue or fluid that comprises nucleic acids. Such samples include, but are not limited to, tissue isolated from animals. Biological samples may also include sections of tissues such as biopsy and autopsy samples, frozen sections taken for histologic purposes, blood, plasma, serum, sputum, stool, tears, mucus, hair, and skin. Biological samples also include explants and primary and/or transformed cell cultures derived from patient tissues. A biological sample may be provided by removing a sample of cells from an animal, but can also be accomplished by using previously isolated cells (e.g., isolated by another person, at another time, and/or for another purpose), or by performing the methods of the invention in vivo. Archival tissues, such as those having treatment or outcome history, may also be used.

d. Complement

“Complement” or “complementary” as used herein may mean Watson-Crick or Hoogsteen base pairing between nucleotides or nucleotide analogs of nucleic acid molecules.

e. Differential Expression

“Differential expression” may mean qualitative or quantitative differences in the temporal and/or cellular gene expression patterns within and among cells and tissue. Thus, a differentially expressed gene can qualitatively have its expression altered, including an activation or inactivation, in, e.g., normal versus disease tissue. Genes may be turned on or turned off in a particular state, relative to another state thus permitting comparison of two or more states. A qualitatively regulated gene will exhibit an expression pattern within a state or cell type which may be detectable by standard techniques. Some genes will be expressed in one state or cell type, but not in both. Alternatively, the difference in expression may be quantitative, e.g., in that expression is modulated, either up-regulated, resulting in an increased amount of transcript, or down-regulated, resulting in a decreased amount of transcript. The degree to which expression differs need only be large enough to quantify via standard characterization techniques such as expression arrays, quantitative reverse transcriptase PCR, northern analysis, and RNase protection.

f. Gene

“Gene” used herein may be a genomic gene comprising transcriptional and/or translational regulatory sequences and/or a coding region and/or non-translated sequences (e.g., introns, 5'- and 3'-untranslated sequences). The coding region of a gene may be a nucleotide sequence coding for an amino acid sequence or a functional RNA, such as tRNA, rRNA, catalytic RNA, siRNA, miRNA and antisense RNA. A gene may also be an mRNA or cDNA corresponding to the coding regions (e.g., exons and miRNA) optionally comprising 5'- or 3'-untranslated sequences linked thereto. A gene may also be an amplified nucleic acid molecule produced in vitro comprising all or a part of the coding region and/or 5'- or 3'-untranslated sequences linked thereto.

g. Host Cell

“Host cell” used herein may be a naturally occurring cell or a transformed cell that contains a vector and supports the replication of the vector. Host cells may be cultured cells, explants, cells in vivo, and the like. Host cells may be prokaryotic cells such as *E. coli*, or eukaryotic cells such as yeast, insect, amphibian, or mammalian cells, such as CHO, HeLa.

h. Identity

“Identical” or “identity” as used herein in the context of two or more nucleic acids or polypeptide sequences, may mean that the sequences have a specified percentage of nucleotides or amino acids that are the same over a specified region. The percentage may be calculated by comparing optimally aligning the two sequences, comparing the two sequences over the specified region, determining the number of positions at which the identical residue occurs in both sequences to yield the number of matched positions, dividing the number of matched positions by the total number of positions in the specified region, and multiplying the result by 100 to yield the percentage of sequence identity. In cases where the two sequences are of different lengths or the alignment produces staggered end and the specified region of comparison includes only a single sequence, the residues of single sequence are included in the denominator but not the numerator of the calculation. When comparing DNA and RNA, thymine (T) and uracil (U) are considered equivalent. Identity may be performed manually or by using computer sequence algorithm such as BLAST or BLAST 2.0.

i. Label

"Label" as used herein may mean a composition detectable by spectroscopic, photochemical, biochemical, immunochemical, chemical, or other physical means. For example, useful labels include $^{32}P$, fluorescent dyes, electron-dense reagents, enzymes (e.g., as commonly used in an ELISA), biotin, digoxigenin, or haptens and other entities which can be made detectable. A label may be incorporated into nucleic acids and proteins at any position.

j. Nucleic Acid

"Nucleic acid" or "oligonucleotide" or "polynucleotide" used herein may mean at least two nucleotides covalently linked together. As will be appreciated by those in the art, the depiction of a single strand also defines the sequence of the complementary strand. Thus, a nucleic acid also encompasses the complementary strand of a depicted single strand. As will also be appreciated by those in the art, many variants of a nucleic acid may be used for the same purpose as a given nucleic acid. Thus, a nucleic acid also encompasses substantially identical nucleic acids and complements thereof. As will also be appreciated by those in the art, a single strand provides a probe for a probe that may hybridize to the target sequence under stringent hybridization conditions. Thus, a nucleic acid also encompasses a probe that hybridizes under stringent hybridization conditions.

Nucleic acids may be single stranded or double stranded, or may contain portions of both double stranded and single stranded sequence. The nucleic acid may be DNA, both genomic and cDNA, RNA, or a hybrid, where the nucleic acid may contain combinations of deoxyribo- and ribo-nucleotides, and combinations of bases including uracil, adenine, thymine, cytosine, guanine, inosine, xanthine hypoxanthine, isocytosine and isoguanine. Nucleic acids may be obtained by chemical synthesis methods or by recombinant methods.

A nucleic acid will generally contain phosphodiester bonds, although nucleic acid analogs may be included that may have at least one different linkage, e.g., phosphoramidate, phosphorothioate, phosphorodithioate, or O-methylphosphoroamidite linkages and peptide nucleic acid backbones and linkages. Other analog nucleic acids include those with positive backbones; non-ionic backbones, and non-ribose backbones, including those described in U.S. Pat. Nos. 5,235,033 and 5,034,506, which are incorporated by reference. Nucleic acids containing one or more non-naturally occurring or modified nucleotides are also included within one definition of nucleic acids. The modified nucleotide analog may be located for example at the 5'-end and/or the 3'-end of the nucleic acid molecule. Representative examples of nucleotide analogs may be selected from sugar- or backbone-modified ribonucleotides. It should be noted, however, that also nucleobase-modified ribonucleotides, i.e. ribonucleotides, containing a non-naturally occurring nucleobase instead of a naturally occurring nucleobase such as uridines or cytidines modified at the 5-position, e.g. 5-(2-amino)propyl uridine, 5-bromo uridine; adenosines and guanosines modified at the 8-position, e.g. 8-bromo guanosine; deaza nucleotides, e.g. 7-deaza-adenosine; O- and N-alkylated nucleotides, e.g. N6-methyl adenosine are suitable. The 2'-OH-group may be replaced by a group selected from H, OR, R, halo, SH, SR, $NH_2$, NHR, $NR_2$ or CN, wherein R is $C_1$-$C_6$ alkyl, alkenyl or alkynyl and halo is F, Cl, Br or I. Modifications of the ribose-phosphate backbone may be done for a variety of reasons, e.g., to increase the stability and half-life of such molecules in physiological environments or as probes on a biochip. Mixtures of naturally occurring nucleic acids and analogs may be made; alternatively, mixtures of different nucleic acid analogs, and mixtures of naturally occurring nucleic acids and analogs may be made.

k. Operably Linked

"Operably linked" used herein may mean that expression of a gene is under the control of a promoter with which it is spatially connected. A promoter may be positioned 5' (upstream) or 3' (downstream) of the gene under its control. The distance between the promoter and the gene may be approximately the same as the distance between that promoter and the gene it controls in the gene from which the promoter is derived. As is known in the art, variation in this distance can be accommodated without loss of promoter function.

l. Probe

"Probe" as used herein may mean an oligonucleotide capable of binding to a target nucleic acid of complementary sequence through one or more types of chemical bonds, usually through complementary base pairing, usually through hydrogen bond formation. Probes may bind target sequences lacking complete complementarity with the probe sequence depending upon the stringency of the hybridization conditions. There may be any number of base pair mismatches which will interfere with hybridization between the target sequence and the single stranded nucleic acids of the present invention. However, if the number of mutations is so great that no hybridization can occur under even the least stringent of hybridization conditions, the sequence is not a complementary target sequence. A probe may be single stranded or partially single and partially double stranded. The strandedness of the probe is dictated by the structure, composition, and properties of the target sequence. Probes may be directly labeled or indirectly labeled such as with biotin to which a streptavidin complex may later bind.

m. Promoter

"Promoter" as used herein may mean a synthetic or naturally-derived molecule which is capable of conferring, activating or enhancing expression of a nucleic acid in a cell. A promoter may comprise one or more specific regulatory elements to further enhance expression and/or to alter the spatial expression and/or temporal expression of same. A promoter may also comprise distal enhancer or repressor elements, which can be located as much as several thousand base pairs from the start site of transcription. A promoter may be derived from sources including viral, bacterial, fungal, plants, insects, and animals. A promoter may regulate the expression of a gene component constitutively, or differentially with respect to cell, the tissue or organ in which expression occurs or, with respect to the developmental stage at which expression occurs, or in response to external stimuli such as physiological stresses, pathogens, metal ions, or inducing agents. Representative examples of promoters include the bacteriophage T7 promoter, bacteriophage T3 promoter, SP6 promoter, lac operator-promoter, tac promoter, SV40 late promoter, SV40 early promoter, RSV-LTR promoter, CMV IE promoter, SV40 early promoter or SV40 late promoter and the CMV IE promoter.

n. Selectable Marker

"Selectable marker" used herein may mean any gene which confers a phenotype on a cell in which it is expressed to facilitate the identification and/or selection of cells which are transfected or transformed with a genetic construct. Representative examples of selectable markers include the ampicillin-resistance gene ($Amp^r$), tetracycline-resistance gene ($Tc^r$), bacterial kanamycin-resistance gene ($Kan^r$), zeocin resistance gene, the AURI-C gene which confers resistance to the antibiotic aureobasidin A, phosphinothricin-resistance gene, neomycin phosphotransferase gene (nptII), hygromycin-resistance gene, beta-glucuronidase (GUS) gene, chloramphenicol acetyltransferase (CAT) gene, green fluorescent protein-encoding gene and luciferase gene.

o. Stringent Hybridization Conditions

"Stringent hybridization conditions" used herein may mean conditions under which a first nucleic acid sequence (e.g., probe) will hybridize to a second nucleic acid sequence (e.g., target), such as in a complex mixture of nucleic acids, but to no other sequences. Stringent conditions are sequence-dependent and will be different in different circumstances. Generally, stringent conditions are selected to be about 5-10° C. lower than the thermal melting point ($T_m$) for the specific sequence at a defined ionic strength pH. The $T_m$ may be the temperature (under defined ionic strength, pH, and nucleic concentration) at which 50% of the probes complementary to the target hybridize to the target sequence at equilibrium (as the target sequences are present in excess, at $T_m$, 50% of the probes are occupied at equilibrium). Stringent conditions may be those in which the salt concentration is less than about 1.0 M sodium ion, typically about 0.01-1.0 M sodium ion concentration (or other salts) at pH 7.0 to 8.3 and the temperature is at least about 30° C. for short probes (e.g., about 10-50 nucleotides) and at least about 60° C. for long probes (e.g., greater than about 50 nucleotides). Stringent conditions may also be achieved with the addition of destabilizing agents such as formamide. For selective or specific hybridization, a positive signal may be at least 2 to 10 times background hybridization. Exemplary stringent hybridization conditions include the following: 50% formamide, 5×SSC, and 1% SDS, incubating at 42° C., or, 5×SSC, 1% SDS, incubating at 65° C., with wash in 0.2×SSC, and 0.1% SDS at 65° C.

p. Substantially Complementary

"Substantially complementary" used herein may mean that a first sequence is at least 60%, 65%, 70%, 75%, 80%, 85%, 90%, 95%, 97%, 98% or 99% identical to the complement of a second sequence over a region of 8, 9, 10, 11, 12, 13, 14, 15, 16, 17, 18, 19, 20, 21, 22, 23, 24, 25, 30, 35, 40, 45, 50 or more nucleotides, or that the two sequences hybridize under stringent hybridization conditions.

q. Substantially Identical

"Substantially identical" used herein may mean that a first and second sequence are at least 60%, 65%, 70%, 75%, 80%, 85%, 90%, 95%, 97%, 98% or 99% identical over a region of 8, 9, 10, 11, 12, 13, 14, 15, 16, 17, 18, 19, 20, 21, 22, 23, 24, 25, 30, 35, 40, 45, 50 or more nucleotides or amino acids, or with respect to nucleic acids, if the first sequence is substantially complementary to the complement of the second sequence.

r. Target

"Target" as used herein may mean a polynucleotide that may be bound by one or more probes under stringent hybridization conditions.

s. Terminator

"Terminator" used herein may mean a sequence at the end of a transcriptional unit which signals termination of transcription. A terminator may be a 3'-non-translated DNA sequence containing a polyadenylation signal, which may facilitate the addition of polyadenylate sequences to the 3'-end of a primary transcript. A terminator may be derived from sources including viral, bacterial, fungal, plants, insects, and animals. Representative examples of terminators include the SV40 polyadenylation signal, HSV TK polyadenylation signal, CYC1 terminator, ADH terminator, SPA terminator, nopaline synthase (NOS) gene terminator of *Agrobacterium tumefaciens*, the terminator of the Cauliflower mosaic virus (CaMV) 35S gene, the zein gene terminator from *Zea mays*, the Rubisco small subunit gene (SSU) gene terminator sequences, subclover stunt virus (SCSV) gene sequence terminators, rho-independent *E. coli* terminators, and the lacZ alpha terminator.

t. Vector

"Vector" used herein may mean a nucleic acid sequence containing an origin of replication. A vector may be a plasmid, bacteriophage, bacterial artificial chromosome or yeast artificial chromosome. A vector may be a DNA or RNA vector. A vector may be either a self-replicating extrachromosomal vector or a vector which integrate into a host genome.

2. MicroRNA

Figure 1:
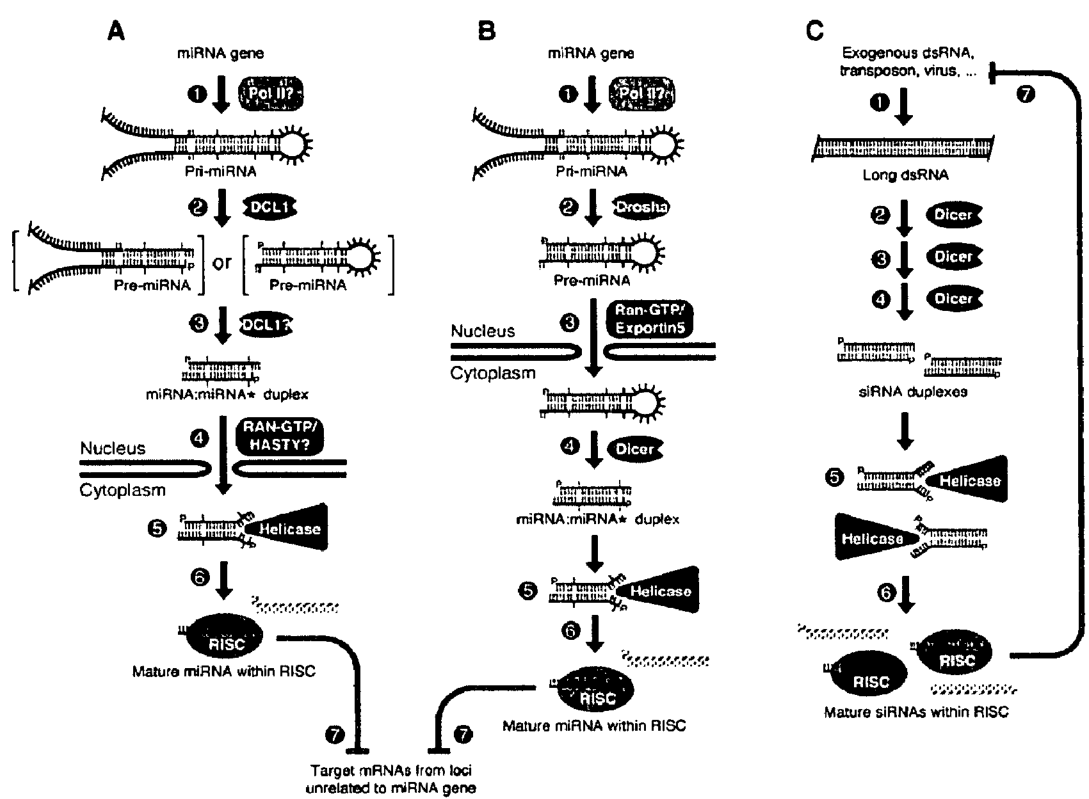
FIG. 1 demonstrates a model of maturation for miRNAs.

While not being bound by theory, the current model for the maturation of mammalian miRNAs is shown in FIG. 1. A gene coding for a miRNA may be transcribed leading to production of an miRNA precursor known as the pri-miRNA. The pri-miRNA may be part of a polycistronic RNA comprising multiple pri-miRNAs. The pri-miRNA may form a hairpin with a stem and loop. As indicated on FIG. 1, the stem may comprise mismatched bases.

The hairpin structure of the pri-miRNA may be recognized by Drosha, which is an RNase III endonuclease. Drosha may recognize terminal loops in the pri-miRNA and cleave approximately two helical turns into the stem to produce a 60-70 nt precursor known as the pre-miRNA. Drosha may cleave the pri-miRNA with a staggered cut typical of RNase III endonucleases yielding a pre-miRNA stem loop with a 5' phosphate and ~2 nucleotide 3' overhang. Approximately one helical turn of stem (~10 nucleotides) extending beyond the Drosha cleavage site may be essential for efficient processing. The pre-miRNA may then be actively transported from the nucleus to the cytoplasm by Ran-GTP and the export receptor Ex-portin-5.

The pre-miRNA may be recognized by Dicer, which is also an RNase III endonuclease. Dicer may recognize the double-stranded stem of the pre-miRNA. Dicer may also recognize the 5' phosphate and 3' overhang at the base of the stem loop. Dicer may cleave off the terminal loop two helical turns away from the base of the stem loop leaving an additional 5' phosphate and ~2 nucleotide 3' overhang. The resulting siRNA-like duplex, which may comprise mismatches, comprises the mature miRNA and a similar-sized fragment known as the miRNA*. The miRNA and miRNA* may be derived from opposing arms of the pri-miRNA and pre-miRNA. MiRNA* sequences may be found in libraries of cloned miRNAs but typically at lower frequency than the miRNAs.

Although initially present as a double-stranded species with miRNA*, the miRNA may eventually become incorporated as single-stranded RNAs into a ribonucleoprotein complex known as the RNA-induced silencing complex (RISC). Various proteins can form the RISC, which can lead to variability in specifity for miRNA/miRNA* duplexes, binding site of the target gene, activity of miRNA (repress or activate), which strand of the miRNA/miRNA* duplex is loaded in to the RISC.

When the miRNA strand of the miRNA:miRNA* duplex is loaded into the RISC, the miRNA* may be removed and degraded. The strand of the miRNA:miRNA* duplex that is loaded into the RISC may be the strand whose 5' end is less tightly paired. In cases where both ends of the miRNA: miRNA* have roughly equivalent 5' pairing, both miRNA and miRNA* may have gene silencing activity.

The RISC may identify target nucleic acids based on high levels of complementarity between the miRNA and the mRNA, especially by nucleotides 2-8 of the miRNA. Only one case has been reported in animals where the interaction between the miRNA and its target was along the entire length of the miRNA. This was shown for mir-196 and Hox B8 and it was further shown that mir-196 mediates the cleavage of the Hox B8 mRNA (Yekta et al 2004, Science 304-594). Otherwise, such interactions are known only in plants (Bartel & Bartel 2003, Plant Physiol 132-709).

A number of studies have looked at the base-pairing requirement between miRNA and its mRNA target for achieving efficient inhibition of translation (reviewed by Bartel 2004, Cell 116-281). In mammalian cells, the first 8 nucleotides of the miRNA may be important (Doench & Sharp 2004 GenesDev 2004-504). However, other parts of the microRNA may also participate in mRNA binding. Moreover, sufficient base pairing at the 3' can compensate for insufficient pairing at the 5' (Brennecke at al, 2005 PLoS 3-e85). Computation studies, analyzing miRNA binding on whole genomes have suggested a specific role for bases 2-7 at the 5' of the miRNA in target binding but the role of the first nucleotide, found usually to be “A” was also recognized (Lewis et at 2005 Cell 120-15). Similarly, nucleotides 1-7 or 2-8 were used to identify and validate targets by Krek et al (2005, Nat Genet 37-495).

The target sites in the mRNA may be in the 5' UTR, the 3' UTR or in the coding region. Interestingly, multiple miRNAs may regulate the same mRNA target by recognizing the same or multiple sites. The presence of multiple miRNA complementarity sites in most genetically identified targets may indicate that the cooperative action of multiple RISCs provides the most efficient translational inhibition.

MiRNAs may direct the RISC to downregulate gene expression by either of two mechanisms: mRNA cleavage or translational repression. The miRNA may specify cleavage of the mRNA if the mRNA has a certain degree of complementarity to the miRNA. When a miRNA guides cleavage, the cut may be between the nucleotides pairing to residues 10 and 11 of the miRNA. Alternatively, the miRNA may repress translation if the miRNA does not have the requisite degree of complementarity to the miRNA. Translational repression may be more prevalent in animals since animals may have a lower degree of complementarity.

It should be notes that there may be variability in the 5' and 3' ends of any pair of miRNA and miRNA*. This variability may be due to variability in the enzymatic processing of Drosha and Dicer with respect to the site of cleavage. Variability at the 5' and 3' ends of miRNA and miRNA* may also be due to mismatches in the stem structures of the pri-miRNA and pre-miRNA. The mismatches of the stem strands may lead to a population of different hairpin structures. Variability in the stem structures may also lead to variability in the products of cleavage by Drosha and Dicer.

3. Nucleic Acid

The present invention relates to an isolated nucleic acid comprising a nucleotide sequence referred to in SEQ ID NOS: 1-760616, the sequences set forth on the Sequence Listing of U.S. patent application Ser. No. 10/709,572, the contents of which are incorporated herein by reference, and the sequences set forth on the Sequence Listing of U.S. Provisional Patent Application No. 60/655,094, the contents of which are incorporated herein by reference, or variants thereof. The variant may be a complement of the referenced nucleotide sequence. The variant may also be a nucleotide sequence that is substantially identical to the referenced nucleotide sequence or the complement thereof. The variant may also be a nucleotide sequence which hybridizes under stringent conditions to the referenced nucleotide sequence, complements thereof, or nucleotide sequences substantially identical thereto.

The nucleic acid may have a length of from 10 to 100 nucleotides. The nucleic acid may have a length of at least 10, 11, 12, 13, 14, 15, 16, 17, 18, 19, 20, 21, 22, 23, 24, 25, 26, 27, 28, 29, 30, 35, 40, 45, 50, 60, 70, 80 or 90 nucleotides. The nucleic acid may be synthesized or expressed in a cell (in vitro or in vivo) using a synthetic gene described below. The nucleic acid may be synthesized as a single strand molecule and hybridized to a substantially complementary nucleic acid to form a duplex, which is considered a nucleic acid of the invention. The nucleic acid may be introduced to a cell, tissue or organ in a single- or double-stranded form or capable of being expressed by a synthetic gene using methods well known to those skilled in the art, including as described in U.S. Pat. No. 6,506,559 which is incorporated by reference.

a. Pri-MiRNA

The nucleic acid of the invention may comprise a sequence of a pri-miRNA or a variant thereof. The pri-miRNA sequence may comprise from 45-250, 55-200, 70-150 or 80-100 nucleotides. The sequence of the pri-miRNA may comprise a pre-miRNA, miRNA and miRNA* as set forth below. The pri-miRNA may also comprise a miRNA or miRNA* and the complement thereof, and variants thereof. The pri-miRNA may comprise at least 19% adenosine nucleotides, at least 16% cytosine nucleotides, at least 23% thymine nucleotides and at least 19% guanine nucleotides.

The pri-miRNA may form a hairpin structure. The hairpin may comprise a first and second nucleic acid sequence that are substantially complimentary. The first and second nucleic acid sequence may be from 37-50 nucleotides. The first and second nucleic acid sequence may be separated by a third sequence of from 8-12 nucleotides. The hairpin structure may have a free energy less than −25 Kcal/mole as calculated by the Vienna algorithm with default parameters, as described in Hofacker et al., Monatshefte f. Chemie 125: 167-188 (1994), the contents of which are incorporated herein. The hairpin may comprise a terminal loop of 4-20, 8-12 or 10 nucleotides.

The sequence of the pri-miRNA may comprise the sequence of a hairpin referred to in Table 1, the sequence of sequence identifiers 6757248-6894882 of the Sequence Listing of U.S. patent application Ser. No. 10/709,572, the contents of which are incorporated herein by reference, the sequence of sequence identifiers 1-6318 or 18728-18960 of the Sequence Listing of U.S. Provisional Patent Application No. 60/655,094, the contents of which are incorporated herein by reference, or variants thereof.

b. Pre-MiRNA

The nucleic acid of the invention may also comprise a sequence of a pre-miRNA or a variant thereof. The pre-miRNA sequence may comprise from 45-90, 60-80 or 60-70 nucleotides. The sequence of the pre-miRNA may comprise a miRNA and a miRNA* as set forth below. The pre-miRNA may also comprise a miRNA or miRNA* and the complement thereof, and variants thereof. The sequence of the pre-miRNA may also be that of a pri-miRNA excluding from 0-160 nucleotides from the 5' and 3' ends of the pri-miRNA.

The sequence of the pre-miRNA may comprise the sequence of a hairpin referred to in Table 1, the sequence of sequence identifiers 6757248-6894882 of the Sequence Listing of U.S. patent application Ser. No. 10/709,572, the contents of which are incorporated herein by reference, the sequence of sequence identifiers 1-6318 or 18728-18960 of the Sequence Listing of U.S. Provisional Patent Application No. 60/655,094, the contents of which are incorporated herein by reference, or variants thereof.

c. MiRNA

The nucleic acid of the invention may also comprise a sequence of a miRNA, miRNA* or a variant thereof. The miRNA sequence may comprise from 13-33, 18-24 or 21-23 nucleotides. The sequence of the miRNA may be the first 13-33 nucleotides of the pre-miRNA. The sequence of the miRNA may be the last 13-33 nucleotides of the pre-miRNA.

The sequence of the miRNA may comprise the sequence of a miRNA referred to in Table 1, the sequence of sequence identifiers 1-117750 or 6894883-10068177 of the Sequence Listing of U.S. patent application Ser. No. 10/709,572, the contents of which are incorporated herein by reference, the sequence of sequence identifiers 6319-18727 or 18961-19401 of the Sequence Listing of U.S. Provisional Patent Application No. 60/655,094, the contents of which are incorporated herein by reference, or variants thereof.

d. Anti-miRNA

The nucleic acid of the invention may also comprise a sequence of an anti-miRNA that is capable of blocking the activity of a miRNA or miRNA*. The anti-miRNA may comprise a total of 5-100 or 10-60 nucleotides. The anti-miRNA may also comprise a total of at least 5, 6, 7, 8, 9, 10, 11, 12, 13, 14, 15, 16, 17, 18, 19, 20, 21, 22, 23, 24, 25 or 26 nucleotides. The sequence of the anti-miRNA may comprise (a) at least 5 nucleotides that are substantially identical to the 5' of a miRNA and at least 5-12 nucleotide that are substantially complimentary to the flanking regions of the target site from the 5' end of said miRNA, or (b) at least 5-12 nucleotides that are substantially identical to the 3' of a miRNA and at least 5 nucleotide that are substantially complimentary to the flanking region of the target site from the 3' end of said miRNA.

The sequence of the anti-miRNA may comprise the compliment of a sequence of a miRNA referred to in Table 1, the sequence of sequence identifiers 1-117750 or 6894883-10068177 of the Sequence Listing of U.S. patent application Ser. No. 10/709,572, the contents of which are incorporated herein by reference, the sequence of sequence identifiers 6319-18727 or 18961-19401 of the Sequence Listing of U.S. Provisional Patent Application No. 60/655,094, the contents of which are incorporated herein by reference, or variants thereof.

e. Binding Site of Target

The nucleic acid of the invention may also comprise a sequence of a target miRNA binding site, or a variant thereof. The target site sequence may comprise a total of 5-100 or 10-60 nucleotides. The target site sequence may comprise at least 5 nucleotides of the sequence of a target gene binding site referred to in Table 4, the sequence of sequence identifiers 117751-6757247 of the Sequence Listing of U.S. patent application Ser. No. 10/709,572, the contents of which are incorporated herein by reference, or variants thereof.

4. Synthetic Gene

The present invention also relates to a synthetic gene comprising a nucleic acid of the invention operably linked to a transcriptional and/or translational regulatory sequences. The synthetic gene may be capable of modifying the expression of a target gene with a binding site for the nucleic acid of the invention. Expression of the target gene may be modified in a cell, tissue or organ. The synthetic gene may be synthesized or derived from naturally-occurring genes by standard recombinant techniques. The synthetic gene may also comprise terminators at the 3'-end of the transcriptional unit of the synthetic gene sequence. The synthetic gene may also comprise a selectable marker.

5. Vector

The present invention also relates to a vector comprising a synthetic gene of the invention. The vector may be an expression vector. An expression vector may comprise additional elements. For example, the expression vector may have two replication systems allowing it to be maintained in two organisms, e.g., in mammalian or insect cells for expression and in a prokaryotic host for cloning and amplification. For integrating expression vectors, the expression vector may contain at least one sequence homologous to the host cell genome, and preferably two homologous sequences which flank the expression construct. The integrating vector may be directed to a specific locus in the host cell by selecting the appropriate homologous sequence for inclusion in the vector. The vector may also comprise a selectable marker gene to allow the selection of transformed host cells.

6. Host Cell

The present invention also relates to a host cell comprising a vector of the invention. The cell may be a bacterial, fungal, plant, insect or animal cell.

7. Probes

The present invention also relates to a probe comprising a nucleic acid of the invention. Probes may be used for screening and diagnostic methods, as outlined below. The probe may be attached or immobilized to a solid substrate, such as a biochip.

The probe may have a length of from 8 to 500, 10 to 100 or 20 to 60 nucleotides. The probe may also have a length of at least 8, 9, 10, 11, 12, 13, 14, 15, 16, 17, 18, 19, 20, 21, 22, 23, 24, 25, 26, 27, 28, 29, 30, 35, 40, 45, 50, 60, 70, 80, 90, 100, 120, 140, 160, 180, 200, 220, 240, 260, 280 or 300 nucleotides. The probe may further comprise a linker sequence of from 10-60 nucleotides.

8. Biochip

The present invention also relates to a biochip. The biochip may comprise a solid substrate comprising an attached probe or plurality of probes of the invention. The probes may be capable of hybridizing to a target sequence under stringent hybridization conditions. The probes may be attached at spatially defined address on the substrate. More than one probe per target sequence may be used, with either overlapping probes or probes to different sections of a particular target sequence. The probes may be capable of hybridizing to target sequences associated with a single disorder.

The probes may be attached to the biochip in a wide variety of ways, as will be appreciated by those in the art. The probes may either be synthesized first, with subsequent attachment to the biochip, or may be directly synthesized on the biochip.

The solid substrate may be a material that may be modified to contain discrete individual sites appropriate for the attachment or association of the probes and is amenable to at least one detection method. Representative examples of substrates include glass and modified or functionalized glass, plastics (including acrylics, polystyrene and copolymers of styrene and other materials, polypropylene, polyethylene, polybutylene, polyurethanes, TeflonJ, etc.), polysaccharides, nylon or nitrocellulose, resins, silica or silica-based materials including silicon and modified silicon, carbon, metals, inorganic glasses and plastics. The substrates may allow optical detection without appreciably fluorescing.

The substrate may be planar, although other configurations of substrates may be used as well. For example, probes may be placed on the inside surface of a tube, for flow-through sample analysis to minimize sample volume. Similarly, the substrate may be flexible, such as a flexible foam, including closed cell foams made of particular plastics.

The biochip and the probe may be derivatized with chemical functional groups for subsequent attachment of the two. For example, the biochip may be derivatized with a chemical functional group including, but not limited to, amino groups, carboxyl groups, oxo groups or thiol groups. Using these functional groups, the probes may be attached using functional groups on the probes either directly or indirectly using a linkers. The probes may be attached to the solid support by either the 5' terminus, 3' terminus, or via an internal nucleotide.

The probe may also be attached to the solid support non-covalently. For example, biotinylated oligonucleotides can be made, which may bind to surfaces covalently coated with streptavidin, resulting in attachment. Alternatively, probes may be synthesized on the surface using techniques such as photopolymerization and photolithography.

9. miRNA Expression Analysis

The present invention also relates to a method of identifying miRNAs that are associated with disease or a pathological condition comprising contacting a biological sample with a probe or biochip of the invention and detecting the amount of hybridization. PCR may be used to amplify nucleic acids in the sample, which may provide higher sensitivity.

The ability to identify miRNAs that are overexpressed or underexpressed in pathological cells compared to a control can provide high-resolution, high-sensitivity datasets which may be used in the areas of diagnostics, therapeutics, drug development, pharmacogenetics, biosensor development, and other related areas. An expression profile generated by the current methods may be a "fingerprint" of the state of the sample with respect to a number of miRNAs. While two states may have any particular miRNA similarly expressed, the evaluation of a number of miRNAs simultaneously allows the generation of a gene expression profile that is characteristic of the state of the cell. That is, normal tissue may be distinguished from diseased tissue. By comparing expression profiles of tissue in known different disease states, information regarding which miRNAs are associated in each of these states may be obtained. Then, diagnosis may be performed or confirmed to determine whether a tissue sample has the expression profile of normal or disease tissue. This may provide for molecular diagnosis of related conditions.

10. Determining Expression Levels

The present invention also relates to a method of determining the expression level of a disease-associated miRNA comprising contacting a biological sample with a probe or biochip of the invention and measuring the amount of hybridization. The expression level of a disease-associated miRNA is information in a number of ways. For example, a differential expression of a disease-associated miRNA compared to a control may be used as a diagnostic that a patient suffers from the disease. Expression levels of a disease-associated miRNA may also be used to monitor the treatment and disease state of a patient. Furthermore, expression levels of e disease-associated miRNA may allow the screening of drug candidates for altering a particular expression profile or suppressing an expression profile associated with disease.

A target nucleic acid may be detected by contacting a sample comprising the target nucleic acid with a biochip comprising an attached probe sufficiently complementary to the target nucleic acid and detecting hybridization to the probe above control levels.

The target nucleic acid may also be detected by immobilizing the nucleic acid to be examined on a solid support such as nylon membranes and hybridizing a labelled probe with the sample. Similarly, the target nucleic may also be detected by immobilizing the labeled probe to the solid support and hybridizing a sample comprising a labeled target nucleic acid. Following washing to remove the non-specific hybridization, the label may be detected.

The target nucleic acid may also be detected in situ by contacting permeabilized cells or tissue samples with a labeled probe to allow hybridization with the target nucleic acid. Following washing to remove the non-specifically bound probe, the label may be detected.

These assays can be direct hybridization assays or can comprise sandwich assays, which include the use of multiple probes, as is generally outlined in U.S. Pat. Nos. 5,681,702; 5,597,909; 5,545,730; 5,594,117; 5,591,584; 5,571,670; 5,580,731; 5,571,670; 5,591,584; 5,624,802; 5,635,352; 5,594,118; 5,359,100; 5,124,246; and 5,681,697, each of which is hereby incorporated by reference.

A variety of hybridization conditions may be used, including high, moderate and low stringency conditions as outlined above. The assays may be performed under stringency conditions which allow hybridization of the probe only to the target. Stringency can be controlled by altering a step parameter that is a thermodynamic variable, including, but not limited to, temperature, formamide concentration, salt concentration, chaotropic salt concentration pH, or organic solvent concentration.

Hybridization reactions may be accomplished in a variety of ways. Components of the reaction may be added simultaneously, or sequentially, in different orders. In addition, the reaction may include a variety of other reagents. These include salts, buffers, neutral proteins, e.g., albumin, detergents, etc. which may be used to facilitate optimal hybridization and detection, and/or reduce non-specific or background interactions. Reagents that otherwise improve the efficiency of the assay, such as protease inhibitors, nuclease inhibitors and anti-microbial agents may also be used as appropriate, depending on the sample preparation methods and purity of the target.

a. Diagnostic

The present invention also relates to a method of diagnosis comprising detecting a differential expression level of a disease-associated miRNA in a biological sample. The sample may be derived from a patient. Diagnosis of a disease state in a patient allows for prognosis and selection of therapeutic strategy. Further, the developmental stage of cells may be classified by determining temporarily expressed miRNA-molecules.

In situ hybridization of labeled probes to tissue arrays may be performed. When comparing the fingerprints between an individual and a standard, the skilled artisan can make a diagnosis, a prognosis, or a prediction based on the findings. It is further understood that the genes which indicate the diagnosis may differ from those which indicate the prognosis and molecular profiling of the condition of the cells may lead to distinctions between responsive or refractory conditions or may be predictive of outcomes.

b. Drug Screening

The present invention also relates to a method of screening therapeutics comprising contacting a pathological cell capable of expressing a disease related miRNA with a candidate therapeutic and evaluating the effect of a drug candidate on the expression profile of the disease associated miRNA. Having identified the differentially expressed miRNAs, a variety of assays may be executed. Test compounds may be screened for the ability to modulate gene expression of the disease associated miRNA. Modulation includes both an increase and a decrease in gene expression.

The test compound or drug candidate may be any molecule, e.g., protein, oligopeptide, small organic molecule, polysaccharide, polynucleotide, etc., to be tested for the capacity to directly or indirectly alter the disease phenotype or the expression of the disease associated miRNA. Drug candidates encompass numerous chemical classes, such as small organic molecules having a molecular weight of more than 100 and less than about 500, 1,000, 1,500, 2,000 or 2,500 daltons. Candidate compounds may comprise functional groups necessary for structural interaction with proteins, particularly hydrogen bonding, and typically include at least an amine, carbonyl, hydroxyl or carboxyl group, preferably at least two of the functional chemical groups. The candidate agents may comprise cyclical carbon or heterocyclic structures and/or aromatic or polyaromatic structures substituted with one or more of the above functional groups. Candidate agents are also found among biomolecules including peptides, saccharides, fatty acids, steroids, purines, pyrimidines, derivatives, structural analogs or combinations thereof.

Combinatorial libraries of potential modulators may be screened for the ability to bind to the disease associated miRNA or to modulate the activity thereof. The combinatorial library may be a collection of diverse chemical compounds generated by either chemical synthesis or biological synthesis by combining a number of chemical building blocks such as reagents. Preparation and screening of combinatorial chemical libraries is well known to those of skill in the art. Such combinatorial chemical libraries include, but are not limited to, peptide libraries encoded peptides, benzodiazepines, diversomers such as hydantoins, benzodiazepines and dipeptide, vinylogous polypeptides, analogous organic syntheses of small compound libraries, oligocarbamates, and/or peptidyl phosphonates, nucleic acid libraries, peptide nucleic acid libraries, antibody libraries, carbohydrate libraries, and small organic molecule libraries.

11. Gene Silencing

The present invention also relates to a method of using the nucleic acids of the invention to reduce expression of a target gene in a cell, tissue or organ. Expression of the target gene may be reduced by expressing a nucleic acid of the invention that comprises a sequence substantially complementary to one or more binding sites of the target mRNA. The nucleic acid may be a miRNA or a variant thereof. The nucleic acid may also be pri-miRNA, pre-miRNA, or a variant thereof, which may be processed to yield a miRNA. The expressed miRNA may hybridize to a substantially complementary binding site on the target mRNA, which may lead to activation of RISC-mediated gene silencing. An example for a study employing over-expression of miRNA is Yekta et al 2004, Science 304-594, which is incorporated herein by reference. One of ordinary skill in the art will recognize that the nucleic acids of the present invention may be used to inhibit expression of target genes using antisense methods well known in the art, as well as RNAi methods described in U.S. Pat. Nos. 6,506,559 and 6,573,099, which are incorporated by reference.

The target of gene silencing may be a protein that causes the silencing of a second protein. By repressing expression of the target gene, expression of the second protein may be increased. Examples for efficient suppression of miRNA expression are the studies by Esau et al 2004 JBC 275-52361; and Cheng et al 2005 Nucleic Acids Res. 33-1290, which is incorporated herein by reference.

12. Gene Enhancement

The present invention also relates to a method of using the nucleic acids of the invention to increase expression of a target gene in a cell, tissue or organ. Expression of the target gene may be increased by expressing a nucleic acid of the invention that comprises a sequence substantially complementary to a pri-miRNA, pre-miRNA, miRNA or a variant thereof. The nucleic acid may be an anti-miRNA. The anti-miRNA may hybridize with a pri-miRNA, pre-miRNA or miRNA, thereby reducing its gene repression activity. Expression of the target gene may also be increased by expressing a nucleic acid of the invention that is substantially complementary to a portion of the binding site in the target gene, such that binding of the nucleic acid to the binding site may prevent miRNA binding.

13. Therapeutic

The present invention also relates to a method of using the nucleic acids of the invention as modulators or targets of disease or disorders associated with developmental dysfunctions, such as cancer. In general, the claimed nucleic acid molecules may be used as a modulator of the expression of genes which are at least partially complementary to said nucleic acid. Further, miRNA molecules may act as target for therapeutic screening procedures, e.g. inhibition or activation of miRNA molecules might modulate a cellular differentiation process, e.g. apoptosis.

Furthermore, existing miRNA molecules may be used as starting materials for the manufacture of sequence-modified miRNA molecules, in order to modify the target-specificity thereof, e.g. an oncogene, a multidrug-resistance gene or another therapeutic target gene. Further, miRNA molecules can be modified, in order that they are processed and then generated as double-stranded siRNAs which are again directed against therapeutically relevant targets. Furthermore, miRNA molecules may be used for tissue reprogramming procedures, e.g. a differentiated cell line might be transformed by expression of miRNA molecules into a different cell type or a stem cell.

14. Compositions

The present invention also relates to a pharmaceutical composition comprising the nucleic acids of the invention and optionally a pharmaceutically acceptable carrier. The compositions may be used for diagnostic or therapeutic applications. The administration of the pharmaceutical composition may be carried out by known methods, wherein a nucleic acid is introduced into a desired target cell in vitro or in vivo. Commonly used gene transfer techniques include calcium phosphate, DEAE-dextran, electroporation, microinjection, viral methods and cationic liposomes.

15. Kits

The present invention also relates to kits comprising a nucleic acid of the invention together with any or all of the following: assay reagents, buffers, probes and/or primers, and sterile saline or another pharmaceutically acceptable emulsion and suspension base. In addition, the kits may include instructional materials containing directions (e.g., protocols) for the practice of the methods of this invention.

EXAMPLE 1

Prediction Of MiRNAs

We surveyed the entire human genome for potential miRNA coding genes using two computational approaches similar to those described in U.S. Patent Application No. 60/522,459, Ser. Nos. 10/709,577 and 10/709,572, the contents of which are incorporated herein by reference, for predicting miRNAs. Briefly, non-protein coding regions of the entire human genome were scanned for hairpin structures. The predicted hairpins and potential miRNAs were scored by thermodynamic stability, as well as structural and contextual features. The algorithm was calibrated by using miRNAs in the Sanger Database which had been validated.

1. First Screen

Table 2 of U.S. patent application Ser. No. 10/709,572, the contents of which are incorporated herein by reference, shows the sequence ("PRECURSOR SEQUENCE"), sequence identifier ("PRECUR SEQ-ID") and organism of origin ("GAM ORGANISM") for each predicted hairpin from the first computational screen, together with the predicted miRNAs ("GAM NAME"). Table 1 of U.S. patent application Ser. No. 10/709,572, the contents of which are incorporated herein by reference, shows the sequence ("GAM RNA SEQUENCE") and sequence identifier ("GAM SEQ-ID") for each miRNA ("GAM NAME"), along with the organism of origin ("GAM ORGANISM") and Dicer cut location ("GAM POS"). The sequences of the predicted hairpins and miRNA are also set forth on the Sequence Listing of U.S. patent application Ser. No. 10/709,572, the contents of which are incorporated herein by reference.

2. Second Screen

Table 1 lists the SEQ ID NO for each predicted hairpin ("HID") of the second computational screen. Table 1 also lists the genomic location for each hairpin ("Hairpin Location"). The format for the genomic location is a concatenation of <chr_id><strand><start position>. For example, 19+135460000 refers chromosome 19, +strand, start position 135460000. Chromosomes 23-25 refer to chromosome X, chromosome Y and mitochondrial DNA. The chromosomal location is based on the hg17 assembly of the human genome by UCSC, which is based on NCBI Build 35 version 1 and was produced by the International Human Genome Sequencing Consortium.

Table 1 also lists whether the hairpin is conserved in evolution ("C"). There is an option that there is a paper of the genome version. The hairpins were identified as conserved ("Y") or nonconserved ("N") by using phastCons data. The phastCons data is a measure of evolutionary conservation for each nucleotide in the human genome against the genomes of chimp, mouse, rat, dog, chicken, frog, and zebrafish, based on a phylo-HMM using best-in-genome pair wise alignment for each species based on BlastZ, followed by multiZ alignment of the 8 genomes (Siepel et al, J. Comput. Biol 11, 413-428, 2004 and Schwartz et al., Genome Res. 13, 103-107, 2003). A hairpin is listed as conserved if the average phastCons conservation score over the 7 species in any 15 nucleotide sequence within the hairpin stem is at least 0.9 (Berezikov, E. et al. Phylogenetic Shadowing and Computational Identification of Human microRNA Genes. Cell 120, 21-24, 2005).

Table 1 also lists the genomic type for each hairpin ("T") as either intergenic ("G"), intron ("I") or exon ("E"). Table 1 also lists the SEQ ID NO ("MID") for each predicted miRNA and miRNA*. Table 1 also lists the prediction score grade for each hairpin ("P") on a scale of 0-1 (1 the hairpin is the most reliable), as described in Hofacker et al., Monatshefte f. Chemie 125: 167-188, 1994. If the grade is zero or null, they are transformed to the lower value of PalGrade that its p-value is <0.05. Table 1 also lists the p-value ("Pval") calculated out of background hairpins for the values of each P scores. As shown in Table, there are few instances where the Pval is >0.05. In each of these cases, the hairpins are highly conserved or they have been validated (F=Y).

Table 1 also lists whether the miRNAs were validated by expression analysis ("E") (Y=Yes, N=No), as detailed in Table 2. Table 1 also lists whether the miRNAs were validated by sequencing ("S") (Y=Yes, N=No). If there was a difference in sequences between the predicted and sequenced miRNAs, the sequenced sequence is predicted. It should be noted that failure to sequence or detect expression of a miRNA does not necessarily mean that a miRNA does not exist. Such undetected miRNAs may be expressed in tissues other than those tested. In addition, such undetected miRNAs may be expressed in the test tissues, but at a difference stage or under different condition than those of the experimental cells.

Table 1 also listed whether the miRNAs were shown to be differentially expressed ("D") (Y=Yes, N=No) in at least one disease, as detailed in Table 2). Table 1 also whether the miRNAs were present ("F") (Y=Yes, N=No) in Sanger DB Release 6.0 (April 2005) (http://nar.oupjournals.org/) as being detected in humans or mice or predicted in humans. As discussed above, the miRNAs listed in the Sanger database are a component of the prediction algorithm and a control for the output.

Table 1 also lists a genetic location cluster ("LC") for those hairpins that are within 5,000 nucleotides of each other. Each miRNA that has the same LC share the same genetic cluster. Table 1 also lists a seed cluster ("SC") to group miRNAs by their seed of 2-7 by an exact match. Each miRNA that has the same SC have the same seed. For a discussion of seed lengths of 5 nucleotides, see Lewis et al., Cell, 120; 15-20 (2005).

EXAMPLE 2

Prediction of Target Genes

The predicted miRNAs from the two computational screens of Example 1 were then used to predict target genes and their binding sites using two computational approaches similar to those described in U.S. Patent Application No. 60/522,459, Ser. Nos. 10/709,577 and 10/709,572, the contents of which are incorporated herein by reference, for predicting miRNAs.

1. First Screen

Table 6 of U.S. patent application Ser. No. 10/709,572, the contents of which are incorporated herein by reference, lists the predicted target genes ("TARGET") and binding site sequence ("TARGET BINDING SITE SEQUENCE") and binding site sequence identifier ("TARGET BINDING SITE SEQ-ID") from the first computational screen, as well as the organism of origin for the target ("TARGET ORGANISM"). Table 12 of U.S. patent application Ser. No. 10/709,572, the contents of which are incorporated herein by reference, lists the diseases ("DISEASE NAME") that are associated with the target genes ("TARGET-GENES ASSOCIATED WITH DISEASE"). Table 14 of U.S. patent application Ser. No. 10/709,572, the contents of which are incorporated herein by reference, lists the sequence identifiers for the miRNAs ("SEQ ID NOs OF GAMS ASSOCIATED WITH DISEASE") and the diseases ("DISEASE NAME") that are associated with the miRNA based on the target gene. The sequences of the binding site sequences are also set forth on the Sequence Listing of U.S. patent application Ser. No. 10/709,572, the contents of which are incorporated herein by reference.

2. Second Screen

Table 4 lists the predicted target gene for each miRNA (MID) and its hairpin (HID) from the second computational screen. The names of the target genes were taken from NCBI Reference Sequence release 9; Pruitt et al., Nucleic Acids Res, 33(1):D501-D504, 2005; Pruitt et al., Trends Genet., 16(1):44-47, 2000; and Tatusova et al., Bioinformatics, 15(7-8):536-43, 1999). Target genes were identified by having a perfect complimentary match of a 7 nucleotide miRNA seed (positions 2-8) and an A on the UTR (total=8 nucleotides). For a discussion on identifying target genes, see Lewis et al., Cell, 120: 15-20, (2005). For a discussion of the seed being sufficient for binding of a miRNA to a UTR, see Lim Lau et al., (Nature 2005) and Brenneck et al, (PLoS Biol 2005).

Binding sites were then predicted using a filtered target genes dataset by including only those target genes that contained a UTR of a least 30 nucleotides. The binding site screen only considered the first 4000 nucleotides per UTR and considered the longest transcript when there were several transcripts per gene. The filtering reduced the total number of transcripts from 23626 to 14239. Table 4 lists the SEQ ID NO for the predicted binding sites for each target gene. The sequence of the binding site includes the 20 nucleotides 5' and 3' of the binding site as they are located on the spliced mRNA. Except for those miRNAs that have only a single predicted binding site or those miRNAs that were validated, the data in Table 4 has been filtered to only indicate those target genes with at least 2 binding sites.

Table 5 shows the relationship between the miRNAs ("MID")/hairpins ("HID") and diseases by their target genes. The name of diseases are taken from OMIM. For a discussion of the rational for connecting the host gene the hairpin is located upon to disease, see Baskerville and Bartel, RNA, 11: 241-247 (2005) and Rodriguez et al., Genome Res., 14: 1902-1910 (2004). Table 5 shows the number of miRNA target genes ("N") that are related to the disease. Table 5 also shows the total number of genes that are related to the disease ("T"), which is taken from the genes that were predicted to have binding sites for miRNAs. Table 5 also shows the percentage of N out of T and the p-value of hypergeometric analysis ("Pval"). Table 8 shows the disease codes for Tables 5 and 6. For a reference of hypergeometric analysis, see Schaum's Outline of Elements of Statistics II: Inferential Statistics.

Table 6 shows the relationship between the miRNAs ("MID")/hairpins ("HID") and diseases by their host genes. We defined hairpins genes on the complementary strand of a host gene as located on the gene: Intron_c as Interon and Exon_c as Exon. We choose the complementary strands as they can cause disease. For example, a mutation in the miRNA that is located on the complementary strand. In those case that a miRNA in on both strands, two statuses like when Intron and Exon_c Intron is the one chosen. The logic of choosing is Intron>Exon>Intron_c>Exon_c>Intergenic. Table 9 shows the relationship between the target sequences ("Gene Name") and disease ("Disease Code").

EXAMPLE 3

Validation of MiRNAs

1. Expression Analysis—Set 1

To confirm the hairpins and miRNAs predicted in Example 1, we detected expression in various tissues using the high-throughput microarrays similar to those described in U.S. Patent Application No. 60/522,459, Ser. Nos. 10/709,577 and 10/709,572, the contents of which are incorporated herein by reference. For each predicted precursor miRNA, mature miRNAs derived from both stems of the hairpin were tested.

Table 2 shows the hairpins ("HID") of the second prediction set that were validated by detecting expression of related miRNAs ("MID"), as well as a code for the tissue ("Tissue") that expression was detected. The tissue and diseases codes for Table 2 are listed in Table 7. Some of the tested tissues wee cell line. Lung carcinoma cell line (H1299) with/without P53: H1299 has a mutated P53. The cell line was transfected with a construct with P53 that is temperature sensitive (active at 32° C.). The experiment was conducted at 32° C.

Table 2 also shows the chip expression score grade (range of 500-65000). A threshold of 500 was used to eliminate non-significant signals and the score was normalized by MirChip probe signals from different experiments. Variations in the intensities of fluorescence material between experiments may be due to variability in RNA preparation or labeling efficiency. We normalized based on the assumption that the total amount of miRNAs in each sample is relatively constant. First we subtracted the background signal from the raw signal of each probe, where the background signal is defined as 400. Next, we divided each miRNA probe signal by the average signal of all miRNAs, multiplied the result by 10000 and added back the background signal of 400. Thus, by definition, the sum of all miRNA probe signals in each experiment is 10400.

Table 2 also shows a statistical analysis of the normalized signal ("Spval") calculated on the normalized score. For each miRNA, we used a relevant control group out of the full predicted miRNA list. Each miRNA has an internal control of probes with mismatches. The relevant control group contained probes with similar C and G percentage (abs diff <5%) in order to have similar Tm. The probe signal P value is the ratio over the relevant control group probes with the same or higher signals. The results are p-value ≦0.05 and score is above 500. In those cases that the SPVal is listed as 0.0, the value is less than 0.0001.

2. Expression Analysis—Set 2

To further confirm the hairpins and miRNAs predicted in 0, we detected expression in additional tissues. Table 2 of U.S. Provisional Patent Application No. 60/655,094, which is incorporated herein by reference, lists expression data of miRNAs by the following: HID: hairpin sequence identifier for sequence set forth in the Sequence Listing of U.S. Provisional Patent Application No. 60/655,094, which is incorporated herein by reference; MID: miRNA sequence identifier for sequence set forth in the Sequence Listing of U.S. Provisional Patent Application No. 60/655,094, which is incorporated herein by reference; Tissue: tested tissue; S: chip expression score grade (range=100-65000); Dis. Diff. Exp.: disease related differential expression and the tissue it was tested in; R: ratio of disease related expression (range=0.01-99.99); and abbreviations: Brain Mix A—a mixture of brain tissue that are affected in Alzheimer; Brain Mix B—a mixture of all brain tissues; and Brain SN—Substantia Nigra.

3. Sequencing

To further validate the hairpins ("HID") of the second prediction, a number of miRNAs were validated by sequencing methods similar to those described in U.S. Patent Application No. 60/522,459, Ser. Nos. 10/709,577 and 10/709,572, the contents of which are incorporated herein by reference. Table 3 shows the hairpins ("HID") that were validated by sequencing a miRNA (MID) in the indicated tissue ("Tissue").

EXAMPLE 4

MiRNAs of Chromosome 19

Figure 2:
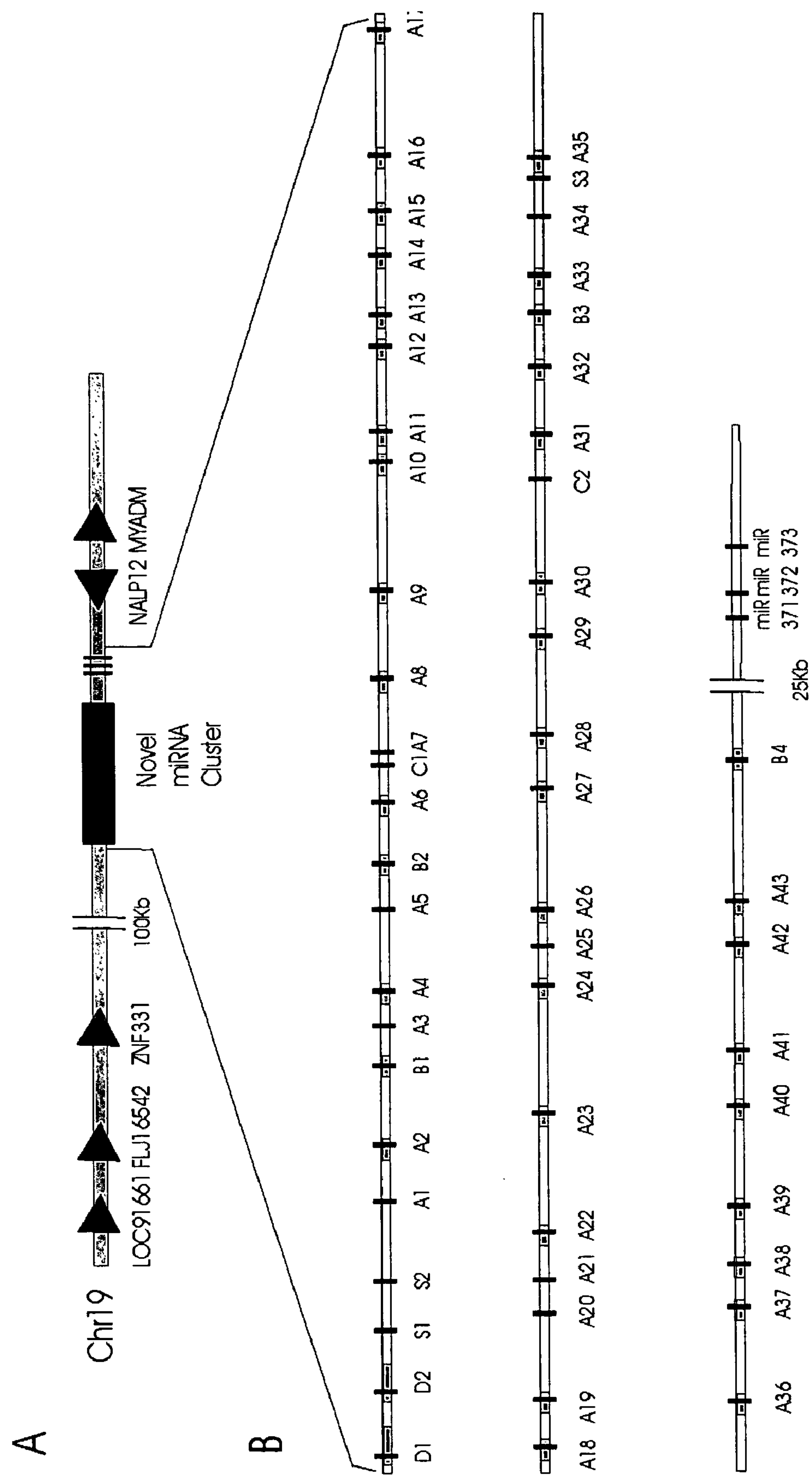
FIG. 2 shows a schematic illustration of the MC19 cluster on 19q13.42. Panel A shows the ~500,000 bp region of chromosome 19, from 58,580,001 to 59,080,000 (according to the May 2004 USCS assembly), in which the cluster is located including the neighboring protein-coding genes. The MC19-1 cluster is indicated by a rectangle. Mir-371, mir-372, and mir-373 are indicted by lines. Protein coding genes flanking the cluster are represented by large arrow-heads. Panel B shows a detailed structure of the MC19-1 miRNA cluster. A region of ~102,000 bp, from 58,860,001 to 58,962,000 (according to the May 2004 USCS assembly), is presented. MiRNA precursors are represented by a black bars. It should be noted that all miRNAs are at the same orientation from left to right. Shaded areas around miRNA precursors represent repeating units in which the precursor is embedded. The location of mir-371, mir-372, and mir-373, is also presented.

A group of the validated miRNAs from Example 3 were highly expressed in placenta, have distinct sequence similarity, and are located in the same locus on chromosome 19 (FIG. 2). These predicted miRNAs are spread along a region of ~100,000 nucleotides in the 19q13.42 locus. This genomic region is devoid of protein-coding genes and seems to be intergenic. Further analysis of the genomic sequence, including a thorough examination of the output of our prediction algorithm, revealed many more putative related miRNAs, and located mir-371, mir-372, and mir-373 approximately 25,000 bp downstream to this region. Overall, 54 putative miRNA precursors were identified in this region. The miRNA precursors can be divided into four distinct types of related sequences (FIG. 2). About 75% of the miRNAs in the cluster are highly related and were labeled as type A. Three other miRNA types, types B, C and D, are composed of 4, 2, and 2 precursors, respectively. An additional 3 putative miRNA precursors (S1 to S3) have unrelated sequences. Interestingly, all miRNA precursors are in the same orientation as the neighboring mir-371, mir-372, and mir-373 miRNA precursors.

Further sequence analysis revealed that the majority of the A-type miRNAs are embedded in a ~600 bp region that is repeated 35 times in the cluster. The repeated sequence does not appear in other regions of the genome and is conserved only in primates. The repeating unit is almost always bounded by upstream and downstream Alu repeats. This is in sharp contrast to the MC14-1 cluster which is extremely poor in Alu repeats.

Figure 3:
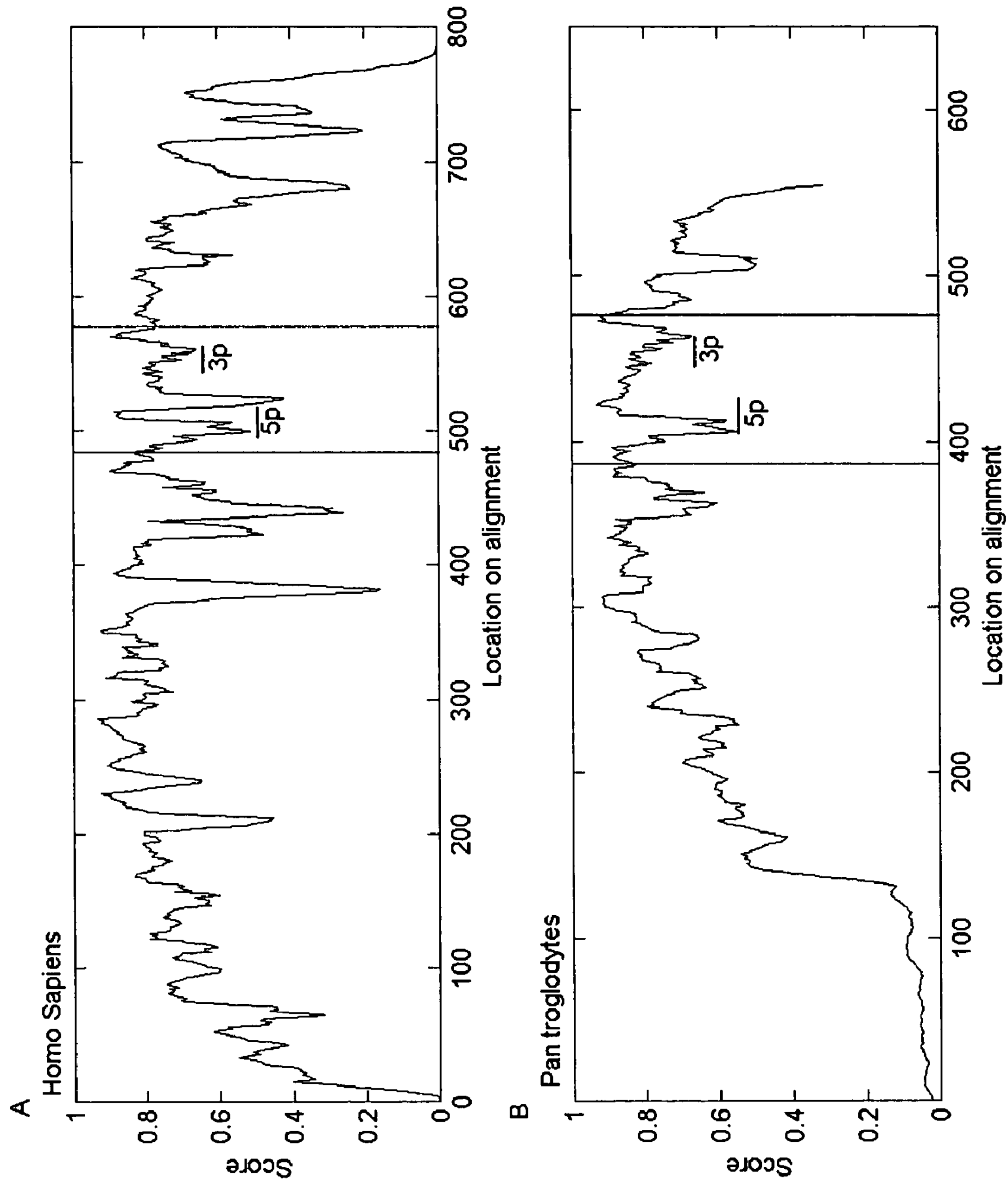
FIG. 3 is a graphical representation of multiple sequence alignment of 35 human repeat units at distinct size of ~690 nt (A) and 26 chimpanzees repeat units (B). The graph was generated by calculating a similarity score for each position in the alignment with an averaging sliding window of 10 nt (Maximum score-1, minimum score-0). The repeat unit sequences were aligned by ClustalW program. Each position of the resulting alignment was assigned a score which represented the degree of similarity at this position. The region containing the miRNA precursors is bordered by vertical lines. The exact location of the mature miRNAs derived from the 5' stems (5p) and 3' stems (3p) of the precursors is indicted by vertical lines.

FIG. 3-A shows a comparison of sequences of the 35 repeat units containing the A-type miRNA precursors in human. The comparison identified two regions exhibiting the highest sequence similarity. One region includes the A-type miRNA, located in the 3' region of the repeat. The second region is located ~100 nucleotides upstream to the A-type miRNA precursors. However, the second region does not show high similarity among the chimp repeat units while the region containing the A-type miRNA precursors does (FIG. 3-B).

Examination of the region containing the A-type repeats showed that the 5' region of the miRNAs encoded by the 5' stem of the precursors (5p miRNAs) seem to be more variable than other regions of the mature miRNAs. This is matched by variability in the 3' region of the mature miRNAs derived from the 3' stems (3p miRNAs). As expected, the loop region is highly variable. The same phenomenon can also be observed in the multiple sequence alignment of all 43 A-type miRNAs (FIG. 4).

Figure 4:
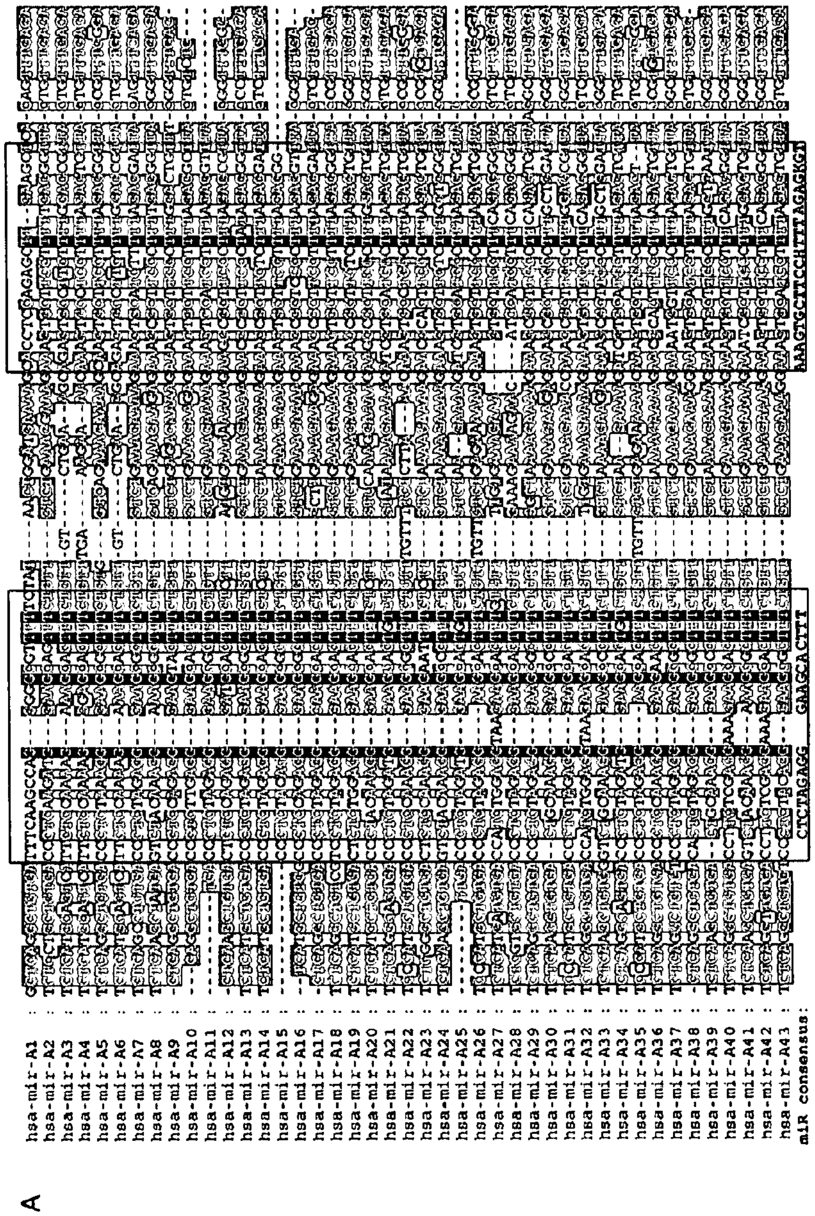
FIG. 4 shows sequence alignments of the 43 A-type pre-miRNAs of the MC19-1 cluster. Panel A shows the multiple sequence alignment with the Position of the mature miRNAs marked by a frame. The consensus sequence is shown at the bottom. Conserved nucleotides are colored as follows: black-100%, dark grey-80% to 99%, and clear grey-60% to 79%. Panel B shows alignments of consensus mature A-type miRNAs with the upstream human cluster of mir-371, mir-372, miR-373. Panel C shows alignments of consensus mature A-type miRNAs with the hsa-mir-371-373 mouse orthologous cluster. The miRNAs hsa-miR-A1 through hsa-miR-A43 of panel A have SEQ ID NOs: 760625 through 760667. respectively. In panel B, the following miRNAs have the following sequences: hsa-miR-371, 3p (SEQ ID NO: 760668), hsa-miR-372, 3p (SEQ ID NO: 760669), hsa-miR-373. 3p (SEQ ID NO: 760670). hsa-miR-A-3p (consensus) (SEQ ID NO: 760671), hsa-miR-373-5-p (SEQ ID NO: 760672), hsa-miR-A-5p (consensus)(SEQ ID NO: 760678). In panel C. the following miRNAs have the following sequences: hsa-miR-302a (SEQ ID NO: 760673), hsa-miR-302b (SEQ ID NO: 760674), hsa-miR-302c (SEQ ID NO.

The multiple sequence alignment presented in FIG. 4 revealed the following findings with regards to the predicted mature miRNAs. The 5p miRNAs can be divided into 3 blocks. Nucleotides 1 to 6 are C/T rich, relatively variable, and are marked in most miRNAs by a CTC motif in nucleotides 3 to 5. Nucleotides 7 to 15 are A/G rich and apart from nucleotides 7 and 8 are shared among most of the miRNAs. Nucleotides 16 to 23 are C/T rich and are, again, conserved among the members. The predicted 3p miRNAs, in general, show a higher conservation among the family members. Most start with an AAA motif, but a few have a different 5' sequence that may be critical in their target recognition. Nucleotides 8 to 15 are C/T rich and show high conservation. The last 7 nucleotides are somewhat less conserved but include a GAG motif in nucleotides 17 to 19 that is common to most members.

Analysis of the 5' region of the repeated units identified potential hairpins. However, in most repeating units these hairpins were not preserved and efforts to clone miRNAs from the highest scoring hairpins failed. There are 8 A-type precursors that are not found within a long repeating unit. Sequences surrounding these precursors show no similarity to the A-type repeating units or to any other genomic sequence. For 5 of these A-type precursors there are Alu repeats located significantly closer downstream to the A-type sequence.

The other miRNA types in the cluster showed the following characteristics. The four B group miRNAs are found in a repeated region of ~500 bp, one of which is located at the end of the cluster. The two D-type miRNAs, which are ~2000 nucleotides from each other, are located at the beginning of the cluster and are included in a duplicated region of 1220 nucleotides. Interestingly, the two D-type precursors are identical. Two of the three miRNAs of unrelated sequence, S1 and S2, are located just after the two D-type miRNAs, and the third is located between A34 and A35. In general, the entire ~100,000 nucleotide region containing the cluster is covered with repeating elements. This includes the miRNA-containing repeating units that are specific to this region and the genome wide repeat elements that are spread in the cluster in large numbers.

EXAMPLE 5

Cloning of Predicted MiRNAs

To further validate the predicted miRNAs, a number of the miRNAs described in Example 4 were cloned using methods similar to those described in U.S. Patent Application No. 60/522,459, Ser. Nos. 10/709,577 and 10/709,572, the contents of which are incorporated herein by reference. Briefly, a specific capture oligonucleotide was designed for each of the predicted miRNAs. The oligonucleotide was used to capture, clone, and sequence the specific miRNA from a placenta-derived library enriched for small RNAs.

We cloned 41 of the 43 A-type miRNAs, of which 13 miRNAs were not present on the original microarray but only computationally predicted, as well as the D-type miRNAs. For 11 of the predicted miRNA precursors, both 5p and 3p predicted mature miRNAs were present on the microarray and in all cases both gave significant signals. Thus, we attempted to clone both 5' and 3' mature miRNAs in all cloning attempts. For 27 of the 43 cloned miRNA, we were able to clone miRNA derived from both 5' and 3' stems. Since our cloning efforts were not exhaustive, it is possible that more of the miRNA precursors encode both 5' and 3' mature miRNAs.

Many of the cloned miRNAs have shown heterogeneity at the 3' end as observed in many miRNA cloning studies (Lagos-Quintana 2001, 2002, 2003) (Poy 2004). Interestingly, we also observed heterogeneity at the 5' end for a significant number of the cloned miRNAs. This heterogeneity seemed to be somewhat more prevalent in 5'-stem derived miRNAs (9) compared to 3'-stem derived miRNAs (6). In comparison, heterogeneity at the 3' end was similar for both 3' and 5'-stem derived miRNAs (19 and 13, respectively). The 5' heterogeneity involved mainly addition of one nucleotide, mostly C or A, but in one case there was an addition of 3 nucleotides. This phenomenon is not specific to the miRNAs in the chromosome 19 cluster. We have observed it for many additional cloned miRNAs, including both known miRNAs as well as novel miRNAs from other chromosomes (data not shown).

EXAMPLE 6

Analysis Of MiRNA Expression

To further examine the expression of the miRNAs of Example 4, we used Northern blot analysis to profile miRNA expression in several tissues. Northern blot analysis was performed using 40 mg of total RNA separated on 13% denaturing polyacrylamide gels and using 32P end labeled oligonucleotide probes. The oligonucleotide probe sequences were 5' ACTCTAAAGAGAAGCGCTTTGT-3' (SEQ ID NO: 760617) (A19-3p, NCBI: HSA-MIR-RG-21) and 5' ACCCACCAAAGAGAAGCACTTT-3' (SEQ ID NO: 760618) (A24-3p, NCBI: HSA-MIR-RG-27). The miRNAs were expressed as ~22 nucleotide long RNA molecules with tissue specificity profile identical to that observed in the microarray analysis (FIG. 5-A).

In order to determine how the MC19-1 cluster is transcribed. A survey of the ESTs in the region identified only one place that included ESTs with poly-adenylation signal and poly-A tail. This region is located just downstream to the A43 precursor. The only other region that had ESTs with poly-adenylation signal is located just after mir-373, suggesting that mir-371,2,3 are on a separate transcript. We performed initial studies focusing on the region around mir-A43 to ensure that the region is indeed transcribed into poly-adenylated mRNA. RT-PCR experiments using primers covering a region of 3.5 kb resulted in obtaining the expected fragment (FIG. 5 B). RT-PCR analysis was performed using 5 mg of placenta total RNA using oligo-dT as primer. The following primers were used to amplify the transcripts: f1: 5' GTCCCT-GTACTGGAACTTGAG-3' SE ID NO: 760619); f2: 5' GTGTCCCTGTACTGGAACGCA-3' (SEQ ID NO: 760620); r1: 5' GCCTGGCCATGTCAGCTACG-3' (SEQ ID NO: 760621); r2: 5' TTGATGGGAGGCTAGTGTTTC-3' (SEQ ID NO: 760622); r3: 5' GACGTGGAGGCGTTCT-TAGTC-3' (SEQ ID NO: 760623); and r4: 5'-TGACAAC-CGTTGGGGATTAC-3' (SEQ ID NO: 760624). The authenticity of the fragment was validated by sequencing. This region includes mir-A42 and mir-A43, which shows that both miRNAs are present on the same primary transcript.

Further information on the transcription of the cluster came from analysis of the 77 ESTs located within it. We found that 42 of the ESTs were derived from placenta. As these ESTs are spread along the entire cluster, it suggested that the entire cluster is expressed in placenta. This observation is in-line with the expression profile observed in the microarray analysis. Thus, all miRNAs in the cluster may be co-expressed, with the only exception being the D-type miRNAs which are the only miRNAs to be expressed in HeLa cells. Interestingly, none of the 77 ESTs located in the region overlap the miRNA precursors in the cluster. This is in-line with the depletion of EST representation from transcripts processed by Drosha.

Examination of the microarray expression profile revealed that miRNAs D1/2, A12, A21, A22, and A34, have a somewhat different expression profile reflected as low to medium expression levels in several of the other tissues examined. This may be explained by alternative splicing of the transcript(s) encoding the miRNAs or by the presence of additional promoter(s) of different tissues specificity along the cluster.

Comparison of the expression of 3p and 5p mature miRNAs revealed that both are expressed for many miRNA precursors but in most cases at different levels. For most pre-miRNAs the 3p miRNAs are expressed at higher levels then the 5p miRNAs. However, in 6 cases (mir-D1,2, mir-A1, mir-A8, mir-A12, mir-A17 and mir-A33) both 3p and 5p miRNAs were expressed at a similar level, and in one case (mir-A32) the 5p miRNA was expressed at higher levels then the 3p miRNA.

EXAMPLE 7

Conservation

Comparison of the sequences from all four types of predicted miRNAs of Example 4 to that of other species (chimp, macaque, dog, chicken, mouse, rat, *drosophila*, zebra-fish, fungi, *C. elegans*) revealed that all miRNAs in the cluster, and in fact the entire region, are not conserved beyond primates. Interestingly, homologues of this region do not exist in any other genomes examined, including mouse and rat. Thus, this is the first miRNA cluster that is specific to primates and not generally shared in mammals. Homology analysis between chimp and human show that all 35 repeats carrying the A-type miRNAs are contiguous between the two species. Furthermore, the entire cluster seems to be identical between human and chimp. Thus, the multiple duplications leading to the emergence of the MC19-1 cluster must have occurred prior to the split of chimp and human and remained stable during the evolution of each species. It should be noted that human chromosome 19 is known to include many tandemly clustered gene families and large segmental duplications (Grimwood et al, 2004). Thus, in this respect the MC19-1 cluster is a natural part of chromosome 19.

In comparison, the MC14-1 cluster is generally conserved in mouse and includes only the A7 and A8 miRNAs within the cluster are not conserved beyond primates (Seitz 2004). In contrast all miRNAs in the MC19-1 cluster are unique to primates. A survey of all miRNAs found in Sanger revealed that only three miRNA, mir-198, mir-373, and mir-422a, are not conserved in the mouse or rat genomes, however, they are conserved in the dog genome and are thus not specific to primates. Interestingly, mir-371 and mir-372, which are clustered with mir-373, and are located 25 kb downstream to the MC19-1 cluster, are homologous to some extent to the A-type miRNAs (FIG. 4), but are conserved in rodents.

Comparison of the A-type miRNA sequences to the miRNAs in the Sanger database revealed the greatest homology to the human mir-302 family (FIG. 4-C). This homology is higher than the homology observed with mir-371,2,3. The mir-302 family (mir-302a, b, c, and d) are found in a tightly packed cluster of five miRNAs (including mir-367) covering 690 nucleotides located in the antisense orientation in the first intron within the protein coding exons of the HDCMA18P gene (accession NM_016648). No additional homology, apart from the miRNA homology, exists between the mir-302 cluster and the MC19-1 cluster. The fact that both the mir-371,2,3 and mir-302a,b,c,d are specific to embryonic stem cells is noteworthy.

EXAMPLE 8

Differential Expression of MiRNAs

Using chip expression methods similar to those described in 0, microarray images were analyzed using Feature Extraction Software (Version 7.1.1, Agilent). Table 2 shows the ratio of disease related expression ("R") compared to normal tissues. Table 2 also shows the statistical analysis of the normalized signal ("RPval"). The signal of each probe was set as its median intensity. Signal intensities range from background level of 400 to saturating level of 66000. 2 channels hybridization was performed and Cy3 signals were compared to Cy5 signals, where fluor reversed chip was preformed (normal vs. disease), probe signal was set to be its average signal. Signals were normalized by dividing them with the known miRNAs average signals such that the sum of known miRNAs signal is the same in each experiment or channel. Signal ratios between disease and normal tissues were calculated. Signal ratio greater than 1.5 indicates a significant upregulation with a P value of 0.007 and signal ratio grater than 2 has P value of 0.003. P values were estimated based on the occurrences of such or greater signal ratios over duplicated experiments.

The differential expression analysis in Table 2 indicates that the expression of a number of the miRNAs are significantly altered in disease tissue. In particular, the MC19-1 miRNAs of Example 4 are differentially expressed in prostate and lung cancer. The relevance of the MC19-1 miRNAs to cancer is supported by the identification of a loss of heterozygosity within the MC19-1 region in prostate cancer derived cells (Dumur et al. 2003).

TABLE 3

SEQUENCED MICRORNAS

| HID | MID | Tissue |
|---|---|---|
| 46 | 7060 | 7 |
| 88 | 7143 | 11 |
| 109 | 7186 | 7 |
| 109 | 7187 | 7 |
| 197 | 7362 | 7 |
| 197 | 7363 | 7 |
| 197 | 7364 | 7 |
| 197 | 7365 | 7 |
| 197 | 7366 | 7 |
| 230 | 7433 | 11 |
| 230 | 7434 | 11 |
| 235 | 7443 | 7 |
| 235 | 7444 | 7 |
| 235 | 7445 | 7 |
| 235 | 7446 | 7 |
| 248 | 7473 | 11 |
| 248 | 7474 | 11 |
| 283 | 7544 | 7 |
| 286 | 7549 | 7 |
| 286 | 7550 | 7 |
| 286 | 7551 | 7 |
| 286 | 7552 | 7 |
| 286 | 7553 | 7 |
| 289 | 7558 | 7 |
| 289 | 7559 | 7 |
| 289 | 7560 | 7 |
| 289 | 7561 | 7 |
| 289 | 7562 | 7 |
| 289 | 7563 | 7 |
| 289 | 7564 | 7 |
| 303 | 7591 | 7 |

TABLE 3-continued

SEQUENCED MICRORNAS

| HID | MID | Tissue |
|---|---|---|
| 303 | 7592 | 7 |
| 303 | 7593 | 7 |
| 303 | 7594 | 7 |
| 374 | 7737 | 11 |
| 449 | 7886 | 12 |
| 604 | 8195 | 12 |
| 679 | 8345 | 7 |
| 679 | 8346 | 7 |
| 699 | 8386 | 7 |
| 699 | 8387 | 7 |
| 699 | 8388 | 7 |
| 778 | 8547 | 11 |
| 841 | 8673 | 20 |
| 908 | 8808 | 7 |
| 908 | 8809 | 7 |
| 917 | 8828 | 11 |
| 917 | 8829 | 11 |
| 978 | 8950 | 11 |
| 1084 | 9162 | 10 |
| 1084 | 9163 | 10 |
| 1084 | 9164 | 10 |
| 1159 | 9315 | 7 |
| 1167 | 9330 | 7 |
| 1167 | 9331 | 7 |
| 1167 | 9332 | 7 |
| 1167 | 9333 | 7 |
| 1192 | 9383 | 7 |
| 1296 | 9591 | 7 |
| 1408 | 9816 | 7 |
| 1459 | 9918 | 12 |
| 1459 | 9919 | 12 |
| 1459 | 9920 | 12 |
| 1459 | 9921 | 12 |
| 1534 | 10070 | 11 |
| 1564 | 10129 | 7 |
| 1564 | 10130 | 7 |
| 1564 | 10131 | 7 |
| 1564 | 10132 | 7 |
| 1564 | 10133 | 7 |
| 1598 | 10201 | 7 |
| 1598 | 10202 | 7 |
| 1601 | 10207 | 7 |
| 1601 | 10208 | 7 |
| 1601 | 10209 | 7 |
| 1601 | 10210 | 7 |
| 1601 | 10211 | 7 |
| 1601 | 10212 | 7 |
| 1601 | 10213 | 7 |
| 1601 | 10214 | 7 |
| 1628 | 10268 | 7 |
| 1633 | 10278 | 9 |
| 1652 | 10315 | 7 |
| 1652 | 10316 | 7 |
| 1652 | 10317 | 7 |
| 1652 | 10318 | 7 |
| 1794 | 10601 | 7 |
| 1794 | 10603 | 7 |
| 1794 | 10604 | 7 |
| 1794 | 10605 | 7 |
| 1890 | 10797 | 6 |
| 1890 | 10798 | 6 |
| 1890 | 10799 | 6 |
| 1929 | 10876 | 7 |
| 1929 | 10878 | 7 |
| 1940 | 10899 | 7 |
| 1940 | 10900 | 7 |
| 1958 | 10936 | 11 |
| 1961 | 10941 | 11 |
| 1961 | 10943 | 11 |
| 1961 | 10944 | 11 |
| 2058 | 11137 | 7 |
| 2058 | 11138 | 7 |
| 2058 | 11139 | 7 |
| 2058 | 11140 | 7 |
| 2058 | 11141 | 7 |

TABLE 3-continued

SEQUENCED MICRORNAS

| HID | MID | Tissue |
|---|---|---|
| 2147 | 11320 | 7 |
| 2147 | 11321 | 7 |
| 2154 | 11336 | 7 |
| 2164 | 11357 | 7 |
| 2164 | 11358 | 7 |
| 2164 | 11359 | 7 |
| 2171 | 11374 | 11 |
| 2172 | 11375 | 7 |
| 2172 | 11376 | 7 |
| 2172 | 11377 | 7 |
| 2172 | 11378 | 7 |
| 2178 | 11389 | 7 |
| 2178 | 11390 | 7 |
| 2178 | 11391 | 7 |
| 2178 | 11392 | 12 |
| 2178 | 11393 | 12 |
| 2180 | 11397 | 7 |
| 2180 | 11398 | 7 |
| 2180 | 11399 | 7 |
| 2182 | 11403 | 11 |
| 2186 | 11412 | 11 |
| 2186 | 11413 | 11 |
| 2213 | 11467 | 7 |
| 2213 | 11468 | 7 |
| 2213 | 11469 | 7 |
| 2362 | 11766 | 12 |
| 2362 | 11767 | 12 |
| 2362 | 11768 | 12 |
| 2363 | 11769 | 12 |
| 2363 | 11770 | 12 |
| 2363 | 11771 | 12 |
| 2364 | 11772 | 12 |
| 2364 | 11773 | 12 |
| 2364 | 11774 | 12 |
| 2414 | 11873 | 7 |
| 2414 | 11874 | 7 |
| 2414 | 11875 | 7 |
| 2414 | 11876 | 7 |
| 2415 | 11877 | 7 |
| 2415 | 11878 | 7 |
| 2415 | 11879 | 7 |
| 2415 | 11880 | 7 |
| 2415 | 11881 | 7 |
| 2415 | 11882 | 7 |
| 2428 | 11907 | 7 |
| 2428 | 11908 | 7 |
| 2483 | 12019 | 11 |
| 2493 | 12039 | 7 |
| 2493 | 12040 | 7 |
| 2493 | 12041 | 7 |
| 2585 | 12224 | 7 |
| 2585 | 12226 | 7 |
| 2585 | 12227 | 7 |
| 2585 | 12228 | 7 |
| 2620 | 12297 | 21 |
| 2682 | 12421 | 7 |
| 2693 | 12443 | 7 |
| 2693 | 12444 | 7 |
| 2693 | 12445 | 7 |
| 2706 | 12470 | 7 |
| 2706 | 12471 | 7 |
| 2706 | 12472 | 7 |
| 2748 | 12555 | 21 |
| 2802 | 12663 | 7 |
| 2802 | 12664 | 7 |
| 2805 | 12670 | 11 |
| 2805 | 12671 | 11 |
| 2811 | 12683 | 7 |
| 2811 | 12684 | 7 |
| 2821 | 12703 | 11 |
| 2821 | 12704 | 11 |
| 2821 | 12705 | 11 |
| 2821 | 12706 | 11 |
| 2828 | 12719 | 7 |
| 2828 | 12720 | 7 |

TABLE 3-continued

SEQUENCED MICRORNAS

| HID | MID | Tissue |
|---|---|---|
| 2828 | 12721 | 7 |
| 2866 | 12798 | 7 |
| 2866 | 12799 | 7 |
| 2866 | 12800 | 7 |
| 3011 | 13090 | 11 |
| 3021 | 13109 | 7 |
| 3021 | 13110 | 7 |
| 3021 | 13111 | 7 |
| 3021 | 13112 | 7 |
| 3021 | 13113 | 7 |
| 3021 | 13114 | 7 |
| 3021 | 13115 | 7 |
| 3026 | 13126 | 11 |
| 3026 | 13127 | 11 |
| 3026 | 13128 | 11 |
| 3055 | 13186 | 11 |
| 3055 | 13187 | 11 |
| 3055 | 13188 | 11 |
| 3055 | 13189 | 11 |
| 3069 | 13218 | 7 |
| 3069 | 13219 | 12 |
| 3069 | 13220 | 12 |
| 3104 | 13291 | 7 |
| 3113 | 13308 | 11 |
| 3113 | 13310 | 11 |
| 3113 | 13311 | 19 |
| 3121 | 13327 | 24 |
| 3121 | 13328 | 24 |
| 3353 | 13791 | 11 |
| 3358 | 13801 | 7 |
| 3358 | 13802 | 7 |
| 3360 | 13806 | 5 |
| 3360 | 13807 | 7 |
| 3360 | 13808 | 7 |
| 3360 | 13809 | 7 |
| 3474 | 14036 | 7 |
| 3506 | 14099 | 7 |
| 3519 | 14125 | 7 |
| 3519 | 14126 | 7 |
| 3519 | 14127 | 7 |
| 3564 | 14216 | 11 |
| 3611 | 14309 | 7 |
| 3611 | 14310 | 7 |
| 3611 | 14311 | 7 |
| 3611 | 14312 | 7 |
| 3611 | 14313 | 7 |
| 3613 | 14318 | 11 |
| 3619 | 14330 | 7 |
| 3737 | 14566 | 13 |
| 3737 | 14567 | 13 |
| 3757 | 14606 | 12 |
| 3765 | 14621 | 11 |
| 3765 | 14622 | 11 |
| 3765 | 14623 | 11 |
| 3765 | 14624 | 11 |
| 3777 | 14647 | 7 |
| 3777 | 14648 | 7 |
| 3777 | 14649 | 7 |
| 3792 | 14679 | 7 |
| 3799 | 14693 | 12 |
| 3799 | 14694 | 12 |
| 3872 | 14840 | 7 |
| 3872 | 14841 | 7 |
| 3872 | 14842 | 7 |
| 3873 | 14844 | 7 |
| 3873 | 14845 | 7 |
| 3873 | 14846 | 7 |
| 3878 | 14855 | 7 |
| 3923 | 14944 | 7 |
| 3929 | 14956 | 11 |
| 3964 | 15025 | 7 |
| 3964 | 15026 | 7 |
| 3964 | 15027 | 7 |
| 3970 | 15040 | 7 |
| 3970 | 15041 | 7 |

TABLE 3-continued

SEQUENCED MICRORNAS

| HID | MID | Tissue |
|---|---|---|
| 3985 | 15070 | 7 |
| 3985 | 15071 | 7 |
| 3985 | 15072 | 7 |
| 3986 | 15073 | 7 |
| 3986 | 15074 | 7 |
| 3986 | 15075 | 7 |
| 3987 | 15076 | 7 |
| 3987 | 15077 | 7 |
| 3987 | 15078 | 7 |
| 3987 | 15079 | 7 |
| 3998 | 15102 | 7 |
| 4022 | 15150 | 7 |
| 4052 | 15209 | 7 |
| 4052 | 15210 | 7 |
| 4053 | 15211 | 7 |
| 4054 | 15212 | 7 |
| 4072 | 15247 | 7 |
| 4072 | 15248 | 7 |
| 4132 | 15367 | 7 |
| 4168 | 15439 | 7 |
| 4168 | 15440 | 7 |
| 4168 | 15441 | 7 |
| 4168 | 15442 | 7 |
| 4168 | 15443 | 7 |
| 4169 | 15444 | 7 |
| 4169 | 15445 | 7 |
| 4169 | 15446 | 7 |
| 4169 | 15447 | 7 |
| 4169 | 15448 | 7 |
| 4203 | 15516 | 12 |
| 4253 | 15617 | 11 |
| 4253 | 15618 | 11 |
| 4253 | 15619 | 11 |
| 4373 | 15860 | 11 |
| 4373 | 15861 | 7 |
| 4373 | 15862 | 11 |
| 4373 | 15863 | 11 |
| 4410 | 15936 | 27 |
| 4451 | 16017 | 26 |
| 4451 | 16018 | 23 |
| 4487 | 16091 | 7 |
| 4487 | 16092 | 11 |
| 4488 | 16095 | 11 |
| 4488 | 16096 | 11 |
| 4489 | 16098 | 14 |
| 4490 | 16100 | 14 |
| 4498 | 16115 | 7 |
| 4662 | 16443 | 11 |
| 4662 | 16444 | 11 |
| 4701 | 16523 | 11 |
| 4721 | 16562 | 12 |
| 4721 | 16563 | 12 |
| 4778 | 16678 | 19 |
| 4796 | 16715 | 11 |
| 4797 | 16718 | 11 |
| 4799 | 16722 | 11 |
| 4799 | 16723 | 11 |
| 4812 | 16748 | 7 |
| 4847 | 16818 | 7 |
| 4927 | 16978 | 7 |
| 4931 | 16986 | 7 |
| 4954 | 17033 | 7 |
| 4982 | 17088 | 11 |
| 4982 | 17089 | 7 |
| 4987 | 17098 | 11 |
| 4987 | 17100 | 11 |
| 4987 | 17101 | 19 |
| 4993 | 17113 | 7 |
| 4993 | 17114 | 7 |
| 5017 | 17163 | 11 |
| 5017 | 17164 | 11 |
| 5017 | 17165 | 11 |
| 5022 | 17175 | 7 |
| 5049 | 17229 | 11 |
| 5049 | 17230 | 11 |

TABLE 3-continued

SEQUENCED MICRORNAS

| HID | MID | Tissue |
|---|---|---|
| 5111 | 17354 | 7 |
| 5164 | 17459 | 11 |
| 5248 | 17627 | 11 |
| 5248 | 17629 | 7 |
| 5313 | 17758 | 7 |
| 5313 | 17760 | 7 |
| 5317 | 17768 | 12 |
| 5354 | 17842 | 7 |
| 5364 | 17861 | 20 |
| 5364 | 17862 | 20 |
| 5364 | 17863 | 7 |
| 5364 | 17864 | 7 |
| 5429 | 17995 | 11 |
| 5448 | 18032 | 11 |
| 5469 | 18073 | 7 |
| 5469 | 18074 | 7 |
| 5469 | 18075 | 7 |
| 5469 | 18076 | 7 |
| 5541 | 18219 | 11 |
| 5541 | 18220 | 11 |
| 5572 | 18281 | 7 |
| 5572 | 18282 | 7 |
| 5627 | 18392 | 7 |
| 5628 | 18393 | 7 |
| 5640 | 18417 | 7 |
| 5640 | 18418 | 7 |
| 5640 | 18419 | 7 |
| 5693 | 18526 | 7 |
| 5693 | 18527 | 7 |
| 5701 | 18542 | 19 |
| 5701 | 18544 | 19 |
| 5701 | 18545 | 19 |
| 5701 | 18546 | 19 |
| 5701 | 18547 | 20 |
| 5747 | 18639 | 7 |
| 5770 | 18685 | 7 |
| 5770 | 18686 | 7 |
| 5770 | 18687 | 7 |
| 5770 | 18688 | 7 |
| 5806 | 18760 | 12 |
| 5806 | 18761 | 12 |
| 5806 | 18762 | 12 |
| 5808 | 18765 | 7 |
| 5888 | 18925 | 12 |
| 5888 | 18926 | 12 |
| 5888 | 18927 | 12 |
| 5891 | 18933 | 19 |
| 5891 | 18934 | 19 |
| 5891 | 18935 | 19 |
| 5906 | 18965 | 11 |
| 5910 | 18972 | 7 |
| 5947 | 19045 | 11 |
| 5947 | 19047 | 19 |
| 5954 | 19061 | 7 |
| 5954 | 19062 | 7 |
| 5954 | 19063 | 7 |
| 5954 | 19064 | 7 |
| 5954 | 19065 | 7 |
| 5987 | 19132 | 11 |
| 6007 | 19171 | 7 |
| 6084 | 19324 | 10 |
| 6230 | 19618 | 11 |
| 6380 | 19918 | 9 |
| 6380 | 19919 | 9 |
| 6396 | 19950 | 7 |
| 6396 | 19951 | 7 |
| 6396 | 19952 | 7 |
| 6429 | 20017 | 7 |
| 6438 | 20034 | 11 |
| 6438 | 20036 | 11 |
| 6443 | 20045 | 7 |
| 6443 | 20046 | 7 |
| 6443 | 20047 | 7 |
| 6443 | 20048 | 7 |
| 6443 | 20049 | 7 |

TABLE 3-continued

SEQUENCED MICRORNAS

| HID | MID | Tissue |
|---|---|---|
| 6444 | 20050 | 11 |
| 6444 | 20052 | 11 |
| 6444 | 20053 | 11 |
| 6444 | 20054 | 11 |
| 6529 | 20223 | 7 |
| 6529 | 20224 | 7 |
| 6529 | 20225 | 7 |
| 6529 | 20226 | 7 |
| 6569 | 20305 | 7 |
| 6569 | 20306 | 7 |
| 6569 | 20307 | 7 |
| 6662 | 20494 | 7 |
| 6662 | 20495 | 7 |
| 6662 | 20496 | 7 |
| 6665 | 20501 | 7 |
| 6665 | 20502 | 7 |
| 6665 | 20503 | 7 |
| 6665 | 20504 | 7 |
| 6665 | 20505 | 7 |
| 6665 | 20506 | 7 |
| 6673 | 20521 | 11 |
| 6673 | 20522 | 11 |
| 6678 | 20531 | 11 |
| 6678 | 20532 | 11 |
| 6678 | 20533 | 11 |
| 6678 | 20534 | 11 |
| 6678 | 20535 | 11 |
| 6692 | 20562 | 7 |
| 6692 | 20563 | 7 |
| 6716 | 20611 | 22 |
| 6716 | 20612 | 22 |
| 6716 | 20613 | 22 |
| 6765 | 20710 | 10 |
| 6765 | 20712 | 10 |
| 6765 | 20713 | 10 |
| 6766 | 20714 | 7 |
| 6766 | 20715 | 7 |
| 6766 | 20716 | 7 |
| 6883 | 20949 | 7 |
| 6883 | 20951 | 7 |
| 6883 | 20952 | 7 |
| 6883 | 20953 | 7 |
| 6914 | 21015 | 7 |
| 6968 | 21122 | 7 |
| 6968 | 21123 | 7 |

TABLE 6

RELATION OF MICRORNAS TO DISEASES BY HOST GENES

| HID | MID | H. Gene | Disease(s) |
|---|---|---|---|
| 31 | 7030, 7029 | CDH6 | 167, 157 |
| 39 | 7046, 7045 | PAK1 | 31 |
| 42 | 7052, 7051 | MAPK8IP1 | 64 |
| 99 | 7166, 7165 | ITGB3 | 172, 171, 118, 127, 154, 41, 67, 92, 53, 40, 111, 51, 102 |
| 103 | 7174, 7173 | GRM7 | 162 |
| 125 | 7219, 7218 | MOBP | 123 |
| 127 | 7223, 7222 | PBX1 | 109 |
| 128 | 7225, 7224 | MUC1 | 110, 133, 31 |
| 189 | 7347, 7346 | MYO7A | 60 |
| 191 | 7351, 7350 | CDH13 | 31, 176, 133, 110, 51, 167 |
| 212 | 7396, 7395 | PAH | 162 |
| 224 | 7420, 7419 | TBXA2R | 110, 133, 18 |
| 232 | 7438, 7437 | NR3C2 | 57, 98 |
| 239 | 7454, 7453 | IL16 | 112, 56, 92, 160, 18 |
| 243 | 7462, 7461 | NRG1 | 31, 162, 154, 8, 123 |
| 246 | 7468, 7467 | ERBB4 | 31, 51, 154 |
| 267 | 7512, 7511 | CCND3 | 31, 122, 35, 118, 112, 109 |
| 291 | 7568, 7567 | ALCAM | 118 |
| 293 | 7572, 7571 | DAB1 | 162 |
| 301 | 7588, 7587 | PAM | 154, 123, 110 |
| 311 | 7610, 7609 | GRIA4 | 82, 77, 8 |
| 338 | 7664, 7663 | SLC1A3 | 82, 8 |
| 355 | 7698, 7697 | NRP2 | 36 |
| 363 | 7714, 7713 | PTPN6 | 31, 112, 109, 93, 35 |
| 364 | 7716, 7715 | GOLGA5 | 173 |
| 375 | 7739, 7738 | HTR2C | 162, 29, 120 |
| 390 | 7769, 7768 | COL2A1 | 135, 60 |
| 396 | 7781, 7780 | MLLT2 | 109 |
| 410 | 7809, 7808 | TGFBR3 | 31 |
| 450 | 7888, 7887 | GRIK2 | 82 |
| 466 | 7920, 7919 | TIAM1 | 157, 70, 31 |
| 480 | 7948, 7947 | LAMB1 | 154, 51 |
| 481 | 7950, 7949 | SEMA3F | 110 |
| 482 | 7952, 7951 | PMS2 | 118, 79, 51, 154, 151 |
| 505 | 7998, 7997 | EPS15 | 109 |
| 506 | 8000, 7999 | ST7 | 51, 31, 24, 90, 83 |
| 560 | 8108, 8107 | CDH13 | 31, 176, 133, 110, 51, 167 |
| 588 | 8164, 8163 | HK2 | 134, 132, 64 |
| 616 | 8219, 8218 | CYLD | 166, 157 |
| 621 | 8229, 8228 | CHRNA7 | 144, 8, 24, 162 |
| 626 | 8239, 8238 | IL15 | 167, 110, 31, 92 |

TABLE 6-continued

RELATION OF MICRORNAS TO DISEASES BY HOST GENES

| HID | MID | H. Gene | Disease(s) |
|---|---|---|---|
| 631 | 8249, 8248 | PTN | 118, 31, 167, 154, 141, 133 |
| 633 | 8253, 8252 | PAH | 162 |
| 634 | 8255, 8254 | ERBB4 | 31, 51, 154 |
| 648 | 8283, 8282 | AMPH | 31 |
| 654 | 8295, 8294 | EGFR | 51, 31, 167, 133, 110 |
| 669 | 8325, 8324 | PTHR1 | 136 |
| 680 | 8348, 8347 | HOXC4 | 166, 157, 27 |
| 681 | 8350, 8349 | MLLT4 | 109 |
| 682 | 8352, 8351 | RANBP17 | 109 |
| 683 | 8354, 8353 | ATP6V1B1 | 158 |
| 689 | 8366, 8365 | NRP2 | 36 |
| 710 | 8410, 8409 | TNC | 118, 110, 98, 31, 180, 154, 79, 51 |
| 714 | 8418, 8417 | TPO | 60, 174, 102, 61 |
| 727 | 8444, 8443 | MLLT2 | 109 |
| 731 | 8452, 8451 | FHIT | 133, 110, 42, 31 |
| 744 | 8478, 8477 | DSTN | 8 |
| 780 | 8551, 8550 | S100A1 | 157 |
| 800 | 8591, 8590 | ITGA5 | 51, 35, 155, 112, 109, 90, 133, 122, 118 |
| 803 | 8597, 8596 | MLLT3 | 109 |
| 813 | 8617, 8616 | PTPRG | 157, 110, 31 |
| 823 | 8637, 8636 | MAP2K5 | 154 |
| 830 | 8651, 8650 | SCN5A | 185, 34 |
| 838 | 8667, 8666 | GABRA3 | 82, 29, 47, 123 |
| 839 | 8669, 8668 | PTPRN | 64, 105, 85 |
| 861 | 8713, 8712 | FGFR2 | 79, 31, 30, 154 |
| 897 | 8785, 8784 | TJP2 | 51, 31, 154 |
| 925 | 8845, 8844 | CYP11B2 | 98 |
| 935 | 8865, 8864 | LPP | 110, 109 |
| 945 | 8885, 8884 | EPHB2 | 167 |
| 982 | 8958, 8957 | ALK | 112, 93 |
| 1029 | 9052, 9051 | TACR1 | 92, 56, 120, 18, 103, 160, 141 |
| 1031 | 9056, 9055 | SCN5A | 185, 34 |
| 1037 | 9068, 9067 | EIF4A1 | 118, 90 |
| 1053 | 9100, 9099 | GRIA4 | 82, 77, 8 |
| 1069 | 9132, 9131 | WNT3A | 122 |
| 1086 | 9168, 9167 | BCL11A | 112, 109, 93 |
| 1103 | 9202, 9201 | TP73L | 26, 42, 30, 27, 83, 51, 48, 166, 110 |
| 1115 | 9226, 9225 | GRIN2B | 162, 77, 8 |
| 1125 | 9246, 9245 | BIK | 31 |
| 1132 | 9260, 9259 | GRIA2 | 8, 77, 82, 162 |
| 1138 | 9272, 9271 | GLDC | 96 |
| 1139 | 9274, 9273 | PRKCD | 157, 154 |
| 1153 | 9302, 9301 | GPC3 | 31, 90 |
| 1181 | 9361, 9360 | RPS6KB1 | 31 |
| 1241 | 9481, 9480 | ITGA3 | 31, 154, 118, 79, 51 |
| 1253 | 9505, 9504 | ROBO1 | 31, 157, 110 |
| 1259 | 9517, 9516 | MEIS1 | 109 |
| 1264 | 9527, 9526 | RORA | 154, 31 |
| 1291 | 9581, 9580 | IGF1 | 60, 133, 31, 51, 67, 110, 92, 105, 64, 132 |
| 1297 | 9593, 9592 | CACNA2D2 | 133 |
| 1298 | 9595, 9594 | DAB1 | 162 |
| 1299 | 9597, 9596 | NTRK3 | 116, 8, 109, 157 |
| 1319 | 9637, 9636 | CDH17 | 109 |
| 1345 | 9689, 9688 | CDH23 | 60 |
| 1353 | 9705, 9704 | DLEU2 | 109 |
| 1362 | 9723, 9722 | PTPRG | 157, 110, 31 |
| 1367 | 9733, 9732 | TPK1 | 117 |
| 1377 | 9753, 9752 | SOAT1 | 134 |
| 1385 | 9769, 9768 | ADCY2 | 8 |
| 1390 | 9779, 9778 | ERCC5 | 110 |
| 1413 | 9826, 9825 | AUTS2 | 24 |
| 1427 | 9854, 9853 | CYP19A1 | 31, 90, 79, 154 |
| 1435 | 9870, 9869 | PTPRF | 134, 31 |
| 1513 | 10029, 10028 | ABCA4 | 113 |
| 1518 | 10039, 10038 | ITGA3 | 31, 154, 118, 79, 51 |
| 1520 | 10043, 10042 | NGFR | 31, 8, 92, 144, 123 |
| 1524 | 10051, 10050 | CALCR | 160, 136, 31 |
| 1541 | 10084, 10083 | ST7 | 51, 31, 24, 90, 83 |
| 1542 | 10086, 10085 | PTPRF | 134, 31 |
| 1547 | 10096, 10095 | PTOV1 | 154 |
| 1606 | 10224, 10223 | GPC3 | 31, 90 |
| 1643 | 10298, 10297 | F13A1 | 48, 56, 49 |
| 1662 | 10338, 10337 | CD8B1 | 92 |
| 1663 | 10340, 10339 | HIP1 | 51, 154, 109 |
| 1671 | 10356, 10355 | AUTS2 | 24 |

TABLE 6-continued

RELATION OF MICRORNAS TO DISEASES BY HOST GENES

| HID | MID | H. Gene | Disease(s) |
|---|---|---|---|
| 1715 | 10444, 10443 | UBE3A | 24 |
| 1753 | 10520, 10519 | ADAM12 | 109, 90, 47, 134, 122, 112 |
| 1766 | 10546, 10545 | NSF | 162 |
| 1771 | 10556, 10555 | LPP | 110, 109 |
| 1776 | 10566, 10565 | SDC2 | 24 |
| 1801 | 10619, 10618 | IGF1R | 110, 154, 118, 31 |
| 1812 | 10641, 10640 | IL15 | 167, 110, 31, 92 |
| 1866 | 10749, 10748 | HMGA2 | 79, 110 |
| 1877 | 10771, 10770 | GRIK2 | 82 |
| 1879 | 10775, 10774 | RORA | 154, 31 |
| 1890 | 10799, 10798, 10797, 10796 | EIF4A2 | 88, 112 |
| 1900 | 10819, 10818 | SREBF2 | 134, 95, 51, 154 |
| 1911 | 10841, 10840 | ELAVL4 | 167 |
| 1915 | 10849, 10848 | MTAP | 110, 109, 133 |
| 1932 | 10884, 10883 | HOXC5 | 112, 42 |
| 1950 | 10920, 10919 | WWOX | 122, 83, 31 |
| 1958 | 10936, 10935 | CALCR | 160, 136, 31 |
| 1973 | 10968, 10967 | TGIF | 83 |
| 2008 | 11038, 11037 | GYPC | 114 |
| 2009 | 11040, 11039 | GYPC | 114 |
| 2028 | 11078, 11077 | CSEN | 8 |
| 2037 | 11096, 11095 | FYN | 112, 109, 92, 157 |
| 2125 | 11275, 11274 | NISCH | 98 |
| 2142 | 11309, 11308 | TMEFF2 | 154, 51, 30 |
| 2146 | 11317, 11316 | HLA-DRB5 | 109, 105, 64, 123 |
| 2149 | 11325, 11324 | GNAO1 | 8 |
| 2156 | 11340, 11339 | FLT4 | 110, 31, 90, 109, 112, 154, 133, 51 |
| 2182 | 11403, 11402 | HTR2C | 162, 29, 120 |
| 2210 | 11461, 11460 | IMP-1 | 51, 31 |
| 2232 | 11507, 11506 | TPK1 | 117 |
| 2265 | 11573, 11572 | CSEN | 8 |
| 2268 | 11579, 11578 | CASP8 | 8, 167, 157, 92, 51, 31, 133, 110 |
| 2269 | 11581, 11580 | COL4A2 | 157, 154 |
| 2281 | 11605, 11604 | VWF | 64, 53, 31, 105, 103, 92, 132 |
| 2283 | 11609, 11608 | KCNH1 | 42, 31 |
| 2285 | 11613, 11612 | BIK | 31 |
| 2287 | 11617, 11616 | PTPRG | 157, 110, 31 |
| 2340 | 11723, 11722 | CRKL | 109 |
| 2379 | 11804, 11803 | CTNNBIP1 | 51, 118 |
| 2399 | 11844, 11843 | RANBP17 | 109 |
| 2412 | 11870, 11869 | ERBB4 | 31, 51, 154 |
| 2417 | 11886, 11885 | GPC1 | 31 |
| 2431 | 11914, 11913 | ROBO1 | 31, 157, 110 |
| 2451 | 11954, 11953 | SCN5A | 185, 34 |
| 2473 | 11998, 11997 | ABAT | 162 |
| 2480 | 12012, 12011 | CEACAM5 | 31, 110, 133, 51 |
| 2482 | 12016, 12015 | TP73 | 118, 112, 110, 51, 35, 31, 109, 90, 59 |
| 2494 | 12043, 12042 | PBX1 | 109 |
| 2498 | 12051, 12050 | MECP2 | 24, 133 |
| 2517 | 12089, 12088 | PRKCG | 31, 8, 154, 51 |
| 2538 | 12131, 12130 | TUB | 134 |
| 2543 | 12141, 12140 | ST7 | 51, 31, 24, 90, 83 |
| 2549 | 12153, 12152 | HLF | 109 |
| 2551 | 12157, 12156 | SEMA3F | 110 |
| 2558 | 12171, 12170 | APLP2 | 8 |
| 2583 | 12221, 12220 | RANBP17 | 109 |
| 2589 | 12236, 12235 | NTRK3 | 116, 8, 109, 157 |
| 2595 | 12248, 12247 | C3 | 51, 31, 8, 105, 92, 64, 134, 110 |
| 2615 | 12288, 12287 | GRIK1 | 82, 77, 70, 10 |
| 2636 | 12329, 12328 | PBX1 | 109 |
| 2651 | 12359, 12358 | DLEU2 | 109 |
| 2662 | 12381, 12380 | DAPK1 | 51, 31, 30, 112, 110, 109, 176, 133 |
| 2668 | 12393, 12392 | CDC27 | 118 |
| 2677 | 12411, 12410 | PAH | 162 |
| 2734 | 12528, 12527 | ALK | 112, 93 |
| 2769 | 12597, 12596 | ED1 | 166, 118 |
| 2781 | 12621, 12620 | GRM7 | 162 |
| 2788 | 12635, 12634 | HDGF | 90, 83 |
| 2808 | 12677, 12676 | DPYD | 30, 157, 106, 83, 51, 31 |
| 2831 | 12727, 12726 | CAST | 98, 63, 8, 160, 111, 109 |
| 2841 | 12747, 12746 | TBX2 | 31 |
| 2853 | 12771, 12770 | CALCR | 160, 136, 31 |
| 2860 | 12785, 12784 | MYH7 | 129, 100 |
| 2861 | 12787, 12786 | AUTS2 | 24 |
| 2881 | 12830, 12829 | SERPINA5 | 172 |

TABLE 6-continued

RELATION OF MICRORNAS TO DISEASES BY HOST GENES

| HID | MID | H. Gene | Disease(s) |
|---|---|---|---|
| 2883 | 12834, 12833 | CACNA1G | 109, 51 |
| 2887 | 12842, 12841 | CDH13 | 31, 176, 133, 110, 51, 167 |
| 2892 | 12852, 12851 | ITGA5 | 51, 35, 155, 112, 109, 90, 133, 122, 118 |
| 2917 | 12902, 12901 | MITF | 118, 60 |
| 2918 | 12904, 12903 | DYSF | 129 |
| 2932 | 12932, 12931 | MME | 167, 133, 110, 8 |
| 2938 | 12944, 12943 | RORA | 154, 31 |
| 2943 | 12954, 12953 | ST7 | 51, 31, 24, 90, 83 |
| 2966 | 13000, 12999 | PTPRF | 134, 31 |
| 2973 | 13014, 13013 | KCNQ1 | 60, 21 |
| 2980 | 13028, 13027 | MEIS1 | 109 |
| 2998 | 13064, 13063 | HOXB3 | 109 |
| 3003 | 13074, 13073 | CSEN | 8 |
| 3023 | 13119, 13118 | PPP2R1B | 51, 31, 110 |
| 3039 | 13154, 13153 | DYSF | 129 |
| 3052 | 13180, 13179 | CDH23 | 60 |
| 3056 | 13191, 13190 | ELN | 110 |
| 3105 | 13293, 13292 | AUTS2 | 24 |
| 3172 | 13430, 13429 | AUTS2 | 24 |
| 3178 | 13442, 13441 | OTOF | 60 |
| 3214 | 13514, 13513 | FUT8 | 138, 51 |
| 3222 | 13530, 13529 | HLF | 109 |
| 3227 | 13540, 13539 | TCF4 | 162, 29 |
| 3250 | 13586, 13585 | ACTN4 | 31 |
| 3300 | 13686, 13685 | ACPP | 181, 154, 30 |
| 3308 | 13702, 13701 | AR | 154, 92, 110, 51, 8, 31 |
| 3312 | 13710, 13709 | GLP1R | 132, 64 |
| 3338 | 13762, 13761 | KCNQ1 | 60, 21 |
| 3361 | 13811, 13810 | RORA | 154, 31 |
| 3409 | 13907, 13906 | GRIA3 | 82, 77, 29 |
| 3422 | 13933, 13932 | DDC | 167, 105, 162, 29, 24, 144, 36, 64, 23, 133 |
| 3427 | 13943, 13942 | PTPRG | 157, 110, 31 |
| 3489 | 14066, 14065 | EDNRA | 64, 51, 42, 132, 108, 98, 31, 174, 134 |
| 3504 | 14096, 14095 | COPEB | 154 |
| 3542 | 14173, 14172 | MLLT2 | 109 |
| 3561 | 14211, 14210 | GYPC | 114 |
| 3592 | 14272, 14271 | FKBP5 | 154 |
| 3608 | 14304, 14303 | BCL11A | 112, 109, 93 |
| 3613 | 14318, 14317, 14316 | HTR2C | 162, 29, 120 |
| 3618 | 14328, 14327 | ALCAM | 118 |
| 3684 | 14460, 14459 | ERBB4 | 31, 51, 154 |
| 3693 | 14478, 14477 | ZNFN1A1 | 112, 109 |
| 3754 | 14601, 14600 | EPB41 | 114 |
| 3756 | 14605, 14604 | SLC7A5 | 51 |
| 3778 | 14651, 14650 | SDC2 | 24 |
| 3794 | 14683, 14682 | ST7 | 51, 31, 24, 90, 83 |
| 3803 | 14702, 14701 | WT1 | 31, 133, 110 |
| 3856 | 14808, 14807 | STS | 31 |
| 3878 | 14855 | ADAM12 | 109, 90, 47, 134, 122, 112 |
| 3885 | 14869, 14868 | FGFR2 | 79, 31, 30, 154 |
| 3890 | 14879, 14878 | C3 | 51, 31, 8, 105, 92, 64, 134, 110 |
| 3902 | 14903, 14902 | DLEU2 | 109 |
| 3924 | 14946, 14945 | HOXC8 | 42, 51 |
| 3928 | 14954, 14953 | PTPRN2 | 64, 105 |
| 3929 | 14956, 14955 | HTR2C | 162, 29, 120 |
| 3935 | 14968, 14967 | GNAO1 | 8 |
| 3955 | 15008, 15007 | PRDX1 | 70, 8, 109 |
| 3997 | 15099, 15098 | PRKCA | 51, 31, 150, 110, 64, 8, 132 |
| 4000 | 15106, 15105 | CDH5 | 118 |
| 4006 | 15118, 15117 | RUNX1 | 109, 160 |
| 4014 | 15134, 15133 | GNAO1 | 8 |
| 4020 | 15146, 15145 | AMPH | 31 |
| 4025 | 15156, 15155 | ETS1 | 110, 51, 31 |
| 4059 | 15222, 15221 | APPBP2 | 31 |
| 4069 | 15242, 15241 | MLLT2 | 109 |
| 4085 | 15274, 15273 | ALK | 112, 93 |
| 4086 | 15276, 15275 | PTN | 118, 31, 167, 154, 141, 133 |
| 4136 | 15376, 15375 | PTPRN2 | 64, 105 |
| 4145 | 15394, 15393 | APBB1 | 144, 8 |
| 4152 | 15408, 15407 | DYSF | 129 |
| 4160 | 15424, 15423 | PLCB1 | 167 |
| 4162 | 15428, 15427 | DPYD | 30, 157, 106, 83, 51, 31 |
| 4171 | 15452, 15451 | MLLT3 | 109 |
| 4179 | 15468, 15467 | ALK | 112, 93 |
| 4211 | 15532, 15531 | TRPM1 | 118 |

TABLE 6-continued

RELATION OF MICRORNAS TO DISEASES BY HOST GENES

| HID | MID | H. Gene | Disease(s) |
|---|---|---|---|
| 4217 | 15544, 15543 | IGFBP2 | 64, 31, 51, 132, 110, 105, 134 |
| 4229 | 15568, 15567 | ALK | 112, 93 |
| 4232 | 15574, 15573 | LPP | 110, 109 |
| 4270 | 15653, 15652 | NF1 | 31, 118, 110, 51, 167 |
| 4275 | 15663, 15662 | MGAT5 | 88, 51, 118, 90 |
| 4286 | 15685, 15684 | MST1R | 133, 31, 110, 51 |
| 4289 | 15691, 15690 | NTRK1 | 31, 116, 173, 167, 8 |
| 4300 | 15713, 15712 | FHIT | 133, 110, 42, 31 |
| 4315 | 15743, 15742 | APBA2 | 75, 51, 8 |
| 4323 | 15759, 15758 | CACNA1A | 120, 61 |
| 4344 | 15801, 15800 | GRIA3 | 82, 77, 29 |
| 4352 | 15817, 15816 | COL11A2 | 60 |
| 4360 | 15833, 15832 | RAD51L1 | 110 |
| 4384 | 15885, 15884 | TERT | 110, 51, 31, 133 |
| 4389 | 15895, 15894 | APBA2 | 75, 51, 8 |
| 4391 | 15899, 15898 | TPO | 60, 174, 102, 61 |
| 4401 | 15919, 15918 | TMC1 | 60 |
| 4402 | 15921, 15920 | AK1 | 86 |
| 4406 | 15929, 15928 | MLLT3 | 109 |
| 4410 | 15936 | CDK6 | 133, 51, 31, 167 |
| 4422 | 15960, 15959 | VWF | 64, 53, 31, 105, 103, 92, 132 |
| 4423 | 15962, 15961 | NR3C2 | 57, 98 |
| 4446 | 16008, 16007 | FHIT | 133, 110, 42, 31 |
| 4454 | 16024, 16023 | DCC | 51 |
| 4469 | 16054, 16053 | GRIA2 | 8, 77, 82, 162 |
| 4470 | 16056, 16055 | ATP1A1 | 98, 64, 8, 105 |
| 4472 | 16060, 16059 | PTPRG | 157, 110, 31 |
| 4476 | 16068, 16067 | SCG3 | 154 |
| 4477 | 16070, 16069 | CBFA2T1 | 109 |
| 4480 | 16076, 16075 | FKBP5 | 154 |
| 4498 | 16115 | ERBB4 | 31, 51, 154 |
| 4509 | 16137, 16136 | HOXB3 | 109 |
| 4529 | 16177, 16176 | GRM7 | 162 |
| 4547 | 16213, 16212 | CDX1 | 106, 51 |
| 4587 | 16293, 16292 | SLC7A5 | 51 |
| 4589 | 16297, 16296 | RANBP17 | 109 |
| 4596 | 16311, 16310 | CACNA1A | 120, 61 |
| 4608 | 16335, 16334 | APBA2 | 75, 51, 8 |
| 4618 | 16355, 16354 | NTRK2 | 10, 154, 8, 162 |
| 4619 | 16357, 16356 | OTOF | 60 |
| 4628 | 16375, 16374 | PTPRN2 | 64, 105 |
| 4659 | 16437, 16436 | CACNA1A | 120, 61 |
| 4660 | 16439, 16438 | CUBN | 117 |
| 4672 | 16464, 16463 | MTAP | 110, 109, 133 |
| 4674 | 16468, 16467 | DYSF | 129 |
| 4680 | 16480, 16479 | PTPRN | 64, 105, 85 |
| 4695 | 16510, 16509 | PRKCA | 51, 31, 150, 110, 64, 8, 132 |
| 4706 | 16533, 16532 | KCNH1 | 42, 31 |
| 4711 | 16543, 16542 | GRIA3 | 82, 77, 29 |
| 4714 | 16549, 16548 | GLP1R | 132, 64 |
| 4723 | 16567, 16566 | THRA | 157, 150 |
| 4761 | 16643, 16642 | PSG1 | 70 |
| 4792 | 16706, 16705 | SEMA3F | 110 |
| 4802 | 16729, 16728 | MPZ | 112 |
| 4858 | 16840, 16839 | AUTS2 | 24 |
| 4864 | 16852, 16851 | NF1 | 31, 118, 110, 51, 167 |
| 4866 | 16856, 16855 | RPA1 | 110, 51, 31, 133 |
| 4872 | 16868, 16867 | PTPRN | 64, 105, 85 |
| 4886 | 16896, 16895 | CD3Z | 93, 157, 111 |
| 4897 | 16918, 16917 | MSN | 70, 92, 160 |
| 4898 | 16920, 16919 | GAP43 | 8, 62, 10, 162, 29 |
| 4900 | 16924, 16923 | PAX2 | 157 |
| 4909 | 16942, 16941 | MYH6 | 129, 100 |
| 4919 | 16962, 16961 | HK2 | 134, 132, 64 |
| 4929 | 16982, 16981 | ZNFN1A1 | 112, 109 |
| 4936 | 16996, 16995 | TNC | 118, 110, 98, 31, 180, 154, 79, 51 |
| 4941 | 17006, 17005 | PLCB1 | 167 |
| 4959 | 17043, 17042 | PTPRF | 134, 31 |
| 5001 | 17130, 17129 | ERBB2 | 110, 133, 154, 26, 176, 167, 51, 31, 30 |
| 5026 | 17183, 17182 | YWHAG | 118 |
| 5037 | 17205, 17204 | KCNN3 | 162, 29 |
| 5040 | 17211, 17210 | DPYD | 30, 157, 106, 83, 51, 31 |
| 5070 | 17272, 17271 | MUC1 | 110, 133, 31 |
| 5079 | 17290, 17289 | CDC10 | 112 |
| 5126 | 17384, 17383 | GRB7 | 83, 31 |

TABLE 6-continued

RELATION OF MICRORNAS TO DISEASES BY HOST GENES

| HID | MID | H. Gene | Disease(s) |
|---|---|---|---|
| 5134 | 17400, 17399 | HTR2C | 162, 29, 120 |
| 5139 | 17410, 17409 | ROBO1 | 31, 157, 110 |
| 5143 | 17418, 17417 | GRIA2 | 8, 77, 82, 162 |
| 5166 | 17464, 17463 | ALK | 112, 93 |
| 5174 | 17480, 17479 | CENPF | 90, 31 |
| 5189 | 17510, 17509 | PROS1 | 172 |
| 5231 | 17594, 17593 | CTNND2 | 154 |
| 5263 | 17659, 17658 | BCL9 | 112, 109 |
| 5309 | 17751, 17750 | MLLT3 | 109 |
| 5331 | 17796, 17795 | PTPRF | 134, 31 |
| 5332 | 17798, 17797 | GRIA4 | 82, 77, 8 |
| 5350 | 17834, 17833 | PAPPA | 53, 70 |
| 5363 | 17860, 17859 | GRIN2B | 162, 77, 8 |
| 5406 | 17948, 17947 | SYN2 | 8, 162 |
| 5409 | 17954, 17953 | DYSF | 129 |
| 5504 | 18146, 18145 | ST7 | 51, 31, 24, 90, 83 |
| 5518 | 18174, 18173 | CPB2 | 172, 127 |
| 5556 | 18250, 18249 | MAP2K5 | 154 |
| 5563 | 18264, 18263 | PRKCA | 51, 31, 150, 110, 64, 8, 132 |
| 5603 | 18344, 18343 | MUC1 | 110, 133, 31 |
| 5630 | 18397, 18396 | FMR2 | 84 |
| 5636 | 18409, 18408 | PRDM2 | 90, 51, 79, 31, 112, 110 |
| 5638 | 18413, 18412 | THRB | 157, 154, 150, 133, 31, 167 |
| 5647 | 18433, 18432 | MOBP | 123 |
| 5670 | 18479, 18478 | APBA2 | 75, 51, 8 |
| 5686 | 18511, 18510 | LPA | 52, 8 |
| 5697 | 18535, 18534 | ACTN4 | 31 |
| 5711 | 18567, 18566 | CDH13 | 31, 176, 133, 110, 51, 167 |
| 5721 | 18587, 18586 | SREBF1 | 132, 92, 64, 134 |
| 5725 | 18595, 18594 | SCN5A | 185, 34 |
| 5738 | 18621, 18620 | TCF4 | 162, 29 |
| 5745 | 18635, 18634 | HTR2C | 162, 29, 120 |
| 5765 | 18675, 18674 | CSEN | 8 |
| 5803 | 18754, 18753 | PTPRF | 134, 31 |
| 5820 | 18789, 18788 | FMR2 | 84 |
| 5827 | 18803, 18802 | HOXA3 | 109 |
| 5832 | 18813, 18812 | HSD11B1 | 134 |
| 5833 | 18815, 18814 | GRIN2B | 162, 77, 8 |
| 5869 | 18887, 18886 | HSPG2 | 133, 110, 31, 8 |
| 5890 | 18931, 18930 | DAB1 | 162 |
| 5901 | 18955, 18954 | TIAM1 | 157, 70, 31 |
| 5913 | 18978, 18977 | ITGA11 | 133 |
| 5923 | 18998, 18997 | PTCH | 30, 27, 166, 83, 31 |
| 5942 | 19036, 19035 | DCC | 51 |
| 5943 | 19038, 19037 | SFTPB | 110 |
| 5967 | 19091, 19090 | GFRA1 | 116 |
| 6006 | 19170, 19169 | CDH13 | 31, 176, 133, 110, 51, 167 |
| 6025 | 19207, 19206 | AUTS2 | 24 |
| 6044 | 19245, 19244 | BCL11B | 109 |
| 6057 | 19271, 19270 | PTPRG | 157, 110, 31 |
| 6070 | 19297, 19296 | CXADR | 154, 30 |
| 6082 | 19321, 19320 | GABRA3 | 82, 29, 47, 123 |
| 6118 | 19393, 19392 | DMD | 129 |
| 6127 | 19411, 19410 | PRKCG | 31, 8, 154, 51 |
| 6151 | 19459, 19458 | STS | 31 |
| 6152 | 19461, 19460 | HTR2C | 162, 29, 120 |
| 6159 | 19475, 19474 | PARK2 | 144, 61 |
| 6164 | 19485, 19484 | ED1 | 166, 118 |
| 6213 | 19583, 19582 | NCOR2 | 109, 31 |
| 6220 | 19597, 19596 | CRHR1 | 57 |
| 6233 | 19624, 19623 | GRM3 | 162, 29 |
| 6255 | 19668, 19667 | LIPC | 97, 64, 53, 132, 105 |
| 6272 | 19702, 19701 | TIE | 109, 31, 4, 166, 157, 118 |
| 6285 | 19728, 19727 | PAX5 | 112 |
| 6289 | 19736, 19735 | MME | 167, 133, 110, 8 |
| 6327 | 19812, 19811 | IGSF4 | 133, 110, 90, 154, 31 |
| 6329 | 19816, 19815 | GRM7 | 162 |
| 6338 | 19834, 19833 | RAD51L1 | 110 |
| 6342 | 19842, 19841 | GOLGA5 | 173 |
| 6344 | 19846, 19845 | BAI1 | 133, 110, 51 |
| 6385 | 19929, 19928 | CTNNA1 | 152, 51 |
| 6398 | 19956, 19955 | AUTS2 | 24 |
| 6408 | 19976, 19975 | LGI1 | 82 |
| 6418 | 19996, 19995 | KCNQ3 | 82 |
| 6420 | 20000, 19999 | MYO7A | 60 |

TABLE 6-continued

RELATION OF MICRORNAS TO DISEASES BY HOST GENES

| HID | MID | H. Gene | Disease(s) |
|---|---|---|---|
| 6421 | 20002, 20001 | NTRK3 | 116, 8, 109, 157 |
| 6447 | 20060, 20059 | CHD4 | 63 |
| 6503 | 20172, 20171 | ACVR1B | 150, 140 |
| 6505 | 20176, 20175 | CDK6 | 133, 51, 31, 167 |
| 6521 | 20208, 20207 | SGCD | 100, 129 |
| 6542 | 20252, 20251 | HMGA2 | 79, 110 |
| 6571 | 20311, 20310 | HK2 | 134, 132, 64 |
| 6575 | 20319, 20318 | DBP | 87 |
| 6577 | 20323, 20322 | MTAP | 110, 109, 133 |
| 6580 | 20329, 20328 | TGFBI | 83 |
| 6582 | 20333, 20332 | KCNQ3 | 82 |
| 6588 | 20345, 20344 | SLC7A5 | 51 |
| 6600 | 20369, 20368 | PTPRF | 134, 31 |
| 6602 | 20373, 20372 | FLJ22795 | 51, 110 |
| 6611 | 20391, 20390 | TGM1 | 133, 8 |
| 6612 | 20393, 20392 | CHRNB1 | 124 |
| 6614 | 20397, 20396 | PAX2 | 157 |
| 6670 | 20516, 20515 | GPC3 | 31, 90 |
| 6671 | 20518, 20517 | SCN5A | 185, 34 |
| 6676 | 20528, 20527 | CACNA1G | 109, 51 |
| 6696 | 20571, 20570 | PRKCA | 51, 31, 150, 110, 64, 8, 132 |
| 6742 | 20665, 20664 | GRIK4 | 162, 82 |
| 6756 | 20693, 20692 | HTR2C | 162, 29, 120 |
| 6760 | 20701, 20700 | NEB | 129 |
| 6776 | 20736, 20735 | TGFBR3 | 31 |
| 6779 | 20742, 20741 | HTR2C | 162, 29, 120 |
| 6789 | 20762, 20761 | GRIA3 | 82, 77, 29 |
| 6811 | 20806, 20805 | CPB1 | 141 |
| 6819 | 20822, 20821 | HD | 8, 51 |
| 6821 | 20826, 20825 | BCL11B | 109 |
| 6835 | 20854, 20853 | NLGN3 | 24 |
| 6844 | 20872, 20871 | MEST | 110, 51, 31 |
| 6846 | 20876, 20875 | CA12 | 31, 157 |
| 6847 | 20878, 20877 | GABRA3 | 82, 29, 47, 123 |
| 6867 | 20918, 20917 | BIK | 31 |
| 6887 | 20961, 20960 | CDH13 | 31, 176, 133, 110, 51, 167 |
| 6918 | 21023, 21022 | PAX3 | 118, 60 |
| 6960 | 21107, 21106 | PRKDC | 51, 109 |

TABLE 7

TISSUE AND DISEASE CODES FOR TABLE 2 AND 3

| Tissue or Disease name | ID |
|---|---|
| Prostate adenocarcinoma | 1 |
| Lung adenocarcinoma | 2 |
| Skeletal muscle | 3 |
| Spleen | 4 |
| Lung | 5 |
| Lung adenocarcinoma | 6 |
| Placenta | 7 |
| Embryonic Stem cells | 8 |
| Prostate adenocarcinoma | 9 |
| Prostate | 10 |
| Brain Substantia Nigra | 11 |
| Testis | 12 |
| Uterus carcinoma cell line (HeLa) | 13 |
| Adipose | 14 |
| Lung carcinoma cell line (H1299) | 15 |
| Lung carcinoma cell line (H1299) with P53 | 16 |
| Overy and Small Intestine (mixture) | 17 |
| Embryonic Stem carcinoma cells | 18 |
| Brain | 19 |
| Brain with Alzheimer | 20 |
| Uterus carcinoma cell line (cMagi) with HIV | 21 |
| T cell line (MT2) | 22 |
| T cell line (MT2) with HIV | 23 |
| Placenta and Brain Substantia Nigra (mixture) | 24 |
| B cell line | 25 |

TABLE 7-continued

TISSUE AND DISEASE CODES FOR TABLE 2 AND 3

| Tissue or Disease name | ID |
|---|---|
| T cell line (MT2) with HIV and Brain Substantia Nigra (mixture) | 26 |
| T cell line (MT2) with HIV and Lung adenocarcinoma (mixture) | 27 |

TABLE 8

DISEASE CODES FOR TABLES 5 AND 6

| Disease Name | ID |
|---|---|
| Addisons disease | 1 |
| Adenovirus | 2 |
| Adrenal cortical carcinoma | 3 |
| Aids | 4 |
| Allergic contact dermatitis | 5 |
| Alopecia | 6 |
| Alpha thalassemia | 7 |
| Alzheimer | 8 |
| Amyloidosis | 9 |
| Amyotrophic Lateral Sclerosis | 10 |
| Anal cancer | 11 |
| Anorexia Nervosa | 12 |
| Antisocial Personality Disorder | 13 |
| Aortic Aneurysm | 14 |
| Aortic stenosis | 15 |

TABLE 8-continued

DISEASE CODES FOR TABLES 5 AND 6

| Disease Name | ID |
| --- | --- |
| Aplastic anemia | 16 |
| Appendicitis | 17 |
| Asthma | 18 |
| Atherosclerosis | 19 |
| Atopic dermatitis | 20 |
| Atrial fibrillation | 21 |
| Atrophic gastriris | 22 |
| Attention Deficit Disorder | 23 |
| Autism | 24 |
| Bacillary Dysentery | 25 |
| Barrett Esophagus | 26 |
| Basal cell carcinoma | 27 |
| Beta Thalassemia | 28 |
| Bipolar Disorder | 29 |
| Bladder cancer | 30 |
| Breast cancer | 31 |
| Bronchiectasis | 32 |
| Bulimia | 33 |
| Bundle-Branch Block | 34 |
| Burkitt lymphoma | 35 |
| Carcinoid | 36 |
| Cataract | 37 |
| Celiac Disease | 38 |
| Cerebral Hemorrhage | 39 |
| Cerebral Infarction | 40 |
| Cerebrovascular Accident | 41 |
| Cervical cancer | 42 |
| Chlamydia | 43 |
| Cholelithiasis | 44 |
| Cholestasis | 45 |
| Chronic obstructive pulmonary disease | 46 |
| Cirrhosis | 47 |
| Cleft Lip | 48 |
| Cleft Palate | 49 |
| Clostridium | 50 |
| Colorectal cancer | 51 |
| Coronary artery disease | 52 |
| Coronary disease | 53 |
| Coronary spasm | 54 |
| Coxsackievirus | 55 |
| Crohn disease | 56 |
| Cushing Syndrome | 57 |
| Cystic fibrosis | 58 |
| Cytomegalovirus | 59 |
| Deafness | 60 |
| Dementia | 61 |
| Depressive Disorder | 62 |
| Dermatomyositis | 63 |
| Diabetes Mellitus | 64 |
| Diabetic Nephropathy | 65 |
| Diabetic Neuropathies | 66 |
| Diabetic Retinopathy | 67 |
| Diphtheria | 68 |
| Diverticulitis | 69 |
| Down Syndrome | 70 |
| Duodenal Neoplasms | 71 |
| Duodenal Ulcer | 72 |
| Dyslexia | 73 |
| *E. coli* | 74 |
| EBV | 75 |
| Emphysema | 76 |
| Encephalitis | 77 |
| Endocarditis | 78 |
| Endometrial carcinoma | 79 |
| Enterovirus | 80 |
| Enuresis | 81 |
| Epilepsy | 82 |
| Esophageal cancer | 83 |
| Fragile X Syndrome | 84 |
| Gestational Diabetes | 85 |
| Hemolytic anemia | 86 |
| Hemophilia | 87 |
| Hepatitis | 88 |
| Hepatocellular carcinoma | 89 |
| Hepatocellular carcinoma | 90 |

TABLE 8-continued

DISEASE CODES FOR TABLES 5 AND 6

| Disease Name | ID |
| --- | --- |
| Herpes | 91 |
| HIV | 92 |
| Hodgkin Disease | 93 |
| HTLV | 94 |
| Hypercholesterolemia | 95 |
| Hyperglycemia | 96 |
| Hyperlipidemia | 97 |
| Hypertension | 98 |
| Hypertrophic Cardiomopathy | 99 |
| Hypertrophic cardiomyopathy | 100 |
| Infectious Mononucleosis | 101 |
| Infertility | 102 |
| Inflammatory Bowel Diseases | 103 |
| Influenza | 104 |
| Insulin-Dependent Diabetes Mellitus | 105 |
| Intestinal Neoplasms | 106 |
| Kidney Failure | 107 |
| Left Ventricular Dysfunction | 108 |
| Leukemia | 109 |
| Lung cancer | 110 |
| Lupus Erythematosus | 111 |
| Lymphoma | 112 |
| Macular Degeneration | 113 |
| Malaria | 114 |
| Measles | 115 |
| Medullary thyroid carcinoma | 116 |
| Megaloblastic anemia | 117 |
| Melanoma | 118 |
| Meningitis | 119 |
| Migraine | 120 |
| Multiinfarct dementia | 121 |
| Multiple Myeloma | 122 |
| Multiple Sclerosis | 123 |
| Myasthenia Gravis | 124 |
| Mycobacterium | 125 |
| Mycoplasma | 126 |
| Myocardial Infarction | 127 |
| Myocarditis | 128 |
| Myopathy | 129 |
| Nephrogenic diabetes insipidus | 130 |
| Nephrolithiasis | 131 |
| Non-Insulin-Dependent Diabetes Mellitus | 132 |
| Nonsmall cell lung cancer | 133 |
| Obesity | 134 |
| Osteoarthritis | 135 |
| Osteoporosis | 136 |
| Otitis Media | 137 |
| Ovarian cancer | 138 |
| Pagets Disease | 139 |
| Pancreatic cancer | 140 |
| Pancreatitis | 141 |
| Papilloma | 142 |
| Paramyxoviridae | 143 |
| Parkinson | 144 |
| Peptic Ulcer | 145 |
| Peripheral Vascular Diseases | 146 |
| Peritonitis | 147 |
| Pertussis | 148 |
| Picornaviridae | 149 |
| Pituitary tumor | 150 |
| Polyposis | 151 |
| Polyposis coli | 152 |
| Postpartum depression | 153 |
| Prostate cancer | 154 |
| Psoriasis | 155 |
| Psoriatic arthritis | 156 |
| Renal cell carcinoma | 157 |
| Renal Tubular Acidosis | 158 |
| Respiratory Syncytial Virus | 159 |
| Rheumatoid arthritis | 160 |
| Rhinitis | 161 |
| Schizophrenia | 162 |
| Sickle cell anemia | 163 |
| Sideroblastic anemia | 164 |
| Sinusitis | 165 |

TABLE 8-continued

DISEASE CODES FOR TABLES 5 AND 6

| Disease Name | ID |
|---|---|
| Skin Neoplasms | 166 |
| Small cell carcinoma | 167 |
| Stroke | 168 |
| Sudden cardiac death | 169 |
| Syphilis | 170 |
| Thrombocytopenia | 171 |
| Thrombosis | 172 |
| Thyroid carcinoma | 173 |
| Thyroiditis | 174 |
| Toxoplasmosis | 175 |
| Transitional cell carcinoma | 176 |
| Trichomonas vaginitis | 177 |
| Tuberculosis | 178 |
| Turner Syndrome | 179 |
| Ulcerative colitis | 180 |
| Urethral neoplasms | 181 |
| Urinary calculi | 182 |
| Urticaria | 183 |
| Vascular dementia | 184 |
| Ventricular Fibrillation | 185 |
| Ventricular tachycardia | 186 |
| Virus Diseases | 187 |

TABLE 9

RELATION OF TARGET GENES TO DISEASE

| Gene Name | Disease Code |
|---|---|
| A2M | 8, 76, 144 |
| AAAS | 1 |
| AANAT | 27, 118 |
| AARS | 63 |
| AAT1 | 14 |
| AAT2 | 14 |
| ABAT | 162 |
| AECA1 | 53 |
| ABCA4 | 113 |
| ABCB1 | 31, 51, 92, 167, 110, 133, 152 |
| ABCB11 | 45 |
| ABCB4 | 31, 44, 45 |
| ABCB7 | 164 |
| AECC1 | 31, 110 |
| ABCC2 | 51, 90 |
| ABCC3 | 30, 110, 133, 167 |
| ABCC4 | 110 |
| ABCC5 | 92, 110 |
| ABCC6 | 109 |
| ABCC8 | 64, 132 |
| ABCD1 | 1 |
| ABCD3 | 51 |
| ABCG2 | 31, 109, 110 |
| ABL1 | 31, 51, 109 |
| ABL2 | 109 |
| ABO | 30, 109 |
| ABP1 | 42, 79, 154 |
| ACE | 8, 31, 65, 110, 127, 133 |
| ACHE | 8, 10 |
| ACO1 | 8 |
| ACP1 | 64, 105, 134 |
| ACP5 | 31, 107, 160 |
| ACPP | 30, 154, 181 |
| ACR | 102 |
| ACTA1 | 129 |
| ACTB | 8, 31, 51, 167 |
| ACTC | 100, 129, 162 |
| ACTG1 | 60 |
| ACTN4 | 31 |
| ACVR1 | 31, 150 |
| ACVR1B | 140, 150 |
| ACVR2 | 150 |
| ACY1 | 110, 157, 167 |
| AD2 | 8 |
| AD5 | 8 |
| AD6 | 8 |
| AD7C-NTP | 8 |
| AD8 | 8 |
| ADA | 86 |
| ADAM10 | 21, 135 |
| ADAM11 | 31 |
| ADAM12 | 47, 90, 109, 112, 122, 134 |
| ADAM17 | 160 |

TABLE 9-continued

RELATION OF TARGET GENES TO DISEASE

| Gene Name | Disease Code |
|---|---|
| ADAM2 | 8 |
| ADAMTS13 | 4, 171 |
| ADAMTS4 | 160 |
| ADCY1 | 8 |
| ADCY2 | 8 |
| ADCY8 | 8 |
| ADCYAP1 | 110, 140, 150, 154, 167 |
| ADD1 | 98 |
| ADFN | 60 |
| ADH1B | 83 |
| ADH1C | 31, 127 |
| ADM | 3, 52, 64, 132, 154, 79, 85, 108 |
| ADORA1 | 8, 58, 186 |
| ADORA3 | 118 |
| ADPRT | 31, 51, 110 |
| ADRA2A | 8, 23, 62, 134, 162 |
| ADRA2C | 23 |
| ADRB1 | 8, 52, 53, 98, 134 |
| ADRB2 | 8, 18, 58, 132, 134, 64, 97, 98 |
| ADRB3 | 53, 64, 67, 134, 97, 98, 132 |
| ADRBK1 | 53, 58, 98, 160 |
| ADSL | 24 |
| AF15Q14 | 109 |
| AF3P21 | 109 |
| AF5Q31 | 109 |
| AFM | 90 |
| AFP | 31, 154 |
| AGER | 8, 9, 64, 146, 105, 132, 133 |
| AGR2 | 31 |
| AGRN | 8 |
| AGRP | 12, 134 |
| AGT | 8, 64, 65, 98, 105, 132 |
| AGTR1 | 3, 15, 53, 127, 98, 99, 105, 64, 65, 95 |
| AGTR2 | 57, 95, 108 |
| AHR | 31, 79, 110, 154 |
| AIF1 | 40 |
| AIRE | 1, 64, 105, 174 |
| AK1 | 86 |
| AKAP12 | 110, 124 |
| AKR1B1 | 64, 66, 90, 105 |
| AKR1B10 | 90 |
| AKT1 | 10, 31, 64, 133, 154, 162, 79, 110, 132 |
| AKT2 | 31, 83, 110 |
| AKT3 | 31, 51, 110, 154 |
| ALAS2 | 164 |
| ALB | 4, 8, 31, 133, 167, 105, 110, 132, 51, 64, 92 |
| ALCAM | 118 |
| ALDH1A1 | 133, 157 |
| ALDH3A1 | 31, 83, 90 |
| ALDOA | 110 |
| ALK | 93, 112 |
| ALMS1 | 134 |
| ALOX12 | 64, 98, 132, 154 |
| ALOX15 | 51, 154 |
| ALOX15B | 154 |
| ALOX5 | 18, 31, 92, 140, 154, 180, 109, 110, 112 |
| ALOX5AP | 18, 92, 127, 168 |
| ALPL | 31 |
| ALPP | 70, 79 |
| ALS2 | 10 |
| ALS4 | 10 |
| ALS6 | 10 |
| ALSFTD | 10, 61 |
| AMACR | 51, 154 |
| AMBP | 92, 110 |
| AMFR | 30, 118, 133, 154 |
| AMN | 117 |
| AMPH | 31 |
| AMT | 96 |
| AMY2A | 64, 105 |
| ANG | 31, 42, 51, 109, 118, 154 |
| ANGPT1 | 31, 42, 133 |
| ANGPT2 | 31, 51, 90 |
| ANGPT4 | 31, 157 |
| ANON | 12 |

TABLE 9-continued

RELATION OF TARGET GENES TO DISEASE

| Gene Name | Disease Code |
|---|---|
| ANP32A | 92 |
| ANPEP | 51, 123 |
| ANXA1 | 31, 83, 110, 154 |
| ANXA2 | 110, 154, 167 |
| ANXA3 | 43 |
| AOC3 | 8, 61, 103, 107, 121 |
| AOCH | 49 |
| AOMS1 | 134 |
| AOMS2 | 134 |
| APBA1 | 51 |
| APBA2 | 8, 51, 75 |
| APBB1 | 8, 144 |
| APC | 31, 51, 83, 167, 151, 152, 154, 106, 110, 133 |
| APCS | 8, 9, 64, 132 |
| APEH | 157 |
| APEX1 | 10, 42, 51, 109 |
| APLP1 | 8 |
| APLP2 | 8 |
| APM1 | 12, 64, 92, 98, 132, 134 |
| APOA2 | 64, 95, 98, 127, 132 |
| APOA4 | 8, 9, 53, 134, 141, 105, 127, 132, 64, 95, 97 |
| APOB | 4, 8, 31, 105, 132, 64, 92, 95 |
| APOBEC1 | 51 |
| APOBEC3G | 92 |
| APOC1 | 8, 64, 95, 97, 132 |
| APOC2 | 8, 64, 132 |
| APOC3 | 8, 53, 64, 134, 97, 105, 132 |
| APOD | 8, 29, 31, 132, 162, 64, 123, 127 |
| APOH | 64, 111 |
| APOL1 | 162 |
| APOL2 | 162 |
| APOL4 | 162 |
| APP | 8, 9, 31, 123, 162 |
| APPBP2 | 31 |
| APRIN | 154 |
| APRT | 131, 182 |
| APXL | 118 |
| AQP1 | 157 |
| AQP2 | 81, 130 |
| AR | 8, 31, 51, 92, 110, 154 |
| AREG | 30, 31, 42, 155, 133, 51, 154 |
| ARG2 | 64 |
| ARH | 95 |
| ARHA | 31, 51, 89, 154, 159, 90, 110, 118 |
| ARHB | 31 |
| ARHC | 31 |
| ARHI | 31, 138 |
| ARHU | 31, 51, 157 |
| ARMD1 | 113 |
| ARMET | 140 |
| ARNT | 31, 109 |
| ARVCF | 29 |
| ARX | 82 |
| AS1 | 18 |
| ASAH1 | 20, 106, 154 |
| ASC | 17, 31 |
| ASCL1 | 167 |
| ASGR1 | 47, 88, 90 |
| ASPSCR1 | 157 |
| ATF1 | 118 |
| ATF2 | 31, 110, 118 |
| ATF3 | 51 |
| ATF6 | 8 |
| ATIC | 112 |
| ATM | 31, 93, 112 |
| ATP10A | 24 |
| ATP1A1 | 8, 64, 98, 105 |
| ATP1A2 | 120 |
| ATP1A4 | 120 |
| ATP2A1 | 129 |
| ATP2A2 | 29 |
| ATP6B1 | 60, 158 |
| ATP6V0A4 | 158 |
| ATP6V1B1 | 158 |
| ATP6V1G2 | 160 |

TABLE 9-continued

RELATION OF TARGET GENES TO DISEASE

| Gene Name | Disease Code |
|---|---|
| ATP7B | 31 |
| ATP8B1 | 45 |
| ATPIF1 | 129 |
| ATRX | 31, 51, 112 |
| AURKB | 51 |
| AUTS1 | 24 |
| AUTS2 | 24 |
| AUTS3 | 24 |
| AUTS4 | 24 |
| AVP | 110, 167 |
| AVPR1A | 24, 57, 98 |
| AVPR1B | 36, 57, 110, 150 |
| AVPR2 | 130 |
| AXIN1 | 90 |
| AXIN2 | 51 |
| AXL | 51, 90, 109, 110, 167 |
| AZGP1 | 31, 154 |
| AZU1 | 8 |
| B2M | 4, 8, 9, 123, 133, 92, 110, 118, 31, 51, 77 |
| B3GALT1 | 51 |
| B3GALT2 | 154 |
| BAALC | 109 |
| BACE | 8 |
| BACE2 | 8, 31, 51, 70 |
| BAD | 8, 109, 110, 118 |
| BAG1 | 31, 42, 109 |
| BAI1 | 51, 110, 133 |
| BAK1 | 8, 31, 51, 166, 110, 133, 154 |
| BAL | 112 |
| BARD1 | 31 |
| BAX | 8, 31, 51, 123, 167, 110, 133 |
| BBP | 8 |
| BCAR1 | 2, 31, 118 |
| BCAR3 | 31 |
| BCAS1 | 31, 51 |
| BCAS2 | 31 |
| BCHE | 8, 110 |
| BCL1 | 112 |
| BCL10 | 31, 42, 51, 157, 112, 122, 154, 79, 109, 110 |
| BCL11A | 93, 109, 112 |
| BCL11B | 109 |
| BCL2 | 4, 8, 31, 167, 112, 123, 133, 51, 92, 110 |
| BCL2L1 | 8, 31, 51, 167, 123, 133, 154, 92, 110, 122 |
| BCL3 | 48, 49, 83, 109, 112 |
| BCL6 | 4, 31, 112 |
| BCL7A | 93, 112 |
| BCL8 | 112 |
| BCL9 | 109, 112 |
| BCMP11 | 31 |
| BCPR | 31 |
| BDKRB1 | 160 |
| BDKRB2 | 18, 64, 92, 132, 154, 160 |
| BDNF | 8, 123 |
| BF | 174 |
| BFSP2 | 37 |
| BGLAP | 31, 64, 92, 136, 105, 110, 132 |
| BID | 90, 154 |
| BIK | 31 |
| BIN1 | 31, 118, 154 |
| BIRC2 | 42, 83, 123 |
| BIRC3 | 110, 112, 122, 123 |
| BIRC4 | 51, 109, 122, 133 |
| BIRC5 | 31, 51, 110, 133, 140 |
| BIRC7 | 118 |
| BLCAP | 30, 157 |
| BLM | 51, 106, 109 |
| BLMH | 8, 35, 112 |
| BLR1 | 4, 92, 109, 112, 122, 123 |
| BLZF1 | 109 |
| BMP1 | 154 |
| BMP2 | 154 |
| BMP3 | 154 |
| BMP6 | 154 |
| BMPR1A | 151 |
| BMPR2 | 98, 154 |

TABLE 9-continued

| RELATION OF TARGET GENES TO DISEASE | |
|---|---|
| Gene Name | Disease Code |
| BMX | 154 |
| BPGM | 86 |
| BRAF | 51, 110, 118 |
| BRCA1 | 31, 51, 138 |
| BRCA2 | 31, 51, 110, 133, 140, 154 |
| BRCA3 | 31 |
| BRCATA | 31 |
| BRCD1 | 31 |
| BRIP1 | 31 |
| BRS3 | 110, 134 |
| BSG | 92, 118, 166 |
| BSND | 60 |
| BST2 | 122 |
| BTC | 79 |
| BUB1 | 51, 109, 110, 112, 133 |
| BUB1B | 51, 109, 112 |
| BULN | 33 |
| BZRP | 8, 31, 162 |
| C11orf17 | 31, 154 |
| C13orf1 | 109 |
| C1QA | 111 |
| C1QB | 8, 10 |
| C1R | 8, 77, 123 |
| C1S | 8, 111 |
| C21orf107 | 70 |
| C21orf33 | 60 |
| C3 | 8, 31, 51, 110, 134, 64, 92, 105 |
| C3AR1 | 18, 119, 123 |
| C4A | 64, 105, 111, 127 |
| C4BPA | 148 |
| C4BPB | 148 |
| C5 | 8, 92, 119, 127 |
| C5orf7 | 109 |
| C5R1 | 18, 92, 119, 123 |
| C6orf15 | 155 |
| C6orf18 | 155 |
| C7 | 8 |
| C9 | 8, 63, 119, 123, 127 |
| CA1 | 109, 133, 141 |
| CA12 | 31, 157 |
| CA2 | 158 |
| CA9 | 31, 42, 51, 118, 133, 157 |
| CAAR | 37 |
| CAB2 | 31 |
| CACNA1A | 61, 120 |
| CACNA1G | 51, 109 |
| CACNA2D2 | 133 |
| CACNB2 | 82, 167 |
| CACNB4 | 82 |
| CALB1 | 8, 10, 51, 82, 144 |
| CALB2 | 8, 51, 162 |
| CALCA | 110, 136, 167 |
| CALCB | 116, 160 |
| CALCR | 31, 136, 160 |
| CALCRL | 98 |
| CALR | 35, 38, 51, 160, 111, 112, 154 |
| CANX | 31, 58 |
| CAPN10 | 64, 132 |
| CARD15 | 56, 103, 156, 180 |
| CARD4 | 103 |
| CART | 134 |
| CASP1 | 4, 31, 51, 92, 123 |
| CASP10 | 93, 112, 133 |
| CASP2 | 8, 109 |
| CASP3 | 8, 31, 42, 154, 110, 123, 133, 51, 92, 109 |
| CASP5 | 51, 79, 133 |
| CASP6 | 31, 118, 154 |
| CASP7 | 31, 51, 154, 157 |
| CASP8 | 8, 31, 51, 157, 167, 92, 110, 133 |
| CASP9 | 4, 8, 31, 122, 133, 51, 90, 110 |
| CASQ2 | 186 |
| CASR | 31, 64, 132, 136 |
| CAST | 8, 63, 98, 109, 111, 160 |
| CAT | 4, 8, 31, 110, 132, 133, 51, 64, 92 |
| CATM | 37 |

TABLE 9-continued

RELATION OF TARGET GENES TO DISEASE

| Gene Name | Disease Code |
|---|---|
| CAV1 | 31, 47, 51, 154, 155, 83, 92, 110 |
| CAV2 | 83, 154 |
| CBFA2T1 | 109 |
| CBFA2T3 | 31, 109 |
| CBL | 109, 112 |
| CBS | 19, 70 |
| CCA1 | 37 |
| CCAL1 | 135 |
| CCFDN | 37 |
| CCK | 8, 64, 132, 167 |
| CCKAR | 44, 64, 132, 134, 141, 162 |
| CCKBR | 51, 64, 110, 132, 162, 167 |
| CCL1 | 5, 92, 125, 159 |
| CCL11 | 18, 20, 56, 165, 180, 183, 92, 93, 159 |
| CCL13 | 18, 155 |
| CCL17 | 5, 18, 20, 93, 109 |
| CCL2 | 8, 31, 64, 167, 123, 132, 133, 92, 105, 110 |
| CCL20 | 155, 160 |
| CCL21 | 20 |
| CCL24 | 18 |
| CCL3 | 4, 31, 51, 92, 94, 123 |
| CCL4 | 4, 8, 31, 123, 133, 92, 94, 110 |
| CCL5 | 31, 42, 92, 94, 123, 133 |
| CCL7 | 18, 20, 92, 123, 180 |
| CCL8 | 92, 112 |
| CCNA1 | 109 |
| CCNB1 | 8, 31, 51, 110, 133 |
| CCNC | 31, 109 |
| CCND1 | 31, 51, 110, 180, 133, 112, 122, 167 |
| CCND2 | 31, 51 |
| CCND3 | 31, 35, 109, 112, 118, 122 |
| CCNE1 | 31, 110, 133, 167 |
| CCNE2 | 31, 42, 109, 133, 167 |
| CCNI | 31 |
| CCNP | 37 |
| CCNT1 | 92 |
| CCR1 | 88, 91, 92, 123, 160 |
| CCR2 | 4, 18, 61, 135, 136, 160, 92, 122, 123 |
| CCR3 | 18, 20, 92, 93, 123 |
| CCR4 | 18, 20, 88, 112, 123, 92, 93, 111 |
| CCR5 | 4, 61, 92, 123 |
| CCR6 | 94, 109, 112, 122, 160 |
| CCR7 | 31, 59, 92, 118, 93, 109, 112 |
| CCR8 | 18, 46, 92, 123 |
| CCS | 10 |
| CCSSO | 37 |
| CCT | 37 |
| CCV | 37 |
| CD14 | 4, 31, 51, 92, 123 |
| CD151 | 110, 133 |
| CD163 | 109, 123, 160 |
| CD19 | 31, 51, 92, 110 |
| CD1A | 31, 92 |
| CD1B | 20, 123 |
| CD1C | 111 |
| CD1D | 64, 105, 109 |
| CD22 | 92 |
| CD24 | 31, 35, 90, 133, 154, 167, 109, 110, 112 |
| CD33 | 31 |
| CD34 | 31, 92 |
| CD36 | 31, 64, 92, 167, 114, 171, 110, 132 |
| CD37 | 109, 112 |
| CD38 | 4, 64, 92, 105, 132 |
| CD3G | 92 |
| CD3Z | 93, 111, 157 |
| CD4 | 4, 31, 92, 111 |
| CD44 | 31, 51, 92, 133, 157, 109, 110, 123 |
| CD47 | 109 |
| CD58 | 31, 51, 64, 92, 105 |
| CD59 | 4, 8, 31, 114, 51, 92, 110 |
| CD63 | 92, 118 |
| CD68 | 4, 92 |
| CD69 | 18, 31, 64, 160, 178, 92, 105, 111 |
| CD74 | 110, 133, 167 |
| CD80 | 31, 51, 64, 123, 105, 92, 110 |

TABLE 9-continued

RELATION OF TARGET GENES TO DISEASE

| Gene Name | Disease Code |
|---|---|
| CD83 | 31, 92, 109, 157 |
| CD86 | 31, 51, 64, 92, 105, 123 |
| CD8A | 38, 88, 92, 93, 109, 157 |
| CD8B1 | 92 |
| CD9 | 31, 51, 133, 167 |
| CD97 | 112, 160 |
| CDA | 109 |
| CDC10 | 112 |
| CDC2 | 8, 31, 51, 167, 92, 110, 133 |
| CDC25A | 31, 51, 83, 112, 133 |
| CDC25B | 31, 51, 83, 112, 133 |
| CDC25C | 79, 112, 166 |
| CDC27 | 118 |
| CDC2L1 | 112, 118 |
| CDC2L2 | 118 |
| CDC42 | 31, 51 |
| CDH1 | 31 |
| CDH11 | 31, 51, 154 |
| CDH13 | 31, 51, 110, 133, 167, 176 |
| CDH17 | 109 |
| CDH23 | 60 |
| CDH5 | 118 |
| CDH6 | 157, 167 |
| CDK10 | 31, 112 |
| CDK2 | 31, 42, 51, 110, 133 |
| CDK4 | 8, 31, 51, 110, 118, 133 |
| CDK5 | 8, 10 |
| CDK5R1 | 8, 70 |
| CDK6 | 31, 51, 133, 167 |
| CDK7 | 31, 51 |
| CDK9 | 92 |
| CDKN1A | 31, 51, 79, 133, 167, 180, 90, 92, 110 |
| CDKN1B | 31, 110, 133, 167 |
| CDKN1C | 3, 30, 31, 110, 141, 51, 90, 109 |
| CDKN2A | 8, 31, 51, 133, 140, 167, 109, 110, 118 |
| CDKN2A__ARF | 31, 51, 110, 133, 180 |
| CDKN2B | 31, 110, 133, 167 |
| CDKN2C | 8, 31, 94, 122, 133, 109, 112, 118 |
| CDKN2D | 31, 109, 110, 167 |
| CDPD1 | 60 |
| CDR2 | 31 |
| CDSN | 155 |
| CDW52 | 109, 123, 160, 174 |
| CDX1 | 51, 106 |
| CDX2 | 51, 106, 151 |
| CDY1 | 102 |
| CEACAM1 | 31, 51, 79, 154, 90, 110, 118 |
| CEACAM5 | 31, 51, 110, 133 |
| CEACAM6 | 31, 51, 109, 133 |
| CEACAM8 | 135, 157, 160 |
| CEBPA | 31, 90, 109, 110 |
| CEBPB | 31, 51, 92 |
| CEBPE | 109 |
| CENPF | 31, 90 |
| CES2 | 51 |
| CETP | 53, 64, 105, 132 |
| CFLAR | 93, 109, 112, 118, 122, 123 |
| CFM1 | 58 |
| CFTR | 18, 32, 58, 102, 141 |
| CGA | 30, 31, 70, 110, 150 |
| CGB | 31, 110, 133 |
| CGB5 | 30, 110 |
| CGB7 | 110 |
| CGB8 | 30, 110 |
| CHAT | 8, 10, 124 |
| CHD3 | 63 |
| CHD4 | 63 |
| CHEK2 | 31, 51, 110, 154, 167 |
| CHGA | 110, 133, 167 |
| CHGB | 36, 110, 167 |
| CHI3L1 | 31, 160 |
| CHK | 31, 51, 166 |
| CHL1 | 162 |
| CHRM1 | 8, 144, 162 |
| CHRM2 | 8, 18, 62, 162, 169 |

TABLE 9-continued

RELATION OF TARGET GENES TO DISEASE

| Gene Name | Disease Code |
|---|---|
| CHRM3 | 8, 18, 51, 154 |
| CHRM4 | 8, 18, 144 |
| CHRNA1 | 124 |
| CHRNA3 | 82 |
| CHRNA4 | 8, 24, 82, 144 |
| CHRNA5 | 82 |
| CHRNA7 | 8, 24, 144, 162 |
| CHRNB1 | 124 |
| CHRNB2 | 82, 162 |
| CHRNE | 124 |
| CHRNG | 124 |
| CHST2 | 51 |
| CHUK | 31, 118, 154 |
| CHX10 | 37 |
| CIP29 | 35, 90, 109, 112 |
| CIRH1A | 47 |
| CKB | 8, 109, 127 |
| CKMT1 | 93, 129 |
| CLCA1 | 51 |
| CLCN2 | 82 |
| CLCN5 | 131 |
| CLCNKB | 98 |
| CLDN1 | 31, 51 |
| CLDN11 | 123 |
| CLDN14 | 60 |
| CLOCK | 62 |
| CLTCL1 | 112 |
| CLU | 8, 10, 31, 127, 154 |
| CMD1B | 129 |
| CMD1C | 129 |
| CMD1E | 129 |
| CMD1F | 129 |
| CMD1H | 129 |
| CMD1J | 129 |
| CMD1K | 129 |
| CMH6 | 129, 144 |
| CMKBR2 | 92 |
| CMKBR5 | 92 |
| CMM | 118 |
| CNK | 110 |
| CNN1 | 90 |
| CNP | 8, 70, 123 |
| CNR1 | 31, 144, 154, 162 |
| CNTF | 8, 10, 122, 162 |
| COCH | 60 |
| COL11A2 | 60 |
| COL17A1 | 27, 91, 154 |
| COL18A1 | 31, 35, 90, 112, 157, 109, 133 |
| COL1A1 | 136 |
| COL1A2 | 136 |
| COL2A1 | 60, 135 |
| COL3A1 | 14 |
| COL4A1 | 154 |
| COL4A2 | 154, 157 |
| COL4A3 | 118 |
| COL4A4 | 67 |
| COL4A6 | 83, 154, 157 |
| COL6A1 | 70, 129 |
| COL6A2 | 129 |
| COL6A3 | 129 |
| COL9A3 | 129 |
| COMP | 160 |
| COMT | 23, 29, 31, 62, 144, 162 |
| COPEB | 154 |
| COPS5 | 31, 150 |
| CORTBP2 | 24 |
| COX15 | 129 |
| COX4I1 | 8 |
| CP | 8, 64, 105, 110, 132, 144 |
| CPA5 | 24 |
| CPB1 | 141 |
| CPB2 | 127, 172 |
| CPE | 64, 105 |
| CPI | 49 |
| CPLX1 | 29, 162 |

TABLE 9-continued

RELATION OF TARGET GENES TO DISEASE

| Gene Name | Disease Code |
| --- | --- |
| CPLX2 | 29, 162 |
| CPT2 | 129 |
| CPX | 49 |
| CR1 | 4, 47, 92, 123, 160, 110, 111, 122 |
| CR2 | 18, 75, 92, 109, 111 |
| CRABP1 | 42, 79, 109 |
| CRABP2 | 166 |
| CRAT | 8 |
| CREB1 | 8, 110 |
| CREBBP | 109 |
| CREM | 3, 94, 102, 111, 154 |
| CRH | 8, 110, 123 |
| CRHBP | 8, 57, 160 |
| CRHR1 | 57 |
| CRISP3 | 154 |
| CRKL | 109 |
| CRMP1 | 110 |
| CRYAA | 37 |
| CRYAB | 8, 37, 75, 123, 129 |
| CRYBA1 | 37 |
| CRYBB1 | 37 |
| CRYBB2 | 37 |
| CRYGC | 37 |
| CRYGD | 37 |
| CRYGS | 37 |
| CRYM | 60 |
| CS | 8, 47, 64, 132 |
| CSE1L | 31, 51, 109 |
| CSEN | 8 |
| CSF2 | 4, 31, 51, 166, 167, 92, 110, 133 |
| CSF3 | 4, 31, 64, 133, 167, 92, 110, 132 |
| CSH1 | 31, 70, 85 |
| CSH2 | 31 |
| CSK | 154 |
| CSN2 | 64, 105 |
| CSPG2 | 31, 109, 118, 154 |
| CSRP3 | 129, 154 |
| CST | 90, 157 |
| CST3 | 8, 9, 10, 123, 51, 53, 110 |
| CST6 | 31 |
| CSTA | 31, 154 |
| CSTB | 51, 82 |
| CTAA1 | 37 |
| CTAA2 | 37 |
| CTAG1 | 51, 83, 110, 157, 112, 118, 122 |
| CTAG2 | 30, 118, 133, 154 |
| CTGF | 31, 47, 64, 109, 65, 103, 105 |
| CTLA4 | 1, 18, 38, 174, 123, 124, 160, 105, 111, 122, 64, 92, 93 |
| CTM | 37 |
| CTNNA1 | 51, 152 |
| CTNNB1 | 31, 51, 90, 110, 133 |
| CTNNBIP1 | 51, 118 |
| CTNND1 | 30, 51, 118, 133, 154 |
| CTNND2 | 154 |
| CTPP | 37 |
| CTPP3 | 37 |
| CTPS | 109 |
| CTSB | 8, 31, 51, 110, 123, 133 |
| CTSD | 8, 31, 51, 92 |
| CTSE | 8 |
| CTSG | 8, 41, 56, 127, 172, 180 |
| CTSH | 110, 154 |
| CTSK | 135 |
| CTSL | 22, 31, 51, 76, 83, 118 |
| CTSL2 | 31, 51, 157 |
| CTSS | 8, 70, 110 |
| CTSW | 109 |
| CUBN | 117 |
| CUL2 | 157 |
| CUTL1 | 31, 109 |
| CX3CL1 | 56, 77, 92, 160 |
| CX3CR1 | 4, 92 |
| CXADR | 30, 154 |
| CXCL1 | 56, 74, 104, 166, 155, 160, 118, 135, 154 |
| CXCL10 | 31, 51, 77, 133, 92, 110, 123 |

TABLE 9-continued

RELATION OF TARGET GENES TO DISEASE

| Gene Name | Disease Code |
|---|---|
| CXCL12 | 4, 31, 52, 154, 160, 106, 109, 112, 61, 90, 92 |
| CXCL13 | 160 |
| CXCL2 | 74, 118 |
| CXCL5 | 74, 110, 126, 133, 160 |
| CXCL9 | 5, 58, 88, 123 |
| CXCR3 | 109, 123 |
| CXCR4 | 31, 52, 91, 160, 170, 92, 154, 157 |
| CXCR6 | 92 |
| CXorf6 | 129 |
| CYLD | 157, 166 |
| CYP11A1 | 3 |
| CYP11B2 | 98 |
| CYP19A1 | 31, 79, 90, 154 |
| CYP1A1 | 27, 31, 51, 110, 154, 157, 79, 83, 88 |
| CYP1A2 | 51, 88, 141, 162 |
| CYP1B1 | 31, 51, 83, 110, 154, 166 |
| CYP21A2 | 1, 64, 105 |
| CYP27A1 | 154 |
| CYP27B1 | 42, 51, 154 |
| CYP2A6 | 51, 83, 110 |
| CYP2C19 | 30, 154 |
| CYP2C9 | 45, 88, 110 |
| CYP2D@ | 144 |
| CYP2D6 | 10, 11, 27, 162, 88, 110, 144, 30, 31, 62 |
| CYP3A4 | 90, 92, 109, 154 |
| CYP46A1 | 8 |
| CYP7A1 | 44 |
| CYP7B1 | 88 |
| CYR61 | 31, 133 |
| D12S2489E | 59 |
| D2S448 | 118, 166 |
| DAB1 | 162 |
| DAB2 | 31, 154 |
| DAB2IP | 154 |
| DAF | 4, 42, 51, 114, 123, 109, 110, 112 |
| DAO | 162 |
| DAPK1 | 30, 31, 51, 133, 176, 109, 110, 112 |
| DAZ | 102 |
| DAZL | 102 |
| DBCCR1 | 30, 176 |
| DBH | 23, 29, 162 |
| DBI | 8, 47, 162 |
| DBN1 | 8, 70 |
| DBP | 87 |
| DCC | 51 |
| DCK | 70, 109, 154 |
| DCN | 31, 51 |
| DCR | 70 |
| DCT | 118 |
| DCTD | 109 |
| DCX | 82 |
| DDB1 | 88, 113 |
| DDB2 | 88 |
| DDC | 23, 24, 29, 167, 133, 144, 162, 36, 64, 105 |
| DDIT3 | 31, 133 |
| DDR1 | 31 |
| DDX10 | 109 |
| DDX26 | 110, 133 |
| DDX6 | 51, 112 |
| DEK | 109, 111 |
| DES | 4, 110, 129, 167 |
| DEXI | 76 |
| DFFB | 31 |
| DFN2 | 60 |
| DFN4 | 60 |
| DFN6 | 60 |
| DFNA16 | 60 |
| DFNA18 | 60 |
| DFNA2 | 60 |
| DFNA23 | 60 |
| DFNA24 | 60 |
| DFNA25 | 60 |
| DFNA30 | 60 |
| DFNA4 | 60 |
| DFNA44 | 60 |

TABLE 9-continued

RELATION OF TARGET GENES TO DISEASE

| Gene Name | Disease Code |
|---|---|
| DFNA49 | 60 |
| DFNA5 | 60 |
| DFNA52 | 60 |
| DFNA7 | 60 |
| DFNB13 | 60 |
| DFNB14 | 60 |
| DFNB15 | 60 |
| DFNB17 | 60 |
| DFNB20 | 60 |
| DFNB26 | 60 |
| DFNB27 | 60 |
| DFNB31 | 60 |
| DFNB33 | 60 |
| DFNB38 | 60 |
| DFNB39 | 60 |
| DFNB40 | 60 |
| DFNB5 | 60 |
| DFNM1 | 60 |
| DHCR24 | 8 |
| DIA1 | 133 |
| DIABLO | 154 |
| DIAPH1 | 60 |
| DIO2 | 150 |
| DIRC2 | 157 |
| DISC1 | 29, 62, 162 |
| DISC2 | 162 |
| DJ1 | 144 |
| DKK3 | 133 |
| DLAT | 47 |
| DLD | 128 |
| DLEC1 | 83, 110 |
| DLEU1 | 109 |
| DLEU2 | 109 |
| DLGAP2 | 82 |
| DLST | 8 |
| DMBT1 | 51, 83, 110, 133, 154, 167 |
| DMD | 129 |
| DMT1 | 61 |
| DNASE1 | 58, 111 |
| DNMT1 | 30, 31, 51, 176, 152, 154, 157, 88, 90, 110 |
| DNMT3B | 30, 51, 88, 133, 157, 167, 90, 109, 110 |
| DNTT | 109 |
| DOK1 | 109 |
| DP1 | 152 |
| DPH2L1 | 31 |
| DPM3 | 154 |
| DPP4 | 4, 51, 64, 154, 161, 92, 118, 132 |
| DPYD | 30, 31, 51, 83, 106, 157 |
| DPYSL5 | 110 |
| DRD1 | 8, 29, 98, 144, 162 |
| DRD2 | 8, 110, 162, 167 |
| DRD3 | 23, 29, 73, 144, 162 |
| DRD4 | 12, 23, 29, 144, 162 |
| DRD5 | 23, 24, 29, 144, 162 |
| DSC3 | 31 |
| DSCAM | 70 |
| DSCR1 | 8, 70 |
| DSCR3 | 70 |
| DSCR5 | 70 |
| DSCR8 | 70, 118 |
| DSG1 | 83 |
| DSP | 31, 129 |
| DSPP | 60 |
| DSTN | 8 |
| DTNBP1 | 162 |
| DTR | 51, 68, 110, 122, 134, 154 |
| DTYMK | 31 |
| DUSP1 | 30, 31, 51, 154 |
| DUT | 51 |
| DYRK1A | 70 |
| DYSF | 129 |
| DYT1 | 144 |
| DYT3 | 144 |
| DYX1 | 73 |
| DYX2 | 73 |

TABLE 9-continued

RELATION OF TARGET GENES TO DISEASE

| Gene Name | Disease Code |
|---|---|
| DYX3 | 73 |
| DYX5 | 73 |
| DYX6 | 73 |
| E2F4 | 31, 51, 79, 109, 154, 180 |
| EB-1 | 109 |
| EBAG9 | 30, 31, 83, 133, 140 |
| EBNA1BP2 | 75 |
| ECA1 | 82 |
| ECE1 | 51, 79 |
| ECGF1 | 30, 31, 51, 129 |
| ED1 | 118, 166 |
| EDN1 | 110 |
| EDN2 | 98 |
| EDNRA | 31, 42, 51, 132, 134, 174, 64, 98, 108 |
| EEC2 | 48 |
| EEF1A2 | 31 |
| EEF2 | 8, 31 |
| EFMR | 82 |
| EFNA1 | 31, 51, 110, 118, 157 |
| EFNB2 | 51 |
| EGF | 31, 110, 133 |
| EGFR | 31, 51, 110, 133, 167 |
| EGI | 82 |
| EGI14 | 82 |
| EGR1 | 8, 31, 110, 133 |
| EIF2S1 | 8, 31, 110, 118 |
| EIF3S3 | 31, 154 |
| EIF3S6 | 31, 133 |
| EIF4A1 | 90, 118 |
| EIF4A2 | 88, 112 |
| EIF4E | 31, 51, 110 |
| EIM | 82 |
| EJM1 | 82 |
| EJM2 | 82 |
| ELAC2 | 154 |
| ELAVL2 | 133, 167 |
| ELAVL3 | 77 |
| ELAVL4 | 167 |
| ELF3 | 31, 110, 154 |
| ELL | 109 |
| ELN | 110 |
| ELOVL4 | 113 |
| EMP1 | 31 |
| EMS1 | 31 |
| ENC1 | 51 |
| ENFL2 | 82 |
| ENG | 31, 51, 110, 118, 133, 154 |
| ENO1 | 31, 110, 111 |
| ENO2 | 31, 110, 133, 167 |
| ENO3 | 110 |
| ENPEP | 8, 157 |
| ENPP1 | 64, 132 |
| ENPP2 | 110, 118, 133, 160 |
| ENTPD1 | 93, 109, 112, 118 |
| ENUR1 | 81 |
| ENUR2 | 81 |
| EP300 | 31, 51, 109 |
| EPAS1 | 30, 31, 133, 157 |
| EPB41 | 114 |
| EPB41L3 | 133 |
| EPD | 82 |
| EPHA2 | 31, 51, 110, 157, 118, 133, 154 |
| EPHA3 | 118, 133, 157, 167 |
| EPHA4 | 31 |
| EPHB2 | 167 |
| EPHX1 | 30, 46, 76, 90, 110 |
| EPM2A | 82 |
| EPO | 4, 31, 92, 110, 133, 167 |
| EPOR | 31, 109 |
| EPPS | 82 |
| EPS15 | 109 |
| EPX | 18, 31, 78, 180 |
| ERBB2 | 26, 30, 31, 154, 167, 176, 51, 110, 133 |
| ERBB3 | 31, 51, 110, 154, 166, 118, 133, 140 |
| ERBB4 | 31, 51, 154 |

TABLE 9-continued

RELATION OF TARGET GENES TO DISEASE

| Gene Name | Disease Code |
|---|---|
| ERCC1 | 42, 51, 109, 133 |
| ERCC2 | 27, 83, 110, 118 |
| ERCC5 | 110 |
| ERCC6 | 110 |
| EREG | 30, 51, 140, 154 |
| ERG | 42, 109 |
| ERN1 | 8 |
| ERN2 | 103 |
| ERVWE1 | 4, 8, 92, 123 |
| ESR2 | 31, 110 |
| ESRRA | 31 |
| ETS1 | 31, 51, 110 |
| ETS2 | 31, 42, 51, 70, 90, 154 |
| ETV4 | 31, 110, 133 |
| EVI1 | 109 |
| EVPL | 83 |
| EXO1 | 51 |
| EXTL3 | 31, 51 |
| EYA1 | 37, 60 |
| EYA4 | 60 |
| EZH2 | 109, 112, 154 |
| F10 | 172 |
| F11 | 109, 127, 172 |
| F12 | 88, 172 |
| F13A1 | 48, 49, 56 |
| F2 | 8, 31, 51, 133, 64, 105, 132 |
| F2R | 31, 172 |
| F2RL1 | 31 |
| F3 | 4, 8, 31, 133, 51, 64, 132 |
| F5 | 53, 103, 127, 168, 172 |
| F7 | 64, 127, 132, 172 |
| F8 | 87 |
| F9 | 87 |
| FAAH | 31 |
| FABP1 | 154 |
| FABP2 | 53, 64, 97, 105, 132, 134 |
| FABP3 | 31, 127 |
| FABP4 | 30, 176 |
| FABP5 | 30, 155 |
| FABP7 | 31 |
| FACL4 | 51 |
| FADD | 51, 64, 105, 133 |
| FADS1 | 134 |
| FADS2 | 31, 109, 113 |
| FANCA | 31 |
| FAP | 118 |
| FASN | 31, 51, 110, 152, 154, 180 |
| FBL | 90, 160 |
| FBLN5 | 31, 51, 112, 157 |
| FBN1 | 14 |
| FBN2 | 14 |
| FBP1 | 64, 132 |
| FBXW7 | 31, 79 |
| FCAR | 18, 92 |
| FCER2 | 18, 20, 88, 123, 160, 92, 109, 111 |
| FCGR1A | 112 |
| FCGR2A | 123 |
| FCGR2B | 111, 112, 118 |
| FCGR3A | 4, 111 |
| FCGR3B | 18, 111, 161, 171 |
| FDXR | 51 |
| FES | 31, 109, 110, 112, 118 |
| FGA | 9, 21, 172 |
| FGB | 52, 53, 98, 127, 146, 172 |
| FGF1 | 31, 53, 64, 109, 154 |
| FGF3 | 31, 110, 167 |
| FGF5 | 31, 154, 157 |
| FGF6 | 154 |
| FGF8 | 31, 154 |
| FGFR1 | 8, 31, 51, 133 |
| FGFR2 | 30, 31, 79, 154 |
| FGFR3 | 30, 42, 51, 109, 122, 176 |
| FGFR4 | 31, 51, 150 |
| FGG | 172 |
| FGL2 | 88 |

TABLE 9-continued

RELATION OF TARGET GENES TO DISEASE

| Gene Name | Disease Code |
|---|---|
| FH | 157 |
| FHIT | 31, 42, 110, 133 |
| FHL2 | 31, 154 |
| FIGF | 31, 51, 110 |
| FIMG1 | 124 |
| FKBP1A | 92 |
| FKBP1B | 186 |
| FKBP4 | 31 |
| FKBP5 | 154 |
| FLG | 155, 160 |
| FLJ11383 | 51 |
| FLJ14813 | 171 |
| FLJ22795 | 51, 110 |
| FLT1 | 31, 51, 110, 133 |
| FLT3 | 109 |
| FLT3LG | 16, 109, 111, 112, 157, 160 |
| FLT4 | 31, 51, 90, 133, 154, 109, 110, 112 |
| FMR1 | 24, 84 |
| FMR2 | 84 |
| FN1 | 31, 51 |
| FOLH1 | 154 |
| FOLR2 | 109 |
| FOS | 8, 31, 92, 110, 123, 133 |
| FOSB | 31 |
| FOSL1 | 31, 42, 51, 83, 110, 167 |
| FOSL2 | 31 |
| FOXA2 | 64, 132 |
| FOXN1 | 6 |
| FOXP3 | 64, 105 |
| FPEVF | 82 |
| FPGS | 51, 109 |
| FPR1 | 92 |
| FPRL1 | 8 |
| FRAT1 | 31, 42, 83 |
| FRDA | 64, 132 |
| FRK | 31 |
| FRZB | 31 |
| FSHB | 30, 92, 102, 150 |
| FSHR | 102 |
| FST | 107, 150 |
| FTH1 | 31 |
| FTL | 8, 37, 144 |
| FURIN | 31, 51, 92, 110 |
| FUS | 109 |
| FUT1 | 51 |
| FUT3 | 51 |
| FUT4 | 110 |
| FUT7 | 110, 133 |
| FUT8 | 51, 138 |
| FVT1 | 112 |
| FXYD3 | 31 |
| FY | 114, 162 |
| FYN | 92, 109, 112, 157 |
| FZD10 | 51 |
| FZD5 | 109, 160 |
| G22P1 | 30, 31, 42, 109, 111 |
| G6PC | 64, 132 |
| G6PD | 8, 31, 51, 64, 86, 132 |
| G72 | 162 |
| GABBR1 | 82 |
| GABRA1 | 82 |
| GABRA3 | 29, 47, 82, 123 |
| GABRA5 | 29 |
| GABRB3 | 24, 29, 49 |
| GABRG2 | 82 |
| GABRG3 | 24 |
| GAD1 | 8, 64, 82, 105, 144, 162 |
| GAD2 | 64, 66, 82, 174, 105, 132, 162 |
| GADD45A | 109, 110, 118 |
| GADD45B | 110 |
| GADD45G | 109, 110 |
| GAL | 8, 12, 57, 134, 150 |
| GALK1 | 37 |
| GALNT3 | 31, 51 |
| GALT | 79 |

TABLE 9-continued

RELATION OF TARGET GENES TO DISEASE

| Gene Name | Disease Code |
|---|---|
| GAP43 | 8, 10, 29, 62, 162 |
| GAPD | 8, 31, 51, 64, 105 |
| GARP | 31 |
| GAS | 51, 64, 132 |
| GAS6 | 160 |
| GASC1 | 83 |
| GATA1 | 70, 171 |
| GATA2 | 109 |
| GATA3 | 31, 60, 92 |
| GBX2 | 154 |
| GC | 64, 105, 123, 132 |
| GCGR | 64, 85, 98, 105, 132 |
| GCK | 64, 132 |
| GCKR | 64, 132 |
| GCLC | 51, 86, 109 |
| GCNT2 | 37 |
| GCSH | 96 |
| GFAP | 4, 8, 123 |
| GFPT1 | 64, 132 |
| GFRA1 | 116 |
| GFRA2 | 116 |
| GFRA3 | 116 |
| GGH | 109 |
| GHR | 12, 31, 47, 107, 134, 154, 64, 90, 105 |
| GHRHR | 110, 150 |
| GHRL | 12, 64, 132, 134, 150, 154 |
| GIPC2 | 51, 157 |
| GIPR | 57 |
| GJA3 | 37 |
| GJA4 | 31, 110 |
| GJA8 | 37 |
| GJB1 | 51 |
| GJB2 | 30, 31, 60, 155, 79, 90, 118 |
| GJB3 | 60 |
| GJB6 | 60 |
| GLDC | 96 |
| GLI | 27, 112 |
| GLI2 | 27 |
| GLP1R | 64, 132 |
| GLUL | 8, 90, 123 |
| GNA11 | 150 |
| GNAI2 | 110, 150, 186 |
| GNAL | 29, 162 |
| GNAO1 | 8 |
| GNAQ | 8, 150 |
| GNAS | 57, 150, 154 |
| GNAT2 | 113 |
| GNB3 | 8, 29, 53, 127, 132, 134, 64, 65, 98 |
| GNE | 129 |
| GNMT | 90 |
| GNRH2 | 31, 79 |
| GNRHR | 118, 154 |
| GOLGA5 | 173 |
| GOLGB1 | 92, 160 |
| GP9 | 171 |
| GPA33 | 51 |
| GPC1 | 31 |
| GPC3 | 31, 90 |
| GPD2 | 64, 132 |
| GPI | 86, 160 |
| GPR1 | 92 |
| GPR15 | 4, 92 |
| GPR2 | 5, 20, 118, 155 |
| GPR30 | 31 |
| GPR37 | 109 |
| GPR44 | 20, 92 |
| GPRK5 | 91, 98, 160 |
| GPT | 47, 88 |
| GPX1 | 86, 110, 154 |
| GPX4 | 102 |
| GRB2 | 8, 31, 109 |
| GRB7 | 31, 83 |
| GRIA1 | 8, 77, 82, 162 |
| GRIA2 | 8, 77, 82, 162 |
| GRIA3 | 29, 77, 82 |

TABLE 9-continued

RELATION OF TARGET GENES TO DISEASE

| Gene Name | Disease Code |
|---|---|
| GRIA4 | 8, 77, 82 |
| GRIK1 | 10, 70, 77, 82 |
| GRIK2 | 82 |
| GRIK3 | 77, 162 |
| GRIK4 | 82, 162 |
| GRIK5 | 82, 162 |
| GRIN1 | 8, 10, 29, 62, 82, 162 |
| GRIN2B | 8, 77, 162 |
| GRM2 | 162 |
| GRM3 | 29, 162 |
| GRM5 | 10, 162 |
| GRM7 | 162 |
| GRN | 31 |
| GRP | 51, 71, 83, 110, 154, 167 |
| GRP58 | 102 |
| GRPR | 31, 51, 110, 154 |
| GSBS | 95 |
| GSE | 38 |
| GSK3A | 90 |
| GSN | 9, 30, 31, 154, 58, 110, 133 |
| GSR | 8, 31, 51, 110, 167, 64, 86, 105 |
| GSS | 86 |
| GSTA1 | 30, 51, 57, 154 |
| GSTA2 | 31 |
| GSTM1 | 31, 110, 133, 167 |
| GSTM3 | 18, 27, 31, 51, 110, 123 |
| GSTP1 | 31, 110, 133, 167 |
| GSTT1 | 30, 31, 51, 110 |
| GUCA2A | 51, 106 |
| GUCA2B | 51, 151 |
| GUCY2C | 51, 83 |
| GUSB | 8, 31, 51, 110 |
| GYPC | 114 |
| GYS1 | 64, 132, 134 |
| GZMA | 75, 92, 160 |
| GZMB | 31, 92 |
| HADH2 | 8 |
| HADHA | 186 |
| HAGH | 157 |
| HARS | 92 |
| HAS1 | 122 |
| HAS2 | 154 |
| HAS3 | 154 |
| HBA1 | 7, 64, 105 |
| HBA2 | 7, 163 |
| HBB | 28, 114, 163 |
| HBD | 163 |
| HBG1 | 28 |
| HBG2 | 28, 163 |
| HBZ | 7, 28 |
| HCK | 92, 109 |
| HD | 8, 51 |
| HDAC1 | 31, 109 |
| HDGF | 83, 90 |
| HDPA | 93 |
| HES1 | 31 |
| HF1 | 30, 160 |
| HFE | 28, 47, 64, 88, 105, 144 |
| HGFAC | 51 |
| HIC1 | 31, 51, 83, 133, 109, 110, 112 |
| HIP1 | 51, 109, 154 |
| HIST4H4 | 31, 84, 111 |
| HK1 | 64, 86, 132 |
| HK2 | 64, 132, 134 |
| HLA-A | 51, 64, 83, 118, 157, 162, 88, 92, 105 |
| HLA-B | 4, 8, 92, 123 |
| HLA-C | 42, 51, 64, 156, 118, 123, 155, 83, 92, 105 |
| HLA-DMB | 64, 105, 123, 160 |
| HLA-DPB1 | 38, 48, 64, 123, 124, 160, 93, 105, 109 |
| HLA-DQA1 | 64, 105, 132 |
| HLA-DQB1 | 64, 105, 123, 132 |
| HLA-DRA | 123 |
| HLA-DRB1 | 64, 88, 105, 160, 174, 111, 123, 156 |
| HLA-DRB3 | 51, 56, 64, 123, 132, 92, 105, 111 |
| HLA-DRB4 | 38, 47, 109, 125 |

TABLE 9-continued

RELATION OF TARGET GENES TO DISEASE

| Gene Name | Disease Code |
| --- | --- |
| HLA-DRB5 | 64, 105, 109, 123 |
| HLA-E | 59, 64, 77, 105, 123 |
| HLA-G | 92, 109, 112, 118, 157, 166 |
| HLF | 109 |
| HLXB9 | 109 |
| HMBS | 26, 83, 112 |
| HMGA1 | 31, 51, 110 |
| HMGA2 | 79, 110 |
| HMGB1 | 31, 90, 180 |
| HMGCR | 8, 31, 51, 132, 64, 95, 110 |
| HMMR | 31, 51, 109, 112, 122 |
| HMOX1 | 8, 123, 127, 144, 157 |
| HMOX2 | 155 |
| HN | 8 |
| HNF4A | 64, 90, 132 |
| HNMT | 18, 70, 72, 161, 162 |
| HNRPA1 | 92, 109 |
| HNRPA2B1 | 83, 92, 110, 167, 111, 133, 160 |
| HOXA1 | 24, 31, 110 |
| HOXA10 | 102, 109, 133 |
| HOXA11 | 109, 171 |
| HOXA13 | 109 |
| HOXA3 | 109 |
| HOXA4 | 109, 157 |
| HOXA5 | 109 |
| HOXA6 | 109 |
| HOXA7 | 109, 110 |
| HOXA9 | 109 |
| HOXB2 | 109 |
| HOXB3 | 109 |
| HOXB4 | 109, 157 |
| HOXB5 | 109, 157 |
| HOXB6 | 51, 109 |
| HOXB7 | 31, 109 |
| HOXB8 | 51 |
| HOXB9 | 157 |
| HOXC11 | 157 |
| HOXC4 | 27, 157, 166 |
| HOXC5 | 42, 112 |
| HOXC8 | 42, 51 |
| HOXD11 | 109 |
| HOXD13 | 109 |
| HOXD3 | 110 |
| HOXD4 | 157 |
| HOXD8 | 64, 105 |
| HP | 31, 64, 92, 105, 141 |
| HPCQTL19 | 154 |
| HPCX | 154 |
| HPN | 154 |
| HPRT1 | 107, 109, 110, 118, 123 |
| HPSE | 83 |
| HR | 6 |
| HRAS | 30 |
| HRASLS | 31, 110, 118, 157 |
| HRC | 64, 132 |
| HRG | 4, 18, 46, 107, 127 |
| HRH1 | 8, 18, 183 |
| HRH2 | 8 |
| HRH3 | 144 |
| HSAJ2425 | 31, 109 |
| HSD11B1 | 134 |
| HSD11B2 | 3, 98 |
| HSD17B1 | 31, 51, 154 |
| HSD17B2 | 51, 79, 154 |
| HSD17B3 | 154 |
| HSD3B1 | 98, 154 |
| HSD3B2 | 154 |
| HSD3B7 | 45 |
| HSF1 | 31, 154 |
| HSF4 | 37 |
| HSPA5 | 31, 51, 160 |
| HSPA8 | 8, 31, 100 |
| HSPB1 | 8 |
| HSPCA | 31, 112 |
| HSPCB | 31, 111 |

TABLE 9-continued

RELATION OF TARGET GENES TO DISEASE

| Gene Name | Disease Code |
|---|---|
| HSPD1 | 8, 64, 105 |
| HSPG2 | 8, 31, 110, 133 |
| HT | 174 |
| HTNB | 98 |
| HTR1A | 8, 29, 62, 64, 132, 162 |
| HTR1B | 110, 120 |
| HTR1D | 120 |
| HTR1F | 73, 120 |
| HTR2A | 8, 12, 23, 120, 162, 24, 29, 62 |
| HTR2B | 120 |
| HTR2C | 29, 120, 162 |
| HTR3A | 29, 162 |
| HTR6 | 8, 29, 162 |
| HVEC | 48 |
| HYAL1 | 154 |
| HYAL2 | 110, 133, 167 |
| HYMAI | 64 |
| HYPLIP1 | 97 |
| HYPLIP2 | 97 |
| HYT1 | 98 |
| HYT2 | 98 |
| HYT3 | 98 |
| IAPP | 9, 58, 64, 132, 134 |
| IBMPFD | 61, 129, 139 |
| IBSP | 31, 51, 110, 122, 154 |
| ICA1 | 64, 105 |
| ICAM2 | 56, 92, 160, 180 |
| ICAM3 | 56, 92, 93, 160, 174, 180, 111, 112, 123 |
| ID1 | 31, 42, 79, 154, 83, 118, 141 |
| IDDM1 | 64, 105 |
| IDDM10 | 64, 105 |
| IDDM11 | 64, 105 |
| IDDM12 | 64, 105 |
| IDDM13 | 64, 105 |
| IDDM15 | 64, 105 |
| IDDM17 | 64, 105 |
| IDDM18 | 64, 105 |
| IDDM2 | 64, 105 |
| IDDM3 | 64, 105 |
| IDDM4 | 64, 105 |
| IDDM5 | 64, 105 |
| IDDM6 | 64, 105 |
| IDDM7 | 64, 105 |
| IDDM8 | 64, 105 |
| IDDMX | 64, 105 |
| IDE | 8, 64, 132 |
| IDS | 84 |
| IFNA1 | 4, 79, 88, 157, 92, 109, 118 |
| IFNA2 | 51 |
| IFNB1 | 4, 31, 51, 123, 133, 110, 115, 118, 77, 91, 92 |
| IFNG | 31, 42, 51, 178, 110, 133, 167 |
| IFNGR1 | 47, 92, 111, 114, 125, 178 |
| IFNGR2 | 125 |
| IGES | 18 |
| IGF1 | 31, 51, 60, 133, 105, 110, 132, 64, 67, 92 |
| IGF1R | 31, 110, 118, 154 |
| IGF2 | 4, 8, 31, 110, 132, 51, 64, 105 |
| IGF2R | 31, 51, 90, 110 |
| IGFALS | 47, 64, 105 |
| IGFBP1 | 31, 51, 64, 105, 132 |
| IGFBP2 | 31, 51, 64, 134, 105, 110, 132 |
| IGFBP4 | 31, 51, 64, 154, 107, 110, 132 |
| IGFBP5 | 31, 42, 64, 154, 79, 105, 107 |
| IGFBP6 | 133, 154 |
| IGFBP7 | 31, 154 |
| IGSF4 | 31, 90, 110, 133, 154 |
| IKBKB | 64, 132 |
| IL10 | 4, 8, 31, 133, 178, 110, 112, 123, 92, 105, 106, 35, 51, 64 |
| IL10RA | 133, 155 |
| IL12A | 20, 56, 92, 118, 123, 154 |
| IL12B | 64, 92, 105, 123, 154 |
| IL13 | 4, 18, 31, 105, 123, 159, 51, 64, 92 |
| IL13RA1 | 93, 175 |
| IL13RA2 | 18, 175 |
| IL15 | 31, 92, 110, 167 |

TABLE 9-continued

RELATION OF TARGET GENES TO DISEASE

| Gene Name | Disease Code |
|---|---|
| IL16 | 18, 56, 92, 112, 160 |
| IL18 | 31, 51, 64, 92, 105, 123 |
| IL1A | 4, 8, 31, 133, 105, 110, 123, 75, 90, 92, 51, 61, 64 |
| IL1B | 31, 110, 167 |
| IL1R1 | 64, 105, 135 |
| IL1R2 | 135 |
| IL1RL1 | 111 |
| IL1RN | 4, 8, 31, 132, 167, 110, 118, 123, 64, 92, 105 |
| IL21R | 112 |
| IL24 | 104, 110, 118, 133 |
| IL2RA | 31, 51, 64, 133, 155, 167, 92, 105, 123 |
| IL2RB | 92, 109, 110, 118, 162 |
| IL2RG | 56, 77, 123 |
| IL3 | 4, 8, 31, 109, 123, 133 |
| IL3RA | 92, 109 |
| IL4 | 4, 8, 31, 133, 105, 110, 123, 51, 64, 92 |
| IL4R | 18, 64, 105, 112, 123, 157 |
| IL5 | 31, 64, 92, 133, 105, 110, 123 |
| IL6R | 4, 31, 42, 127, 150, 112, 122, 123, 56, 77, 92 |
| IL6ST | 4, 8, 31, 92, 110, 133 |
| IL7 | 51, 92 |
| IL7R | 92, 109 |
| IL8 | 4, 31, 51, 110, 123, 133, 64, 92, 105 |
| IL8RA | 59 |
| IL8RB | 4, 92, 154, 155, 178 |
| ILK | 31, 65, 152, 154 |
| ILVASC | 6 |
| IMP-1 | 31, 51 |
| IMP-2 | 47, 90 |
| INA | 109, 112 |
| ING1 | 31, 83, 118 |
| INHBB | 102 |
| INPPL1 | 64, 132 |
| INS | 8, 64, 85, 132, 134, 92, 98, 105 |
| INSM1 | 110 |
| INSR | 8, 31, 64, 132, 134, 85, 105, 129 |
| IPF1 | 64, 132 |
| IRF1 | 110, 133 |
| IRF2 | 123 |
| IRF4 | 122 |
| IRS1 | 64 |
| IRS2 | 31, 64, 85, 132, 134 |
| IRTA1 | 112, 122 |
| ISGF3G | 31, 109, 118 |
| ISL1 | 64, 132, 134 |
| ITGA11 | 133 |
| ITGA2 | 31, 51, 110, 127, 169, 171 |
| ITGA2B | 53, 64, 127, 154, 171 |
| ITGA3 | 31, 51, 79, 118, 154 |
| ITGA4 | 31, 92, 123 |
| ITGA5 | 35, 51, 90, 133, 118, 155, 109, 112, 122 |
| ITGA6 | 27, 31, 51, 175, 154, 160, 166, 90, 110, 142 |
| ITGA7 | 129 |
| ITGA9 | 110, 133, 167 |
| ITGAL | 4, 51, 92, 123 |
| ITGAM | 4, 8, 31, 92, 123 |
| ITGAX | 92 |
| ITGB1 | 4, 31, 51, 167, 110, 123, 133, 64, 92, 105 |
| ITGB2 | 92, 123 |
| ITGB3 | 40, 41, 51, 172, 127, 154, 171, 102, 111, 118, 53, 67, 92 |
| ITGB5 | 31 |
| ITGB7 | 64, 105, 109, 112, 122 |
| ITM2B | 61 |
| IVL | 31, 42, 75, 155, 83, 110, 133 |
| IVNS1ABP | 104 |
| JAG1 | 42, 60 |
| JAG2 | 42, 83, 122 |
| JAK1 | 31, 122, 154, 157 |
| JAK2 | 31, 51, 109, 154, 122 |
| JAK3 | 20, 109, 112, 157 |
| JRK | 82 |
| JUN | 8, 31, 51, 110, 123, 133 |
| JUNB | 31, 92, 93, 109, 112 |
| JUP | 31, 51, 118, 133 |
| KAI1 | 30, 31, 42, 133, 154, 51, 83, 110 |

TABLE 9-continued

RELATION OF TARGET GENES TO DISEASE

| Gene Name | Disease Code |
| --- | --- |
| KCNA1 | 31 |
| KCNA5 | 21 |
| KCNE1 | 21 |
| KCNH1 | 31, 42 |
| KCNJ11 | 64, 132 |
| KCNJ2 | 21 |
| KCNJ3 | 31, 64, 132 |
| KCNJ6 | 64, 70, 132 |
| KCNJ8 | 53 |
| KCNJ9 | 64, 132 |
| KCNN3 | 29, 162 |
| KCNN4 | 58 |
| KCNQ1 | 21, 60 |
| KCNQ2 | 82 |
| KCNQ3 | 82 |
| KCNQ4 | 60 |
| KIAA1199 | 60 |
| KIR2DL1 | 92, 155 |
| KIR3DL1 | 4 |
| KISS1 | 31, 118 |
| KIT | 31, 51, 92, 167, 109, 110, 183 |
| KITLG | 31, 51, 92, 110, 133, 167 |
| KL | 107, 136, 157 |
| KLF1 | 28 |
| KLF4 | 31, 51, 152 |
| KLF5 | 31, 53, 154 |
| KLHL4 | 49 |
| KLK1 | 79, 98, 141 |
| KLK10 | 31, 154 |
| KLK11 | 154 |
| KLK13 | 31 |
| KLK2 | 154 |
| KLK3 | 31, 107, 154 |
| KLK4 | 154 |
| KLK5 | 31, 154 |
| KLK6 | 8 |
| KLK8 | 8 |
| KLKB1 | 107 |
| KLRB1 | 123 |
| KLRC1 | 92, 118 |
| KLRD1 | 59, 92, 102, 118 |
| KRAS2 | 51 |
| KRT13 | 30, 42 |
| KRT14 | 31, 110 |
| KRT17 | 42 |
| KRT18 | 31, 47, 110, 133 |
| KRT20 | 31, 51, 110, 154 |
| KRT7 | 31, 45, 47, 110 |
| KRT8 | 47 |
| KRTHB1 | 31 |
| L1CAM | 49, 118 |
| LAF4 | 109 |
| LAMA1 | 8, 51, 67, 110 |
| LAMA3 | 110 |
| LAMA5 | 110 |
| LAMB1 | 51, 154 |
| LAMB2 | 154 |
| LAMB3 | 133, 154 |
| LAMC2 | 51, 83, 133, 166 |
| LAMP1 | 51, 118 |
| LAMP2 | 51, 118 |
| LAMP3 | 31, 51, 83 |
| LAMR1 | 31, 51, 110, 118, 133 |
| LASP1 | 31 |
| LAT | 160 |
| LBP | 133 |
| LCAT | 64, 95, 97, 132 |
| LCK | 51, 64, 75, 167, 109, 110, 157, 83, 92, 105 |
| LCN1 | 58, 110 |
| LCN2 | 17, 51, 56, 69, 103, 180 |
| LCO | 90 |
| LCP1 | 31, 112, 154 |
| LCS1 | 45 |
| LDHA | 31 |
| LDLR | 51, 64, 95, 110, 132 |

TABLE 9-continued

RELATION OF TARGET GENES TO DISEASE

| Gene Name | Disease Code |
|---|---|
| LEF1 | 51, 112, 118 |
| LEP | 31, 64, 85, 133, 134, 92, 105, 132 |
| LEPR | 12, 31, 33, 134, 109, 150, 105, 64, 92, 110 |
| LGALS1 | 30, 31, 51, 110, 154 |
| LGALS3 | 31, 51, 110, 133 |
| LGALS3BP | 31, 88, 92, 133, 106, 110, 112 |
| LGI1 | 82 |
| LHX2 | 109 |
| LIG4 | 31, 109, 122 |
| LILRB1 | 59, 92 |
| LILRB2 | 160 |
| LIM2 | 37 |
| LIPC | 53, 64, 97, 105, 132 |
| LIPE | 64, 97, 132, 134 |
| LMNA | 21, 31, 42, 129, 133, 154, 51, 83, 110 |
| LMNB1 | 31, 42, 51, 83, 133, 154 |
| LMO1 | 109 |
| LMO2 | 109, 110 |
| LMOD1 | 174 |
| LOC90925 | 109 |
| LOH11CR2A | 31, 110 |
| LOR | 142 |
| LOST1 | 110 |
| LOX | 31 |
| LPA | 8, 52 |
| LPL | 8, 64, 105, 132 |
| LPP | 109, 110 |
| LRP1 | 8, 31, 53, 118, 154 |
| LRP2 | 8 |
| LRP5 | 64, 105, 136 |
| LRPAP1 | 8 |
| LTA | 31, 51, 64, 127, 110, 132, 105, 92, 123 |
| LTB | 47, 88, 160 |
| LTB4R | 92 |
| LTC4S | 18, 109, 165 |
| LTF | 4, 8, 31, 92 |
| LUC7L | 7 |
| LUM | 31, 42 |
| LY75 | 31 |
| LYL1 | 109 |
| LYN | 35, 51, 109, 112 |
| LYZ | 9 |
| LZTS1 | 31, 83, 133, 154 |
| MAD | 110, 166 |
| MAD1L1 | 112, 154 |
| MAD2L1 | 31, 109, 112 |
| MADCAM1 | 56, 103, 109, 112, 180 |
| MADH1 | 31, 152 |
| MADH3 | 31, 51, 56, 83, 152, 180 |
| MADH4 | 31, 110, 133, 140, 151 |
| MADH5 | 51, 109 |
| MADH6 | 90 |
| MADH7 | 56, 90, 180 |
| MAF | 37, 122 |
| MAG | 24, 123 |
| MAGEA10 | 118 |
| MAGEA3 | 30, 31, 110, 118 |
| MAGEA4 | 83, 110, 118 |
| MAGEC1 | 118 |
| MAGEE1 | 118 |
| MALT1 | 110, 112, 166 |
| MAOA | 8, 13, 23, 144, 162, 24, 29, 62 |
| MAOB | 8, 10, 23, 162, 24, 29, 144 |
| MAP1B | 8 |
| MAP2 | 8, 82, 118, 144, 162 |
| MAP2K1 | 8, 31, 51, 110 |
| MAP2K3 | 46, 137, 154 |
| MAP2K4 | 31, 51, 154 |
| MAP2K5 | 154 |
| MAP2K6 | 8 |
| MAP3K1 | 79, 154 |
| MAP3K3 | 90 |
| MAP3K4 | 31 |
| MAP3K8 | 31 |
| MAP4 | 31 |

TABLE 9-continued

RELATION OF TARGET GENES TO DISEASE

| Gene Name | Disease Code |
|---|---|
| MAPK1 | 31, 51, 110 |
| MAPK10 | 8 |
| MAPK11 | 154 |
| MAPK14 | 31, 51, 64, 132 |
| MAPK3 | 8, 31, 51, 92, 133, 167 |
| MAPK6 | 154 |
| MAPK8 | 31 |
| MAPK8IP1 | 64 |
| MAPKAPK2 | 31 |
| MAPKAPK3 | 110 |
| MAPT | 8, 61, 70, 144 |
| MAT1A | 90 |
| MAT2A | 90 |
| MATK | 31 |
| MATN3 | 135 |
| MAX | 31 |
| MAZ | 135 |
| MBD1 | 51, 110 |
| MBD2 | 31, 51, 154 |
| MBD4 | 51 |
| MBL2 | 4, 58, 88, 92, 114, 163 |
| MBP | 4, 8, 24, 61, 123 |
| MC1R | 27, 118, 154, 166 |
| MC2R | 3 |
| MC3R | 134 |
| MC4R | 12, 33, 134 |
| MCC | 31, 51, 83, 110, 152 |
| MCP | 91, 110, 123 |
| MDK | 8, 51, 71, 106, 110 |
| MDM1 | 60 |
| MDM2 | 31, 51, 110, 133 |
| MDS1 | 109 |
| ME1 | 31 |
| MEAX | 129 |
| MEBA | 82 |
| MECP2 | 24, 133 |
| MEF2A | 52 |
| MEFV | 9 |
| MEIS1 | 109 |
| MEN1 | 31, 36, 110, 167 |
| MEP1A | 51 |
| MEST | 31, 51, 110 |
| MET | 90, 157 |
| MFGE8 | 31 |
| MFI2 | 8, 118 |
| MGAT3 | 47, 90 |
| MGAT5 | 51, 88, 90, 118 |
| MGP | 127 |
| MGR1 | 120 |
| MGR2 | 120 |
| MGR3 | 120 |
| MGR4 | 120 |
| MGR5 | 120 |
| MGR6 | 120 |
| MGST1 | 110 |
| MHC2TA | 64, 77, 92, 123, 160, 167, 105, 110, 112 |
| MIA | 51, 118, 157 |
| MICA | 1, 38, 56, 166, 178, 180, 64, 105, 155 |
| MIP | 37 |
| MIPS | 127 |
| MITF | 60, 118 |
| MJD | 82, 144 |
| MKKS | 53 |
| MKL1 | 109 |
| MLANA | 110, 118, 157, 166 |
| MLC1 | 61, 162, 184 |
| MLF1 | 109 |
| MLH1 | 31, 51, 103, 166, 110, 133, 151 |
| MLH3 | 51 |
| MLLT1 | 109 |
| MLLT10 | 109, 112 |
| MLLT2 | 109 |
| MLLT3 | 109 |
| MLLT4 | 109 |
| MLLT6 | 109 |

TABLE 9-continued

RELATION OF TARGET GENES TO DISEASE

| Gene Name | Disease Code |
|---|---|
| MLLT7 | 109 |
| MLN | 64, 66 |
| MLN51 | 31 |
| MME | 8, 110, 133, 167 |
| MMP1 | 31, 51, 110 |
| MMP10 | 31, 51, 67, 166 |
| MMP12 | 46, 51 |
| MMP13 | 14, 31, 42, 160, 166, 83, 118, 135 |
| MMP15 | 90 |
| MMP16 | 118 |
| MMP2 | 4, 8, 10, 144, 167, 123, 132, 133, 64, 110, 118, 31, 51, 61 |
| MMP26 | 79, 110, 154 |
| MMP3 | 31, 51, 56, 123, 167, 180 |
| MMP8 | 118, 160 |
| MMP9 | 31, 51, 110, 112, 133 |
| MNT | 31 |
| MOBP | 123 |
| MOG | 24, 123 |
| MPD1 | 129 |
| MPD2 | 129 |
| MPG | 31, 42, 102 |
| MPL | 171 |
| MPO | 8, 110, 123, 167 |
| MPRM | 129 |
| MPZ | 112 |
| MRE11A | 31, 112 |
| MRPL28 | 118 |
| MRXE | 82 |
| MS4A1 | 92 |
| MS4A2 | 18 |
| MSF | 31, 109 |
| MSH2 | 31, 51, 79, 151, 154, 106, 112, 138 |
| MSH3 | 31, 51, 79, 152, 109, 167, 83, 133 |
| MSH6 | 51, 138, 151 |
| MSLN | 31, 42, 51, 79, 83, 110 |
| MSMB | 154 |
| MSN | 70, 92, 160 |
| MSR1 | 8, 97, 154 |
| MSSE | 27 |
| MST1 | 110, 157, 167 |
| MST1R | 31, 51, 110, 133 |
| MSX1 | 48, 49 |
| MT1B | 31 |
| MT1E | 31, 154 |
| MT1X | 30, 31, 154 |
| MT2A | 31, 135, 154 |
| MT3 | 8, 31, 154 |
| MTA1 | 31 |
| MTAP | 109, 110, 133 |
| MTATP6 | 88 |
| MTBS1 | 178 |
| MTBSX | 178 |
| MTCO2 | 8, 51, 100, 129 |
| MTCP1 | 109 |
| MTHFR | 8, 31, 51, 132, 53, 64, 110 |
| MTM1 | 129 |
| MTND5 | 8, 129, 144 |
| MTNR1A | 8 |
| MTP | 95 |
| MTR | 51, 70 |
| MTRR | 70, 117 |
| MUC1 | 31, 110, 133 |
| MUC3A | 56, 180 |
| MUC4 | 26, 51, 106, 110, 133, 141 |
| MUC5B | 58, 110, 133 |
| MUC6 | 26, 31, 51, 56, 110 |
| MUC8 | 102, 110, 165 |
| MUSK | 124 |
| MVK | 90 |
| MX1 | 88, 104, 123, 143, 159 |
| MXI1 | 154, 167 |
| MYAS1 | 124 |
| MYBL1 | 35, 109, 112 |
| MYBL2 | 154 |
| MYBPC3 | 129 |

TABLE 9-continued

RELATION OF TARGET GENES TO DISEASE

| Gene Name | Disease Code |
|---|---|
| MYCL1 | 30, 31, 42, 122, 133, 51, 83, 110 |
| MYCN | 110, 167 |
| MYF6 | 129 |
| MYH2 | 129 |
| MYH6 | 100, 129 |
| MYH7 | 100, 129 |
| MYH9 | 60 |
| MYL2 | 100, 129 |
| MYL3 | 100 |
| MYL4 | 127 |
| MYLK2 | 129 |
| MYO15A | 60 |
| MYO18B | 110 |
| MYO1A | 60 |
| MYO1G | 109 |
| MYO3A | 60 |
| MYO6 | 60 |
| MYO7A | 60 |
| MYOD1 | 31, 51 |
| MYST3 | 109 |
| N33 | 51, 110, 154 |
| NAP1 | 107 |
| NBL1 | 31 |
| NBS1 | 31, 109, 112 |
| NCAM1 | 8, 24, 31, 133, 167, 51, 92, 110 |
| NCAM2 | 70 |
| NCF1 | 134 |
| NCF2 | 8, 56, 64, 132 |
| NCKAP1 | 8 |
| NCL | 92, 109, 111 |
| NCOA1 | 31 |
| NCOA2 | 31, 109, 154 |
| NCOA3 | 31, 79, 109, 154 |
| NCOA4 | 31, 154, 173 |
| NCOR1 | 31 |
| NCOR2 | 31, 109 |
| NCSTN | 8 |
| NDP | 60 |
| NDRG1 | 51 |
| NDUFV2 | 144 |
| NEB | 129 |
| NEDD5 | 8, 109 |
| NEF3 | 8, 10, 144 |
| NEFH | 10 |
| NEFL | 8, 10, 31, 154, 70, 61, 123 |
| NEK4 | 31 |
| NES | 118 |
| NEUROD1 | 64, 105, 132 |
| NEUROG3 | 64, 132 |
| NF1 | 31, 51, 110, 118, 167 |
| NFKB1 | 31, 92, 133 |
| NFKB2 | 31, 109, 112, 122 |
| NFKBIA | 31, 51, 92, 110, 133 |
| NFKBIL1 | 123, 160, 180 |
| NGFB | 8, 123, 154 |
| NGFR | 8, 31, 92, 123, 144 |
| NHLRC1 | 82 |
| NID | 67 |
| NIDDM2 | 64 |
| NIDDM3 | 64 |
| NISCH | 98 |
| NKX3-1 | 154 |
| NLGN3 | 24 |
| NLGN4 | 24 |
| NMB | 51 |
| NME1 | 31, 90, 110, 133 |
| NME2 | 51, 110, 118 |
| NMT1 | 30, 51, 92 |
| NMTC1 | 173 |
| NOL1 | 31, 51, 110, 154 |
| NONO | 157 |
| NOS1 | 8, 10, 18, 98, 144 |
| NOS2A | 4, 8, 31, 114, 132, 133, 98, 105, 110, 64, 88, 92, 51, 58, 61 |
| NOS3 | 8, 31, 54, 64, 110, 132 |
| NOTCH1 | 42, 51, 109, 167 |

TABLE 9-continued

RELATION OF TARGET GENES TO DISEASE

| Gene Name | Disease Code |
|---|---|
| NOV | 3, 31, 154, 157 |
| NP | 18, 109, 112, 174 |
| NPHP1 | 107 |
| NPPA | 64, 98, 105, 132, 167 |
| NPPC | 107 |
| NPR3 | 51, 98 |
| NPY | 8, 31, 64, 92, 132 |
| NPY2R | 82 |
| NPY5R | 134 |
| NQO1 | 8, 30, 31, 133, 154, 182, 51, 109, 110 |
| NR0B1 | 3 |
| NR0B2 | 64, 132, 134 |
| NR1I2 | 31 |
| NR2C1 | 31, 142, 163 |
| NR2F1 | 3, 57 |
| NR2F2 | 3, 31, 57 |
| NR2F6 | 31 |
| NR3C1 | 4, 8, 31, 167, 110, 132, 134, 57, 64, 92 |
| NR3C2 | 57, 98 |
| NR4A1 | 31, 110 |
| NR4A2 | 29, 144, 162 |
| NR5A1 | 3, 150 |
| NRAS | 51 |
| NRG1 | 8, 31, 123, 154, 162 |
| NRIP1 | 31 |
| NRP1 | 154 |
| NRP2 | 36 |
| NSEP1 | 31, 133 |
| NSF | 162 |
| NTF3 | 8, 10, 118, 154, 162 |
| NTF5 | 10 |
| NTRK1 | 8, 31, 116, 167, 173 |
| NTRK2 | 8, 10, 154, 162 |
| NTRK3 | 8, 109, 116, 157 |
| NTS | 8, 110, 144, 154, 162, 167 |
| NUFIP1 | 84 |
| NUMA1 | 51, 109 |
| NUP153 | 80, 149 |
| NUP214 | 92, 109 |
| NUP88 | 31, 47, 51, 154, 90, 93, 110 |
| NUP98 | 109 |
| OADIP | 135 |
| OAS2 | 88, 109, 118, 122 |
| OASD | 60 |
| OASF | 135 |
| OATL1 | 157, 171 |
| OB10P | 134 |
| OB10Q | 134 |
| OB4 | 134 |
| OCLN | 56, 74, 92, 180 |
| OGDH | 8 |
| OGG1 | 51, 83, 110, 133, 154, 157 |
| OGT | 51 |
| OLIG2 | 109 |
| OLR1 | 8, 172 |
| OMG | 24, 123 |
| OPHN1 | 51 |
| OPLAH | 110 |
| OPRD1 | 8, 92, 144 |
| OPRK1 | 8, 92 |
| OPRM1 | 8, 144 |
| OQTL | 134 |
| OR51E2 | 154 |
| ORC5L | 109 |
| ORM1 | 31, 110 |
| ORM2 | 31, 110 |
| OSM | 31, 92, 110, 154, 118, 122, 133 |
| OSMR | 31 |
| OTOA | 60 |
| OTOF | 60 |
| OXT | 4, 110, 123, 167 |
| OXTR | 31 |
| P2RX7 | 109 |
| P2RY12 | 172 |
| P2RY2 | 58 |

TABLE 9-continued

RELATION OF TARGET GENES TO DISEASE

| Gene Name | Disease Code |
|---|---|
| P8 | 31, 141 |
| PABPC1 | 55 |
| PACE4 | 31, 92, 110 |
| PADI4 | 160 |
| PAEP | 79, 102 |
| PAH | 162 |
| PAK1 | 31 |
| PAM | 110, 123, 154 |
| PAPPA | 53, 70 |
| PARK10 | 144 |
| PARK11 | 144 |
| PARK2 | 61, 144 |
| PARK3 | 144 |
| PARK4 | 144 |
| PARK6 | 144 |
| PARK8 | 144 |
| PARK9 | 144 |
| PAWR | 8, 10, 144, 154, 157 |
| PAX2 | 157 |
| PAX3 | 60, 118 |
| PAX4 | 64, 132 |
| PAX5 | 112 |
| PAX6 | 30, 37, 51, 64 |
| PAX7 | 110 |
| PBCA | 64, 105 |
| PBOV1 | 30, 31, 51, 110, 154 |
| PBP | 154 |
| PBX1 | 109 |
| PCAF | 31 |
| PCAP | 154 |
| PCBC | 154 |
| PCBD | 51 |
| PCC | 37 |
| PCK1 | 64, 132 |
| PCM1 | 173 |
| PCMT1 | 8, 37 |
| PCNA | 8, 31, 51, 133 |
| PCSK1 | 31, 64, 92, 150, 167, 110, 132, 134 |
| PCSK2 | 24, 64, 110, 132, 167 |
| PCSK7 | 112 |
| PCSK9 | 95 |
| PDB | 139 |
| PDB3 | 139 |
| PDB4 | 139 |
| PDCD1 | 111 |
| PDCD8 | 112, 133 |
| PDE4D | 168 |
| PDE5A | 30, 176 |
| PDGFA | 31 |
| PDGFB | 31, 51 |
| PDGFRA | 27, 106, 109, 166 |
| PDGFRL | 51, 89, 90, 133, 154 |
| PDPK1 | 64, 132 |
| PDYN | 24, 29, 46, 62, 162 |
| PEA15 | 64, 132 |
| PECAM1 | 31, 47, 56, 163, 174, 180, 135, 157, 160, 123, 127, 133, 109, 110, 118 |
| PEPD | 31 |
| PFC | 119 |
| PFKL | 29, 86 |
| PFKM | 64, 132 |
| PFN1 | 31 |
| PGA5 | 22, 145 |
| PGAM2 | 129 |
| PGC | 31, 145 |
| PGF | 51, 70, 110, 118, 157 |
| PGGT1B | 30, 31, 110 |
| PGK1 | 16, 86, 144 |
| PHB | 31 |
| PHF11 | 18 |
| PHKA1 | 109 |
| PI | 47, 76 |
| PI3 | 31, 128, 155 |
| PIAS3 | 112 |
| PICALM | 109 |
| PIGR | 51, 110 |

TABLE 9-continued

RELATION OF TARGET GENES TO DISEASE

| Gene Name | Disease Code |
|---|---|
| PIK3CA | 42, 110, 133, 138 |
| PIK3R1 | 31, 51, 64, 93, 132 |
| PIM1 | 112, 154 |
| PIN1 | 8 |
| PIP | 31, 139 |
| PITPNM1 | 113 |
| PITX3 | 37 |
| PKD1 | 31 |
| PKLR | 64, 132 |
| PKM2 | 31, 51, 106, 157, 110, 133, 142 |
| PLA2G10 | 51 |
| PLA2G2A | 51, 118, 141, 152, 154 |
| PLA2G7 | 4, 18, 41 |
| PLAB | 31, 154 |
| PLAGL1 | 31, 64 |
| PLAT | 31, 51, 64, 133, 152, 123, 132, 134, 92, 105, 110 |
| PLAU | 8, 31, 51, 133, 152, 92, 110, 123 |
| PLAUR | 31, 51, 92, 110, 123, 133 |
| PLCB1 | 167 |
| PLCB3 | 36 |
| PLCD1 | 8, 29, 51, 54, 152 |
| PLCG1 | 29, 31, 51, 152 |
| PLCL1 | 110, 133, 167 |
| PLD1 | 31, 51 |
| PLD2 | 31, 51, 157 |
| PLEC1 | 92, 154 |
| PLK | 51, 83, 110, 112, 133 |
| PLP1 | 123 |
| PLTP | 64, 76, 105, 146, 132, 134 |
| PLU-1 | 31 |
| PMS1 | 51, 151 |
| PMS2 | 51, 79, 118, 151, 154 |
| PNCA1 | 140 |
| PNMT | 8, 98, 144 |
| PNOC | 162 |
| POLB | 30, 31, 51, 109, 110, 154 |
| POLG | 102 |
| POLK | 133 |
| POMC | 4, 8, 31, 167, 132, 110, 123, 134, 64, 92, 105 |
| PON1 | 41, 52, 53, 132, 105, 144, 95, 64, 127 |
| PON2 | 41, 52, 53 |
| POR | 3, 31, 110 |
| POU3F4 | 60 |
| POU4F3 | 60 |
| PPARA | 30, 64, 97, 132, 154 |
| PPARD | 51, 95 |
| PPARGC1 | 64, 132, 134 |
| PPID | 31, 154 |
| PPM1D | 31, 154 |
| PPND | 61, 144 |
| PPP1CC | 31 |
| PPP1R15A | 118 |
| PPP1R3A | 51, 64, 132, 133, 167 |
| PPP2CB | 31 |
| PPP2R1B | 31, 51, 110 |
| PRCC | 157 |
| PRDM2 | 31, 51, 79, 90, 110, 112 |
| PRDX1 | 8, 70, 109 |
| PREP | 8 |
| PRF1 | 14, 51, 88, 92, 122, 123 |
| PRG2 | 18, 174 |
| PRKAA2 | 64, 132 |
| PRKAG2 | 129, 144 |
| PRKAR1A | 31, 57, 111, 150, 154, 173 |
| PRKCA | 8, 31, 51, 150, 64, 110, 132 |
| PRKCD | 154, 157 |
| PRKCE | 8, 31, 51, 154, 167, 92, 110, 133 |
| PRKCG | 8, 31, 51, 154 |
| PRKCL1 | 8 |
| PRKCM | 31, 110, 167 |
| PRKCQ | 64, 109, 132, 134 |
| PRKCZ | 8, 31 |
| PRKDC | 51, 109 |
| PRKN | 144 |
| PRKR | 8, 31, 51, 118, 187, 91, 92, 109 |

TABLE 9-continued

RELATION OF TARGET GENES TO DISEASE

| Gene Name | Disease Code |
|---|---|
| PRL | 4, 12, 31, 105, 111, 123, 51, 64, 92 |
| PRLR | 31, 150, 154 |
| PRM1 | 102 |
| PRM2 | 102 |
| PRND | 8 |
| PRNP | 8, 61 |
| PRODH | 162 |
| PROM1 | 109 |
| PROMM | 129 |
| PROS1 | 172 |
| PROZ | 41 |
| PRSS1 | 51, 141 |
| PRSS2 | 141 |
| PRSS8 | 31, 154 |
| PRTN3 | 56, 58, 92, 180, 109, 111, 160 |
| PRY | 102 |
| PSDA | 24 |
| PSEN1 | 8, 9, 39, 70, 61 |
| PSEN2 | 8, 61 |
| PSG1 | 70 |
| PSMB8 | 64, 105, 118, 174 |
| PSMB9 | 64, 105, 118, 174 |
| PSORS1 | 155 |
| PSORS2 | 155 |
| PSORS3 | 155 |
| PSORS4 | 155 |
| PSORS5 | 155 |
| PSORS6 | 155 |
| PSORS7 | 155 |
| PTAFR | 18, 31, 50, 51, 118 |
| PTCH | 27, 30, 31, 83, 166 |
| PTCH2 | 27 |
| PTCPRN | 173 |
| PTCRA | 31 |
| PTEN | 31, 51, 79, 167, 173, 110, 133, 154 |
| PTGER2 | 42, 79 |
| PTGER4 | 30, 42, 51, 79 |
| PTGES | 51 |
| PTGIS | 98, 127 |
| PTGS1 | 31, 51, 133 |
| PTH | 3, 4, 31, 136, 98, 110, 132, 51, 64, 92 |
| PTHLH | 31, 110, 133 |
| PTHR1 | 136 |
| PTK2B | 31, 167 |
| PTK6 | 31, 51 |
| PTMA | 31, 51, 110 |
| PTN | 31, 118, 133, 141, 154, 167 |
| PTOV1 | 154 |
| PTPN1 | 8, 31, 64, 134, 83, 98, 132 |
| PTPN13 | 154 |
| PTPN6 | 31, 35, 93, 109, 112 |
| PTPRA | 31, 154 |
| PTPRC | 64, 92, 105, 123 |
| PTPRF | 31, 134 |
| PTPRG | 31, 110, 157 |
| PTPRJ | 31, 51, 56, 110 |
| PTPRN | 64, 85, 105 |
| PTPRN2 | 64, 105 |
| PTTG1 | 31, 51, 110, 150 |
| PURA | 92, 109 |
| PVR | 51 |
| PVRL1 | 48, 91 |
| PXN | 31, 51, 83, 167, 118, 92, 154 |
| PYGM | 31, 113, 150 |
| RAB3A | 8 |
| RABEP1 | 109 |
| RAC1 | 31, 51 |
| RAD50 | 42, 51 |
| RAD51 | 31, 154 |
| RAD51A | 31 |
| RAD51C | 31 |
| RAD51L1 | 110 |
| RAD52 | 31 |
| RAD54B | 93, 112 |
| RAD54L | 31, 51, 93, 112 |

TABLE 9-continued

RELATION OF TARGET GENES TO DISEASE

| Gene Name | Disease Code |
| --- | --- |
| RAG2 | 111 |
| RAGE | 118, 157, 176 |
| RALA | 30 |
| RAN | 154 |
| RANBP17 | 109 |
| RAP1A | 110, 154 |
| RARG | 31 |
| RASA1 | 27, 51, 110 |
| RASSF1 | 30, 31, 110, 133, 157, 167 |
| RB1 | 30, 31, 51, 110, 167, 133 |
| RB1CC1 | 31 |
| RBBP1 | 31 |
| RBL2 | 31, 35, 79, 110, 112, 133 |
| RBM15 | 109 |
| RBM5 | 110, 133, 167 |
| RBM6 | 110, 167 |
| RBP1 | 31, 79, 107, 166 |
| RBP1L1 | 31, 51, 110 |
| RCBTB1 | 109 |
| RCCP3 | 157 |
| RCV1 | 110, 167 |
| RDS | 113 |
| RDX | 110, 160 |
| REA | 31 |
| RECK | 90 |
| RECQL | 51 |
| REG1A | 51, 141 |
| REL | 31, 92, 93, 112 |
| RELA | 8, 31, 92, 110 |
| RELN | 24, 29, 83, 162 |
| REN | 8, 64, 65, 105, 132 |
| REST | 167 |
| RET | 116, 173 |
| RETN | 64, 132, 134 |
| RFC3 | 51 |
| RFH1 | 98 |
| RFP2 | 109 |
| RGS4 | 162 |
| RHD | 86 |
| RIL | 136 |
| RLF | 110, 167 |
| RLN1 | 31 |
| RLN2 | 31 |
| RNASE1 | 141 |
| RNASE2 | 92 |
| RNASEL | 154 |
| RNF14 | 154 |
| RNF7 | 51, 110, 133 |
| ROBO1 | 31, 110, 157 |
| ROCK1 | 90 |
| RORA | 31, 154 |
| RPA1 | 31, 51, 110, 133 |
| RPGR | 60, 113 |
| RPL13 | 31, 154 |
| RPL19 | 31 |
| RPL29 | 51 |
| RPL30 | 90 |
| RPN1 | 109 |
| RPN2 | 51 |
| RPS6 | 110, 157 |
| RPS6KA1 | 110, 133 |
| RPS6KA3 | 110, 167 |
| RPS6KB1 | 31 |
| RRAD | 31, 64, 132, 134 |
| RRAS | 31 |
| RRAS2 | 31 |
| RSN | 93 |
| RTN1 | 110 |
| RUNX1 | 109, 160 |
| RUNX2 | 136, 154 |
| RXRB | 162, 166 |
| RXRG | 133 |
| RYR1 | 129 |
| RYR2 | 169, 186 |
| S100A1 | 157 |

TABLE 9-continued

RELATION OF TARGET GENES TO DISEASE

| Gene Name | Disease Code |
|---|---|
| S100A2 | 31, 118, 133 |
| S100A6 | 118, 51 |
| S100A7 | 31, 155 |
| S100A9 | 56, 58, 155, 180 |
| S100B | 8, 61 |
| S100P | 31, 56, 154, 180 |
| SAA1 | 9, 160 |
| SAFB | 31 |
| SAH | 98, 134 |
| SARDH | 90 |
| SAT | 31, 118, 133, 154, 167, 180 |
| SC5DL | 134 |
| SCA2 | 123 |
| SCA7 | 113 |
| SCABD | 60 |
| SCARB1 | 3 |
| SCD | 31, 51, 83 |
| SCG2 | 8, 36, 160 |
| SCG3 | 154 |
| SCGB1A1 | 18, 154 |
| SCGB1D2 | 31, 154 |
| SCGB2A2 | 31 |
| SCGB3A1 | 31 |
| SCGB3A2 | 18 |
| SCN10A | 123 |
| SCN1A | 82 |
| SCN1B | 82 |
| SCN4A | 154 |
| SCN5A | 34, 185 |
| SCO2 | 100, 129 |
| SCP2 | 3 |
| SCT | 24 |
| SCTR | 140 |
| SCYE1 | 118 |
| SCZD1 | 162 |
| SCZD10 | 162 |
| SCZD11 | 162 |
| SCZD2 | 162 |
| SCZD3 | 162 |
| SCZD4 | 162 |
| SCZD5 | 162 |
| SCZD6 | 162 |
| SCZD7 | 162 |
| SCZD8 | 162 |
| SCZD9 | 162 |
| SDC1 | 31, 42, 51, 122, 90, 110, 112 |
| SDC2 | 24 |
| SDHD | 36, 60, 106 |
| SE20-4 | 111, 112 |
| SEL1L | 31 |
| SELE | 4, 31, 51, 132, 133, 105, 110, 123, 64, 85, 92 |
| SELL | 4, 64, 92, 132, 105, 109, 123 |
| SELP | 31, 64, 92, 95, 105, 132 |
| SELPLG | 103, 109 |
| SEMA3B | 110, 133, 167 |
| SEMA3C | 110, 160 |
| SEMA3F | 110 |
| SEPP1 | 51, 154 |
| SERPINA1 | 47, 58, 90, 107, 110 |
| SERPINA3 | 8, 31, 110 |
| SERPINA5 | 172 |
| SERPINA7 | 90, 92 |
| SERPINB3 | 155 |
| SERPINB5 | 31, 112, 154 |
| SERPINE1 | 31, 110, 154 |
| SERPINE2 | 8, 102 |
| SERPINF1 | 10, 31, 67, 113 |
| SERPINF2 | 40, 47, 52, 109, 127, 154 |
| SERPING1 | 8, 74, 111, 112, 141, 160 |
| SERPINH1 | 147 |
| SERPINI1 | 61 |
| SERPINI2 | 31 |
| SET | 109 |
| SFN | 31, 90 |
| SFRP1 | 31, 51, 180 |

TABLE 9-continued

| RELATION OF TARGET GENES TO DISEASE | |
|---|---|
| Gene Name | Disease Code |
| SFTPA1 | 110, 159 |
| SFTPA2 | 137, 159 |
| SFTPB | 110 |
| SFTPC | 110 |
| SFTPD | 104, 159, 178 |
| SFXN5 | 144 |
| SGCD | 100, 129 |
| SH2D1A | 16, 75, 88, 160, 101, 109, 112 |
| SHBG | 31, 64, 92, 134, 154, 98, 105, 132 |
| SHC1 | 8, 31, 64, 132 |
| SHFM1D | 60 |
| SHH | 27, 49, 110, 166 |
| SHOX | 179 |
| SI | 26, 56, 74, 83 |
| SIAH1 | 31, 51, 90, 154 |
| SIAT6 | 31, 51 |
| SIAT8A | 118 |
| SIAT8B | 110, 133 |
| SIAT9 | 30, 118, 176 |
| SIL | 109 |
| SILV | 118 |
| SIM1 | 134 |
| SIM2 | 70 |
| SKP2 | 31, 51, 90, 109, 110, 112 |
| SLC11A1 | 56, 178, 180 |
| SLC16A1 | 51 |
| SLC18A2 | 144, 162 |
| SLC18A3 | 8 |
| SLC19A1 | 31, 109 |
| SLC19A2 | 64, 117 |
| SLC1A1 | 10, 29, 82, 162 |
| SLC1A2 | 8, 10, 82, 162 |
| SLC1A3 | 8, 82 |
| SLC22A1L | 31, 110 |
| SLC22A4 | 160 |
| SLC25A1 | 162 |
| SLC25A13 | 88 |
| SLC26A3 | 51 |
| SLC26A4 | 60, 173 |
| SLC2A1 | 8, 31, 51, 133, 105, 110, 132, 64, 65, 92 |
| SLC2A10 | 64, 132 |
| SLC2A2 | 64, 105, 110, 132, 134 |
| SLC2A3 | 8, 31, 92, 110, 133 |
| SLC2A4 | 31, 64, 85, 134, 105, 106, 132 |
| SLC2A5 | 31 |
| SLC3A2 | 51 |
| SLC4A1 | 8, 86, 114, 158 |
| SLC4A4 | 158 |
| SLC5A5 | 31 |
| SLC5A7 | 8 |
| SLC6A1 | 162 |
| SLC6A14 | 134 |
| SLC6A2 | 12, 23, 29, 62, 162 |
| SLC6A3 | 23, 29, 144, 162 |
| SLC6A4 | 8, 13, 23, 162, 120, 144, 153, 62, 70, 98, 24, 29, 53 |
| SLC7A5 | 51 |
| SLC9A1 | 65, 98, 109 |
| SLEB1 | 111 |
| SLEB3 | 111 |
| SLEB4 | 111 |
| SLEH1 | 86, 111 |
| SLEN1 | 111 |
| SLEN2 | 111 |
| SLEN3 | 111 |
| SLEV1 | 111 |
| SLPI | 18, 58, 76, 177, 92, 110, 133 |
| SMAP1 | 16 |
| SMARCA3 | 51, 83 |
| SMARCA4 | 31, 110, 154 |
| SMARCB1 | 157 |
| SMN1 | 10 |
| SMN2 | 10 |
| SMO | 27, 166 |
| SMS | 31, 109 |
| SNAI1 | 31, 118 |

TABLE 9-continued

RELATION OF TARGET GENES TO DISEASE

| Gene Name | Disease Code |
|---|---|
| SNAP25 | 8, 23, 29, 62, 162 |
| SNCA | 8, 61, 70, 144 |
| SNCAIP | 144 |
| SNCB | 8, 31, 144 |
| SNCG | 8, 10, 31, 144 |
| SNRPB | 111, 118 |
| SNRPN | 111 |
| SOAT1 | 134 |
| SOCS3 | 56, 109, 112, 160 |
| SOD1 | 8, 10, 31, 132, 51, 64, 105 |
| SOD2 | 8, 10, 31, 110, 144, 51, 64, 105 |
| SOD3 | 10 |
| SORD | 37 |
| SOX13 | 64, 105 |
| SOX4 | 31 |
| SP1 | 31, 110 |
| SP100 | 47, 91 |
| SP3 | 123 |
| SPA17 | 122 |
| SPARC | 31, 51, 69, 157, 83, 118, 154 |
| SPARCL1 | 133 |
| SPDEF | 31, 154 |
| SPG7 | 31, 51, 90 |
| SPINK1 | 141 |
| SPINK5 | 18, 20 |
| SPINT1 | 31, 51, 90 |
| SPINT2 | 110 |
| SPN | 8, 51, 92, 110 |
| SPRR1B | 110 |
| SPRR3 | 83 |
| SQSTM1 | 31, 139 |
| SRA1 | 31 |
| SRC | 25, 31, 51, 109, 112, 180 |
| SRD5A2 | 31, 154 |
| SREBF1 | 64, 92, 132, 134 |
| SREBF2 | 51, 95, 134, 154 |
| SRF | 31 |
| SRI | 112 |
| SRP19 | 152 |
| SRPX | 51, 110 |
| SRY | 179 |
| SS18 | 154, 157 |
| SSA1 | 111, 133, 160 |
| SSA2 | 111 |
| SSB | 111 |
| SST | 8, 64, 105, 132 |
| SSTR1 | 31 |
| SSTR4 | 154 |
| SSTR5 | 29, 31, 51, 150, 154 |
| SSX2 | 30, 31, 51, 157, 112, 118, 154, 79, 90, 110 |
| ST14 | 31, 51 |
| ST7 | 24, 31, 51, 83, 90 |
| ST8 | 138 |
| STARD3 | 31, 83 |
| STAT1 | 31, 51, 92, 123, 125, 94, 109, 112 |
| STAT2 | 31, 109, 118 |
| STAT5A | 92 |
| STAT5B | 92, 109 |
| STAT6 | 18, 31, 160 |
| STC1 | 31 |
| STE | 31 |
| STK11 | 118, 140 |
| STMN1 | 8, 31, 110 |
| STRC | 60 |
| STS | 31 |
| SUCLA2 | 164 |
| SULT1A1 | 31 |
| SULT2A1 | 57 |
| SULT2B1 | 31 |
| SUSP1 | 112 |
| SYBL1 | 29 |
| SYCP1 | 31, 110, 112, 157 |
| SYK | 31, 109 |
| SYN1 | 8, 162 |
| SYN2 | 8, 162 |

TABLE 9-continued

RELATION OF TARGET GENES TO DISEASE

| Gene Name | Disease Code |
| --- | --- |
| SYN3 | 162 |
| SYP | 8, 10, 29, 61, 144, 162 |
| TAC1 | 8, 31, 64, 92, 110, 167 |
| TACC1 | 31 |
| TACC3 | 122 |
| TACR1 | 18, 56, 92, 160, 103, 120, 141 |
| TACR2 | 56, 103, 160, 180 |
| TAGLN | 31 |
| TAL1 | 109, 112 |
| TAL2 | 109 |
| TALDO1 | 123 |
| TAM | 70 |
| TAP1 | 31, 64, 105, 167, 174, 110, 123, 133 |
| TAT | 47, 88, 90 |
| TAZ | 99, 129 |
| TBX2 | 31 |
| TBX22 | 49 |
| TBXA2R | 18, 110, 133 |
| TBXAS1 | 98 |
| TCAP | 129 |
| TCF1 | 64, 90, 105, 132, 157 |
| TCF2 | 26, 64, 107, 132 |
| TCF4 | 29, 162 |
| TCF7 | 51, 64, 105, 112 |
| TCL1A | 4, 109, 112 |
| TCL1B | 112 |
| TCL4 | 112 |
| TCL6 | 109 |
| TCO | 173 |
| TCP1 | 70 |
| TCPT | 171 |
| TCRA | 112 |
| TCTA | 109, 167 |
| TDGF1 | 31, 42, 51, 133, 141 |
| TECTA | 60 |
| TEK | 4, 31, 90, 166, 110, 118, 133 |
| TERC | 16 |
| TERF1 | 31, 109 |
| TERT | 31, 51, 110, 133 |
| TF | 8, 110, 123, 167 |
| TFAM | 88, 129 |
| TFAP2A | 51, 118, 154, 166 |
| TFAP2C | 31, 79 |
| TFCP2 | 8, 92 |
| TFE3 | 157 |
| TFF2 | 26, 31, 145 |
| TFF3 | 51 |
| TFG | 112 |
| TFPI | 64, 105 |
| TFRC | 8, 31, 51, 110, 123, 133, 64, 92, 105 |
| TG | 64, 92, 105, 123 |
| TGFB2 | 8, 31, 51, 110, 114, 123 |
| TGFB3 | 31, 51, 110 |
| TGFBI | 83 |
| TGFBR2 | 30, 31, 42, 176, 151, 154, 167, 90, 110, 133, 51, 79, 83 |
| TGFBR3 | 31 |
| TGIF | 83 |
| TGM1 | 8, 133 |
| TGM2 | 8, 31, 110, 133 |
| TGM3 | 83 |
| TGM4 | 154 |
| TH | 23, 24, 29, 134, 144, 162 |
| THBD | 31, 47, 51, 127, 132, 167, 110, 118, 123, 64, 92, 105 |
| THBS2 | 31, 42, 51, 133, 83, 110, 127 |
| THBS4 | 127 |
| THC2 | 171 |
| THPO | 31, 110 |
| THRA | 150, 157 |
| THRB | 31, 133, 150, 154, 157, 167 |
| THRSP | 31 |
| THY1 | 109, 160 |
| TIA1 | 51, 92, 109 |
| TIAM1 | 31, 70, 157 |
| TIE | 4, 31, 109, 118, 157, 166 |
| TIEG | 31, 154 |

TABLE 9-continued

RELATION OF TARGET GENES TO DISEASE

| Gene Name | Disease Code |
|---|---|
| TIF1 | 173 |
| TIF1G | 173 |
| TIMM8A | 60 |
| TIMP2 | 31, 51, 110, 118 |
| TIMP4 | 31 |
| TIP47 | 42 |
| TITF1 | 36, 110, 167 |
| TJP1 | 31, 74, 77, 92, 140, 155 |
| TJP2 | 31, 51, 154 |
| TK1 | 31, 51 |
| TK2 | 129 |
| TKT | 8 |
| TLX1 | 109 |
| TLX3 | 109 |
| TM4SF2 | 109 |
| TMC1 | 60 |
| TMEFF2 | 30, 51, 154 |
| TMIE | 60 |
| TMPRSS2 | 154 |
| TMPRSS3 | 60 |
| TMSB10 | 31, 51, 83, 154, 157 |
| TNC | 31, 51, 79, 154, 180, 98, 110, 118 |
| TNDM | 64 |
| TNF | 31, 35, 42, 133, 167, 110, 112, 114, 51, 79, 109 |
| TNFRSF10A | 31, 51, 110, 112 |
| TNFRSF10C | 51, 83, 110 |
| TNFRSF10D | 110 |
| TNFRSF11A | 139 |
| TNFRSF11B | 139 |
| TNFRSF1B | 31, 51, 64, 123, 134, 98, 105, 110, 92, 95, 97 |
| TNFRSF5 | 8, 31, 35, 123, 133, 180, 92, 110, 112, 42, 56, 75 |
| TNFRSF7 | 75, 92, 109, 123, 157, 111, 112, 118 |
| TNFRSF8 | 92, 123 |
| TNFRSF9 | 110, 160 |
| TNFSF10 | 31, 51, 92, 133, 110, 122, 123 |
| TNFSF11 | 31, 109, 112, 122, 154, 156 |
| TNFSF12 | 111 |
| TNFSF6 | 8, 26, 30, 123, 133, 92, 110, 111, 31, 51, 83 |
| TNFSF7 | 92, 109, 112, 122 |
| TNNC1 | 129 |
| TNNI3 | 129 |
| TNNT1 | 129 |
| TNNT2 | 129 |
| TNRC11 | 162 |
| TOC | 83 |
| TOP1 | 31, 51, 109, 110, 133 |
| TOP2B | 110, 167 |
| TP53 | 3, 4, 8, 167, 173, 123, 133, 140, 92, 110, 112, 31, 51, 90 |
| TP73 | 31, 35, 51, 110, 112, 118, 59, 90, 109 |
| TP73L | 26, 27, 30, 110, 83, 48, 166, 42, 51 |
| TPD52 | 31 |
| TPH1 | 29, 62, 162 |
| TPI1 | 86 |
| TPK1 | 117 |
| TPM1 | 100, 129, 154 |
| TPM2 | 31, 110, 129 |
| TPM3 | 112, 129 |
| TPO | 60, 61, 102, 174 |
| TPT1 | 8, 18, 51, 70 |
| TPX2 | 110 |
| TRA1 | 8, 21, 51, 88, 90 |
| TRAF1 | 75, 93, 109, 112 |
| TRAF4 | 31 |
| TRAPPC1 | 118 |
| TRBV5-3 | 92 |
| TRC8 | 157 |
| TRDD3 | 109, 123 |
| TRDV3 | 38, 92, 109, 157 |
| TREM2 | 61 |
| TRGV9 | 92, 114, 160, 166 |
| TRHR | 8, 150, 162 |
| TRIP11 | 109 |
| TRPM1 | 118 |
| TRPV6 | 154 |
| TSC1 | 30, 82, 110, 157 |

TABLE 9-continued

RELATION OF TARGET GENES TO DISEASE

| Gene Name | Disease Code |
|---|---|
| TSG101 | 31, 42, 79, 154, 90, 92, 109 |
| TSG11 | 110 |
| TSLP | 20 |
| TSN | 109 |
| TSP50 | 31 |
| TSPY | 154 |
| TSPYQ1 | 102 |
| TTC3 | 70 |
| TTC4 | 31, 118 |
| TTN | 100, 124, 129 |
| TTR | 8, 9, 64, 105 |
| TU3A | 157 |
| TUB | 134 |
| TUBB2 | 154 |
| TULP1 | 79 |
| TXN | 31, 90, 92, 109, 133, 160 |
| TXNRD3 | 90 |
| TYMS | 31, 51, 59, 133, 109, 110, 112 |
| TYRO3 | 122 |
| TYROBP | 61 |
| TYRP1 | 118 |
| UAN | 131 |
| UBB | 8, 70 |
| UBC | 157 |
| UBE1L | 110 |
| UBE2B | 102 |
| UBE2I | 110 |
| UBE3A | 24 |
| UBM2 | 118 |
| UBTF | 90, 111, 160 |
| UCHL1 | 36, 51, 110, 133, 144, 167 |
| UCN | 64, 134, 150 |
| UCP1 | 134 |
| UCP2 | 64, 132, 134 |
| UCP3 | 64, 106, 132, 134 |
| UFD1L | 162 |
| UGCG | 92 |
| UGT1A1 | 28, 31 |
| UGT2B15 | 154 |
| UMOD | 122, 157 |
| UMPK | 51 |
| UPK1A | 74 |
| UPK1B | 30, 176 |
| UPK2 | 30, 176 |
| UPK3A | 30, 139, 176 |
| UPP1 | 31, 51 |
| USF1 | 31 |
| USF2 | 31 |
| USH1C | 60 |
| USH3A | 60 |
| USP4 | 110, 167 |
| USP9Y | 102 |
| UVM1 | 118 |
| VCAM1 | 4, 31, 51, 112, 123, 132, 64, 92, 105 |
| VCL | 31, 51 |
| VCY2 | 102 |
| VDR | 4, 31, 51, 154, 123, 132, 136, 64, 105, 109 |
| VEGFC | 31, 42, 83, 157, 110, 133, 154 |
| VHL | 157 |
| VIL1 | 45 |
| VIL2 | 79, 160 |
| VIM | 8, 31, 51, 110, 167 |
| VIP | 4, 8, 51, 110, 167, 133 |
| VIPR1 | 92, 133, 154, 167 |
| VIPR2 | 154 |
| VLDLR | 8, 31, 61 |
| VMD2 | 113 |
| VSNL1 | 8, 162 |
| VSPA | 179 |
| VTN | 8, 51 |
| VWF | 31, 53, 64, 132, 92, 103, 105 |
| WAS | 171 |
| WDM | 129 |
| WEE1 | 47, 92 |
| WFS1 | 29, 64, 105 |

TABLE 9-continued

RELATION OF TARGET GENES TO DISEASE

| Gene Name | Disease Code |
|---|---|
| WHN | 6 |
| WHSC1 | 9, 122 |
| WHSC1L1 | 31, 109 |
| WHSC2 | 92 |
| WISP1 | 31, 51 |
| WISP2 | 31, 51 |
| WISP3 | 31, 51 |
| WIT-1 | 109 |
| WNT1 | 27, 31 |
| WNT10B | 31 |
| WNT2 | 24, 31, 51, 69, 83 |
| WNT3 | 31, 110 |
| WNT3A | 122 |
| WNT7A | 79, 110 |
| WNT7B | 30, 31, 83, 110 |
| WNT8B | 82 |
| WRB | 70 |
| WRN | 127 |
| WSN | 144 |
| WT1 | 31, 110, 133 |
| WTS | 134 |
| WWOX | 31, 83, 122 |
| XBP1 | 29 |
| XCL1 | 56, 92 |
| XK | 29 |
| XLKD1 | 31, 47 |
| XPA | 51, 110 |
| XPC | 24, 166 |
| XRCC1 | 27, 31, 51, 83, 110, 166 |
| XRCC2 | 31 |
| XRCC3 | 30, 31, 118 |
| XRCC5 | 31, 42, 51, 109, 122 |
| YES1 | 51, 83, 118 |
| YWHAG | 118 |
| YWHAH | 162 |
| YY1 | 92, 109 |
| ZAP70 | 92, 118 |
| ZFY | 154 |
| ZIC2 | 110, 167 |
| ZNF145 | 109 |
| ZNF147 | 31 |
| ZNF151 | 51 |
| ZNF198 | 112 |
| ZNF217 | 31, 51, 154 |
| ZNFN1A1 | 109, 112 |
| ZNFN1A2 | 109 |
| ZXDA | 179 |
| ZXDB | 179 |

SEQUENCE LISTING (760616 sequences)

SEQ ID NO: 1 - RNA, 90 nt, Homo sapiens
ugaguaacacucaaagcaucuauaaggaccccaugcagcacauccuaaauagcuguauggggucuuuauggaugcuuuggguguuauuca

SEQ ID NO: 2 - RNA, 91 nt, Homo sapiens
acauaugugaaaacauaggacugugcuuggcacauagcacaaagucuuaugguacugugugccaagcauaguccuguguuuuuacauaugu

SEQ ID NO: 3 - RNA, 82 nt, Homo sapiens
ucuccuggcugaauucucacucacagaaguagauucaacagcagcagugucuacuucugugggugagaauucggccaggagg

SEQ ID NO: 4 - RNA, 109 nt, Homo sapiens
uuuuguuucuguaggaucugugacucuguauaaucuuaauuugcuuucccuccuguuucuugaagacaaaauaggaauauauggagucacagguccuauggaaacaaaa

SEQ ID NO: 5 - RNA, 75 nt, Homo sapiens
uucauacucauggguucugcaaaaugcagauucaaauaauguaaaucugcauuuuguagaacccauggguaugaa

SEQ ID NO: 6 - RNA, 80 nt, Homo sapiens
gcuguuucaagguaguaccaguaccuuguguucaguggaaccaagguaaacacaagguauugguauuaccuugagauagc

SEQ ID NO: 7 - RNA, 77 nt, Homo sapiens
auauucacucaugaaugaccaaagcaaaauuucuuuuauaacauuuuguuuugcuuuggucguucaugagugaaugu

SEQ ID NO: 8 - RNA, 84 nt, Homo sapiens
ggcugacagccauaggggagggccucugacacccccagcaauccaccaguggguaucagaggcccuccucuauggcugucagcc

SEQ ID NO: 9 - RNA, 139 nt, Homo sapiens
ccugaugccaggaacccuaucucuccagcucugacccagaucuccaguguccaggagaauucauuuuacaaagcagggaauucuccugggcacuggagagcugggucagagguggggagguaggguuccugguaucagg

SEQ ID NO: 10 - RNA, 63 nt, Homo sapiens
cauguugucauagaaguaaaugaaaagguugggagacuuuucauuugcuucugugauaacaug

SEQ ID NO: 11 - RNA, 148 nt, Homo sapiens
aauucugaaaugguuggaccauuaauuugauacaaaauauggaaucucuuacauucugcagacuacucauggaagaugguaaguggccucuggaauauaagaaauuacauauauuagguugaauuaaugguccagcuauuucagaauu

SEQ ID NO: 12 - RNA, 78 nt, Homo sapiens
uucacauccugugugacccuaugggaaaauuuuuaacuaauacuggggaaaaucccauaggguuacacaggaugugaa

SEQ ID NO: 13 - RNA, 69 nt, Homo sapiens
uuacuuagguaaacuaccaaaucucaugacugcuuccagguccugagauuuggugguuuaccugaguaa

SEQ ID NO: 14 - RNA, 69 nt, Homo sapiens; identical to SEQ ID NO: 13

SEQ ID NO: 15 - RNA, 69 nt, Homo sapiens
uuacuuagguaaacugccaaaucucaugacugcuuccagguccugagauuuggcgguuuaccugaguaa

SEQ ID NO: 16 - RNA, 93 nt, Homo sapiens
aaucaccuuaaccuuguuguacuucagaaucuccaggaguaauguaugaaguuaguccuggagauucuaaaguauaacaagguugaggugauu

SEQ ID NO: 17 - RNA, 75 nt, Homo sapiens
uaauuauccucaaucauaauguuacaugauagaauagugcuacaguucauuuaacauuaugauuggggauaauua

SEQ ID NO: 18 - RNA, 86 nt, Homo sapiens
uaaauaucuugaacuuguaacuaagcaguuacuuugauauacccuaaaaucaaaguaacugguuaguuacaaguuuaagauauuua

SEQ ID NO: 19 - RNA, 137 nt, Homo sapiens
aguugaguuuggugcauguaaaauuuucccagcaaaauacuucuggagguaaaucuuagguugaaaaucuuggaucuaaaaaggcuuaccuccagcagaacuuugcugggaacauuuuacaugcacuaaacucaauu

SEQ ID NO: 20 - RNA, 84 nt, Homo sapiens
gcuggcaaagagguagacaguaaccauuuuaugaaaggggaacuaaugcuuuacaaaaugauuacuguuuacuucuuugucagu

SEQ ID NO: 21 - RNA, 70 nt, Homo sapiens
acuauuauuuauugauucugggaguguucuugguaguaggaaaccugaucuagaaucaauaaaugauggu

SEQ ID NO: 22 - RNA, 80 nt, Homo sapiens
guucuucaucagagcuuugugucauggucauauaaggucauccccuuaggucaccauaacacgaagcucugaugaagagc

SEQ ID NO: 23 - RNA, 84 nt, Homo sapiens
ucugcaguuggaacagaucugugauuaugucagggaucagcuaucagaccccugacauggugacagaucuguucuaacugcaga

SEQ ID NO: 24 - RNA, 77 nt, Homo sapiens
gugauuuaagauguuuucuuucgccuuucuccuuuugagagagauggagaaagaggaaagaaaauaucuuaaaucac

SEQ ID NO: 25 - RNA, 76 nt, Homo sapiens
aguucauuugaagccuaucucuuuuuaauucggagagccgggcucugaauuaauagagauaggcuucgagugaacu

SEQ ID NO: 26 - RNA, 76 nt, Homo sapiens; identical to SEQ ID NO: 25

SEQ ID NO: 27 - RNA, 79 nt, Homo sapiens
uguucuuucauucauuuacuccuccuuuuucucacuaauucugcuuugauacuggggagagugaaugggugaaagagca

SEQ ID NO: 28 - RNA, 69 nt, Homo sapiens
guuauaaugugucaggaguaaacagccucauucauucuguuaguucuguugcuucuggcauguuaugau

SEQ ID NO: 29 - RNA, 70 nt, Homo sapiens
uauuuuuguauuguagauugaauaauaagauugaaaacaauucuguaaauuaaucuauaguauagaagua

SEQ ID NO: 30 - RNA, 116 nt, Homo sapiens
uccacuuaguucucuucccuacagguaaugaugcuauuuacuuuuuguuuauucuuccaaagauauuuuauaaaaauuaauagcaucauugccuauagggaagagaacugagugga

SEQ ID NO: 31 - RNA, 91 nt, Homo sapiens
ggcucaacauaugacugccuucuucacaucauucaugcccucuuugagcugaggcaugaaugauguaaaugaggcaguuauauguugagcu

SEQ ID NO: 32 - RNA, 84 nt, Homo sapiens
uaguaauaagaaagaugagcucauuguaauaugagcuucauuuauacauuucauauuaccauuagcucaucuuuuuuauuacua

SEQ ID NO: 33 - RNA, 61 nt, Homo sapiens
gucugcuugaugccaagcauccugauuuuucaacuauccagauguuuggcaucaggcagac

SEQ ID NO: 34 - RNA, 81 nt, Homo sapiens
agcuucugcaaucuguaacaugccacaggcagccaucuauagcugcuagcagccuguggaauguuacggauugcagaagcu

SEQ ID NO: 35 - RNA, 108 nt, Homo sapiens
auaucauugugagaauuaaguuauuuaauacauauaaaaaggcacuuacaacagugucuggcagugucuuuuuauauguaugaaaucacuuaauucucauaaugauau

SEQ ID NO: 36 - RNA, 85 nt, Homo sapiens
aguuuuuucuucagcaaguaaaucuucaacuauacaguauuaaaguauuuuuauauuguugaaacuacuuguuggagagaaaauu

SEQ ID NO: 37 - RNA, 91 nt, Homo sapiens
uguuuuguuuugcaccaggucacuccauucauauauauuacaccagcaauucugccuacaugaauagagcagccuggugcaaaacagaaca

SEQ ID NO: 38 - RNA, 103 nt, Homo sapiens
cucaccccagugccauuccacgcaggaaaccacuucagucccuggacacgguggggcucuggggacugaagugcuuuccucaauggaaugguauugggguggg

SEQ ID NO: 39 - RNA, 77 nt, Homo sapiens
uuuggcuuuuaaaacuagaaguagaagcaguuauuuucuugguuagauauuuuggcuuuuugguuuuaaaagccaaa

SEQ ID NO: 40 - RNA, 80 nt, Homo sapiens
gagcagaaguuaaugaaauauaaaacaaagauacacuaagaaagauauauccuuguuuucuauuuuauugacuucugcuc

SEQ ID NO: 41 - RNA, 86 nt, Homo sapiens
ccugaauuggccaaugcuaauuggaacucuacuaagucuacuuacuccaguuaguagaauuccaauauagcguuggccaauucagg

SEQ ID NO: 42 - RNA, 138 nt, Homo sapiens
ccccaccccggacuccuugcgcccucccguuccccuggcaacggccggugaccucaccgggguuguaagccgagcccagagugaagucaccgcuguugcuauggggacucaguggucgccaaggaguucggggugggg

SEQ ID NO: 43 - RNA, 85 nt, Homo sapiens
uuugauagcaaaagcuuguaaaugugugugugguaagggguaaaguggaguucuacacacaaauucacaagcuuuugcugucaaa

SEQ ID NO: 44 - RNA, 69 nt, Homo sapiens
uuuuuuuugguaacagggaacaguaagucucaugcacaggaguccuaaugucccuguugcuaagaaaga

SEQ ID NO: 45 - RNA, 65 nt, Homo sapiens
gcacaucacuuccucucugagccucaguuuccucaugguaaggcagugggggggaggugaugugu

SEQ ID NO: 46 - RNA, 90 nt, Homo sapiens
ucucaggcugugaccuucucgaggaaagaagcacuuucuguugucugaaagaaaagaaagugcuuccuuucagaggguuacgguuugaga

SEQ ID NO: 47 - RNA, 82 nt, Homo sapiens
ugcuuuacaugaauggucccauugaaucccaacagcuuugcgaaguguuguugggauucagcaggaccauucguguaaagua

SEQ ID NO: 48 - RNA, 83 nt, Homo sapiens
uucauagcuauuuuggggacacuauuuuuauucuuacccacccauggauggggccugagaaauaucuucaaaguagcuaugag

SEQ ID NO: 49 - RNA, 121 nt, Homo sapiens
caucuuuugaggccacauaguuggguccucugccuucugucuauuuacucucucuguuuuaaaucuuauagagaguaaacagauagaaugcaggagacccaauauguggccucaaaggaug

SEQ ID NO: 50 - RNA, 72 nt, Homo sapiens
aaagucauguuuuccaggaugggguccuugguggaaagcucugcuaggaagccuuuuggaaaaugugauuuu

SEQ ID NO: 51 - RNA, 69 nt, Homo sapiens
cauauucagcucuuggaugugaacucuuagccaagaaacuauucaaauauuauucaggggcugaaugug

SEQ ID NO: 52 - RNA, 58 nt, Homo sapiens
cagaaagguuguuuaugguuguuucaguuguuacugguuacuguaaauaaucuuuuug

SEQ ID NO: 53 - RNA, 73 nt, Homo sapiens
cagagcuuuuucuaggaaaugacagggcagguaauugucaucuuuccuucucauauucuuggaaaaaguuuug

SEQ ID NO: 54 - RNA, 87 nt, Homo sapiens
guguagauaaaucaaugcuguuuuagauuuuauuugugaccucaaagagcacauaaaaucuaaaacauugcauugauuugucuauau

SEQ ID NO: 55 - RNA, 112 nt, Homo sapiens
uuuuggaggugcauuaacauuuucaggccccuaagguacaguuuaguaaauuacuauuccagugaacuaaaugauacccuaggggccuggaagaguuaaugcaccuucaaaa

SEQ ID NO: 56 - RNA, 77 nt, Homo sapiens
auuuuguaggauuggaggagucugauuuguuuauuccccucuccucaacaaaucagaccccuccaaucuuacaaaau

SEQ ID NO: 57 - RNA, 71 nt, Homo sapiens
uguggcuuagguaguuucauguuguugggauugaguuuugaacucggcaacaagaaacugccugaguuaca

SEQ ID NO: 58 - RNA, 88 nt, Homo sapiens
agucuuugacccuauggaauucaaacauaauuuugaacaagauuacaaagaauucaaauuacauuugaacucuguagggucaaagacu

SEQ ID NO: 59 - RNA, 63 nt, Homo sapiens
agaaugauuauuucucagaguagacucccuaguuuggcuucuggcuugagagguaauuauuuu

SEQ ID NO: 60 - RNA, 58 nt, Homo sapiens
gcagccccuucucccucucagggccucuuuguguggggccagagggggagggggcugc

SEQ ID NO: 61 - RNA, 111 nt, Homo sapiens
aguucaagguugguauaucuguauaaauagcuacuguauuuggaggaggcucauaauccgaaaguccuucaucuauaguagcuauucauauuaauauacuagcuuugaacu

SEQ ID NO: 62 - RNA, 98 nt, Homo sapiens
gaguucucacucuguucugcuuccuaaaucaccucccuccaggagauucugcacuguaggagggaggugguuuaggcagaagaacagagugaggacuc

SEQ ID NO: 63 - RNA, 81 nt, Homo sapiens
gagugugugucugugugugcaccugugucugucuguauucguguuguauagacagacgcagguacacacagauacauacuc

SEQ ID NO: 64 - RNA, 94 nt, Homo sapiens
uagaacuguuacagucuaguaaguaaauaacauguuuuucaaaauuagaacguguaccaaauauguauuuacccaauaggcuguaacaguucug

SEQ ID NO: 65 - RNA, 70 nt, Homo sapiens
uaagccagauucucaacuuacguaauucuaugggaauucacagaguuauauugguugagaauuuggcuua

SEQ ID NO: 66 - RNA, 89 nt, Homo sapiens
gcauuagagauagaaaagcuugaagagacuuaauuaugucacauggagcacauaauuaaaucucuucaagcuuuuuuuaucucuaaugu

SEQ ID NO: 67 - RNA, 80 nt, Homo sapiens
uugugacaccuuucuuuuacaguuucaggucuuugaaaaacuagagguagaagaaacuguacaagagaaaggugucauga

SEQ ID NO: 68 - RNA, 73 nt, Homo sapiens
ggcuggagucagggagaccacuaauaauucugucugacagaucucagcuggauuuuucucucugacuuuaguu

SEQ ID NO: 69 - RNA, 60 nt, Homo sapiens
gggguagaaaugaaagagcuauagaaauguagcacacucauaaucuuucauuucugcccu

SEQ ID NO: 70 - RNA, 113 nt, Homo sapiens
uaauuuacauauggugaaauuugcuguuuuaauguaugguucugcaaaauauaucaaauuugucaaauuuuguagaaccaaacaaaacaauaaaugucaccauauguaaguua

SEQ ID NO: 71 - RNA, 63 nt, Homo sapiens
uuuucgguuaucaugguaccgaugcuguauaucugaaagguacaguacugugauaacugaaga

SEQ ID NO: 72 - RNA, 92 nt, Homo sapiens
uuuaauacuaucucaaacuaaaggauauagaagguuuucccuuucucuugcccugaaaccuucuguauccuuuauuuugagauaguauuaga

SEQ ID NO: 73 - RNA, 84 nt, Homo sapiens
ucaaacccuacugucaucuaaaaggggaaucccuuuccuuguaggugaaaagggauucuccuuuuauauggcaguaggguuuga

SEQ ID NO: 74 - RNA, 84 nt, Homo sapiens
uagcugaaggcauuauuccacagcucagaauuuuuuuucaucuggaaaguaguaaucucaauugugaaauagugccuucagcug

SEQ ID NO: 75 - RNA, 136 nt, Homo sapiens
cguuuaaaaguaacuggcaguugagcaagcaagagacauagggaauagucuuaaaagaauagcggaaggaaaaagcauguugcuuuuaugauuauuuccaugaguccugcuuguucaaaucaguuauuuuuaaaug

SEQ ID NO: 76 - RNA, 75 nt, Homo sapiens
gcuucuugaagcuucucccgcgugucggcagccacccuccucuuccgugugaccugcagagaagcuucagggggc

SEQ ID NO: 77 - RNA, 75 nt, Homo sapiens; identical to SEQ ID NO: 76

SEQ ID NO: 78 - RNA, 68 nt, Homo sapiens
uaaauuagaccucauuaccuagccaguugggcugcccggcucuccugcacauaaugaggucugauuua

SEQ ID NO: 79 - RNA, 97 nt, Homo sapiens
ucuuauauucauugggacuuguaccuuugcuuuguaaauauguaaaaagcauauuuuuuccuugugguggagagugcuucuucuaguggguauagga

SEQ ID NO: 80 - RNA, 77 nt, Homo sapiens
gguugagggaagguagaggucaccggcacauaguucauuugcaaauauaugcugaugacaucuaucuucccucaacc

SEQ ID NO: 81 - RNA, 61 nt, Homo sapiens
uuauaaugauuucuuaugcucauuuuuauauaaaagaagaggaaaugaggaaucauuauga

SEQ ID NO: 82 - RNA, 68 nt, Homo sapiens
cccguaacuaggauguuggggaauuguaccuuauuugggggugcauuuggaaacguccuaguuauggg

SEQ ID NO: 83 - RNA, 59 nt, Homo sapiens
uuuuaauugcaauuauggucccuuaugaguccccugggagggcaugauugcaauuaaaa

SEQ ID NO: 84 - RNA, 59 nt, Homo sapiens
ucucuccccugccugccuccuucuccguuagcgcuaccgguuggcgggcgggggagggg

SEQ ID NO: 85 - RNA, 74 nt, Homo sapiens
ugaucuuauagauacgguccgagaacuccugugucugaugacgcagaguaaguugccuuguauuuguaggauua

SEQ ID NO: 86 - RNA, 63 nt, Homo sapiens
uugggcaucaaccaugacuaauuguauguuuugaagaguacuuagugcaugguuggugcucaa

SEQ ID NO: 87 - RNA, 61 nt, Homo sapiens
gacacucuuugcuguggguuuugauuuuuaacucauucucugcugugcagcagaggguguc

SEQ ID NO: 88 - RNA, 78 nt, Homo sapiens
uacaauuaguuuugcagguuugcauuucagcguauauauguauauguggcugugcaaauccaugcaaaacugauugug

SEQ ID NO: 89 - RNA, 104 nt, Homo sapiens
aagaaggaggguccucugaguagugguccccagcccguuuuucugcccuaacacuauugaaugggagguuggcgaucacuacuuagaugagggcuuuuuuuuuu

SEQ ID NO: 90 - RNA, 84 nt, Homo sapiens
aaauuucugccuggaaucccugauguagugucucugcucccuccuuucuggcacagagacaggaauaauuccagguaggaauuu

SEQ ID NO: 91 - RNA, 134 nt, Homo sapiens
aaaauagaaccuuaucaauaucuuugaaauucuguuuaugccccucccugguggcauccugaaggaaggggaaggggaugaaaccagggaagggcauaaccagaacuuuaaagauauagguaagguucuauuuu

SEQ ID NO: 92 - RNA, 126 nt, Homo sapiens
ucauuuugauuaaauaagacucuggaggauuaagacuggagagcaaucaguuguucugaaagauagcucuggagaauuuauuguacuguggucuuagucauucagaguuguguuuaaucaaaguga

SEQ ID NO: 93 - RNA, 76 nt, Homo sapiens
ggugauuuccaaaucuauauguccgguccaaauaugcaaaaugcucuggucugggcauacagauuugggaaucacc

SEQ ID NO: 94 - RNA, 102 nt, Homo sapiens
uugcuuuaacaaauauauuguuucuucaguuuugauucuugaggauacgauucaauucacuggugaaucaaaacugagagaauaacauauuuguuaagguaa

SEQ ID NO: 95 - RNA, 80 nt, Homo sapiens
aaugucaggugcucaaaaggugcuuauugaacugaauuacugaggacaagagaaggagcuccuauugaguaccugauauu

SEQ ID NO: 96 - RNA, 72 nt, Homo sapiens
agcugcccgggcugggaggcggaggcugagaccugaaaggugcugaccggccuccccccagccugggcagcu

SEQ ID NO: 97 - RNA, 78 nt, Homo sapiens
gggaauuaaugacuagagaggguuaaugggcuaaaacucuguugggucaucaacuuuuccagcuagucauuaauucuc

SEQ ID NO: 98 - RNA, 93 nt, Homo sapiens
gggugugguuaucaugaaauaauuacacuccugagagauuacaggcacaaggcuguaccccaggagugugauuaucccaugauaaccacaucc

SEQ ID NO: 99 - RNA, 110 nt, Homo sapiens
aggaacuaagucuucuaagccuccuacccuuucucuugccuuucucagaaggcagagguauucagaaaagggcaagagagagggcaagaggcccaggagacuuaguuccu

SEQ ID NO: 100 - RNA, 122 nt, Homo sapiens
guguuagagguuaauaacacuguuauuuccucuauuaccuggauuuaauaaaagcaguggggcauaacauucuguaaagccaggcaauaagaggaaauaacacaaauguuaaccucuaacau

SEQ ID NO: 101 - RNA, 77 nt, Homo sapiens
uguaaugagauuggaaacgcagaugaggugacuaaaauugauuaccuacuauaucugaaaauuucaauuuuauugca

SEQ ID NO: 102 - RNA, 89 nt, Homo sapiens
uauuaaaaauuauguacuuagcugaagguccugguugucuaagcuuaugggacaaccaggacugucagcuaauuauauaauuuuugaua

SEQ ID NO: 103 - RNA, 77 nt, Homo sapiens
cagugaugcuaaugugccuaaugacugcuagugucugugguugugcuuagcaaucauuagacauauuaguaucacug

SEQ ID NO: 104 - RNA, 98 nt, Homo sapiens
uaaacuuauuuauuuacagguucauucaacuaacaaauauuuauuauaggagauauaaauauguguugguugaacgaaccuauaaauaaaugaguuua

SEQ ID NO: 105 - RNA, 66 nt, Homo sapiens
cuccugacugauugcacuacauacugaugcucacuaauaucaauauguaauguaaucagucaggag

SEQ ID NO: 106 - RNA, 123 nt, Homo sapiens
uuagguaagggaaauacaugcucagguuugcauuccagauguguauuuuuagugccuguuuggugcuggcacugaaaagacacaucugaaaugcaaaccugaacauauguuucccuuacuuaa

SEQ ID NO: 107 - RNA, 81 nt, Homo sapiens
cuccuguggucauucuccuuuaggcuucuuuguuggcuuuguagaccuacaaagaagccuacagaagaaugaccauaggag

SEQ ID NO: 108 - RNA, 81 nt, Homo sapiens
guuuuauuuucucucccaaauccccaaaugaggugcagcaucucauuuucaugaggaacuggggaggagagaggauaaagc

SEQ ID NO: 109 - RNA, 71 nt, Homo sapiens
guggccuauggcuuuucauuccuaugugauugcugucccaaacucauguagggcuaaaagccaugggcuac

SEQ ID NO: 110 - RNA, 74 nt, Homo sapiens
gguuuccgagucccugccauggcugcugcugcugccuccgcggcugcucuugcagccccagggacucgggagcc

SEQ ID NO: 111 - RNA, 57 nt, Homo sapiens
gccuuuccaacgaagacuuccuccaggccauccgagcaaaaucuucguuggaagggc

SEQ ID NO: 112 - RNA, 64 nt, Homo sapiens
uugaaaugucauuucuggaagucauucucugccuaaugcugcacuuugggaagugacauuuuaa

SEQ ID NO: 113 - RNA, 59 nt, Homo sapiens
ggcgugagcgagcagggaagagcuccuggcagcugccugccugcuugcucgcucgcgcc

SEQ ID NO: 114 - RNA, 176 nt, Homo sapiens
gguuuaguccgguugugacuggccacagccaguuuacacugguuuagacaagcugcaaccagauuugaaugguuuugacuagccaugacugacuuaggcuuugacugguuugaaccauucuugguuggaugcaacuuguuuagaccaguuuuggcuggccacaacuggauuagacu

SEQ ID NO: 115 - RNA, 71 nt, Homo sapiens
acuuuccaaagaauucuccuuuugggcuuucugguuuuauuuuaagcccaaaggugaauuuuuugggaagu

SEQ ID NO: 116 - RNA, 136 nt, Homo sapiens
cucucaaugauacuuguggcagacaauguugauacugugcccauaaauaugagcacaguaucgacauuuuucaaggcagugcaaugauaaauaugggcacagugccaacauuguccacccugaguaucauugagag

SEQ ID NO: 117 - RNA, 88 nt, Homo sapiens
auaaaauguuuauggguuuaagagguuuaugaaucagcuauaaauauuugcucuggguuuaugagaccucuccccauaaacauuuugu

SEQ ID NO: 118 - RNA, 77 nt, Homo sapiens
guuucuuuugggugaaaacagucucugaugcagcucuauugcaccauuucagcggguguuuaucauuuaaaaggaac

SEQ ID NO: 119 - RNA, 69 nt, Homo sapiens
guggugcauguuugagcaaacaaaaaugaugauuuaagcacacuacuuauugcaucaaauauguaccac

SEQ ID NO: 120 - RNA, 110 nt, Homo sapiens
aaaauacuuuuugguaucucuccucuucccaggaugcugagugaaaccagaugagagggaguuuagucggccuggggcaguugagucguagcaaaaucaggaaguguuuu

SEQ ID NO: 121 - RNA, 91 nt, Homo sapiens
acaauaaagcuacuuauauuuuguuucuucuuuaagagcaaauuuauucuuauuucuuaaagaagaaauaagauacaaguagcuuuauugu

SEQ ID NO: 122 - RNA, 93 nt, Homo sapiens
ucuacuuucuccucuaaguauuaacucuaugagguaccagaaugaauaaaaacccuugaucucauggaguuaauacugggaggagaaaguaga

SEQ ID NO: 123 - RNA, 99 nt, Homo sapiens
gaguuugaggaaggaacagcaggucuuucuucagagcuuggacucaaagaacuucaguuuaagcccugaagaaagagcugcugcuccuuccucaaacuc

SEQ ID NO: 124 - RNA, 67 nt, Homo sapiens
gcaccaggaagccugagaaugaauccugagggcucuagcccaggcuuugucccaggcuuucuggugu

SEQ ID NO: 125 - RNA, 67 nt, Homo sapiens
ggagagagaguuauaaagaaaucauuucaacucacaucuuugaaaugaccuauauaauucuuucucc

SEQ ID NO: 126 - RNA, 74 nt, Homo sapiens
aguuuuaagaguaauaaauagcuguugaauuguaucaaagaccuuuucagcaguugggaguuauuuuuaaaauu

SEQ ID NO: 127 - RNA, 124 nt, Homo sapiens
ucaccuuuuggagguaaacggucucuuuccagggcaccaggggaucauuuagcacucuggaagaaguaauuugcucuaugguucucugguguccugaaaaguguaauccaccuccaaaagguga

SEQ ID NO: 128 - RNA, 60 nt, Homo sapiens
ggacuacaacucccaagguacauacaaagcaauuguggugcacacugggaguuguagucc

SEQ ID NO: 129 - RNA, 64 nt, Homo sapiens
gacaucugcauuuuuagcagaguuuuauccauucguuuuuaaaaacuugaaaaaugcagauguu

SEQ ID NO: 130 - RNA, 75 nt, Homo sapiens
uaguacuuuagagcccuaaaguauucagaaacugggauugaaauuugcuuaauacuuuaaggcucuaaaguacug

SEQ ID NO: 131 - RNA, 87 nt, Homo sapiens
uugcugcucagcaauccagucacaugugucuuggagacauggaaucuugccuccaagacacauaggagcugaauugcugagcagcag

SEQ ID NO: 132 - RNA, 64 nt, Homo sapiens
gauuuucugcucuaucagcucaggcucuaauuuugacugcaagaagcuuauggagcagaggauu

SEQ ID NO: 133 - RNA, 69 nt, Homo sapiens
uuuccauuuugaguccuuuuaaauguaaugcuaaccuuuacaauuaaaaagucagauucagaauggaaa

SEQ ID NO: 134 - RNA, 154 nt, Homo sapiens
ggaggagagggagagcagcgucagggaggcagaggggucuccuagcaacagcaugggcuccuccuucuugaaaagcuuucgggauggggggcuggugcuccgacgaggacggcuggaccucugaaaaagacccucccgucuuuucuucuccucc

SEQ ID NO: 135 - RNA, 72 nt, Homo sapiens
gugguuagccugguccaagggucuccacucccuuccuagcauccuagagauccuggaggcuagguuggccac

SEQ ID NO: 136 - RNA, 72 nt, Homo sapiens
gugguuagccugguccaagggucuccacucccguccuagcauccuagagauccuggaggcuagguuggccac

SEQ ID NO: 137 - RNA, 79 nt, Homo sapiens
uuaugugucuaucagccacucccaguuggaaaggacaggcuuugaguguauuauaauugggaguuugguggauacguaa

SEQ ID NO: 138 - RNA, 79 nt, Homo sapiens
acuuuggcagcugcuccagaugcuacccaaucuaggguuuuaagauuucaaauaagagcuuauuggcaguugucaaggu

SEQ ID NO: 139 - RNA, 101 nt, Homo sapiens
cuuggcugccaggacccuagaccaaccuguguuaggcucagccaagggccacucaaaccuugagccuaagcacagguuggucuuguguccuggcagccaag

SEQ ID NO: 140 - RNA, 69 nt, Homo sapiens
uucucagaguugacuccugcuccugccccuggauucggcuucaagguuagagaaaguuaacucugagaa

SEQ ID NO: 141 - RNA, 127 nt, Homo sapiens
gcagguuuuauuuccguagccucacagccuugaugggagagagaaaauguguguguguuuuccaucccugaauauacacauuuuaucucuccucuugaggcugugaggcuagggaaauaaaaccugc

SEQ ID NO: 142 - RNA, 83 nt, Homo sapiens
ccaggaaauauuuguggaauccaucauuuuauuacauuacaauauuaauccauacaauaauggguucaacaaauauuuccugg

SEQ ID NO: 143 - RNA, 58 nt, Homo sapiens
gucaggugccagagagucuagacacagugauuucagucaugggucuuugguaucugau

SEQ ID NO: 144 - RNA, 78 nt, Homo sapiens
gauucauuccacagaguuccccagcaucaaucagugcuuggcccaagauugaugcuuaggaaaucugugggaugaauu

SEQ ID NO: 145 - RNA, 84 nt, Homo sapiens
uacuacauuucccaggaggcuucgcggugagccuccgcacucggcugguucucuuuaccgcgaggaaagcugggaaauguagug

SEQ ID NO: 146 - RNA, 67 nt, Homo sapiens
gacuguacucuuauagccaucugaaauacguuuucuagguagagauagauuguguaaggguacaguu

SEQ ID NO: 147 - RNA, 67 nt, Homo sapiens
gguagguguggcccugguuuccaggacagguggccagacugcucugugacaaagggccacgccugcc

SEQ ID NO: 148 - RNA, 98 nt, Homo sapiens
acauuauaucucuuuuagggucaggucuucauuugacuuacugaccauuaugacucaguaagucaagugaagaccugacucuuaaagggauauaaugu

SEQ ID NO: 149 - RNA, 84 nt, Homo sapiens
uguauguguauauuuucuuguaucauacugccuauaaguacguaaucccacaggcaguauguuacaaguaaauaugcacauaua

SEQ ID NO: 150 - RNA, 98 nt, Homo sapiens
guguaauaaaguuucugaagaacaaauaaaaugauuaugugugagacaaaccucaaucacaaaacuauuuucuuugcuuuuuugaaacuuuauuauac

SEQ ID NO: 151 - RNA, 72 nt, Homo sapiens
aaagaaauuuuuuguuguuacaaaacaccuuuuuuaacaaaaagguauuuugagccuacaaaaaguuucuuu

SEQ ID NO: 152 - RNA, 105 nt, Homo sapiens
uugcuuuaacaaauauauuauuccuucaguuuuuauuuuucagaauaugauucaauuucuuggugaaucaaaacugagaggagaauaacuuauuuguuaagguaa

SEQ ID NO: 153 - RNA, 85 nt, Homo sapiens
uaauucaaaugcccauaccauagauaccuguucuugaugaacauaccuugaggagcaaguaucugugauuuggguauuugaauua

SEQ ID NO: 154 - RNA, 65 nt, Homo sapiens
cgugguuuguuuuccugcuuugaaaaugaaaccguucauagcucagagauggaaagcagaccacg

SEQ ID NO: 155 - RNA, 55 nt, Homo sapiens
agugacaaagauucuccuuguugcaugauggacacaaggaugaaucuuuguuacu

SEQ ID NO: 156 - RNA, 58 nt, Homo sapiens
acuaccuuauacaaaauguagguuucauacaaacacaugcauucuuguguaagguagu

SEQ ID NO: 157 - RNA, 108 nt, Homo sapiens
guaacgcuuuucccugcucugcuugucugcaggcagugaagugaaaucugcaagaguccugcucgcucaaggccugcauacaggaaagaagcaggggaaaagcguuac

SEQ ID NO: 158 - RNA, 108 nt, Homo sapiens
guaaugcuuuucccugcacugcuugucugcaggaggugaagugaaaucugcaagaguccugcucgcucaaggccugcauacaggaaagaagcaggggaaaagcguuac

SEQ ID NO: 159 - RNA, 58 nt, Homo sapiens
gggcaggucuaggucugguuugggcaguugguuguaaucugagugccuggacuugccc

SEQ ID NO: 160 - RNA, 111 nt, Homo sapiens
gcaagauggauuuucaacuucaaggaaauuggcaagaagagcagagggaacccuuacauuuuucuuucucauucugggucucuuuccagucagcugaaaaaucuauuuugc

SEQ ID NO: 161 - RNA, 65 nt, Homo sapiens
gggaguuguaguuucggaugcguuccccgucaacgcggcggcggcggucguggacuacaacuccc

SEQ ID NO: 162 - RNA, 80 nt, Homo sapiens
cuuccuuccugcuuaguuuuagcucccuauucucauccuggccacugagggagggggcuaauucuuggguaggagggaag

SEQ ID NO: 163 - RNA, 133 nt, Homo sapiens
aaagggaagagagagaugaaacucacaucuuuaauauugguccuaguuuguuauuguaggaggcugcaaucacuuguuacaaugaaacuuuuggcuggauuaucagugaauuuuauuuaucucuuuucccuuu

SEQ ID NO: 164 - RNA, 59 nt, Homo sapiens
uagggaaagggaauaggcacugaaacacauaaaucaguguuuugaauucuuuuucucug

SEQ ID NO: 165 - RNA, 78 nt, Homo sapiens
uugagauuuuauugguugagaaucaguacagacauuucaauuuguacacaauucuuaacauauguaaugaaauuuuaa

SEQ ID NO: 166 - RNA, 102 nt, Homo sapiens
cuuagugggucaccaugaggaaauuauucccaggcagagagcccuuacucucugcccugagcucucugccuggggauaauuucuucaaggugacccacuaag

SEQ ID NO: 167 - RNA, 83 nt, Homo sapiens
accugagagauuccaugugaacucacuuuucacaaacaagcgcugagauugugaaaaguggguucauagggaaucucuuaggu

SEQ ID NO: 168 - RNA, 128 nt, Homo sapiens
uugggggcuucccaauuucuggaaaccuggaguuaaaaggaagaggcaucccagauagaaaugauuuccucgagcuggagugccuuuuccuucuauuuccagguuuccagaagcuggggagccucuga

SEQ ID NO: 169 - RNA, 94 nt, Homo sapiens
gaagguaguaauaaaaaagaugagcuaaugguaauaugaaauguauaaaugaagcucauauuacaaugagcucaucuuucuuauuacuaucuuu

SEQ ID NO: 170 - RNA, 93 nt, Homo sapiens
augcuguggcaaguacuauaauagacaugaucaaauaagacauaaucaaggaacuauuauugaucacgucaauuauagcacuugccacaguau

SEQ ID NO: 171 - RNA, 69 nt, Homo sapiens
cuggguaccaggcgaauccuacuggguaggucggguacgcggcauaugugggguauguuugguauccag

SEQ ID NO: 172 - RNA, 100 nt, Homo sapiens
ggcaaauauuaggaaaguaacuucucuguuucggccaugugugaggggcugugaguacacacauggccaaaacagagaagauacucuccuaauguuugcu

SEQ ID NO: 173 - RNA, 65 nt, Homo sapiens
ucaagggggaaaaaaucuccagcuuuccauguguaaguggauggaagagacuuuuuccuuuuugg

SEQ ID NO: 174 - RNA, 60 nt, Homo sapiens
ggaggagggcgcaaaguccuuuuguacgcagaaauaaggagcgacauuguguuuucuucc

SEQ ID NO: 175 - RNA, 69 nt, Homo sapiens
uaaaaugcagguaaaauacuuagcacaguacgcaguggauguacuguuaagcauauuaccugcauuuua

SEQ ID NO: 176 - RNA, 67 nt, Homo sapiens
gacuguacucuuacagccaucugaaauacguuuucuagguagagauagauuguguaaggguacaguu

SEQ ID NO: 177 - RNA, 67 nt, Homo sapiens; identical to SEQ ID NO: 176

SEQ ID NO: 178 - RNA, 67 nt, Homo sapiens; identical to SEQ ID NO: 176

SEQ ID NO: 179 - RNA, 59 nt, Homo sapiens
ggauucauacagugauuucaugguguuauguguugugaaacauugcacuguaugaaucu

SEQ ID NO: 180 - RNA, 111 nt, Homo sapiens
ggagggggaggcgaaaggagaucauacauggaagcagaucugagaaauccccuaccccagccucugggugcucuuaggccuucuucccuguugcuccucgcuuucccuucc

SEQ ID NO: 181 - RNA, 111 nt, Homo sapiens
ggagggggaggcgaaaggaggucauacauggaagcagaucugagaaauccccuaccccagccucugggugcucuuaggccuucuucccuguugcuccucgcuuucccuucc

SEQ ID NO: 182 - RNA, 72 nt, Homo sapiens
gauggaaacucuagaagauguggucuggugacauuggguaucuacagcuacuuuucaccuaggguuucuguu

SEQ ID NO: 183 - RNA, 57 nt, Homo sapiens
ugguuuccuuugauaaaaaguucuucaggaaaauaacagcuuagucagaggaggcca

SEQ ID NO: 184 - RNA, 115 nt, Homo sapiens
gacaaauguuuauuaaacacacaguugugauagacacugguucuaggugcuucauucauucauuugcaccuagaaccaugucugacgcauaaugggagcucaauaaauauuuguu

SEQ ID NO: 185 - RNA, 81 nt, Homo sapiens
gagguggaggcuccaaggaauguuaaaauaaucuguggcaaaacagagaaagcuaaauauucauuaaggggcuuucauuuc

SEQ ID NO: 186 - RNA, 75 nt, Homo sapiens
acacuuguuuagauaauaggaacaucugaaucugggccacuaaaaccaacucaguuccacggucuaaauaggugu

SEQ ID NO: 187 - RNA, 87 nt, Homo sapiens
cauaggcacagaucacugucaucugagucucugcagaccggaugacaaugaucugcaugaccuggaugacaacgaucugugccugug

SEQ ID NO: 188 - RNA, 116 nt, Homo sapiens
aauuaauuguacuuacaaaugccuccuugagggcauaauuagucaccagcaacucauucuaaaggcgccagaggcuaauuguacccccaagugagaaguuucagguguaauuaauu

SEQ ID NO: 189 - RNA, 69 nt, Homo sapiens
agucucagggccugagcugggagguggcagagagguccccuuuccccccagaaggcagguccuggggcu

SEQ ID NO: 190 - RNA, 67 nt, Homo sapiens
ggaagcuuugguuaagugaaaaagccuguugggguuuucccccuguaguuuucuaauuagggcuucc

SEQ ID NO: 191 - RNA, 66 nt, Homo sapiens
aauuauaaaguaaaaugagacugauuucccacgucaugaggaaaaaugucucuuuacuuugugauu

SEQ ID NO: 192 - RNA, 68 nt, Homo sapiens
aacagcaaugccuuaucuaugguucucugugcaucuggguguggaggcaugaaaaagguauugcuguu

SEQ ID NO: 193 - RNA, 66 nt, Homo sapiens
gccaaguguuuuucaugacccucaacagaaauuccaugaugaacugguaacagaagagcacuuggc

SEQ ID NO: 194 - RNA, 79 nt, Homo sapiens
auuuuucuucauagcauuugccaaccaguggcagcuuggcaaccugacccacugguugguaaauacuaugaagaaaaau

SEQ ID NO: 195 - RNA, 86 nt, Homo sapiens
uucuguuucgaugacacccacagggugaacaggaaagaaaauaauuuaucuuuccugcucacccuguggguaucaucggaacagaa

SEQ ID NO: 196 - RNA, 80 nt, Homo sapiens
aaaaaugcagauuccugggucccacccccaaaagaugcuaauuuuguagaucugaguaggaccuaagggucugcauuuuu

SEQ ID NO: 197 - RNA, 87 nt, Homo sapiens
ucucaggcagugacccucuagauggaagcacugucuguuguauaaaagaaaagaucgugcaucccuuuagaguguuacuguuugaga

SEQ ID NO: 198 - RNA, 121 nt, Homo sapiens
cauuaaggcacucccggguacauuuuauugguccauuaauauagggcccgagugguugaauacaccuaaggcauguacuguauuaaugaaccaauaaaacaugcccuggagugucuuaaug

SEQ ID NO: 199 - RNA, 70 nt, Homo sapiens
uuuuuccuuagcuucucugcgaggucacuuuucaaaaauuuuagucuaucucagaaaagcuaaggagaaa

SEQ ID NO: 200 - RNA, 108 nt, Homo sapiens
guaacgcuuuuccccugcuucuuuccuguaugcaggccuugagcgagcaggacucuugcagauuucacuucacugccugcagacaagcagagcagggaaaagcguuac

SEQ ID NO: 201 - RNA, 75 nt, Homo sapiens
ucaggggaaaaggucucaaaggauucacaccaacuauuaaauauagugugaaucuucugaaaccuuuuccuuugg

SEQ ID NO: 202 - RNA, 101 nt, Homo sapiens
ugccauuuugaaaacagaaaaaugcggccuaugaauagagcuaucauuuuaaggcagaauacuccauucgugggcugcauuuuccuuuuuucaaaauggua

SEQ ID NO: 203 - RNA, 58 nt, Homo sapiens
ugucugucuguccacacucaccagcccccugggcccuggggggauggauagacagaca

SEQ ID NO: 204 - RNA, 77 nt, Homo sapiens
ucagcccuuuccugcagcucuugucuguucauuuuauauaguugcccaguuugacaagaaauccaggaaagggcuga

SEQ ID NO: 205 - RNA, 91 nt, Homo sapiens
uaauaaauuaaaugccuaaacuggcagagugcaaacaauuuugacucagaucuaaauguuugcacuggcuguuuaaacauuuaauuuguua

SEQ ID NO: 206 - RNA, 68 nt, Homo sapiens
cggugacugacaagccuuucgcugaguaguuacaaaugggacuaaugguuuaaacuuguuagucauug

SEQ ID NO: 207 - RNA, 124 nt, Homo sapiens
gcucccucgccccacccugcccgggacccaguucaaguaauucaggauagguugugugcuguccagccuguucuccauuacuuggcucggggaccggugcccugcagccuuggggugagggggc

SEQ ID NO: 208 - RNA, 65 nt, Homo sapiens
auucuaguuuccucccgcgugggugcagcugagacuugcuguggacucacagaggaagcuggagu

SEQ ID NO: 209 - RNA, 93 nt, Homo sapiens
gagcauuaagauuuccuauucuuugaggcaaauauugaccuugacuucaccucggucaauauuuaccucucaggucaauagaucuugauguuc

SEQ ID NO: 210 - RNA, 87 nt, Homo sapiens
gagaaacacuuugccuuuuuacaggaguuuauuauguuuuggacauagaaacauaacaaacaccuguaaaacagcaaaguguuucuc

SEQ ID NO: 211 - RNA, 65 nt, Homo sapiens
aaaaauguagauuucugugcuccuuucaaagaguggcucacuaggacguacgaaucugcauuuuu

SEQ ID NO: 212 - RNA, 58 nt, Homo sapiens
gggguucagaucuccuacuugaaccugcugucagacucgccucugagaucugagcccc

SEQ ID NO: 213 - RNA, 101 nt, Homo sapiens
uuuaaggauauaucguauucaggauuuuuuaguucugaguuggcucucuuaaaguagauuacaaucacacuagaaaauccuggauaagauauauccuugga

SEQ ID NO: 214 - RNA, 76 nt, Homo sapiens
caucaggcugugaugcucaguuguguguagauugaaagcccuaauuuuacacacaacugaggaucauagccugaug

SEQ ID NO: 215 - RNA, 125 nt, Homo sapiens
caaaaucugcaauugaucaagcuccccaggugaucccuaaugugcacaggaaucauauucuucagauucagaauuccuaugcacauuagcaaucgccugggcagcuugauaaguugcagauuuug

SEQ ID NO: 216 - RNA, 93 nt, Homo sapiens
gucaagauuuauuggucuuucagguaaacaaugauugagaaccuaaagucaauauuuagucaaaauuuaucuugaaaggcaauaaaucuugau

SEQ ID NO: 217 - RNA, 92 nt, Homo sapiens
uaucaugagauaaugacaccccaaguguguugugaggcauaagguucagcugagugcuucuaaaccucuaggggugugauuaucucaugaua

SEQ ID NO: 218 - RNA, 132 nt, Homo sapiens
guagggguaauaugguuaccuccacacacaucugcguuuucaggagaugugguuauacuacccuguucuuucucuauguagccacaucuucugaaaauucaaguguguguggaguaagcauauuaccucuau

SEQ ID NO: 219 - RNA, 63 nt, Homo sapiens
ucuuggcuggcacagaaauuuauucauuugaagcagaauaauaaacuaaugugucagccaaga

SEQ ID NO: 220 - RNA, 77 nt, Homo sapiens
ucagcccuuuccuggauuucuugucaaacugggcaacuauauaaaaugaacagacaagagcugcaggaaagggcuga

SEQ ID NO: 221 - RNA, 75 nt, Homo sapiens
gccuucuuugcugggcaccaccuugugugcugggauggagaguagaaccagcacggguggucuggcagggagggc

SEQ ID NO: 222 - RNA, 65 nt, Homo sapiens
aaauuuaaggaggugcuuacucucaagucauaaaaguacuugcauaugaaugccuccuuaaauuu

SEQ ID NO: 223 - RNA, 65 nt, Homo sapiens
acuguacucuuauagccaucugaaauacguuuucuagguagagauagauuguguaaggguacagu

SEQ ID NO: 224 - RNA, 90 nt, Homo sapiens
ccgguccccccauuggcauccuugccuggagaacuugagauggcugccaucgccugaagccaggguggggaguggagguggggggauugg

SEQ ID NO: 225 - RNA, 84 nt, Homo sapiens
ugugaucucuuugcuguucucuuccuacaauggugccucccagccaaugcccacuuguaggaagagaacugcaaagagaucaca

SEQ ID NO: 226 - RNA, 83 nt, Homo sapiens
uacucucuaucugaucucuuuugugcuguuaggauuuuacucacuuagguaaaugaaaucagcugggaguuggguagagagug

SEQ ID NO: 227 - RNA, 100 nt, Homo sapiens
cuuaauaaauaaauuacacagccaauguauuauacauaauuuguguccucguggauuugagugauauauaaugcaugguccaagucauuuauuuauuaag

SEQ ID NO: 228 - RNA, 67 nt, Homo sapiens
acagcugcaaguguugccuccuacauguuguuaauuuagagguaaucagguuugcauuugcagcugu

SEQ ID NO: 229 - RNA, 55 nt, Homo sapiens
ggugagcaggcuucuacuguuacaaaucagaaaaacaacaggaggccugcucauc

SEQ ID NO: 230 - RNA, 88 nt, Homo sapiens
gcccuucgcgaaucuuuuugcggucugggcuugcuguacauaacucaauagccggaagcccuuaccccaaaaagcauuugcggagggc

SEQ ID NO: 231 - RNA, 131 nt, Homo sapiens
guauggucccagcugaauaguaagagggugauuuauucccaagguucuguuuccauuuuugcuguuuaugauagcauaucaagcuagcuuuuugauugaauuaccaccuuguauucaggcugggaccaugc

SEQ ID NO: 232 - RNA, 55 nt, Homo sapiens
cagccuacucauuuauuuuuggaagaacacuuuagugaauacaaugagugggcug

SEQ ID NO: 233 - RNA, 65 nt, Homo sapiens
gucuugauagucauggaacauuaugcuuuaaucaaucauugauggaguccauuggcugucaggac

SEQ ID NO: 234 - RNA, 77 nt, Homo sapiens
guuuaucagguaacagcuaugucucucuuuuuauugagagacuuuuacugagagacagaacuguuuaccugauaaac

SEQ ID NO: 235 - RNA, 85 nt, Homo sapiens
ucucaagcugugacugcaaagggaagcccuuucuguugucugaaagaagagaaagcgcuucccuuugcuggauuacgguuugaga

SEQ ID NO: 236 - RNA, 60 nt, Homo sapiens
ucccuuuaugcaccaaguucccuuugaagucaauuaaaggccuauguguguaugaaggga

SEQ ID NO: 237 - RNA, 102 nt, Homo sapiens
uucuguccuugcgguaggugguuauuuuguugagguucaugaguuucuuuauuucuugugggucuguucuaaacaagaaacugcacacacgcaaggacagag

SEQ ID NO: 238 - RNA, 66 nt, Homo sapiens
cugcaggcagaagggauggugagggggcgcaacccucugcccugucagccccacuucugccugcag

SEQ ID NO: 239 - RNA, 71 nt, Homo sapiens
aauggggucuacauugcauucuggaaaaucguauccaaaccacauccacugagcaaucuguagaccucauu

SEQ ID NO: 240 - RNA, 65 nt, Homo sapiens
gugggaggggcagggauagaagcaaagcagagaaaaauugcucuaauuccuucugcuccuucuau

SEQ ID NO: 241 - RNA, 56 nt, Homo sapiens
gagggagggggaacgguguucgcggcaucuggagucaucgaucuuccuuuuccuuc

SEQ ID NO: 242 - RNA, 108 nt, Homo sapiens
guacagggcaaauagcagugcggggugaaaauaaagacugacuaccacuggcaacccuuggucacucuucauuuauucauccaacauugcugaauauuugcccugugc

SEQ ID NO: 243 - RNA, 131 nt, Homo sapiens
aguagagugaggugcaacauaauuuuaucucuggcagaaaaauguugagguuucaagcuaugagaagauuuugaaacaugacucuuuuuucuggcaacacuuaagaguugaugcuuaaaccucacuuuauu

SEQ ID NO: 244 - RNA, 70 nt, Homo sapiens
aguugaugacaauauuguagauaaaauagacacucaagcuguugaaaaauuuuacagguugucaucaauu

SEQ ID NO: 245 - RNA, 78 nt, Homo sapiens
uccccacccccucaccucucuggggcccuaucuucccuuauauggugaaggcaguuccuagaggagggggggugggga

SEQ ID NO: 246 - RNA, 91 nt, Homo sapiens
uuccuggggauuaaugaauagcuggguggaguuaauugccuaaaguauagucucaggccauuaaccucaguuggucacuaaucccuaggaa

SEQ ID NO: 247 - RNA, 81 nt, Homo sapiens
uaguuacauaguaacuaauaguauguauuaguaguacacaguacuaauacugcugauacuacugcuaguacuauguaacug

SEQ ID NO: 248 - RNA, 84 nt, Homo sapiens
gaggacuccaaggaacauucaacgcugucggugaguuugggauuugaaaaaaccacugaccguugacuguaccuugggguccuu

SEQ ID NO: 249 - RNA, 63 nt, Homo sapiens
auugcuauuugcaaauauauuucuugauuauaucugugaaguaauuuauaugcaaauagcagu

SEQ ID NO: 250 - RNA, 80 nt, Homo sapiens
ggggugggagaauaagguagugugguucccuagaagagacacauuugucuucaccacugaagccucaguuuucucauuuc

SEQ ID NO: 251 - RNA, 60 nt, Homo sapiens
cuggaaaugguaaacauuuuaauggucagacccuguccacuuaugcauuacuauuuccag

SEQ ID NO: 252 - RNA, 69 nt, Homo sapiens
gcgggagagccccagccccuccgggagcuggaaacggagcccagucugggggcgccggggcuuucccgu

SEQ ID NO: 253 - RNA, 65 nt, Homo sapiens
cuuuuggggggcuacacggcccuuucaauaauuugugagagcauuugugauaggcucuccagaag

SEQ ID NO: 254 - RNA, 85 nt, Homo sapiens
gguugacuucuggaauggucacuagggaaggggcgccagaggugcagccggugccucugacccuuuuggucgcuaggagucagcc

SEQ ID NO: 255 - RNA, 55 nt, Homo sapiens
aguggagagagccacagccaggagcuagaaugccuggguucagguuuuuuccacu

SEQ ID NO: 256 - RNA, 116 nt, Homo sapiens
gggugugaacuuuagggaggccugugagcccccaccuggaauuugcacacaaaaugucaugcauguguacauuuuucugggugggaaugcagaguguuucaaaggaguucacaucc

SEQ ID NO: 257 - RNA, 67 nt, Homo sapiens
uuuuagauaggccaguuuggaccaaagauugucucuuucuuacagaaccaacaaggccugucuaaaa

SEQ ID NO: 258 - RNA, 71 nt, Homo sapiens
uuuuaauuaagcaauaaguuagaugucaagagcaauuagagucuugaaggucaaagcuugcuuaauuaaag

SEQ ID NO: 259 - RNA, 79 nt, Homo sapiens
cacagcagcuuuaauaaacagcuccauuuagugccuccuccuuguaucuagggaggugagcuggucuggggcugcugug

SEQ ID NO: 260 - RNA, 111 nt, Homo sapiens
cuuugaaacaggacuaaugcacaucucauauggaaauauugacagcauucucuaucauucuuagcauggucaucauuuucauaugagauguguauuaauccuguuucaaag

SEQ ID NO: 261 - RNA, 103 nt, Homo sapiens
ccaaaaaggcauccuuuuucagugacuggauguuuacucaaauaaugguagguauugaauauuugaauaaacauccggucacugaaaaaagaugccuuuuugg

SEQ ID NO: 262 - RNA, 70 nt, Homo sapiens
aaugagaaauuuucagggcuacugaacacugaaaaugcauggugcucaauggcccuaaaaauuucucauu

SEQ ID NO: 263 - RNA, 66 nt, Homo sapiens
cagugcuuggcaccuagcaagcacucaguaaauauuuguugagugccugcuaugugccaggcauug

SEQ ID NO: 264 - RNA, 77 nt, Homo sapiens
uaucuuacuaauaccugcucuacagcugggagacacuauagaacacugcccagcuguaggcagcuguuaguaagaua

SEQ ID NO: 265 - RNA, 59 nt, Homo sapiens
uuuuaauugcaaucaugcccucccaggggacucauaagggaccauaauugcaauuaaaa

SEQ ID NO: 266 - RNA, 103 nt, Homo sapiens
gggaguugggaggcuucagcggggagguggugaugguacuggggccuuuugccuggccugccaguggccagcauggcucuccccgugggaccuuccagcuccu

SEQ ID NO: 267 - RNA, 69 nt, Homo sapiens
gccccgccccucgcgacgauguagcaaccguggaaugcucggacgucgcaacgcuccgaggggcggggc

SEQ ID NO: 268 - RNA, 89 nt, Homo sapiens
gucuggcacauagcagaugcucaauaaacauuugcuaaaugaaugaguagaaaggguaacguuuacugagcacuuacuaugugccaggc

SEQ ID NO: 269 - RNA, 68 nt, Homo sapiens
ggccgggucggugcggacacggcgguaaccguagggaccguggccgccccucccccaccggcccggcc

SEQ ID NO: 270 - RNA, 79 nt, Homo sapiens
cugucccuugguucaaaugacuugggccauccuggucaaguguucuucucugguccaaucauuuauggccaggggaugg

SEQ ID NO: 271 - RNA, 88 nt, Homo sapiens
gugagucugggcacauggaccuuuuucugguccaagagagaugguccacgugccugcaccagaaaaggguccacaugcccggacucac

SEQ ID NO: 272 - RNA, 86 nt, Homo sapiens
guccugggggcuccaaagugcuguucgugcagguagugugauuacccaaccuacugcugagcuagcacuucccgagcccccgggac

SEQ ID NO: 273 - RNA, 73 nt, Homo sapiens
uugaggggcuccccauuucuaucauucauuuggaagcucaucagcucucccagaaggcaugggagcccuucaa

SEQ ID NO: 274 - RNA, 65 nt, Homo sapiens
uuagggagaggagccggcuguccgggagaguuugaaaaaaugcccucagccucuuuucuucuuga

SEQ ID NO: 275 - RNA, 92 nt, Homo sapiens
cuguuugcacgggccagggcagggaggcuuucugggagugaggugagagcaaggcuguucccagaggcuccagucucuauuugugcagacag

SEQ ID NO: 276 - RNA, 60 nt, Homo sapiens
aguugccauagagccacuucccucugcuuuuacaaaggcuguugagucucuauggcaauu

SEQ ID NO: 277 - RNA, 84 nt, Homo sapiens
acagugcuugguuccuaguagguguccaguaaguguuugugacauaauuuguuuauugaggaccuccuaucaaucaagcacugu

SEQ ID NO: 278 - RNA, 83 nt, Homo sapiens
uuaaauuucagccccgggccaaucugucaaagaaacaggaaaugucucuugcuaugacauauuugccagcggcugagguuuga

SEQ ID NO: 279 - RNA, 68 nt, Homo sapiens
uuucucuuccuaacgccagucugcugagguucaaaacgugucaccccaggcuggauuggggagaggga

SEQ ID NO: 280 - RNA, 65 nt, Homo sapiens
aguaucccaggcccgggauuaggcacugaggacacacagaugaccaugaucuggucugggaugcu

SEQ ID NO: 281 - RNA, 70 nt, Homo sapiens
uuuguuuauuuuucuaaggagaccagcuucaacucugcugauaauguguuuucuuuugaaaaugagcaga

SEQ ID NO: 282 - RNA, 80 nt, Homo sapiens
gcucuuucucucgcugucuuagaaucacaugugugacaaugccugacaauaugcgauucuaagagacugagagaaagagc

SEQ ID NO: 283 - RNA, 85 nt, Homo sapiens
ucucaagcugugacugcaaagggaagcccuuucuguugucuaaaagaaaagaaagugcuucccuuuggugaauuacgguuugaga

SEQ ID NO: 284 - RNA, 86 nt, Homo sapiens
guaaguuauauaugucuacuucuaccuguguuaucauaauaaaggugucaugaugauacagguggagguagaaauauauaacuuau

SEQ ID NO: 285 - RNA, 95 nt, Homo sapiens
gcuggcacuucuuguuaaaagcagcauuaacaaaugugggcucaaauagaaagccauugccauuugucaauguugcuuugagaagaggugccagc

SEQ ID NO: 286 - RNA, 87 nt, Homo sapiens
ucucaagcugugggucugcaaagggaagcccuuucuguugucuaaaagaagagaaagcgcuucccuuugcuggauuacgguuugaga

SEQ ID NO: 287 - RNA, 75 nt, Homo sapiens
uuguuuagucagagagcacagcauaucggggcuacuagcccuugccccagugugcugggcugucugacuaaacaa

SEQ ID NO: 288 - RNA, 67 nt, Homo sapiens
gggggacaggccugagacaucugagauaauaaagacaugauugucucagcccuggggcuugucuccc

SEQ ID NO: 289 - RNA, 87 nt, Homo sapiens
ucucaagcugugagucuacaaagggaagcccuuucuguugucuaaaagaaaagaaagugcuucucuuugguggguuacgguuugaga

SEQ ID NO: 290 - RNA, 72 nt, Homo sapiens
ggucucagcaguggucagcccaggagguuuuuacaucugccucuucccuguauugaaaaugcugcuggggcc

SEQ ID NO: 291 - RNA, 56 nt, Homo sapiens
uuccauuuuuccugacagucauucuucuuaauugaagagugggaggaaagauggga

SEQ ID NO: 292 - RNA, 66 nt, Homo sapiens
uaugcacaugcaugcuugaauaucugagugcauacaugcuuggauaucuaugaauguaugugcaug

SEQ ID NO: 293 - RNA, 72 nt, Homo sapiens
cuaugagugugauguuuauuuuaucccauuaggaauuuuauuccuugaggacuaaaugaaucauacuuaugg

SEQ ID NO: 294 - RNA, 70 nt, Homo sapiens
uagucuauuccagguagacaggccugcaggggguccaaccccuacaagccccucugucuggaauagacug

SEQ ID NO: 295 - RNA, 87 nt, Homo sapiens
ucucaagcugugagucuacaaaggaaagcgcuuucuguugucugaaagaaaagaaaucgcuucccuuuggaguguuacgguuugaga

SEQ ID NO: 296 - RNA, 97 nt, Homo sapiens
ggugacucuugagugaugaauucaagguauucacaccuugaccaccucucuuuaaagaacauugugaguaucuugaauucaucucucaagagucacu

SEQ ID NO: 297 - RNA, 93 nt, Homo sapiens
ggguuuauguucaugggcuuucuagauggacuuucaaguccaaguagaaguccaacuugagagcucguguagaaagcccuugaauguaaaccc

SEQ ID NO: 298 - RNA, 68 nt, Homo sapiens
aaauaauaguaacuaccucacagggugaauguccauugcuacugucuuugggguuguuauuauuauuu

SEQ ID NO: 299 - RNA, 72 nt, Homo sapiens
gcugagggcugggucuuugcgggcgagaugagggugucggaucaacuggccuacaaagucccaguucucggc

SEQ ID NO: 300 - RNA, 75 nt, Homo sapiens
gccccaggcacaguggcccgguggccucacucagagugcagacuggagggcagggcgggguccugugcuuggggc

SEQ ID NO: 301 - RNA, 68 nt, Homo sapiens
aaacuuuaaagagucucuugucugcccugguguuagggcagcauggcagcuagagcucuuuaaaguuu

SEQ ID NO: 302 - RNA, 69 nt, Homo sapiens
auacauuauuacuuagaagcauguaaguuguggcuguacugcauacuccugcauuugguaaugaugugu

SEQ ID NO: 303 - RNA, 85 nt, Homo sapiens
cucaagcugugacucuccagagggaugcacuuucucuuaugugaaaaaaaagaaggcgcuucccuuuagagcguuacgguuuggg

SEQ ID NO: 304 - RNA, 68 nt, Homo sapiens
cuaggccaucuauuuuuuucucagagauagaaauugaagagaucuuugaguaaguauagaugguuuag

SEQ ID NO: 305 - RNA, 73 nt, Homo sapiens
augaacuaugugguuuugaaucggauguagaccauuaguacuacuacuugagcuaaacuucugcaugguucau

SEQ ID NO: 306 - RNA, 73 nt, Homo sapiens
augaacuaugugguuuugaaucggauguagaccuuuaauacuacuacuugagcuaaacuucugcaugguucgu

SEQ ID NO: 307 - RNA, 100 nt, Homo sapiens
cguggcagcagcuuacuauggcccaggcugauguagacuggcagcuucuccccaucacugguagcugguaugcaggcagccugccucggcuguugccaug

SEQ ID NO: 308 - RNA, 77 nt, Homo sapiens
auaaggcuuauucuaugggagcugacuuuauccaaccccacacuugggugauguagugggcucugaguaagcuuugu

SEQ ID NO: 309 - RNA, 87 nt, Homo sapiens
caucuuuauucugucacaccaugauaaagaguuuuguauuugucacaagugcaaugaacuuauugugguguuuuuagaaugagggug

SEQ ID NO: 310 - RNA, 74 nt, Homo sapiens
uauuaguuggccuuccuugaguggcacacauuuuagcaaauaaaacccauugcugcucauuaggcuaauuagua

SEQ ID NO: 311 - RNA, 82 nt, Homo sapiens
ucugguuuuauagugcuuacucaagucacacuccugccuauuuuaaagggagugugguguaaguaagaucuguaaaauuaga

SEQ ID NO: 312 - RNA, 73 nt, Homo sapiens
ccaggccuccaggugcugccaccacuucagagcaggggaccgacagucccugggagagugucuggaggccugg

SEQ ID NO: 313 - RNA, 68 nt, Homo sapiens
uaucuuuccuuugugugugauguuuaaguuggaguugagggaagugcuccauguguagaggaaagaua

SEQ ID NO: 314 - RNA, 77 nt, Homo sapiens
agcagcagauucaugguguccggcuaaauggaaaaucuguaauucagaccacgaaguaggcagcuggguuuguugcu

SEQ ID NO: 315 - RNA, 69 nt, Homo sapiens
gcucuaauuagaauucccuuauuccauuucuguuucucaggagaggacagggggcuuuuuaauuggggc

SEQ ID NO: 316 - RNA, 74 nt, Homo sapiens
uaaaaucauaguuuucagaauuggagccucagugaaaagcacugcuaguaagccuuuugggaacugugauuuua

SEQ ID NO: 317 - RNA, 69 nt, Homo sapiens
ucagcuggguucuuuuuauaguuucaaucaucccugguaaugaagauucugcaauuagaacucagcugg

SEQ ID NO: 318 - RNA, 56 nt, Homo sapiens
gagauuuagcugcuuaacuccuguuguuuuuaaugggagucauguggcuaaaucuc

SEQ ID NO: 319 - RNA, 62 nt, Homo sapiens
cugccagaggcuguugccagaggagcuaaugacuaagucacucuccuuuuggccucuggcag

SEQ ID NO: 320 - RNA, 86 nt, Homo sapiens
guagcaucccucacccugguccccuggccucuguaaagccaccagccugagggcaguggcaggagaugggggugggggggugcugc

SEQ ID NO: 321 - RNA, 68 nt, Homo sapiens
aaaagaaugcuuccuuugaaacugaaguucuuucuacuugguuucagcccaaaggugagcauuuuuuu

SEQ ID NO: 322 - RNA, 59 nt, Homo sapiens
gccccuuccccuccugaagggcccgggaaacccagcagccugcaggugggggagggggc

SEQ ID NO: 323 - RNA, 70 nt, Homo sapiens
cgggcagggagcccggaccgaaagcucagcuccaggauggcugcgcuugggccccggcguucccugcccg

SEQ ID NO: 324 - RNA, 95 nt, Homo sapiens
uaaauaaguaauuaugcacacucauugucugugccugacauguggcacuuggcaugucaggcacaguugaugaguguucauauguuacuuauuug

SEQ ID NO: 325 - RNA, 73 nt, Homo sapiens
accaugcugggccuugggugcacucaucaaaaaacggaccacaggcaugaugcucacaggugcccggcauggu

SEQ ID NO: 326 - RNA, 87 nt, Homo sapiens
aggacagucuggcuggcuuugucaggacuuuucagacguggugacaaacacugaaaucacggggcagugcucaguucagacuguccu

SEQ ID NO: 327 - RNA, 121 nt, Homo sapiens
gaacuaauuguucugugauugauugauaguuucccucuuguugcuacauacagcccaaugacaugcauuguacacacaacaggagguaagagagucaaucaauuagggaaacaauuaguuc

SEQ ID NO: 328 - RNA, 75 nt, Homo sapiens
gugagcugcauuuugcuaacagccugucucacuuuacaaucuuaggacuagggaguuagggaaagugcagcucau

SEQ ID NO: 329 - RNA, 65 nt, Homo sapiens
ccccguucccucucggugggagucaagggggaaaagcccuugaaucccgagacggggggaugggg

SEQ ID NO: 330 - RNA, 69 nt, Homo sapiens
augacccuuucuaaacaaaaggacucuuuaaggccuauccugagucuuuguguuuugaggagggguuau

SEQ ID NO: 331 - RNA, 68 nt, Homo sapiens
ggaagaugacaaugcuaaugaugaauucacggaggaaaugcauuagauaaagcagauugucaucuuuu

SEQ ID NO: 332 - RNA, 68 nt, Homo sapiens
ccagugguuucugacuaccgcuuagggcaauuuugcuuagccuagcggaauguccuggaaacuacugg

SEQ ID NO: 333 - RNA, 102 nt, Homo sapiens
ucaggggcucuggagagucaccaucuccccaccugcucccucagcuucuggaagggugcagggaggaggcggguggaggugguucuugcacagggucccugg

SEQ ID NO: 334 - RNA, 97 nt, Homo sapiens
ccauuuugaaaaaaggaaaaugcagcccacgaauggaguauucugccuuaaaaugauagcucuauucauaggccgcauuuuucuguuuucaaaaugg

SEQ ID NO: 335 - RNA, 78 nt, Homo sapiens
uuuuaaauggccacucuggcuucagucugggaauggauuugaaagggacagaaguagagucagggaggccauuuagga

SEQ ID NO: 336 - RNA, 89 nt, Homo sapiens
uucuaaaauucuauaauuuugucuucuacacuuaaaaacuugaacauuuguuuuucgguguuagaagaugaaauuacagaauuuuagaa

SEQ ID NO: 337 - RNA, 68 nt, Homo sapiens
caguuuaggagaagaacaagccuucuuuuauaucauuugugucuaagaaaauguucucuucuagauug

SEQ ID NO: 338 - RNA, 82 nt, Homo sapiens
gauuuggucaggaugggcagccaaacuagaaauuucaugccagaaauaugaguugguuuggcugacuuagccugauuaaauu

SEQ ID NO: 339 - RNA, 137 nt, Homo sapiens
auacauaauuuaaauguauccacuguguuucauguguuucuuacauaauuggaagggaucuauaauugcaagagaucuauaagagauaacaauguaagagacaugugaaacacaguggacaugucuaaauuauguau

SEQ ID NO: 340 - RNA, 122 nt, Homo sapiens
cguuuaacuuuaaugcuagguuucaaauuguuguauggacaggaaaguaacauuagaaaaauuacucuacuguugcuuucuuuucuauacagugguuugaacucaagcaauaaaguuaaaug

SEQ ID NO: 341 - RNA, 178 nt, Homo sapiens
uucuucccuuggacacucccuucuaggaacagggugagcuggagagaggcaacagagcaggagcagggagcacugaggguggcuccgccugaggguacagcacacguccagggcugucugcacacuauuucucccucucuucucacucccaauuuagaacaagugcccaggggaagaa

SEQ ID NO: 342 - RNA, 136 nt, Homo sapiens
gaaagcccuuauaauuccgagggaucccauggucagcauuuuuagccaguagcuuuucuauuuuuuucagucccaaauagaaaagcuaguugcuaaaaauacugaucaugggauccccagaaucauaagggcuuuc

SEQ ID NO: 343 - RNA, 56 nt, Homo sapiens
gucacugcgcugacugcuacgaucauugggcaggcgugcacaggcaguguaguggc

SEQ ID NO: 344 - RNA, 66 nt, Homo sapiens
cagcuuuccccaagguguggugugguucugccgcuaaggaggcacgcugcagccuggggaaggcug

SEQ ID NO: 345 - RNA, 87 nt, Homo sapiens
agaguuuauaguaagaagaauuggccuacucaggugucagcaaagccuuccucucugaauaggucaauuccccucacuauaaacucu

SEQ ID NO: 346 - RNA, 68 nt, Homo sapiens
gcccguggcuggaggaccucgugucguaccuagagucccuucaggacggccgacugccagccaugggc

SEQ ID NO: 347 - RNA, 91 nt, Homo sapiens
gaauaucuuucuauacguucucuuauagacuaugugagaaauaugugauauucucacauaggucuauaagaagacauacagaaagauauuc

SEQ ID NO: 348 - RNA, 75 nt, Homo sapiens
gggugauaaaucacagaagguugcauuaaucaaggcagccuaaagcugauaagugcaauuauggauuugucaccc

SEQ ID NO: 349 - RNA, 86 nt, Homo sapiens
aagcagggggagagcugauugggaauggaagcagaggcaaagaaaugaaagagaugcuuugauuucuaaugugccuucccuugcuu

SEQ ID NO: 350 - RNA, 59 nt, Homo sapiens
ggcuuuugugguauuaaacaccucaauuuuacucaggcauuuagcaaaccacaaaagcc

SEQ ID NO: 351 - RNA, 91 nt, Homo sapiens
agcuggcuucagaaggcagccuugacuagugacuuaguuacaaucucaucccugcucugaguggcuggugagguuagcccuggggucagcu

SEQ ID NO: 352 - RNA, 111 nt, Homo sapiens
ggagggggaggcaaaaggaggucauacauggaagcaguucugagaaauccccuaccccagacucugggcgcucuuaggccuucuucccuguugcuccuagcuucuccuucc

SEQ ID NO: 353 - RNA, 87 nt, Homo sapiens
guccuguuccuuaaaaucucugggaucaaaaucgcuuaaucuguaaaaugagggagcugcacauguccuggggacaagggacaggac

SEQ ID NO: 354 - RNA, 64 nt, Homo sapiens
guucaucggagaaacucccugcgaugagccacuagggucacggacagggaacuuuuugaugagc

SEQ ID NO: 355 - RNA, 148 nt, Homo sapiens
caugaaauauggaacuuugaaagugugagaaaaaucucaaaucacuuugacagcauuuuaauuauaguugauuuguuugccgcuaauagugaaaaugcugucagcaugauuugagauguuucuuccacucaaaauguuauauuucaug

SEQ ID NO: 356 - RNA, 67 nt, Homo sapiens
auuucaagugaaaauuaauggcaaauucuuguaaccacauuaagagccauugucguucauuugaaau

SEQ ID NO: 357 - RNA, 101 nt, Homo sapiens
auccaggaauugacaagucauacugaaacaaauuaaagccucuuuaaaauuugaauauagaggcuuuccuuuguguuauugugacuuuccaauucuuggau

SEQ ID NO: 358 - RNA, 68 nt, Homo sapiens
agucuauuccagacagaggggcuuguagggguuggacccccugcaggccugucuaccuggaauagacu

SEQ ID NO: 359 - RNA, 68 nt, Homo sapiens; identical to SEQ ID NO: 358

SEQ ID NO: 360 - RNA, 67 nt, Homo sapiens
ccaggacucuagacauucaggacagggcugcuuguaccacucugcugccucugaacugggguccugg

SEQ ID NO: 361 - RNA, 112 nt, Homo sapiens
gcucccugagugacaguguuuuccuucauaugggacuggugaauugcaaguguagggacauagucuuugguuucuuaguuuugcugucugauauguuagguacucagggagu

SEQ ID NO: 362 - RNA, 77 nt, Homo sapiens
gcauaguccaugagcaagauggauuuaggggccgcuccuugacggccaugacauuucagcuuguccauggacugugu

SEQ ID NO: 363 - RNA, 68 nt, Homo sapiens
ggguggggggugagcagccccucgguguccgccuaugccuggaccugagguuugacugccccccaccc

SEQ ID NO: 364 - RNA, 66 nt, Homo sapiens
ugugcacaugguagguauugaguaugugaauuauugaacauguacuuuagauaaauuaugugcaca

SEQ ID NO: 365 - RNA, 68 nt, Homo sapiens
ggguagggaggaagcuuguuuugcugagaugagggcaguugccuggcaaaaccuuguccuuccugccc

SEQ ID NO: 366 - RNA, 70 nt, Homo sapiens
aggaacauguaaauaucauuguacugggcuuugcauucuggcugaacagcacaguggcuuacguguuccu

SEQ ID NO: 367 - RNA, 68 nt, Homo sapiens
cuucccagccuuauuaguccugccugaagucuccgcugcuucauuggcugaugaggaagguuggggag

SEQ ID NO: 368 - RNA, 86 nt, Homo sapiens
uaugguuugggacucaggauguggucaaguguuguuaaggcauguucaggaacaauacuugaccacauuuugaauuccaaaccaua

SEQ ID NO: 369 - RNA, 87 nt, Homo sapiens
aaugcccagugacuaggacagaaccuaggaaguucccagugaauauguaggccuauguccuagguucuguucuaaucacugggcauu

SEQ ID NO: 370 - RNA, 109 nt, Homo sapiens
cuuaugaauauacuccaacuauagacuacuuuucuuucuacauucauguacuucauuauucaguuuguacagaaagaaagguagccuaugguuggaauauauucauaag

SEQ ID NO: 371 - RNA, 91 nt, Homo sapiens
guuaucuagcaucaugggcagaguucuacuuaacacuuguuuaaaaaaguucuaguuguuaaguagaacccugcccaucaugcuagauaac

SEQ ID NO: 372 - RNA, 99 nt, Homo sapiens
uuucuuuguucuccagauaagugaacugagauacagaguuauuaagcaaguucuuuaauagcuuuguaccucaguucccuuaucuguagaacaaaggaa

SEQ ID NO: 373 - RNA, 78 nt, Homo sapiens
gaaucauccagacugggaaccgcuauccuguggauaugcaggaaugcacggaauagcaguucccaaucugggugauuc

SEQ ID NO: 374 - RNA, 85 nt, Homo sapiens
cggcuguccucuccaacaauauccuggugcugagugaugacucaggcgacuccagcaucagugauuuuguugaagagggcagcug

SEQ ID NO: 375 - RNA, 77 nt, Homo sapiens
cauauagcagguccucaauaaguauuuguugaaagaauaaauaaaccaacaagucuuauuugagcaccuguuaugug

SEQ ID NO: 376 - RNA, 61 nt, Homo sapiens
cgggugugugcccggccccaggcuggccccagcccccagugcagggccuggcacgcgcccg

SEQ ID NO: 377 - RNA, 69 nt, Homo sapiens
gauuaaugcuugccuagguuacagugaagguacucauguuucacugugcucucuagauaggcauuaauc

SEQ ID NO: 378 - RNA, 67 nt, Homo sapiens
cggggccugggccaccacaggggaaggaugcugcucagagcccacagaccugggugcccgggccccg

SEQ ID NO: 379 - RNA, 72 nt, Homo sapiens
ucaugccaaagacagaugauuucuuggagaauguucagguaauucucuagguuuuuuuuuuuuuuggcauga

SEQ ID NO: 380 - RNA, 69 nt, Homo sapiens
aacucccugccccuccuccuuggcucucuuagcugcaagaggccucagagcaguggagggcaggggguu

SEQ ID NO: 381 - RNA, 65 nt, Homo sapiens
uuccucauccuccugaggccuggggagcgcucuaacaaccagacggccaaacagaggaugaggag

SEQ ID NO: 382 - RNA, 110 nt, Homo sapiens
cccuggaucacucagauucuaaaugccucccaaugauugcuccuggugcauacaacaaccugauagaggcaaugguuggggacauuuggcaaguuuccagugguucaggg

SEQ ID NO: 383 - RNA, 77 nt, Homo sapiens
cuucccuucuggccauuuccuccccuccagaauaccacuugggucgcucgaggaggaagagugucccaggggggaag

SEQ ID NO: 384 - RNA, 68 nt, Homo sapiens
gagguaauuauccagguaauuuagggaaaauaaacugccauuaccugaauuauucagauaauuaccuc

SEQ ID NO: 385 - RNA, 66 nt, Homo sapiens
uacuguaugcaacagggaaggcuauguuuccaaagagaaguaaagccuuccccuuugcauauggua

SEQ ID NO: 386 - RNA, 66 nt, Homo sapiens; identical to SEQ ID NO: 385

SEQ ID NO: 387 - RNA, 72 nt, Homo sapiens
ggccucagaggccaucuggggagcagucgucccagcgggcggcagggcccccuccaggcugccuuugaggcc

SEQ ID NO: 388 - RNA, 55 nt, Homo sapiens
gggauuuggcagcauggccccaugaacauuagugggaguuagucugcuaaauccc

SEQ ID NO: 389 - RNA, 66 nt, Homo sapiens
gugguauaggggcaggcucaugggagcacucaggacugcuguccccauuggccaccccugugccgc

SEQ ID NO: 390 - RNA, 80 nt, Homo sapiens
uuaacacuucaccaacacuggcucccuaaugugcagauucccagauccuuucugaggggcccgugugagugaaguguuga

SEQ ID NO: 391 - RNA, 76 nt, Homo sapiens
auauuugcuuuucagcuuuuccuaaaaggauuguacaccuuagaagugcuuaaggaagagugaugaaggcaaguau

SEQ ID NO: 392 - RNA, 94 nt, Homo sapiens
gaggcugaggcccacgggaggaggcagaaaugguagcuggucccaagcuccuuagcuauaaccauuuuucugcccuucccauggcuucagucuu

SEQ ID NO: 393 - RNA, 58 nt, Homo sapiens
cugcugauuacacagaagaacauugcuauuuacaugcaaauaucuuuguaaucagcag

SEQ ID NO: 394 - RNA, 100 nt, Homo sapiens
uuugacugccaucaugauucaggccucagugucauggacucuagcgaccggucacuggagguuaugaccagcugaggccugauugaaaauggcagucaaa

SEQ ID NO: 395 - RNA, 90 nt, Homo sapiens
uugcauugucauccccuugcauugugguugcagucaaugaaaguuagaaauaauugauugcagcugcauggcuauuuaauggcaaugcaa

SEQ ID NO: 396 - RNA, 78 nt, Homo sapiens
cuuccgacaugcccuggaacuaggaacaaagccacaagacuguuaugucuguuguuuucuuagucuguguguugggag

SEQ ID NO: 397 - RNA, 80 nt, Homo sapiens
gggaggagaaagcugagaaauucuagcucugcuacagccaguaugagcagcagagcuaggauugcuuuuuuucuucuucu

SEQ ID NO: 398 - RNA, 67 nt, Homo sapiens
gacuguacucuucuagccaucugaaauacguuuucuagguagagauagauuguguaaggguacaguu

SEQ ID NO: 399 - RNA, 67 nt, Homo sapiens; identical to SEQ ID NO: 398

SEQ ID NO: 400 - RNA, 67 nt, Homo sapiens; identical to SEQ ID NO: 398

SEQ ID NO: 401 - RNA, 67 nt, Homo sapiens; identical to SEQ ID NO: 398

SEQ ID NO: 402 - RNA, 62 nt, Homo sapiens
ugcuugugggaucucccuguugcuccugccccuggguggaguggcgggccauccuacaagua

SEQ ID NO: 403 - RNA, 70 nt, Homo sapiens
aaagacuucagccuuagaugauaugccuuuguacagaucccauuauggagagcuaucugcuggaguuuuu

SEQ ID NO: 404 - RNA, 78 nt, Homo sapiens
gcuggucuccagcuuggugcuggcucuccaggcuuuuauuugccagcauuuuggagccacgcccucuuggagaucggc

SEQ ID NO: 405 - RNA, 91 nt, Homo sapiens
guuaucuagcaugaugggcaggguucuacuuaacaacuagaacuuuuuuaaacaaguguuaaguagaacucugcccaugaugcuagauaac

SEQ ID NO: 406 - RNA, 57 nt, Homo sapiens
cucuggccuggggccugcucccuaucuguggaacugggaguagggcccaggcuaggg

SEQ ID NO: 407 - RNA, 57 nt, Homo sapiens; identical to SEQ ID NO: 406

SEQ ID NO: 408 - RNA, 57 nt, Homo sapiens; identical to SEQ ID NO: 406

SEQ ID NO: 409 - RNA, 65 nt, Homo sapiens
caggaaggaggugguucacauuggccccggaaucaauacuuaugcuguggaugaccuccuuccug

SEQ ID NO: 410 - RNA, 76 nt, Homo sapiens
uuggagcccagugcucuguucauucccacaggaagacauuugucaugucagggaauguuagaggauuggguuuuaa

SEQ ID NO: 411 - RNA, 80 nt, Homo sapiens
uuuuugaaugaggcuaauucauuucgaaagcacccuaggaagaccagaugcuuuugaaaugauuuagacucauucaaaaa

SEQ ID NO: 412 - RNA, 73 nt, Homo sapiens
ggcagcaggauggccaauugccaucaauuucugcagcaagucuggcaucauggcaucuuggcaucuugcugcu

SEQ ID NO: 413 - RNA, 68 nt, Homo sapiens
cucuagguuuuugucucaagcagacaugugaaugacagugcuguuggcuagaugagaaaggcuuggag

SEQ ID NO: 414 - RNA, 116 nt, Homo sapiens
ggaagcaggggaggugggcaugagauuggggugagggguaauguugagaauccgcauguggaacgagcaagucuauucuuuacuauguuucaaagcuaaaauagucuccugcuuuu

SEQ ID NO: 415 - RNA, 65 nt, Homo sapiens
gauucuuuuuucgcuuuuaccacacccucuguggguguuccaccagaagaaaagaaaaagggauc

SEQ ID NO: 416 - RNA, 58 nt, Homo sapiens
cauuuaucaucagaccuuuuaaaagccucugcuuuuaaaacggacauggugauagaug

SEQ ID NO: 417 - RNA, 58 nt, Homo sapiens
gguaguuaucuugagguaggugugacuucagggucacagauaaauaaagaugauuacc

SEQ ID NO: 418 - RNA, 139 nt, Homo sapiens
ucaacaugucaggauguuaaaagugugguaauuuggggugcuuucaguuucuuuugaaaacaaugagagauuauuuucuauggaaacuaaaagccuaccauguguuuaaaguugcuacacuugaaaauugauauguuga

SEQ ID NO: 419 - RNA, 66 nt, Homo sapiens
gaggagggguaggcaggagccaggcugaggauuuagcaccucuucugguaaccuuuaucccuccuc

SEQ ID NO: 420 - RNA, 114 nt, Homo sapiens
gagccaaaacguggauuuugagugcauucaagaugcuggcuggguuuggaagggaacugagucuuccaggacccaauagguagagagacgcagucaagagaaauguuuuggcuc

SEQ ID NO: 421 - RNA, 55 nt, Homo sapiens
cucucuuugaaggucggcugccagugaaucucaggcagcuggacuucaaaggggg

SEQ ID NO: 422 - RNA, 74 nt, Homo sapiens
ccaauuaggugagucuguguguggguuucuaagugucuaugcuuugcagugaucccacacaguuaucuaauugg

SEQ ID NO: 423 - RNA, 68 nt, Homo sapiens
agucuauuccagguagacaggccugcaggggguccaaccccuacaagccccucugucuggaauagacu

SEQ ID NO: 424 - RNA, 63 nt, Homo sapiens
uggcuccuuaagguuuguacucccagagagccauguggaguugcaauaauacuuaaggaguua

SEQ ID NO: 425 - RNA, 75 nt, Homo sapiens
uuucaguaguguuggaaaaacagacaaaugugggaaaaacacacauauuugucuguuuuucucauacuacugaaa

SEQ ID NO: 426 - RNA, 65 nt, Homo sapiens
guugauaaauauuuuggcugacuguuuccuacugaggcuggcauuuagccaacauauuuguuaac

SEQ ID NO: 427 - RNA, 65 nt, Homo sapiens
aauucugguuccucugccuuugugggcaaauuagcucuucaauguucagguagggagccggaguu

SEQ ID NO: 428 - RNA, 63 nt, Homo sapiens
agcacauaagcauguuuuauuugcuguuuaauuguuucuaguaaaagaauuugcuuaugugcu

SEQ ID NO: 429 - RNA, 56 nt, Homo sapiens
gcgcccccggccugccccagagcugcgcggcgcggggagggggcggcugggggcgc

SEQ ID NO: 430 - RNA, 84 nt, Homo sapiens
uaaguuauauauuucuaccuccaccuguaucaucaugacaccuuuauuaugauaacacagguagaaguagacauauauaacuua

SEQ ID NO: 431 - RNA, 104 nt, Homo sapiens
gauuuauguuccuaggcuguucccaucuuacauugaacaaagguuagcccacagagcccaaacuuugaucaaugcaagaugggaagagccucggaacauaaauu

SEQ ID NO: 432 - RNA, 77 nt, Homo sapiens
auuuucuauugcuucuuauuagcaguaauucucagcccugcgaggagaauuacugcuagcaagacgcaauagaaaau

SEQ ID NO: 433 - RNA, 80 nt, Homo sapiens
uuuuugaaugagucuaaaucauuucaaaagcaucuggucuuccuagggugcuuucgaaaugaauuagccucauucaaaaa

SEQ ID NO: 434 - RNA, 90 nt, Homo sapiens
aauacgauguguugagacagugucccuagugucaaggcuggggacauugacaguguugacauuggggacauuaucuccacauguuguauu

SEQ ID NO: 435 - RNA, 82 nt, Homo sapiens
gaugcuuccugaugcuucucuugcugggucagcagccacccuccccuucccugugaccugcagaaaagcuucagggggcguu

SEQ ID NO: 436 - RNA, 103 nt, Homo sapiens
uuuaucaaguugugugggcuuuuauauuucuucuuuggcaguucuaugacuuccuaaaauaauugcugaaaaagaaauauaaaaggccauucaacuugauaaa

SEQ ID NO: 437 - RNA, 67 nt, Homo sapiens
gcggggggaggguggcggaggccgggugucucggaggugacggccgguccucgcucucucccccugc

SEQ ID NO: 438 - RNA, 71 nt, Homo sapiens
aaaggcaugucaucuuguuuggaaaguaucuauugauuuuccaguucaucagaucagguugaugugucuuu

SEQ ID NO: 439 - RNA, 86 nt, Homo sapiens
gggggaaaggggugggaucugaauguguggaggucaagguccugacaaugugauaaugauauaagcagagcucuccccuuucucuc

SEQ ID NO: 440 - RNA, 88 nt, Homo sapiens
agcaaggauggguguugaggccuccaggauguagucacagagggagaauacaagacuauauuggcaggccuagauucccguucuugcu

SEQ ID NO: 441 - RNA, 69 nt, Homo sapiens
ggcucugucugauuauugacagggagcuuuucaaacuccugagccucuguuuguguuucagauggaguu

SEQ ID NO: 442 - RNA, 103 nt, Homo sapiens
uuagaauguugaugaaauuggaaugugucuugggauauauggugaauauucauucuuccaagaaaaacucaucuaaucuccaucuaauaauucagcauucuaa

SEQ ID NO: 443 - RNA, 66 nt, Homo sapiens
gggaggaagguauacagaauuguaaauggcaugcuccaaacuuauauucuugauuacuuucuuccu

SEQ ID NO: 444 - RNA, 86 nt, Homo sapiens
ugcuguugcgauuagaugaugacagcuagcuggcuuuuaaaauugaucaggaaguauucuggcagucauucaguguuguaauagca

SEQ ID NO: 445 - RNA, 101 nt, Homo sapiens
auguggagaagcuagauaaugaugaagaugacagugaggugcccagccugcuccugggacugacaggagcuuuugaggauacuucauuugcuucucuaugu

SEQ ID NO: 446 - RNA, 76 nt, Homo sapiens
cuguaccacaguuauggaggcugacugagggucuccuugcuucuuccuuccaaaccgccucuccacugugguacag

SEQ ID NO: 447 - RNA, 67 nt, Homo sapiens
uagguguuuuauuccuauggcuuaauuuuuuaaauucuaaagcucuggaguagugauaagacaccua

SEQ ID NO: 448 - RNA, 70 nt, Homo sapiens
auuuucucagcuucuuuaauuugguggaaaacguaaaguugucucuccaagguaaacuagcugagaaagu

SEQ ID NO: 449 - RNA, 129 nt, Homo sapiens
gggaugccacauucagccauucagcguacagugccuuucacagggaggugucauuuaugugaacuaaaauauaaauuucaccuuucugagaaggguaauguacagcaugcacugcauaugugguguccc

SEQ ID NO: 450 - RNA, 71 nt, Homo sapiens
agagugggggugugguagauaauuagguuucuuccauauuuagauccuaugauuuauguuacccccacucu

SEQ ID NO: 451 - RNA, 66 nt, Homo sapiens
auaaaaauaacuugcuggguucggcagcuucuagaaaggcucucugacaagguggguuauuuuuau

SEQ ID NO: 452 - RNA, 66 nt, Homo sapiens
gggaggucaggguggccaugaguuaguuuuuagauauuuugaguuggaggcguucccugaccuccc

SEQ ID NO: 453 - RNA, 66 nt, Homo sapiens
aggagugugagcuguugaaagaaccuggugaagucuugcaagguccagcaaauugcuuacguuccu

SEQ ID NO: 454 - RNA, 95 nt, Homo sapiens
cacuuugauucaugagguuuuuggcagacaccaaagcauacaaugaauaguuuggucuugcugugguuuauucaaggguuauuugaaucaaggug

SEQ ID NO: 455 - RNA, 85 nt, Homo sapiens
ggcccaggcaggugggggcaggauuugaccccagguagccuugcugcacagccuuggguuuaauccuauccaucuugccuggguc

SEQ ID NO: 456 - RNA, 67 nt, Homo sapiens
cugaugaauggauguguaggaaguggugucuaguaugcauauaaauuuuagcuguuccauucaucag

SEQ ID NO: 457 - RNA, 59 nt, Homo sapiens
uguggccuggaguuugauguaggccaguggugucuggcuccuugcaccucuaggccaca

SEQ ID NO: 458 - RNA, 69 nt, Homo sapiens
aauuugguuucuuuugugcuuucuauuguacaaguuggguuggaaaauagauugccaggaaaucagauu

SEQ ID NO: 459 - RNA, 97 nt, Homo sapiens
uccuugguguuauuacugagggcugaggcuccuagagauuggcauucuggacauaugaaggucaaauuuuagagcuuaagccuuuugguaccaggga

SEQ ID NO: 460 - RNA, 59 nt, Homo sapiens
ggcuuuugugguuugcuaaaugccugaguaaaauugagguguuuaauaccacaaaagcc

SEQ ID NO: 461 - RNA, 58 nt, Homo sapiens
gccucugggggguuuugauggaggagcugccccuucuugcuucauuucucccagaggu

SEQ ID NO: 462 - RNA, 68 nt, Homo sapiens
agcucaggagaggagauaggugugcaaauuaaauuuuagucuuuccagccaucuccuuuuucugaguu

SEQ ID NO: 463 - RNA, 59 nt, Homo sapiens
aaggguucccucugggccccaacuuggcagauaaguucauugcccggaagggaauucuu

SEQ ID NO: 464 - RNA, 67 nt, Homo sapiens
uccccaaagcugucauauuaaguuguuuugauccuucuucuaguacuucuguggcuggcuuugggga

SEQ ID NO: 465 - RNA, 68 nt, Homo sapiens
ccccucugucucuuggccuguguccugugucuggcagaggcugcccaugguccaggaagacagagggg

SEQ ID NO: 466 - RNA, 76 nt, Homo sapiens
auuuugagacucuauauucugucuguauucuaaggugacuaugagauauaguaggauuauauaguagucucagaau

SEQ ID NO: 467 - RNA, 68 nt, Homo sapiens
ggaaacaaagcccuuuaucaagaauaauuaacucuucccuuuucuuuuuggagaggugcuuuguuucu

SEQ ID NO: 468 - RNA, 72 nt, Homo sapiens
ucuaagccucuggggaccacucaggcaggcaggugaccaccugggugucguguguucccugagggguuugga

SEQ ID NO: 469 - RNA, 75 nt, Homo sapiens
aauggcuguaucucuggucuuacguaaauucucugcgguccauguguuuacauaagacaagggaauauagcuauu

SEQ ID NO: 470 - RNA, 67 nt, Homo sapiens
agcugugaaauggugucccugcucaacugggccccaaagcugucagggggcugccaauuucacaguu

SEQ ID NO: 471 - RNA, 55 nt, Homo sapiens
cgcgcguggggcuggcgcgccgcccucgcccggcuucccgcaguccccacgcgcg

SEQ ID NO: 472 - RNA, 70 nt, Homo sapiens
gggcugggagggaggggccagggauaauuuaugauaucauugcucccccgccgcacuuacuucccagccc

SEQ ID NO: 473 - RNA, 94 nt, Homo sapiens
ucuccaucuggcuaagaccugucugucccuuaucugugucuuguucugucuccuccauagaaggggaggggaggucuucaggacuggaugggga

SEQ ID NO: 474 - RNA, 70 nt, Homo sapiens
cucuugcucccgcccuccgcucaugcucacuguggccccaggacgugggcgauguugcagggagcaaggg

SEQ ID NO: 475 - RNA, 58 nt, Homo sapiens
cauaauaggaauuuuggcuucuccugggugucucuaaagccagaaguuuucuauuaug

SEQ ID NO: 476 - RNA, 59 nt, Homo sapiens
ggcagagagguuggauuggaugauuucuaugaucuguuccaguucaaaacuucucuguu

SEQ ID NO: 477 - RNA, 74 nt, Homo sapiens
aaauucuggcaccugguaucuugggaaaugguaaacugaugagaucuggccaaguaccaggaaugucggaguuu

SEQ ID NO: 478 - RNA, 75 nt, Homo sapiens
gucauaaucuuguuugugauaucgcaaucaucaccacagcaaccaauugugauucaacaaauugaggauuaugac

SEQ ID NO: 479 - RNA, 72 nt, Homo sapiens
cugccucucugggccugugucuuaggcucugcaagaucaaccgagcaaagcacacggccugcagagaggcag

SEQ ID NO: 480 - RNA, 73 nt, Homo sapiens
ccuucccuuuacuccaguuagaacuuuuguugcacaacagaaguugaauuuuugacggagccugaaggggagg

SEQ ID NO: 481 - RNA, 99 nt, Homo sapiens
ggcacaugagugcagucugacaccuuacucccagguguucgugccccaugccucccaugagucaucuguggacacagguguccugcacacucaugugcu

SEQ ID NO: 482 - RNA, 67 nt, Homo sapiens
cggcccugugaggaguuggguucggccugucccagacaggccuugcccacaucccaucacagggccg

SEQ ID NO: 483 - RNA, 99 nt, Homo sapiens
ggcuagggcuuccagggauuccagggaguuaggcucuguggcaggggaucagguguugcggaggagaacuucccagagucccaaggccaagcccuaguu

SEQ ID NO: 484 - RNA, 67 nt, Homo sapiens
caucauucugugcauguguuucagaaagaucuguuuggggauuuggagcaugcaaggcaggguggug

SEQ ID NO: 485 - RNA, 68 nt, Homo sapiens
gccucccugcacagaggcugugcauguccccugggcauucacucuagcugucugggcugcagggaggc

SEQ ID NO: 486 - RNA, 97 nt, Homo sapiens
uuuaacaaauguauuggucuuucaguuuuaauucuuccggauaugauucaauuuccugaugaaucugaacugagaggagaauaacuuauuuguuaaa

SEQ ID NO: 487 - RNA, 97 nt, Homo sapiens
ggaacugagguagacgggcuguucagagucagauccuagcuuugucacuugcuaaagggcucugacguucggacagcaaguuuugagccucaguuuu

SEQ ID NO: 488 - RNA, 66 nt, Homo sapiens
aggaacugggacagaaaucggaagaaauaauuccccaaucuucugaucccugugcucccaguucuu

SEQ ID NO: 489 - RNA, 99 nt, Homo sapiens
uguucccaggucaggcccugugcuguguccugggguaaaagggaugaguaagaaccagccccagaguacagcauaguacucuaugggagccuggggaua

SEQ ID NO: 490 - RNA, 59 nt, Homo sapiens
aauaauccagaauuccuugugguggggcugcucccacaaggggucagaucuggauuauu

SEQ ID NO: 491 - RNA, 66 nt, Homo sapiens
agacuagauuggcagguuggggcucaaauguggaagccuucaauaccaugcaaaauaauuuggucu

SEQ ID NO: 492 - RNA, 79 nt, Homo sapiens
gucuccgcugagugacauuugcaccagcugcuuccaaagggaguagcuuuggugaaaugucaccggcuucagcggggau

SEQ ID NO: 493 - RNA, 108 nt, Homo sapiens
ucuucuaagguccugcuauccuucuguggggaauguguccggaacccagucuccuaacacccaggauacaaccuccaggaggcaaaagcggggaaaaaccuuggaaga

SEQ ID NO: 494 - RNA, 114 nt, Homo sapiens
aguugacuagcccuaaaagguaucuuauucuccagucaaguuugcaugaacuuuauggauagugcuaacuugacuggagaaauaggagaucuuucaggcuuauguuaguuaacu

SEQ ID NO: 495 - RNA, 83 nt, Homo sapiens
cuggaguuaagauggaaaaaacuggugugugcuuauugauguagccaacaagcauacaucaguuuuuuccaacuuaacuccag

SEQ ID NO: 496 - RNA, 124 nt, Homo sapiens
aagucacagagaagguauaaucauaaguauggguauuucuaccauauguuuaggcauaugguagaaauaaugcaaacauaugguggaaauaaucauacuuaugauuguaccuccucugugacuu

SEQ ID NO: 497 - RNA, 88 nt, Homo sapiens
ccuagcaccauaguuucuugccuacauuauugggacggauccaucaggccucugugcaaugaucuaggcaagaggcgauggugcuagg

SEQ ID NO: 498 - RNA, 111 nt, Homo sapiens
gcagauaugugacagagccaggcaugcuauacugccauggugacucuaggucaguuugaaucucagagucaccaugacaguauagcuugccuggcucugcuacauaucugu

SEQ ID NO: 499 - RNA, 63 nt, Homo sapiens
ugaugcauugcacuaauaugcucucagagcauacucacugggauguauuagagcaauguauca

SEQ ID NO: 500 - RNA, 76 nt, Homo sapiens
aguagucuguuaucgcaugguaagcuuucauucuacauagauuaaguaauggagcuuggaugugaagcaggcuauu

SEQ ID NO: 501 - RNA, 126 nt, Homo sapiens
gaccuguauaaauacuuguaaguuguacucuacauaaaauuucuauaacuguuauacucuucacuaggaucaccaaguuauugaaauuuugauguagaugaaaauacagugaguauuauacagguc

SEQ ID NO: 502 - RNA, 92 nt, Homo sapiens
cauaguaaagaauuugagauuuguucugcaggugaugggaugguuucaggcuuuccaucacauuuagaauaaaauccaaacuuuuugcuaug

SEQ ID NO: 503 - RNA, 69 nt, Homo sapiens
gggaagccgggaugggaaggcugggauuuuguuucagaagucccugguucuguguccaccuggcuuccc

SEQ ID NO: 504 - RNA, 88 nt, Homo sapiens
ggagguuuauaaaggccuucacaauuccuaugguaacccaggagaaaggcuguugccauggggacuagugaagccuauauaaaccuuc

SEQ ID NO: 505 - RNA, 81 nt, Homo sapiens
guauucuggucaagaauuuacuucugguuuauaaaucauuuuuugguuuauauaucaggaguaagaucuagaccagaauac

SEQ ID NO: 506 - RNA, 95 nt, Homo sapiens
ucauauccuguauaaacuguggggagucuauggggaaaauuaccauauauggaaacuuuccccauagcauccccuuggaguuacacaggauguga

SEQ ID NO: 507 - RNA, 65 nt, Homo sapiens
gugggaugcuuaggaucuugcccuuaugguauaggcacaagaagggcaggcuccaagcauccuau

SEQ ID NO: 508 - RNA, 105 nt, Homo sapiens
gcccucuucccaucaucugacugcccugccuuccagcucuggggaggguuggagcccucuugggggcaggagggacagggguccaacugaggaagggaagagggc

SEQ ID NO: 509 - RNA, 79 nt, Homo sapiens
agaaaggaacaaauguagcauuuguagauuguuuucauguaaaucacugucugcauaggugcugaaucuguuucuuucu

SEQ ID NO: 510 - RNA, 90 nt, Homo sapiens
uuauugucuccauuuauuuaggaggaaacugagguuugggaagguuagucacuuuaccgaaguuucuuccuaaaccagcggggacaauaa

SEQ ID NO: 511 - RNA, 109 nt, Homo sapiens
gagcaguaaugaggagaauuacucuggcaguuucuggcaucagcuuugcagugucauucccgaagcuggcaggaaacuuuccaauuguaacuuucuagcauugcuguuu

SEQ ID NO: 512 - RNA, 65 nt, Homo sapiens
uuuauaguuucaaaacuaauuauucuauuacauaaaagcagaauaauuaguugggaaacuauaaa

SEQ ID NO: 513 - RNA, 59 nt, Homo sapiens
cuuuggccuuaaaauaagacaggcaggcagaucugccuaucuuauggcuaaggucgggg

SEQ ID NO: 514 - RNA, 144 nt, Homo sapiens
uauugcuaauaacacacauccaaaaaggcaucuuuuuucagugaccggauguuuauucaaauauucaauaccuaccauuauuugaguaaacauccagucacugaaaaaggaugccuuuuuggcauccuuguucuauuggcaaua

SEQ ID NO: 515 - RNA, 68 nt, Homo sapiens
agguaugggagacuagguugugauugcaagaugaaaauaauauguuucaacuuauaccuucuauaccu

SEQ ID NO: 516 - RNA, 87 nt, Homo sapiens
ggauuauuugcacauuuuccugaugacuucucucucucagaauucuuuuuuuguuggaaggaggugggugggaagagcaaauagucc

SEQ ID NO: 517 - RNA, 103 nt, Homo sapiens
uguguuuucccaccgaaggacccagcuguucuuucuguuuuugcuuccuguggaagcccuaugguugggagcguugggucaauaaacagcuggggagagcaca

SEQ ID NO: 518 - RNA, 111 nt, Homo sapiens
ccgcaaucgggagcccagggcuggguguaggggccccccgggguuggaggaaccuaguccccccagcccuggggugcccccucgcgcccgacggagggagcccgauugcgg

SEQ ID NO: 519 - RNA, 74 nt, Homo sapiens
gcuuucuugcuagggugcuuucuucuaaccccagaagugauggggagccauggaagguuuuuaggcaggagagc

SEQ ID NO: 520 - RNA, 69 nt, Homo sapiens
uuccugggaaaagaugaguuuugguauuagcuggcacacacucuaugccaaaucaguauuucccaggaa

SEQ ID NO: 521 - RNA, 64 nt, Homo sapiens
uuggcuggggcagagaugggggagucuugggggaacccaccagggccucuguggccccagcuga

SEQ ID NO: 522 - RNA, 69 nt, Homo sapiens
gaaauguuuguaucaucugugggcucugagcuacuccaguccaggguuucagaugcuggcaggcauuuc

SEQ ID NO: 523 - RNA, 67 nt, Homo sapiens
ucucuuuuuugauuucccuuugauaguaaauauaaucagaacuucaaaggguagcccagggaagaga

SEQ ID NO: 524 - RNA, 83 nt, Homo sapiens
caccaagaagacucuuauaacgacucacuagaaaaggaguagggggacccuuccuaguggguuguugugggaucuucuuggug

SEQ ID NO: 525 - RNA, 92 nt, Homo sapiens
auuucucauaccucccuuauuuggcuaucuaaugcaagauccuuugccauagaccuugcauuagacaaccaaauaggggaagugugagaagu

SEQ ID NO: 526 - RNA, 95 nt, Homo sapiens
agaaaugcaagcucucagauccuuguuccagagauucugacuuaguaagucugugugaggggaguuggagggggauggcugagauuugcauuucu

SEQ ID NO: 527 - RNA, 73 nt, Homo sapiens
ccgggcaggcgcgagggccgggggucguuugacuuggguguccccgagccccgcugccuucacgucugcccgg

SEQ ID NO: 528 - RNA, 70 nt, Homo sapiens
uauggcauuucccugauuaacagccauuuuauaaccuccguaauuggccacaaaucagagaaaugucaua

SEQ ID NO: 529 - RNA, 72 nt, Homo sapiens
uaaucacaccccuggggcauugcaagucaugauccaaagauaaguguuuuuaaccucccaagggugugauua

SEQ ID NO: 530 - RNA, 113 nt, Homo sapiens
ggcaggggaagcgcugguggugggcccagcccugacugucauggaagcuaggaagguguuuucagcuucuggggugggagccagggcgggcauucagcggcccuuucucuguu

SEQ ID NO: 531 - RNA, 80 nt, Homo sapiens
aggauaauagacugggguugaacucuagucaguaaaaggaaacuuuucagacuuggaguuaaaguucaaucuguuauucu

SEQ ID NO: 532 - RNA, 72 nt, Homo sapiens
ggacccaggcccccuggggucuccuugugugaaccucaccuccaugcaggggucugcagguggccugggucu

SEQ ID NO: 533 - RNA, 59 nt, Homo sapiens
cagguugggaucgguugcaaugcuguguuucuguaugguauugcacuugucccggccug

SEQ ID NO: 534 - RNA, 71 nt, Homo sapiens
ccuggguggggccaggcccuucaggcugcagcacagggcugaguaugaagggcacguugcccccaucuagg

SEQ ID NO: 535 - RNA, 70 nt, Homo sapiens
gguucuuuccacauuugcuaggcuguauuuauuuuuuaauaccagcagccugggacaucuggaggggauc

SEQ ID NO: 536 - RNA, 66 nt, Homo sapiens
uuauuuucugccauuuaccuucaaaccaauucuuugacaguggggaggagguaaagcagaaaguga

SEQ ID NO: 537 - RNA, 95 nt, Homo sapiens
uuccucauuaacauucccauagagugauuggagggauuggagggaucauucagacacaauuucuccaaucacucuauuggaacauuaaugaggaa

SEQ ID NO: 538 - RNA, 83 nt, Homo sapiens
gccggccggcucagcccccuccucuccuccucugggcaguccgcccgcccauggggccagggaggggagccaggccggcuggc

SEQ ID NO: 539 - RNA, 67 nt, Homo sapiens
gccuugccuuccaaaaccccuaucuacuggggagacagaacacagacuggggguccgaaggcagggc

SEQ ID NO: 540 - RNA, 128 nt, Homo sapiens
ggggagaaacucaagcgcggguuaggaagcaagacugaggggccucagaccgagcuuuuggaaaauagaaaagucucgcucucugccccucagccuaacuuccuuuauuuccucacaaguuucucccu

SEQ ID NO: 541 - RNA, 90 nt, Homo sapiens
cuuucagcuuucaguuuuuauuuaaaagacuuaauuggaaguuuuuauuacucccaauuaggcuuuuuaauuaaaaggaaaaguugaaag

SEQ ID NO: 542 - RNA, 104 nt, Homo sapiens
ugcacaccucccagggcuaaggugcuguggagaauacaggugcuauguggaggacauaaggugcuacguauccuccauagcaccucagccauaggaggugugua

SEQ ID NO: 543 - RNA, 95 nt, Homo sapiens
auuauuauuaucaucagaggugagcaguaaauauuuguugcacaaggauucacuuuucccacaaauacuuacugcuugccugcuauaaugauaau

SEQ ID NO: 544 - RNA, 60 nt, Homo sapiens
uuuuucuguccccagaauguggccaacauauguaugacucacauucacaggacagaagga

SEQ ID NO: 545 - RNA, 171 nt, Homo sapiens
cauaggugcuucccaccuaaacaucaguuaugaggacuuuuucucugcccuucaucaacaugcagccugugaacagugucugggaaaguaguggucauugguugcguaauuugauuuuaggcuuauggagaaaaggacccaagugacucugauguuuacaaagcaccuaug

SEQ ID NO: 546 - RNA, 66 nt, Homo sapiens
ugggaggugggcguggggcugaagggacuagagugggucccuuucugcucuccuucccauuucuca

SEQ ID NO: 547 - RNA, 74 nt, Homo sapiens
cugaagugaaucuggggccagcuguagaucccauguuagcagugacauaagcagcuggcccccguuuauuuuag

SEQ ID NO: 548 - RNA, 81 nt, Homo sapiens
gggguuucuggcugggugagugucacugugguaccagcugcugcuauaccccacugugacacagacaccuucagaaaccuc

SEQ ID NO: 549 - RNA, 86 nt, Homo sapiens
gggcgggggcccucgucuuacccagcaguguuugggugcgguugggagucucuaauacugccggguaaugauggaggccccugucc

SEQ ID NO: 550 - RNA, 65 nt, Homo sapiens
uggcacucaaacugugggggcacuuucugcucucuggugaaagugccgccaucuuuugaguguua

SEQ ID NO: 551 - RNA, 88 nt, Homo sapiens
gaguucugguucuaaaugcuccaguggaaucaagacugcuuuucucaaggggcagggaaaaugccauaggguuuucaaaucagaauuc

SEQ ID NO: 552 - RNA, 65 nt, Homo sapiens
guuuuuucuuccuggaaugcucugggcuugauuucaggagaaguucauuccuuuggagaaaagac

SEQ ID NO: 553 - RNA, 84 nt, Homo sapiens
gggccuuuggccuccugaaguuuaugcuuuucgggucuuaaaggaugcuggaccccgagaguuggacuccagagcuaaaggcuu

SEQ ID NO: 554 - RNA, 88 nt, Homo sapiens
auugggacauugguuaauuuccuguuaauaccaauaauaccaauauuaccaauauugguauuaaugggaaauuaacagaugucccagu

SEQ ID NO: 555 - RNA, 80 nt, Homo sapiens
agaggucaggggcaugggguauggccagggaaaagagaaaguuauugguccaagaaggguugccucaugucuuggcuucu

SEQ ID NO: 556 - RNA, 72 nt, Homo sapiens
uuucccuuugugaggggaaaaaaacaauugcugagcugauaacaucaguuaauuuccucuggcagagggaga

SEQ ID NO: 557 - RNA, 77 nt, Homo sapiens
gccagggcaucggggccuucuuuugguuuuacccaaauaagggagucagaguaacagaaaggcucaggugcucuggc

SEQ ID NO: 558 - RNA, 101 nt, Homo sapiens
acgcuuccccuggcucccuucguucccccccaccccacuuggccugcgugcuggagggugugcgagggagugggaggacgucgggggguggggggaggcgu

SEQ ID NO: 559 - RNA, 70 nt, Homo sapiens
uccauugagggguucugggaauacuauaaccacaaguacgaagcuggagucaccagaaacccucaaugga

SEQ ID NO: 560 - RNA, 55 nt, Homo sapiens
acgcagcagaagguaaugcuuuuaaggucaggcuaaaaauugcguucugcugugu

SEQ ID NO: 561 - RNA, 70 nt, Homo sapiens
uggggcaggaggacauuagcuuauuugugccccucagcacaauuucugaggcagaaugucucuugccuca

SEQ ID NO: 562 - RNA, 138 nt, Homo sapiens
ggaggaggguugcggcccguagucaguaguuggggggugggaacggcuucauacaggaguugaugcacaguuauccagcuccuauaugaugccuuucuucauccccuucaaccacgcgcagcccccggacccuccucu

SEQ ID NO: 563 - RNA, 71 nt, Homo sapiens
ccgcucccauggccccggaccuuggcaacgcugcgcagcgcgucagucaacgucacagggcgugggggugg

SEQ ID NO: 564 - RNA, 72 nt, Homo sapiens
gguggaugggagaugggcagauaaucuucacucagaucuaaacauggauuauuugugcauaucccauccacc

SEQ ID NO: 565 - RNA, 79 nt, Homo sapiens
ugagcagggggguuaguuaugcagguaauuuccaucaaugccacugggaguuaucugcgaaaugggagucuccuguuca

SEQ ID NO: 566 - RNA, 70 nt, Homo sapiens
cugucagagaggagagggugcggggugggggagccacuggaccacuccccgcucagcugcucucugacag

SEQ ID NO: 567 - RNA, 82 nt, Homo sapiens
uucuguccuuagugauuauuuacaguuuagguguuuauuuucugucuuuuucaacuagacuguaaguuccaugagggcagga

SEQ ID NO: 568 - RNA, 102 nt, Homo sapiens
ggcccagcuaggaugcucccagcccagcuccuacccgccgggucuuucccguuugucaggcaggccggcaggcugggcuggugacucaugacuggcugggcc

SEQ ID NO: 569 - RNA, 65 nt, Homo sapiens
uuucuucuguuggccccucauguugucagugaaauggcuacaagaauggcauuugauggaagaag

SEQ ID NO: 570 - RNA, 56 nt, Homo sapiens
ggaggcagggggaggaaggaauguacuauucacggccccacccauccccugccucu

SEQ ID NO: 571 - RNA, 142 nt, Homo sapiens
uacguguuuaagagaaauuuuacucuuugaaccacuuuuguuaaguuuugacuagcucauaauugcuucacaaaaccuuuuguuuugaguuagucaaaacuuuagagugguuuaaagaguaaaauuucagauuaaauaugug

SEQ ID NO: 572 - RNA, 55 nt, Homo sapiens
ggccuccuccugauucuccagcuauggcucugcuggggagagcagggaggggguu

SEQ ID NO: 573 - RNA, 76 nt, Homo sapiens
uaauuaauugggcuuguggucaccucacaccucucauuugaggccguauagguaacccacagacauuaauuaauua

SEQ ID NO: 574 - RNA, 94 nt, Homo sapiens
auguagguggggcaagagcaucccagggaaacuccaagcugagucagacauuugccagugggguucuuuagggucucuuaagaccuaccuauau

SEQ ID NO: 575 - RNA, 75 nt, Homo sapiens
gaccacucuaugccucaguuuccucauuuguaaaauggguagacaaggauguggaggggacugaauggggugguc

SEQ ID NO: 576 - RNA, 97 nt, Homo sapiens
cuuaccugaaggcuuaaucuucuguuggugacaugauaaucaguucuccagcaagcaauuaugaugucacaaagagguaauuaucacuucaggugag

SEQ ID NO: 577 - RNA, 87 nt, Homo sapiens
gauggguguguggcagacagugauaauuucuucuaaauauacugacuugggagacugagaagaaggcaauugucugacauauucauc

SEQ ID NO: 578 - RNA, 72 nt, Homo sapiens
gagggagggaggggcaagccgugagcccucccguugagaggagggggcuuccggccuugcacucucuucuuu

SEQ ID NO: 579 - RNA, 66 nt, Homo sapiens
ggagugggagggggaggagggggccaggccuagagaagagcaggccccggcuuuacuucccacucu

SEQ ID NO: 580 - RNA, 57 nt, Homo sapiens
ggagguggcagggaacauaauuucuguuugaaaguucuuuuguuuucugcuaccuuu

SEQ ID NO: 581 - RNA, 73 nt, Homo sapiens
aggggaaaaugggcuguauuccaaaaauucaauuuuaaauugacuguuuggaaugcagaacacauuuucccuu

SEQ ID NO: 582 - RNA, 134 nt, Homo sapiens
gcugccuucauggggcccagccuagaugaacacagcuguccucauugggcccuggccagguuuuagagugaauaccugggcugggcccuauuaggacaucugugaucaugugggcuggguacaaugagggcagc

SEQ ID NO: 583 - RNA, 77 nt, Homo sapiens
ucuucuuuuugguuccucugucuuuaaauaucucuaugccaacuaguaucaagaaggcaggggaugcagggagaaga

SEQ ID NO: 584 - RNA, 89 nt, Homo sapiens
cucaguuaauugugaauugcuuaugccaggugagagagaauuggugucuaccccucucaccugacauaagcaacucugaauuaacuggg

SEQ ID NO: 585 - RNA, 82 nt, Homo sapiens
gucuaagaacuguaaaacaguuacacagagagccuuggcaggugagggacauucauguauagcuguuucagaguucuuagau

SEQ ID NO: 586 - RNA, 76 nt, Homo sapiens
acagacuguuuguacuuccagauuaggugugggaagccagacacacaaagagcuuuucugggagaggauagucugu

SEQ ID NO: 587 - RNA, 72 nt, Homo sapiens
caggaagauauguauauguuuaaaaaauaaaccaaucucugcuuuauuuuuuuaaacauuaauauuuuccug

SEQ ID NO: 588 - RNA, 104 nt, Homo sapiens
gugacuggcacguauuuugagcuuaagaaacacuuccuggguaaaaagagcaccagaguggugcauuccaagagguguccuaggagcuuuagggugccagucau

SEQ ID NO: 589 - RNA, 91 nt, Homo sapiens
ucuucucuuucuucuuuuuccguuuuuggucuucaagauccucuagugacugaggagucaggagccacguggaagagggugggggagaaga

SEQ ID NO: 590 - RNA, 56 nt, Homo sapiens
uaaaugagagcuccuuuuucucuucaaaagugccaggaaaaagguguuuuuauuua

SEQ ID NO: 591 - RNA, 68 nt, Homo sapiens
ugaaaugaaugugauucgauaguuaucgcauccucauaaauguguuagauugaaucccauucauuuua

SEQ ID NO: 592 - RNA, 78 nt, Homo sapiens
ucuuugguuuuuaguuauuccuaaagggucuuggcauugguggccugccucucuuuucaaaauaauuaaaaccaaaga

SEQ ID NO: 593 - RNA, 70 nt, Homo sapiens
ucugguuguugucggcaucuuuccaaaacacuguauuagcuguugcaguggaauguugccagcagccaga

SEQ ID NO: 594 - RNA, 71 nt, Homo sapiens
agauaaacucaugccaagaaaugauccuggaaauauauuucagacugaugguuucuggucugaguuuaucu

SEQ ID NO: 595 - RNA, 82 nt, Homo sapiens
ccuccccguccuguggacugugcugccacagugggcauucuccauccaccucacaguggcgugacagccauggauggggagg

SEQ ID NO: 596 - RNA, 93 nt, Homo sapiens
uaugcacauacucacugcaauauauuuuuacaauguguauuuauauauguacauaugcugugacuauaugugugcaacgugugugugugcaug

SEQ ID NO: 597 - RNA, 56 nt, Homo sapiens
ccuugagugcaucgugggugucaugcaggcaguagacccggauguuguacucgagg

SEQ ID NO: 598 - RNA, 59 nt, Homo sapiens
ucauuaacugguuaauaacuauuuaugaccccaggauguaguuucuacccaguuaaugg

SEQ ID NO: 599 - RNA, 109 nt, Homo sapiens
auuguauguauuaucggacauguccguauauuuuggggacaacugaacuuaucccaugacacccaggccuuccccaaaauacauggacgugucccaucauacauauaau

SEQ ID NO: 600 - RNA, 57 nt, Homo sapiens
aggaaagaguguauccaucaauccauguaaugugacgugaugaguuuacucuuuucu

SEQ ID NO: 601 - RNA, 73 nt, Homo sapiens
uaaaauguccuuccuugcuugcaguuuuacauccaagugcuuuuuggguuccugcgguugguaggauauuuua

SEQ ID NO: 602 - RNA, 56 nt, Homo sapiens
ccuaaaacaagugcaagacuagcagaccccagacuacucuugcuucuuguuuuagg

SEQ ID NO: 603 - RNA, 56 nt, Homo sapiens
agggaccagaauggggccuccugggauucugcccagugcuuuuucuuuugguuccu

SEQ ID NO: 604 - RNA, 127 nt, Homo sapiens
ggaugccacauucagccauucagugugcagugccuuucacagggaggugucauuuaugugaacuaaaauauaaauuucaccuuucugagaaggguaauguacagcaugcacugcauauguggugucc

SEQ ID NO: 605 - RNA, 73 nt, Homo sapiens
ucuggagaguguaauuauguucauaguuaagaauuaaucaggugagagaauuauggaauaaucauucuccgga

SEQ ID NO: 606 - RNA, 67 nt, Homo sapiens
acaggggagcuuaguguacuuccgcuuuguguguguaugagguggggaaaauacaugguuucccugu

SEQ ID NO: 607 - RNA, 98 nt, Homo sapiens
guuaccgaggguagaauuagaccucggggcccaauuuccugccacauuacaaggcgguaauuaacucagcucagaggucccguuccucccucgguaac

SEQ ID NO: 608 - RNA, 59 nt, Homo sapiens
gacagcucuuuuaaaagcaggcagaaggcauuauugcugaggcagcuugaggagcuguu

SEQ ID NO: 609 - RNA, 140 nt, Homo sapiens
uauagacgugauaugcuucuauaaaacaaaacguccugaacuggagucuccuuuuuucaugcagaaguuucuuugcuaguguaggaguaagaggggcggcucuuccucagaaguuuuagauauuugacuuuaugucuaua

SEQ ID NO: 610 - RNA, 60 nt, Homo sapiens
cgcgcggcgcuucgggccuuguagucuuggacagacccccgaggcccauggugccgugcg

SEQ ID NO: 611 - RNA, 81 nt, Homo sapiens
uuuuuuccuuuuccuucuggcagcuucuuggcaucaacauagacaugccugaagagcuguuuuggagccugaaggaaaaaa

SEQ ID NO: 612 - RNA, 65 nt, Homo sapiens
gcuucaggggaucagagacuaggcuccaaauaagcuugccaagccucaguuuccuccuuugaagc

SEQ ID NO: 613 - RNA, 129 nt, Homo sapiens
gagucugccagucaggaccuagggcuucagagcugguucuuuaggugcugagccuucuaaagucuccguucuaggguucagcaccccgaaagugucuuccugcccugggauuauucauuuggcagacuc

SEQ ID NO: 614 - RNA, 67 nt, Homo sapiens
gguggcgggugugcagaugaaggcugaggccccaaggccccaccaucccaacugugugcuugccacc

SEQ ID NO: 615 - RNA, 83 nt, Homo sapiens
acucucuucggugacggguauucuuggguggauaauacggauuacguuguuauugcuuaagaauacgcguagucgaggagagu

SEQ ID NO: 616 - RNA, 69 nt, Homo sapiens
ggagaugguguugaguuugguacucagcugggucagcugccgguuauucauguacuuggcaucguuucu

SEQ ID NO: 617 - RNA, 68 nt, Homo sapiens
aguguaaggaauggagaaguucuucaaaguuucuuaaaaccauaaagagcuugucauuucuuugcacu

SEQ ID NO: 618 - RNA, 127 nt, Homo sapiens
ucccagcugucugggacugucugcuggagcaagugacaucacagugaccagaaaccaccuccccuuugucuggagcaguuaugaugucauucccucuggcagcgaagcaggauguuggcagcuggga

SEQ ID NO: 619 - RNA, 81 nt, Homo sapiens
gcaucuguuuauuuucauggcgaggcuucauggggacgggaacaaguccuugaugagcgccugccagagcugggcaggugu

SEQ ID NO: 620 - RNA, 84 nt, Homo sapiens
caggagagaaguuucuaaaggaggcaguauagauuguugcaacuguuucuuaaacuagcugccugccuugagguuuuucuccug

SEQ ID NO: 621 - RNA, 70 nt, Homo sapiens
gaacuucuucuuuaagagacucuuaagaaaccaaguuauuaugaggagcucugagucuuaggagaaguuu

SEQ ID NO: 622 - RNA, 64 nt, Homo sapiens
gaugaagucguuuucagaaagacaguuuuguucugacuugaguguuuuuccacaugacuucauc

SEQ ID NO: 623 - RNA, 78 nt, Homo sapiens
cucauuaccugccagcuggccucuucccacaugccccccucauccugaccuguggguaccaguuggcggggugauggg

SEQ ID NO: 624 - RNA, 81 nt, Homo sapiens
cagggcugggaggggcagugggugccgggccagcagcaggccaggagguaaccauuccccaccugucccugcccagcucug

SEQ ID NO: 625 - RNA, 75 nt, Homo sapiens
aaaagauucuuccagggccugaauguccccuaccccauaggaaggucuacauuucauuccugggcagggucuuuu

SEQ ID NO: 626 - RNA, 82 nt, Homo sapiens
gucaguacguggcuucauaaagcuguaggauucugauagggaaacuaccgauuccaugugcuuuggaagccaaugugcugau

SEQ ID NO: 627 - RNA, 62 nt, Homo sapiens
acccacuucuacuucuguuaucgcugguuccugcuggauuuuaagagagguaagaagugggu

SEQ ID NO: 628 - RNA, 79 nt, Homo sapiens
ccccagcuuuuucugcaagugaggaaugccugcccuuucgggccagcagggauuccucacccucagggcagggcugggg

SEQ ID NO: 629 - RNA, 73 nt, Homo sapiens
aauccuguggccauguguggucauuucaguuucuuuguuuccagcuuggccacacccaauggaucauaggguu

SEQ ID NO: 630 - RNA, 65 nt, Homo sapiens
gagaaacacaagagcaaggugcugaggcaaaaaacaccugagguagcuuuuucuguguguuuuuc

SEQ ID NO: 631 - RNA, 67 nt, Homo sapiens
gaagcugggggcaacaccugaauacuuuugccggaaugggcugggcggguaccugcacuccagcuuc

SEQ ID NO: 632 - RNA, 73 nt, Homo sapiens
aaggucugugcucaugaccacuggguggaacccuucucaacaugguacccguggucccagagucacaggccuu

SEQ ID NO: 633 - RNA, 79 nt, Homo sapiens
uuaacuguaaucacaugugacacaugugauuacauguuaugugaaauguaaucacgugucacauaugacuuauaguuaa

SEQ ID NO: 634 - RNA, 155 nt, Homo sapiens
cagcagagagcaccaucaggucuguggggaccgauuagcgagguggcucucuguguccuauauacuauaugccacuucagugguuacaguaacacauaggacauggagaagugaaaacuuugauucauaaaaggaccccaugugacucucugcug

SEQ ID NO: 635 - RNA, 69 nt, Homo sapiens
uggggauggaggaugggguuggcaugagaaggcaagguccuaucagauuaacccuaccauccaucccca

SEQ ID NO: 636 - RNA, 70 nt, Homo sapiens
aauguuuugcugaaugcugugucuccaaugccuagaaagagcguggugcacaguagacgugugaaauauu

SEQ ID NO: 637 - RNA, 69 nt, Homo sapiens
agauacugaaucagugaaugguuuuuggcauugcuaaguuguuccacuggccauuggauuucaguaucu

SEQ ID NO: 638 - RNA, 83 nt, Homo sapiens
uuccucccuucuguauaccuuuuaaaacaagccaaucggccgugcaugguggcuuguuuucaaagguguaggaaagggaggaa

SEQ ID NO: 639 - RNA, 98 nt, Homo sapiens
gacugacuuaccggugccuccuagccuuuguucugccucucacgcugacaucagggaagcagugauguagaauaaagcaggggugggcuagguuaguc

SEQ ID NO: 640 - RNA, 119 nt, Homo sapiens
gaccuuugcucuuuauuauaucggacaggucaguuugcaaguuuguuggguuggggcaacuuuucugaaucagacucauguacugauaaauucugcacuugguggaggaggcaaagguu

SEQ ID NO: 641 - RNA, 67 nt, Homo sapiens
gcuccaggcagccaggucuucccugugucaacaaggggaaggaaagcagcuuggcccugucuggggc

SEQ ID NO: 642 - RNA, 71 nt, Homo sapiens
uccuucaagccauggcucaggacagucaguacuucuaagggguuuucuguccuuccaugauguuuggggga

SEQ ID NO: 643 - RNA, 71 nt, Homo sapiens
cagggcugccgccagccucacucaucacacagaauuaguggguaugugagugcuguggcauggcagcucug

SEQ ID NO: 644 - RNA, 72 nt, Homo sapiens
cuuccuccuuguguauuggcaggggauugcaggcugccugccucugcuuugccaaagcacugagggaggagg

SEQ ID NO: 645 - RNA, 72 nt, Homo sapiens
guggguagguagguaguuguguggaugggugaguaaucuaucccuaaccacugcuauucuuaaccugccuac

SEQ ID NO: 646 - RNA, 58 nt, Homo sapiens
ggagguaggaaggagcccugcacaggaggcuugacacaugggcccuauuccugccucc

SEQ ID NO: 647 - RNA, 105 nt, Homo sapiens
agcaccacucagcgccaucucaccucccugagccaugcugccaucacccuucgccuccaugugaaguguggcucagggagaugagaugaggcugagaguggugcu

SEQ ID NO: 648 - RNA, 66 nt, Homo sapiens
gaaugucugugcagccuuggaaaaccugcguuaacaguggaguccuaggcugcuccauggauauuc

SEQ ID NO: 649 - RNA, 92 nt, Homo sapiens
augugugugggugggcguguauuguguguuuauauaguauacucccgauauauauaugcacacauauauacuugcccauuaucugcacauau

SEQ ID NO: 650 - RNA, 92 nt, Homo sapiens
augugugugggugggcguguauuguguguuuauauaguguacucccgauauauauaugcacacauauauacuugcccauuaucugcacauau

SEQ ID NO: 651 - RNA, 84 nt, Homo sapiens
gucauuugcuuuuccucucucccaccugaagcccugaguaagcucagaggguugagggugggagugggaaaccaggcaggugac

SEQ ID NO: 652 - RNA, 55 nt, Homo sapiens
ucccagcagugccaucugguuguugcugucuagucagcuggccuggcugcuggga

SEQ ID NO: 653 - RNA, 80 nt, Homo sapiens
cugggacucccuuucuugugggcagauggggccagauguucaggucaggcuucugccacgagagggaaguggggucccag

SEQ ID NO: 654 - RNA, 171 nt, Homo sapiens
gcacaggagcagggcuuuccaaacggcacggaugacgggaucuuuggaugacugugccgugugauuuauucugggauuuacuagcuggcuuguaaaucccaggaagaguagacaggcuuucuuaagucuaacuuaaucccagugcaugaaagccacugugagcuccugugu

SEQ ID NO: 655 - RNA, 87 nt, Homo sapiens
cuuagugcuaacuuuuccaagcacuaaagggucuccuucuuuugaggacucacagguguauggaaaaguaagaagccuagcacuaag

SEQ ID NO: 656 - RNA, 88 nt, Homo sapiens
auauggagccccuucuucucucagcucuuuugacccaaccaauauguaggucugggggcgaggaaggaggagaguguaggcuucaugu

SEQ ID NO: 657 - RNA, 81 nt, Homo sapiens
guauuuuguaagauuggaggggucugauuuguugaggagaggggaauaaacaaaucagacuccuccaauccuacaaaaugc

SEQ ID NO: 658 - RNA, 89 nt, Homo sapiens
ucagucaucuaugacaucuagagcagugaagaagaacaagagauuuagaguaguucuucuucacuacucuagaugucagagaugacuga

SEQ ID NO: 659 - RNA, 67 nt, Homo sapiens
gauuuaagacaugaagauuuacagcuugauaaaccagcuucaggagguaggucuucagucuugaguc

SEQ ID NO: 660 - RNA, 67 nt, Homo sapiens
auauuaguuaauauagcuucaccuaauacuagucagaaguauuaagugaagcuaugauaacuaguau

SEQ ID NO: 661 - RNA, 118 nt, Homo sapiens
ugauguggagagaggucuuccgagcuaaagucagugcacauggucuacaccacguguagugcggugugguguagacaaugugcacggaccuuggcucagaagaccucccuccacauca

SEQ ID NO: 662 - RNA, 67 nt, Homo sapiens
gggucucauuaggaggaggcugucagaugagcucagcgucuggugggucauuccuccaaugagaucu

SEQ ID NO: 663 - RNA, 79 nt, Homo sapiens
cgguccccagagggggcagcucuaacccuaaacaagugcucaacccuugaaugggccuggauggcuccccuggggacug

SEQ ID NO: 664 - RNA, 95 nt, Homo sapiens
ugacauauguaaaaacacaggacuaugcuuggcacacaguaccauaagacuuugugcuaugugccaagcacaguccuauguuuucacauauguua

SEQ ID NO: 665 - RNA, 109 nt, Homo sapiens
uuuuauuaauauaguuuuaaguggauuuuuugggucuguuugauugcuuuugggcagaagcaguuuaacaggggacuagaaaaacuacuaucugaacuaguuaaugaaa

SEQ ID NO: 666 - RNA, 126 nt, Homo sapiens
gaccuuuucaauauucuguuauuagaugggcuggccauuucaacuuccuccugaacaaaguaucuucaacaugugcugaagagggagaauggccaguuaaucagaacaccgaaugcugaaaagguc

SEQ ID NO: 667 - RNA, 107 nt, Homo sapiens
gcauauauccauuaccaccauaaauucugggagcaaagacuaaacuaagcugguggcgaugaguucagccugugcucccagaauguauggggguaagggauauaugc

SEQ ID NO: 668 - RNA, 57 nt, Homo sapiens
uccacccccaagccucuugguaggaacugcaucauauuuaaugaggcugggggugga

SEQ ID NO: 669 - RNA, 70 nt, Homo sapiens
uucuggggacacucccugguccagccaccacaucaggaaggcagcuauuucagaaggagaguccucagga

SEQ ID NO: 670 - RNA, 110 nt, Homo sapiens
caaucugcuaacaauaacaguacaaaugacuggguaacaguauuagagauauugcgguacaccucuaauaccuauacccagucauuugcacagucauugcuagcagauug

SEQ ID NO: 671 - RNA, 77 nt, Homo sapiens
ggcuuaauggacaguacaagucagugaggcaaaaaugggccaauuugcucucauugauuuucacugcccauugagcu

SEQ ID NO: 672 - RNA, 85 nt, Homo sapiens
ccugggggucacugccaggccuuuguccuggcguuuauggcaugcacagugccugggcuccaggacagggugcggggcccccggg

SEQ ID NO: 673 - RNA, 59 nt, Homo sapiens
cucacauacaagagaugguggaucuuguggcccagaaguaccacuucuuugugugugag

SEQ ID NO: 674 - RNA, 62 nt, Homo sapiens
uacuuguuauagaauuucaggugguagguaacaaagccugccucguuuauucauaacaagug

SEQ ID NO: 675 - RNA, 63 nt, Homo sapiens
agggucugggauuccaguucacggaugccccagguaccauggguggacagaggcccagacccu

SEQ ID NO: 676 - RNA, 126 nt, Homo sapiens
cuuaccucugaauccccacaaagcccucagcacaaugccuggcacauagcaggcacucaacaaauauuuacugagugcuugcuaggugccaagcacugaucugggugcugcagauacagaggugag

SEQ ID NO: 677 - RNA, 71 nt, Homo sapiens
cagagccagaagcaagggccaaagucuucucugaguugucaagauggacuuggacucuggcucuggcucug

SEQ ID NO: 678 - RNA, 103 nt, Homo sapiens
gccauguguuaguaaagggaauuuucagcauugcuaauccacauagcaacagguuggccauguggauuaacaaugacggaaauuaccuucaugaacacauggc

SEQ ID NO: 679 - RNA, 56 nt, Homo sapiens
cucaaaacugaggggcauuuucugugguuugaaaggaaagugcacccaguuuuggg

SEQ ID NO: 680 - RNA, 64 nt, Homo sapiens
uuggauggggaggggcccaggcugagccgaggaggcuggagagccuggagugccccccauccaa

SEQ ID NO: 681 - RNA, 64 nt, Homo sapiens
guucugcuugauuuccccucgucuguuuuucuccaggaaguagaccagguugaccagguaggac

SEQ ID NO: 682 - RNA, 147 nt, Homo sapiens
uuguggugauauggucaugguuuacgaaaacaauaauccguaagaaauaggucauuaacaguaguuaacguuuacuugugaucuaugguaaugacugauuucuuugggauuacugcaguuauaaaccauaauuacagauuauuacag

SEQ ID NO: 683 - RNA, 177 nt, Homo sapiens
guucugcuagaggcuggcugagagaccugggacagucccuugcccauaguccugaccagugcccuucucugagguucuugugaugcaccaaugagaugagacaccugagaugaaggcauuuggcaaggugggcagggggucugugaggccucugggucagccacaggcuggcaggau

SEQ ID NO: 684 - RNA, 108 nt, Homo sapiens
uuagguuucuauccugcuuugaggaaagauuucagucagcugugauguauauggaauagcagaguggaacuugucucuuuuucagagcauggggcuuagggaaccuga

SEQ ID NO: 685 - RNA, 88 nt, Homo sapiens
uucuacagguaaggcuuguccguauucccucuucucucaccucuggggaggaauggggaguuggguagggcugauggagcuuguagaa

SEQ ID NO: 686 - RNA, 85 nt, Homo sapiens
ugugggagcuaaguagaaaugcagaaccugauuuaggggacacagcauugagccucagguucuacaauucuaccagguucucaua

SEQ ID NO: 687 - RNA, 66 nt, Homo sapiens
ugcugaucucaacuuuucacuggggaccacuaagaagccuuucagaagaaaagaccgggaucagca

SEQ ID NO: 688 - RNA, 80 nt, Homo sapiens
aagcaucugaaaaacaugcaaauuguuugaaaaccuugcauggcaaauucagacaguuugcaagcgucaaucagauguuu

SEQ ID NO: 689 - RNA, 148 nt, Homo sapiens
caugaaauauaacauuuugaguggaagaaacaucucaaaucaugcugacagcauuuucacuauuagcggcaaacaaaucaacuauaauuaaaaugcugucaaagugauuugagauuuuucucacacuuucaaaguuccauauuucaug

SEQ ID NO: 690 - RNA, 97 nt, Homo sapiens
uuucugcagcaacaguaaaauacucugaucuuacugcuuauuggccaaagaguugcagcaauaagaugagaauagagaugauuaugggcugcagagg

SEQ ID NO: 691 - RNA, 109 nt, Homo sapiens
gcguuuccugaaucguggccuggugaaacagcuuagcuucugcagagcucgagagaaagaacggauuugguuuugcagagguuaaggcugaggcggcagcaggagaugu

SEQ ID NO: 692 - RNA, 107 nt, Homo sapiens
acaaaacagcaauucagaauagacucucuuuuaauauaguaauguggauaggcuuuccugggcuagcgguauuaggaaugagggcuaauuaguaauggcuguuuugu

SEQ ID NO: 693 - RNA, 113 nt, Homo sapiens
uauuuuacagacuacaaauaaccuuguaauuaaacugaaaacaaauaauugccaagaaacaauuaucauuuaauuaaagaguaauuacaugguuauucgugcccuguaaaaua

SEQ ID NO: 694 - RNA, 171 nt, Homo sapiens
uuuauaaugaacagaacaaaaacguuccaacacacauguucauuacuauuuucugaaggcauaaugucaaaguaaaaauuuuucuguuacacugaauuuuauuuuggcauuaugccaucaaaauauaauaaagaacauguguuggaaacuccuugcuuuacucauuauaaa

SEQ ID NO: 695 - RNA, 121 nt, Homo sapiens
gggaagagaaacaggauggcuggguggauggguguguauucggggaucaaugggugggccucugaaaauaggccuguccccgaaucccagccuguuuuuuccaguuaacacuucucuuccu

SEQ ID NO: 696 - RNA, 73 nt, Homo sapiens
ugauguauggaccaaaugauguaauaaaacugaaguugggaaugcauccagccccaucauuucccauauauca

SEQ ID NO: 697 - RNA, 69 nt, Homo sapiens
cuuguacuacagguuguuggaguacuccuagaucacuguuucauaguagccagcaauaaguagugcaag

SEQ ID NO: 698 - RNA, 66 nt, Homo sapiens
ucuaggucuuagauagcuuguccuggggcuccggcuugcugcggggagagcugugcggggcuugga

SEQ ID NO: 699 - RNA, 65 nt, Homo sapiens
gugacccucuagagggaagcacuuucuguugaaagaaaagaacaugcauccuuucagaggguuac

SEQ ID NO: 700 - RNA, 67 nt, Homo sapiens
uuccauaugcagaugugaaacagauaaaguucuuucccacuugauucuguugacauggcauguggaa

SEQ ID NO: 701 - RNA, 69 nt, Homo sapiens
agagguugagagcauggauucuggagucccacaaacccgacuccugccuugaguccugacucagccuuu

SEQ ID NO: 702 - RNA, 78 nt, Homo sapiens
gacucauuccagagcccaguucgugucaggggccaagggccaggcccccggcauagaaacugggccgaggaguggguc

SEQ ID NO: 703 - RNA, 78 nt, Homo sapiens; identical to SEQ ID NO: 702

SEQ ID NO: 704 - RNA, 88 nt, Homo sapiens
ucuaccaucaagagaguggggagcagaugaaacccaauuugacugaaucucuguguaaugggcugcucugcacucaacugauggugga

SEQ ID NO: 705 - RNA, 55 nt, Homo sapiens
gggagcagcuagaggggguccuggcaggcucgaggggccucccggagcugcuccc

SEQ ID NO: 706 - RNA, 91 nt, Homo sapiens
ucugggagagagcagggggcuccucccuggggcccagcgggaccucaguuucacgggagucucagagagccaagcccccuccucucccaga

SEQ ID NO: 707 - RNA, 56 nt, Homo sapiens
gaucucagacagguggacaggggucuggacgaggcuuacuguuugggucugagguc

SEQ ID NO: 708 - RNA, 82 nt, Homo sapiens
cacgggggcuaggccccaagucuggggggucccugccgccagcgguguucugggagcuccugggccugguggagcccccgug

SEQ ID NO: 709 - RNA, 90 nt, Homo sapiens
acgauuuggcaggucagucaaugggaaaugaugcacaguuugcugaaauugaucacacuucauuucccaucaauuguaaagccaaauugu

SEQ ID NO: 710 - RNA, 76 nt, Homo sapiens
uggcagcuguaguuugcuggugcucuaaacaaguguuuaaucugucaacuggguacauuagcacugaugguugcca

SEQ ID NO: 711 - RNA, 68 nt, Homo sapiens
caguggagagauaagacugguaauuaaggaggaguuauugugcuaaagcuggucuucccuuuccacug

SEQ ID NO: 712 - RNA, 56 nt, Homo sapiens
auucccuuucauguggcugccugugaucucuccaggcggcucugccgaaggggggu

SEQ ID NO: 713 - RNA, 176 nt, Homo sapiens
aaacagguguauccaugagguaaugaaaugcagguugcuccucugcuacagugguguggagggucauguucaggaucacagguagaaacugucucugugcagaaugauccuuuccacccagugguacaauugcagcuguggguugagagaaagccgcaugguuugagcacuuguuu

SEQ ID NO: 714 - RNA, 106 nt, Homo sapiens
uagucuuucaaucaugaaugcucacuaacaguccaacgggaauggcucuaugggaacaguuaaguaaaccuuggacugcagugugcauucaguuaguggaggauua

SEQ ID NO: 715 - RNA, 62 nt, Homo sapiens
cucuuguuuuauuugaggaacagacagaugguuccacuguuguuuuccuugcaagacaaggg

SEQ ID NO: 716 - RNA, 89 nt, Homo sapiens
ucagucaucucugacaucuagaguagugaagaagaacuacucuaaaucucuuguucuucuucacugcucuagaugucauagaugacuga

SEQ ID NO: 717 - RNA, 130 nt, Homo sapiens
ggauaucucccugaggucacugucuugucacauuuuucuauaugaacucuauuuaaaaauaguuucaauaaaggugaaauggcguucuuauagaagaaugugauaaaacagugaccucaaggagauaucc

SEQ ID NO: 718 - RNA, 70 nt, Homo sapiens
aggcgaagggcaggaggguuggacaugaagccacaaagcuacucggguuccuccuucuucucuuuugccu

SEQ ID NO: 719 - RNA, 60 nt, Homo sapiens
gucgucuucccugcccaaggcuguguugugacggcggcaugucugggcaagggagauggc

SEQ ID NO: 720 - RNA, 98 nt, Homo sapiens
auacucugaaccccaagaaguguccuuuugggggaccuugauuuucccucugguauaacuaagacccucaaaaggacucuccuugggauucagaguau

SEQ ID NO: 721 - RNA, 105 nt, Homo sapiens
gguuuuuaugcugagagagcaaucuugaaggagugauauuuguuguugauucagaaaauuuaaccacaaacaugucccuuugagaacauucucaacaugaaaacc

SEQ ID NO: 722 - RNA, 66 nt, Homo sapiens
cuuggggguacaauuagccucuggcgccuuuagaaugaguugcuggugacuaauuaugcccucaag

SEQ ID NO: 723 - RNA, 97 nt, Homo sapiens
aagaauaacacagagaacucccuauaucccagauuaaccaauuuucaauguuauuuuugucauauuugggguauggggagaucuuuuuguuguuuuu

SEQ ID NO: 724 - RNA, 76 nt, Homo sapiens
ugauucaggccaagaaagcacuuuugccucauuaauuggguguuaaccggugaauguggguuuuuagucugaauua

SEQ ID NO: 725 - RNA, 72 nt, Homo sapiens
cugccugccgccucuguuauuauaaguuggcagcagggcauggaaacuuacgagaccagagccggcaggcag

SEQ ID NO: 726 - RNA, 109 nt, Homo sapiens
gauggauuaccaagcucugcaucaaucaauagggcuuuuaugguuauauuuguggugguuuguaauaagaucaggcccugaagauugauguggaaguuuguaauccauc

SEQ ID NO: 727 - RNA, 81 nt, Homo sapiens
acagagccaacagaccuggcaucuugaaagucuuguucucugcugaaugucuguuuucuuguguuaguuuauuggcuuugu

SEQ ID NO: 728 - RNA, 65 nt, Homo sapiens
auuagguaugcagccuauuugccagggugaguuaucuccucuuagaguuugguuauauaccuagu

SEQ ID NO: 729 - RNA, 72 nt, Homo sapiens
ccucuuacuucuucagggcuuccauuuucccuucuggguaggaguacaaggaaggcugagaaaagugagagg

SEQ ID NO: 730 - RNA, 87 nt, Homo sapiens
auggggaaggccagaggaggggaagguuauaugagugaacacgagcauuguuccuaaaguuauuuccuuucuccugcccuuucccau

SEQ ID NO: 731 - RNA, 144 nt, Homo sapiens
ugagagagagcaaacgugagacgaacauaagcauguacuaugagagccuauauucauuaaagaaagauucuggggcuguuuguugucccaggauaaugaguaauaggugauagauacagagcugucauccuuuucucucuuuua

SEQ ID NO: 732 - RNA, 77 nt, Homo sapiens
uccauuccaucccagaucccagccugcagaauaaagauaacuaaacucugacagguugggauauggaauggaaugga

SEQ ID NO: 733 - RNA, 67 nt, Homo sapiens
uaaauaauuccuaggcaauauuuagaauggcugcaagccauuuuuagaauuggcugagaauuauuua

SEQ ID NO: 734 - RNA, 91 nt, Homo sapiens
cugaccguggcgguucaaaugaagaguucagugauggcagccggagaggaacaaaguuacugaccucauccuugaaacccaccaugguuag

SEQ ID NO: 735 - RNA, 73 nt, Homo sapiens
gcuuggaaggcgauggggaaauguaggcacuuggaagaaguugcgcugcuguuucugcaccucccuuccaagu

SEQ ID NO: 736 - RNA, 77 nt, Homo sapiens
gccaagggagcucagcagggugaaggggauuugcagacaacugcucuaucuccuuccucugccacgacuuccuuggu

SEQ ID NO: 737 - RNA, 96 nt, Homo sapiens
cuuccuaaucccuaaacuaagcucagggaggcauuugucaucucugccuggcucagaugagaugcucugcccugaguacuaugagagauugggaag

SEQ ID NO: 738 - RNA, 76 nt, Homo sapiens
gggguggccccccuuccccgguguacauauuguaucuauguaacguuuuguauauuccagaggguagggccgcccc

SEQ ID NO: 739 - RNA, 159 nt, Homo sapiens
aacuuucuccccaccaugucuuuucauuucucucugggcucuugucucagucuuagcccugaaccucucacuuaaaggaugagcuagagaggugggggaagagaugagauuuucaaaggaugcaggagaaaauggggcuggcuggugaagggggagguu

SEQ ID NO: 740 - RNA, 115 nt, Homo sapiens
ugagcuccuuccucuuuuucccagagaugagacuaacaaucguugguaugaggguuuaaccacaugacuguugucugucuuuaggauaaaggaagcaaagagaacaaggagcuua

SEQ ID NO: 741 - RNA, 120 nt, Homo sapiens
gugggguaguccucuggcuucucugggccugguuuccccuuuuuuuguguacuaagggagcuacauggaagaggggaggcucaggaauggaguagagggucagggccuuagcugccccau

SEQ ID NO: 742 - RNA, 80 nt, Homo sapiens
ggcaggcagccagaggggccuggcacugagcuggcacggaggagaacggcccugcuggcccaggccccuugcugucuguc

SEQ ID NO: 743 - RNA, 77 nt, Homo sapiens
aaacauucuucacaggugaguuuguguuccuuuucucuuguuucuagagaacaugagcucccugaaagagaauguuu

SEQ ID NO: 744 - RNA, 57 nt, Homo sapiens
ugugugauugcaggagauguggcuguagacaaagccugccuccccaucaguuauaca

SEQ ID NO: 745 - RNA, 74 nt, Homo sapiens
gcaguuuugacaauaauaauagaugaguguuuugugaaaauagguuacagguuuaucauuaauauuaaagcugc

SEQ ID NO: 746 - RNA, 77 nt, Homo sapiens
aucugcuuuucaaucagcucaauggaauucaaucaacuccaacaguuaaaaggauucauugauugaaaagagcagau

SEQ ID NO: 747 - RNA, 114 nt, Homo sapiens
ucaacaacaacaaaaaugggaauuaaccgauuccuucuaaaagcugaaggcuccuuggcaguggauauugacccuucaacuuuuagaaggaaucaguuaauuuuuuguuguuga

SEQ ID NO: 748 - RNA, 70 nt, Homo sapiens
cuuucuuuuucaauauucugaaauagacaaggacuuuggucuuugacuaauuucagaguuaaagagaagg

SEQ ID NO: 749 - RNA, 72 nt, Homo sapiens
cucuugauuacaauuuaaaagcauagguggcacucuagaaagccaccuaugccuuuugaccauaaucaagag

SEQ ID NO: 750 - RNA, 114 nt, Homo sapiens
ucugcaaguccacggccaggcugauggagccaguuuugaggcagcuuaagauuuucccuuuccauggccagaucuguuuuaaauugaaucuuccagcuggucccgauuugcaga

SEQ ID NO: 751 - RNA, 99 nt, Homo sapiens
uuucuggaauccugaagcuuaauuuuugcuacaggcuauccucucuuaaaaggaacuuggaaagaaaauaagcagaaauuggcucucacauuccagaaa

SEQ ID NO: 752 - RNA, 120 nt, Homo sapiens
uuuccagagcccaguccuucuuugguauuuaaaacguggauauuccuucuauguuuacgugauuccugguuaaucauagaggaaaauccauguuuucaguaucaaaugcugcuuuggaaa

SEQ ID NO: 753 - RNA, 90 nt, Homo sapiens
gugcuuuuugccauccuccccacuccucccaccacccagcauuucccaggaugaaagggugggaagguagggaggagagacaaggagcau

SEQ ID NO: 754 - RNA, 73 nt, Homo sapiens
aaggagggcuccaaagucggggcggguugccugggucccagcugggcccugcucuggacuccuggcucuccuu

SEQ ID NO: 755 - RNA, 67 nt, Homo sapiens
cugcucuauaccuggguuuguuccugugugaaaaugggauaaaagcuguacaaaccuuauaggguag

SEQ ID NO: 756 - RNA, 94 nt, Homo sapiens
gcacaaggugccugggcaguugcuuugagauuuacauuagaaaauggcuacuguaucuaaguaaaaucucagagugugccaauacaccuugugu

SEQ ID NO: 757 - RNA, 56 nt, Homo sapiens
ugcuuccuccccuuagaaagucauuuuagcauuagauuuucccuaaggaggaagca

SEQ ID NO: 758 - RNA, 58 nt, Homo sapiens
gccugauuucccuuagggccccuacuguggaugguggggaucugccuagaagucaggc

SEQ ID NO: 759 - RNA, 56 nt, Homo sapiens
uuccggggcccgguagaggcgcgccaagaggaaaggaaagugcggcggcccuggaa

SEQ ID NO: 760 - RNA, 68 nt, Homo sapiens
gaauguuugccgcgacguacugaguauugcaucaauggggagguuauggaguaugucagcagacauuc

SEQ ID NO: 761 - RNA, 75 nt, Homo sapiens
uaugugcccacuuauaugcugcauauaauucugcuuaccuggaaccauuuaaguaugcauguacuuggguauaua

SEQ ID NO: 762 - RNA, 74 nt, Homo sapiens
ggagccgcugcuguggaaugaccaugaaagucuccaucauaagugauggugaauaagcauccaccaguggcucu

SEQ ID NO: 763 - RNA, 76 nt, Homo sapiens
ggucaggccccugggcgcucagcaguucugucggcaagugagcacaagaggagcugggcagccugagggucuggcc

SEQ ID NO: 764 - RNA, 68 nt, Homo sapiens
aauucuucaacucugugaugaaaggaugagcucccucugugaucaucacuuacuaggauugaagaauu

SEQ ID NO: 765 - RNA, 59 nt, Homo sapiens
ccuggucaaacuucaagcuuccuuuucuucauagggauggaaacggauauuuggccagg

SEQ ID NO: 766 - RNA, 90 nt, Homo sapiens
gauuuuaaaucugacaguuagauuacaggguaccuaagaaaaaauggcucuuucacuagguaccuaguaauuuaauucuuguuugaaauu

SEQ ID NO: 767 - RNA, 129 nt, Homo sapiens
uucuguuuugcucccugauguagccccaaaaccuagaauacaguuugauacauaauagggucccauuccaggacugcuaugugccagccuguguucuaggauacaggaauacauagguucaaagcagaa

SEQ ID NO: 768 - RNA, 140 nt, Homo sapiens
ccuucagcuccuauguucuacaccuccugcugccccuauccuuugccaccaguguucucagguccugcuggggggacagagaagaucagaggugaaggguagagauggcagaaagugggguuggagcagugggcuggagg

SEQ ID NO: 769 - RNA, 133 nt, Homo sapiens
gggauagaaacuaacgccacaacaacaggaugucauggucacugcugaguagaaaucuuuugacaaguacaaacagaccucugcuauagcacugucacauugcauuauaguuauuuguuuacuuuucugucuu

SEQ ID NO: 770 - RNA, 65 nt, Homo sapiens
agcccugggacucugaauccagcugugaugacuuggguucccagcuagaucacacucccagggcu

SEQ ID NO: 771 - RNA, 67 nt, Homo sapiens
guuauggugacucugguguguuaggaaccucuaugaaaauuuaaugacacccauaucucaccaugac

SEQ ID NO: 772 - RNA, 120 nt, Homo sapiens
guuucuuguucuccucuauauacccucagagcugauaugaguguggagauuccauucacuucaaaggaagcuucacgcuuggaucuucuccacaggggugcuuagacuaagacaagaaau

SEQ ID NO: 773 - RNA, 55 nt, Homo sapiens
aguucuucuccuuaggucccuucugcucaccaugcaaggcuaccugggaagagcu

SEQ ID NO: 774 - RNA, 73 nt, Homo sapiens
gagcccgcacgcugcucccgggauagcaggcacaggcagacgcagccccagccccgggagcaggugugggcuc

SEQ ID NO: 775 - RNA, 64 nt, Homo sapiens
uagggauaagguucugaugugcuuggcaucugccugcauagugaccguuagagacuuauucuua

SEQ ID NO: 776 - RNA, 73 nt, Homo sapiens
gggacugggggauggugggaaggcaaucuggccaggagaagcugcgggggagacucccgccauccccaguccc

SEQ ID NO: 777 - RNA, 106 nt, Homo sapiens
ccauuacuuagccucucuguuccucagcauucucuguaaaacgaugagagcuauagcaacccucuuaacaugggagugcuugaggaugaaaugagguaaguggugg

SEQ ID NO: 778 - RNA, 87 nt, Homo sapiens
uggugugguggggcagcugguguugugaaucaggccguugccaaucagagaacggcuacuucacaacaccagggccacaccacacua

SEQ ID NO: 779 - RNA, 77 nt, Homo sapiens
agcaucucuugcacucuggagacugaggacuugcuauaguggaacaagaagcagucuucggcaauggaggagaugcu

SEQ ID NO: 780 - RNA, 145 nt, Homo sapiens
auugcaguagggcucuaaucccacagcuauuugagcugucagccagggccaguccugaggguuccccucaccuagaccccagguacuccgggccugguccucagcucacuuccaugauggggguggguaggugcacugcugcaau

SEQ ID NO: 781 - RNA, 73 nt, Homo sapiens
gggguccucaguuuccccauccccagugcccccaugggcaaaacauucuacagauggguugggugaggaucuc

SEQ ID NO: 782 - RNA, 68 nt, Homo sapiens
acaaguuauugguuuaauuauagaaagcugaacuuucaucuuucuuuaauugagcauggauaauuugu

SEQ ID NO: 783 - RNA, 59 nt, Homo sapiens
aggagguagggaggggucuguccuuuggucccaaaaaacaagaucucggcuugcuuccu

SEQ ID NO: 784 - RNA, 68 nt, Homo sapiens
uauuuacucugauuucggacuucaguguaagugagcccacaagcugaagucccaaacuggaguggaua

SEQ ID NO: 785 - RNA, 85 nt, Homo sapiens
uaaacuuuuugaggucaccaagguaccaugaaguaaauuauugccccacaguucuaaaugguaccuaguagccaggaagaguuua

SEQ ID NO: 786 - RNA, 94 nt, Homo sapiens
caggccggcagccggccucuccucagucgggaaggauggagcugggcagcaguacuugguguuuuuccacuugagaagaggcugugccggcuug

SEQ ID NO: 787 - RNA, 144 nt, Homo sapiens
ccagggcugggcugggguugaggccccgcgagggcagccacggccaaggagaaggggggugucucuccaucugcaugcuugccccccuuccccagggcccuagcacaaugccaaaggucggccucccauccccaccagcccugg

SEQ ID NO: 788 - RNA, 91 nt, Homo sapiens
ucagcccgccgcuccggcuugcgugaucacugcccucccuaaacacggagccggcucgggaaguggggagugggcaagcggggcgggcuga

SEQ ID NO: 789 - RNA, 84 nt, Homo sapiens
ccaggcgcagggcagccccugcccaccgcacacugcgcugccccagacccacugugcgugugacagcggcugaucugugccugg

SEQ ID NO: 790 - RNA, 79 nt, Homo sapiens
aaaaaaagggggagguuuacaauguauaguuuuuaucaccuaguuacaacuaaauauugugaacauuuucucuuuuuuu

SEQ ID NO: 791 - RNA, 67 nt, Homo sapiens
ucauuaagauggaugaaauaaccauauugacuguuuagugagcugguuauuucaguaaucuuaauga

SEQ ID NO: 792 - RNA, 115 nt, Homo sapiens
ugggggcaggggugaaggugcccauugcuuccuuaucacugggccucacuuuuuccaucugccacugguugggcuccaguccuaaggaaagggcuaucugucuugccugccccca

SEQ ID NO: 793 - RNA, 82 nt, Homo sapiens
guuuuauugggugaaugggaucaaaaaggcucagcucaccuaaguaugcugagucuuucugaucccauuccacuaauaaaau

SEQ ID NO: 794 - RNA, 129 nt, Homo sapiens
ccccaggccugugggcagagcuggccugggaggacacgggccugagggcugagcaaucccugagugagaacagguagcugaggcuggagccugugucccccaggcagcugcuaaggcccgggccugggg

SEQ ID NO: 795 - RNA, 66 nt, Homo sapiens
agguggccaggugcauaucuuggugugaggaccuucacuguaucugggaaugccuacugguuaccu

SEQ ID NO: 796 - RNA, 66 nt, Homo sapiens
agguggccaggugcauaucuuggugugaggaccuucgcuguaucugggaaugccuacugguuaccu

SEQ ID NO: 797 - RNA, 64 nt, Homo sapiens
acuuuccacuguaaauucaggcugcucuuggaucuguuaaugagucugggugcaaguggagggu

SEQ ID NO: 798 - RNA, 65 nt, Homo sapiens
agauagcuggguguagggggcuuuugaauggaugcacucauuucugcccccuggucuagcuaucu

SEQ ID NO: 799 - RNA, 136 nt, Homo sapiens
ucucccaccagugaccuguuuugugauuccuccgaguuuuucagucucaguauuauugacauuuggacuagauaugugaauaguguugagauugagaagcucagagaaauaauaaaacagaguggguggugggaga

SEQ ID NO: 800 - RNA, 165 nt, Homo sapiens
gcucaguggugugguggccaggggaugggcagugguuggguaaggccgggccuggagggagggaggaagggccuuauuggacugaaucugaaggccccuccuccugggcccucccaggcaugcgcuccacuguacagcuggcgcacagagaaggagccacugagc

SEQ ID NO: 801 - RNA, 120 nt, Homo sapiens
uccagagccuguggagcucacuuuagcaggcacacaauaaauguuugcugaugagucauucauuuauucaucuaauaaacauuuacugaggccuacuaaugugccaggcugggcucugga

SEQ ID NO: 802 - RNA, 55 nt, Homo sapiens
gugagcguggguuggggacugggugagaggucucccagauuccugccaugcuugc

SEQ ID NO: 803 - RNA, 116 nt, Homo sapiens
uuucuuccugugguguuaaguacuauuguucaguuuauuacucccucccuacccuccuuuguaccuuugguuuaggguagaagcuaaacaauaguacuugacaucccaggaagaaa

SEQ ID NO: 804 - RNA, 97 nt, Homo sapiens
caugccagggugagguaguaaguuguauuguugugggguagggauauuaggccccaauuagaagauaacuauacaacuuacuacuuucccuggugug

SEQ ID NO: 805 - RNA, 66 nt, Homo sapiens
uuucucaaauuaaaucaagacuauuuagcuauguagggauaaaagaaucuugauuuguuugagaaa

SEQ ID NO: 806 - RNA, 80 nt, Homo sapiens
ucagguuuuauguucaguacuuaugggcauguuuuuauguuuccccaaaauaugucuggaguuacugagcugaagccuga

SEQ ID NO: 807 - RNA, 111 nt, Homo sapiens
ccagcaggccuggauaaaauguuucuguucauuugccucggcucugagccaccagccucagaguggaaggaaaaagagcagauucuggggguguuuugucuggcuugcugg

SEQ ID NO: 808 - RNA, 73 nt, Homo sapiens
uaggcugggcuggggcugcacugagaaaucccaccauguggcuggaguaggaguuuagucucuguccagccug

SEQ ID NO: 809 - RNA, 90 nt, Homo sapiens
ccucaucuccucucugggcacuggccuauugucaggcugcuccuugcgaaaggaaagacaggccuccagugugcuaggguggggaugggg

SEQ ID NO: 810 - RNA, 56 nt, Homo sapiens
gaggggucucugccucuacccaggacucuuucaugaccaggaggcugaggccccuc

SEQ ID NO: 811 - RNA, 66 nt, Homo sapiens
uggggcugccuccaccacaaucagaagcaggcagggcacuguucucaucaugguggggcagcccca

SEQ ID NO: 812 - RNA, 85 nt, Homo sapiens
agaauagcacuaguuaauuuuaucuauuuaugaauacacauccuuaugucuucuuuauaaauaguaaugcuaacugugcuguucu

SEQ ID NO: 813 - RNA, 77 nt, Homo sapiens
agagggaggaugaagccgagaguugaguggccuucaagcucccucugguugcucauaccuuguuucuuucuccuucu

SEQ ID NO: 814 - RNA, 77 nt, Homo sapiens
gcccuucugcugccgaggcuucuagcaggauccagaggaaaauuccucuggccugaaggcugcggccgcggaggggc

SEQ ID NO: 815 - RNA, 62 nt, Homo sapiens
ggguuggaggucucuguggugguggaggagcuaucaucaucagccaaagaguccuucagcuc

SEQ ID NO: 816 - RNA, 78 nt, Homo sapiens
cucagugccauagacuacgcucacacuagaccccagccuucuccugggcccugugugaagguagcucuuggcacuggg

SEQ ID NO: 817 - RNA, 72 nt, Homo sapiens
gaggguagguucuguugguugaaauggaaaauccuaaaaaagagguccuugcacuaauuaguaccuacccuu

SEQ ID NO: 818 - RNA, 73 nt, Homo sapiens
gauaugggagugaaggaagucaaaggaauuaguauuuuaaaauuaauucauuuaauaucucuccucccauauu

SEQ ID NO: 819 - RNA, 98 nt, Homo sapiens
guuguaggagugacguuagagcagaagaaugcggacugaagaaucuguuucucccacagguuuuucccccgcuuccuccuaucccaucuuccuauaac

SEQ ID NO: 820 - RNA, 78 nt, Homo sapiens
uggaggcaggugcgagaugagcccucugaagucuaaguugacaaggugguuuugggcacucaucuggcucugucucua

SEQ ID NO: 821 - RNA, 85 nt, Homo sapiens
agccucgggguugugagcugggggugggcagaggcuaggucagcuuggucuggggcgcccgccuugagguuugcauucuggggcu

SEQ ID NO: 822 - RNA, 55 nt, Homo sapiens
cuuguuuccauggugacagcagcuggcucacaugugugguugcuuuggaaacgag

SEQ ID NO: 823 - RNA, 78 nt, Homo sapiens
guuugauguauaaugaaugugaaaaucagccauuuaauuaaaugguacaugguacaaucacuuuguucugcauuaaac

SEQ ID NO: 824 - RNA, 67 nt, Homo sapiens
gggucagagauuucaaagggaggcaggagucccuguccuaugucucuucuuuggaccuuucugauuc

SEQ ID NO: 825 - RNA, 62 nt, Homo sapiens
cggccggaggugccauugacccugagagcaagagccaucagucugauggcuuccucuggccg

SEQ ID NO: 826 - RNA, 116 nt, Homo sapiens
gcccacucccuucaccauaacaaccauucuuuuggaguugcuuaagacuuuaauaucauuucauuaagucagcaaguucagagaagguugggggcacaaagagacugggggugggc

SEQ ID NO: 827 - RNA, 56 nt, Homo sapiens
ggggggaggcuggaaauguucugggccccaaagagcagcuuccuuugucucccucc

SEQ ID NO: 828 - RNA, 67 nt, Homo sapiens
ucauuaagauuacugaaauaaccagcucacuaaacagucaauaugguuauuucauccaucuuaauga

SEQ ID NO: 829 - RNA, 107 nt, Homo sapiens
cagacaggcuuacagaccucuccaucugucaaauaucaugcucuuugguuuggaacauauuccuugguuuggagcauuauguuugaacagauggaguggccuguuug

SEQ ID NO: 830 - RNA, 70 nt, Homo sapiens
ggggagguucuagagggacagggcaagugagaagaugcaaugcaggucaguccuguuccugaaccuuccc

SEQ ID NO: 831 - RNA, 66 nt, Homo sapiens
uguguucuccuaggucccacugaagaugugcaggugucugcacacggcgguguggaggagaauaua

SEQ ID NO: 832 - RNA, 86 nt, Homo sapiens
aagaauggauuauugaggcagaggugggaaucacauagaacauaccuaaguaugguuucuacuuuucucuuuuucuauccguucuu

SEQ ID NO: 833 - RNA, 67 nt, Homo sapiens
cuuucacuuuucagccaccuccuucuuuuacuuuggguucaagcucaagaguugguuaaagugaaag

SEQ ID NO: 834 - RNA, 72 nt, Homo sapiens
gcugguugcaucuguuuugauguuagaaucgguagucaagaaagaacauaaucaaauacaagugcagccagc

SEQ ID NO: 835 - RNA, 89 nt, Homo sapiens
gcaugugacguccaugugugccauguaugugugugaccuguauguguuacauguuacaugcaugccugccacaugcaugugucaugugc

SEQ ID NO: 836 - RNA, 77 nt, Homo sapiens
cuguggggauucagagaaggaauggauaaugaguauaaacugcauauuuacucuuuauucuuucauuauucucauag

SEQ ID NO: 837 - RNA, 65 nt, Homo sapiens
uuguacuccuuccuuccucaccaugcuguggcaugcacggccugugcugggaacuagggguacaa

SEQ ID NO: 838 - RNA, 112 nt, Homo sapiens
auguugcagaucuucugugugugcaucguggucaaaugcucagacuccugugguggcugcuuaugcaccacggauguuugagcaugugcuauggugucuacuuuugcaacau

SEQ ID NO: 839 - RNA, 73 nt, Homo sapiens
gggugggggaugggaggguggcgcgugggggaaggggcgcagccucgccgccuggcgcccucuuuccccaccc

SEQ ID NO: 840 - RNA, 73 nt, Homo sapiens
aauaugaugauguauauaagacaucuaguguaguacugcugcauagcugguaucauauaugugucauuauauu

SEQ ID NO: 841 - RNA, 84 nt, Homo sapiens
uugacuuagcuggguaguggggaacccuuccaugaggaguagaacacuccuuaugcaagauucccuucuaccuggcuggguugg

SEQ ID NO: 842 - RNA, 68 nt, Homo sapiens
uucccauccuugccccgguacaauguguagagcugauacgcccugaacucauggggugggggugggga

SEQ ID NO: 843 - RNA, 62 nt, Homo sapiens
gggcugaggcugcaguacccaccaggcgguaaugacuucucggagggagcuggcuucggcuc

SEQ ID NO: 844 - RNA, 73 nt, Homo sapiens
uuuuuggcucugagaauaaagugagggaggagaguuuuugugccuuuucacccucauuuuuuggagucaagga

SEQ ID NO: 845 - RNA, 69 nt, Homo sapiens
aauggaagguuggugguggaggacaucccaguccagugcuuuucuuuuuuuugcugcugauuuuucauu

SEQ ID NO: 846 - RNA, 64 nt, Homo sapiens
aguggaucaguggccaccacggaggagagguuccccugcccuuagcuguagcaucugauccacu

SEQ ID NO: 847 - RNA, 84 nt, Homo sapiens
ggcuucagauugcuuaaugcucgcauggcaaagccacuuacugagacuggcagccuccauuccaccaucuagugaucugaaguc

SEQ ID NO: 848 - RNA, 103 nt, Homo sapiens
gggcauuuucugaggauugaugaccagcuaggaggaguugaugguccuuggcugaaacuugggccauuaacucuagccagucauuaauugccuggaaaugucc

SEQ ID NO: 849 - RNA, 77 nt, Homo sapiens
acaguuucuuuucuuuugucguuuuucuggaucugccucaguucauuguucuuagacuugggaaggggagaagcugu

SEQ ID NO: 850 - RNA, 83 nt, Homo sapiens
cgucucccccuuugguuucuccuagccccaucugguucgcauugcacucccgcccacggcugggagggcuguugggggaggcg

SEQ ID NO: 851 - RNA, 78 nt, Homo sapiens
caauggguuguuccaguuucucuuacugauaugcaaaagcuuuguuguauauuagagaugguuacuguuaacuuauug

SEQ ID NO: 852 - RNA, 79 nt, Homo sapiens
cuuugcuuuuuuguuucuauugaaugcauuucggcuguacagcuggaaagggcauuccuauaggacuuuaaaggcaaag

SEQ ID NO: 853 - RNA, 72 nt, Homo sapiens
gggauuagggucugggcuggaaaaauccugguguuuugaauauguucagguccaguucagacucuugauccc

SEQ ID NO: 854 - RNA, 56 nt, Homo sapiens
ucuuguucucuggaaauccccuuuccugaggugcacugauuucuagcagggcagga

SEQ ID NO: 855 - RNA, 79 nt, Homo sapiens
ggaguucuuuuguucaguccgucaucauuuguugagcucuuaugauaagccaaaugcugagcugagcaaugaggauucc

SEQ ID NO: 856 - RNA, 73 nt, Homo sapiens
gauaggcuuaauuuuccugucaaauguggacuucccuuguaaacaugucaauugaggaaaguucaagcuuguc

SEQ ID NO: 857 - RNA, 65 nt, Homo sapiens
uuucuuccuuuuucuuuuuggcucuuuauuuuauuugccagugaccugaagaagaugggaagaga

SEQ ID NO: 858 - RNA, 70 nt, Homo sapiens
ggggaucuguguucagguucagaggucuguaaaucuguuucuaggucuuugcccuggauauuagaucucu

SEQ ID NO: 859 - RNA, 69 nt, Homo sapiens
gcucacucuccuuucucccaucuccaggagccauugcaccaccagagaaugaagagaggcagagugggc

SEQ ID NO: 860 - RNA, 68 nt, Homo sapiens
gccucuugaccuccugggacaguucuuccuuugggaggggcaggggucaggcaggaggcucagggggc

SEQ ID NO: 861 - RNA, 66 nt, Homo sapiens
uuuggagagggccuuaugccgcuguauuuuauaaugaaauauaaugguccagggucacuuuuuaaa

SEQ ID NO: 862 - RNA, 67 nt, Homo sapiens
uaguagauuugcaugcuuauaacauguauagacacagguguaugcuuauaauauguauaaucuacug

SEQ ID NO: 863 - RNA, 87 nt, Homo sapiens
agugggcuguuuguacauaagcuagccugccugcacauacgcugugcccuaugcagaaaggcuggccuauaugcagaucagcucacu

SEQ ID NO: 864 - RNA, 117 nt, Homo sapiens
gcuacuguugcugugguuguauuuuauuuguugaacaauccuguacuuugaaaugauucauuuaagagccaugaaacauucaaagcaggaugugugacucacauagcaaacaguagc

SEQ ID NO: 865 - RNA, 82 nt, Homo sapiens
auuuauuuuugucuguguuuucuuaccacugugguuucuccaccuaaagcaauggcugggacacacuaggcacaaaauaaau

SEQ ID NO: 866 - RNA, 66 nt, Homo sapiens
uaacacccuaagccauuaggucauuaaagagcucuuggcacuuuaccuaaaggcuucaggguguua

SEQ ID NO: 867 - RNA, 65 nt, Homo sapiens
ucugccagguggggagaggccaggcccgccucugcccccaggccugccugccccgcccuggcaga

SEQ ID NO: 868 - RNA, 67 nt, Homo sapiens
aggguuucugcaugcacugggugucacaggcugcaggugaugccucaugugcugugcugggagcccu

SEQ ID NO: 869 - RNA, 67 nt, Homo sapiens
cccccgcccgaugaagaagaucccaggguaagucuagcccuggaucucuuggguaucgggguggggg

SEQ ID NO: 870 - RNA, 67 nt, Homo sapiens; identical to SEQ ID NO: 869

SEQ ID NO: 871 - RNA, 67 nt, Homo sapiens; identical to SEQ ID NO: 869

SEQ ID NO: 872 - RNA, 67 nt, Homo sapiens; identical to SEQ ID NO: 869

SEQ ID NO: 873 - RNA, 67 nt, Homo sapiens; identical to SEQ ID NO: 869

SEQ ID NO: 874 - RNA, 67 nt, Homo sapiens; identical to SEQ ID NO: 869

SEQ ID NO: 875 - RNA, 67 nt, Homo sapiens; identical to SEQ ID NO: 869

SEQ ID NO: 876 - RNA, 67 nt, Homo sapiens; identical to SEQ ID NO: 869

SEQ ID NO: 877 - RNA, 67 nt, Homo sapiens; identical to SEQ ID NO: 869

SEQ ID NO: 878 - RNA, 67 nt, Homo sapiens; identical to SEQ ID NO: 869

SEQ ID NO: 879 - RNA, 67 nt, Homo sapiens; identical to SEQ ID NO: 869

SEQ ID NO: 880 - RNA, 67 nt, Homo sapiens; identical to SEQ ID NO: 869

SEQ ID NO: 881 - RNA, 67 nt, Homo sapiens; identical to SEQ ID NO: 869

SEQ ID NO: 882 - RNA, 67 nt, Homo sapiens; identical to SEQ ID NO: 869

SEQ ID NO: 883 - RNA, 67 nt, Homo sapiens; identical to SEQ ID NO: 869

SEQ ID NO: 884 - RNA, 78 nt, Homo sapiens
cggccuggggauaagugugccuggcuguucuagccaccugguugugaacaguacagugugcgcauaucucucaggcug

SEQ ID NO: 885 - RNA, 88 nt, Homo sapiens
guuuuguuugcaccaggccacuccauucauguauauuacaccagcaguucugccuacaugaauagagcagccucgugcaaaacagaac

SEQ ID NO: 886 - RNA, 71 nt, Homo sapiens
ggcucucaguuugcagcuugucccugaacucaggcagaugaagaacagggagggucucaggccugggagcu

SEQ ID NO: 887 - RNA, 66 nt, Homo sapiens
cgccuccauguuucagcaucuaugucaugggcuugguccuggaguggauuaaaaacaauggaggug

SEQ ID NO: 888 - RNA, 65 nt, Homo sapiens
caggcuugggucagaaggcuuguuccuuagucacauguugcuacaaguaaaugacaccaggccug

SEQ ID NO: 889 - RNA, 77 nt, Homo sapiens
agauuuauuauucuugaagauaaguaauaaccuugacuuugccuuggucaauauuuaucucaugagucgauaaaucu

SEQ ID NO: 890 - RNA, 65 nt, Homo sapiens
ggggcucuaaguguggcccaugagcuuggcuucccagagcuagggcccggucacugugggguccc

SEQ ID NO: 891 - RNA, 76 nt, Homo sapiens
ugaggagaaggcuuggaguguuccaggacagugagugguggagucuugcugggaguguucugagccuuucucuuua

SEQ ID NO: 892 - RNA, 76 nt, Homo sapiens
uugaggucaagaacuaugacaccacaauccaugggaaaaacacuguuauuggugucuuggauaucuauggcuuuga

SEQ ID NO: 893 - RNA, 66 nt, Homo sapiens
cugguguggugucgagcuaggaaauccuguguauguuagcacaguaucgucucacauucacaccag

SEQ ID NO: 894 - RNA, 59 nt, Homo sapiens
ucccuccuccuucccacugugccugaguguguauugucaaagugucaagugaggaggga

SEQ ID NO: 895 - RNA, 83 nt, Homo sapiens
uuugcugugagugauaggaaauacaggagcucuacccuugggcagcauuccaaacuugugauuuccuauaacuccacagcaga

SEQ ID NO: 896 - RNA, 78 nt, Homo sapiens
ggcaucugugaugagggccugguggcugugccggcugcucagcagauacgcagggcaugggcccugucugcaggugcc

SEQ ID NO: 897 - RNA, 72 nt, Homo sapiens
gagacugggguggggagcgaggagagcacugcuucacgcuaacagccacuuuuccuucacacuuccagucuu

SEQ ID NO: 898 - RNA, 55 nt, Homo sapiens
ugguaugcaaccucaaauauggaaaauuguuucuacuuuuaugguguguauacca

SEQ ID NO: 899 - RNA, 136 nt, Homo sapiens
cgcgcgcugcggcguucgcgacguguccaagacgcugguggggcuggagggcgcgccggccacgcggcugcgcuucaccaagugcuucaguuucgccagcguggaggccgagaacgcguaccugugccagcgcgcg

SEQ ID NO: 900 - RNA, 83 nt, Homo sapiens
cuuccucccucagcccuuccugauggcuuccuggggauucuggauucccauggggugaugagaggagagcagaugggaggagg

SEQ ID NO: 901 - RNA, 60 nt, Homo sapiens
gagaaguggagagguugaucuaaggaagaaaacauauuaggucauaggcuuccauuucuu

SEQ ID NO: 902 - RNA, 71 nt, Homo sapiens
guggggggggccagugaggcagggacacaugcaaaagaaugaccucacucugccagcuugcuccuccccac

SEQ ID NO: 903 - RNA, 66 nt, Homo sapiens
cuugcucccgcccuccgcucaugcucacuguggccccaggacgugggcgauguugcagggagcaag

SEQ ID NO: 904 - RNA, 66 nt, Homo sapiens; identical to SEQ ID NO: 903

SEQ ID NO: 905 - RNA, 66 nt, Homo sapiens; identical to SEQ ID NO: 903

SEQ ID NO: 906 - RNA, 66 nt, Homo sapiens; identical to SEQ ID NO: 903

SEQ ID NO: 907 - RNA, 66 nt, Homo sapiens; identical to SEQ ID NO: 903

SEQ ID NO: 908 - RNA, 86 nt, Homo sapiens
ucucuuacacaggcugaccgauuucuccugguguucagagucuguuuuugucuagcaccauuugaaaucgguuaugauguaggggg

SEQ ID NO: 909 - RNA, 100 nt, Homo sapiens
agggcgugcacgugggcgugugcugagauugcguuccuuacacacacagagucuguguguguacgaguacauccucaucauagccuugguggcaugcccu

SEQ ID NO: 910 - RNA, 65 nt, Homo sapiens
gggccccuucgugugccuaccugguuaugugcuuguccccauguggguaccucugaaaggggcuu

SEQ ID NO: 911 - RNA, 163 nt, Homo sapiens
uuuuuuccagauuuuaagaauuuccagauuauuccaaauuuuaugggcgaaauucugcccucaauuaugcacaugcaacuaauugcacacacauaacugaggguagaguuuggcuuuuggagcugaaaaucucuaaaguucugaauuuuuuucuuggaaaaaa

SEQ ID NO: 912 - RNA, 65 nt, Homo sapiens
gcugaggguggggcuggcucagugcccuaaggggggcucugaaggaccagcuccuuacccucagc

SEQ ID NO: 913 - RNA, 81 nt, Homo sapiens
ugugcugcuuugcggguggacgagggucuacacgcugccuucgcagagacaggcccuccuuugcccgugaauggcagcgca

SEQ ID NO: 914 - RNA, 64 nt, Homo sapiens
uccacuggugggcuguuuauuucuaauaauuugguagaaaaaaacauuggcucauaccagugga

SEQ ID NO: 915 - RNA, 141 nt, Homo sapiens
uaaacaucaguuauggggacuuuuucucugcccuucgucauuaugcagccugugaacagcgucugggaaagugguggucauugguugcauaauuugaucugaggcuuauggaggaaaggacccaagugacucugauguuua

SEQ ID NO: 916 - RNA, 141 nt, Homo sapiens
uaaacaucaguuaugaggacuuuuucucugcccuucgucaauaugcagccugugaacagcgucugggaaaguaguggucauugguugcguaauuugauuugaggcuuguggaggaaaggacccaagugacucugauguuua

SEQ ID NO: 917 - RNA, 68 nt, Homo sapiens
gccucucugggccugugucuuaggcucugcaagaucaaccgagcaaagcacacggccugcagagaggc

SEQ ID NO: 918 - RNA, 151 nt, Homo sapiens
agggaggcaaaguuccuuccaucccccggggcgcugucccugugagcucccgguguccugcacacgugggccccugagucacugggucugugugugugggauggggcuccguggccagccuguccuccugggguucacuuucugcuuuccu

SEQ ID NO: 919 - RNA, 75 nt, Homo sapiens
ccaggcggcccaggagauggccucgaccauggaggacugggaccugcaccuccgccaucuucggcagccgccugg

SEQ ID NO: 920 - RNA, 66 nt, Homo sapiens
uccccggaucauugccacgauagacccaaacaacuccagucuaucgugucaauguguauuugggga

SEQ ID NO: 921 - RNA, 64 nt, Homo sapiens
gaugagccaagaguuaugguggcaauagaucuccccugcagcugugagcucucucuggcuuauc

SEQ ID NO: 922 - RNA, 66 nt, Homo sapiens
uccuuuucauccuucccugaacuuuguaauuauaaccucaauaaaagggugggaacauggaaagga

SEQ ID NO: 923 - RNA, 71 nt, Homo sapiens
gggcuggggaggcuggaggggagauuuccuggcagcaggauccaugaccaccucucccucacccccagccc

SEQ ID NO: 924 - RNA, 67 nt, Homo sapiens
cugggggcccugguagaagcugccuguuuguguucgagcugcagccuuuucucagagcggccuccag

SEQ ID NO: 925 - RNA, 67 nt, Homo sapiens; identical to SEQ ID NO: 924

SEQ ID NO: 926 - RNA, 55 nt, Homo sapiens
cccuguggggccuggccaccccgcugauggggccggacaggcggaccccacaggg

SEQ ID NO: 927 - RNA, 129 nt, Homo sapiens
aaaauaggaauaguaugcaucucaaauacuugugaggauuaaauguucuaaauaaacucauauauaucacuuagaacauuuuaucuucaccacaaccauuugagauccauacuauuauuauucuauuuu

SEQ ID NO: 928 - RNA, 119 nt, Homo sapiens
ggaugauaacagaugucugaaaaauuuuucucuccuugauuucguggcuagccauuucaaaaagcuagugaaauuaaagaggaaaaucuuuucaaggcaaauuugggaauuuaucaucc

SEQ ID NO: 929 - RNA, 89 nt, Homo sapiens
ggcucccgggccccgcccugcuaaggcuugguguauucugggaguccugggaacagggucacagcagggcuggguaguagccggggguu

SEQ ID NO: 930 - RNA, 85 nt, Homo sapiens
agcuccagagagggaaggaauggggagagagcuggcccagugggcagcuguuuucugccuguccucccuccuguauucuggggcu

SEQ ID NO: 931 - RNA, 114 nt, Homo sapiens
ugggagcagagggcaaauuggacaucaaagaguugcuaaaggcuuuucggcuguggaaggccgaggagcugaugauucuuugaucuccacuucccccuacacacacugcuccca

SEQ ID NO: 932 - RNA, 124 nt, Homo sapiens
ggggaagguggguccagaugaggugagccaguggagagcuuaagggacugacaacuccuucuccaguccucuuccuucugaguuccuccauuggucacacuguacccuaauuaaugcuuucccu

SEQ ID NO: 933 - RNA, 86 nt, Homo sapiens
caaagacaaucuccaucgcacucuuuuuuuucuguacugacaacacaggggaaggagaaagugaagggaaauguguuuuguuuuug

SEQ ID NO: 934 - RNA, 96 nt, Homo sapiens
aagccuugugggagaaggggucaaaggaaagcaauggccaugacugaggugaugaauucuuuggcuuuucuuuuaugcaauuaacaagcagggcuu

SEQ ID NO: 935 - RNA, 78 nt, Homo sapiens
cuugcccucaaggagcucacagucuauugaguuaccuuucugacuuucccacuagauugugagcuccuggagggcagg

SEQ ID NO: 936 - RNA, 80 nt, Homo sapiens
uauuugcucaagacuaaacuguaggcucuucucuacugcacgcuguugagaagagcccacaguuuaguuuggagcaaaug

SEQ ID NO: 937 - RNA, 65 nt, Homo sapiens
gcgcacgugaugaucuggcuaggauuauuagagcucuucuguuaaagcacagaucacaugugugc

SEQ ID NO: 938 - RNA, 80 nt, Homo sapiens
gugcuaggcacucucauccauaccucuuuaucuccucccaacaacccugccaaggagauauguaugagagagccuagcac

SEQ ID NO: 939 - RNA, 68 nt, Homo sapiens
aauccugugauuuccaacauugcaaugacuaugaauucaggcagauggaauuuggagacuacaggauu

SEQ ID NO: 940 - RNA, 77 nt, Homo sapiens
auacauugaaaaauuaacugggacagugcagguaugguuugauuaucuauacucuccucauugauuucucagugugu

SEQ ID NO: 941 - RNA, 56 nt, Homo sapiens
ccuguuuucauccuacuuuuaaguaauaaauuuggcauuagugggaggggagcagg

SEQ ID NO: 942 - RNA, 76 nt, Homo sapiens
ggccugucuagggcagaccugggcauugcuggccucuaacagaugaggaaugccugggaccugcccaagacagguc

SEQ ID NO: 943 - RNA, 92 nt, Homo sapiens
auggaggacagaagugaagucaaaggcaugcugaggaaggaacucugaguggccauucacaguguguccuugacagcacuuccguucucuau

SEQ ID NO: 944 - RNA, 71 nt, Homo sapiens
aauugcuucaguuuuccuggaauugaggcaggccauaaaccuaucagugacucaagaaaauggaagcaauu

SEQ ID NO: 945 - RNA, 88 nt, Homo sapiens
ugagcaccaaggguacgucuccaccgacuugcaacacaccaagacaaauguauguugcaagucaguagagagguaccccuggugcuca

SEQ ID NO: 946 - RNA, 69 nt, Homo sapiens
auaauguauaguuuuguggucauuacuggucagauaauaaccggcagugaccuuaaaaccaugcauuau

SEQ ID NO: 947 - RNA, 74 nt, Homo sapiens
uguuuuuuuauuccacuguucauccuucaagcugauaaacagcaacaaugggaaacagcugggacaggaaaaca

SEQ ID NO: 948 - RNA, 83 nt, Homo sapiens
cugugucuaagagauaucaaaacaauugguugauugaauuuuuuauuauaugaguugacuguuuugacaucuuauagauacag

SEQ ID NO: 949 - RNA, 75 nt, Homo sapiens
cccgggcagacgugaaggcagcggggcucggggacacccaagucaaacgacccccggcccucgcgccugcccggg

SEQ ID NO: 950 - RNA, 71 nt, Homo sapiens
aacauugagaugugccuaguucuguauuuacaguuuggucuggcuguuugaguucuagcgcauuuaauguu

SEQ ID NO: 951 - RNA, 76 nt, Homo sapiens
cagauggaaacugguuucugagauggaacuuggcagugguaccuauguucccucucagaaauccagguuuuaucug

SEQ ID NO: 952 - RNA, 88 nt, Homo sapiens
cccuuuuucauccucuuugccccaucgugguugcaauacuucacgugaucuucuugcaaccauggggauaaagcaggaggagagaggg

SEQ ID NO: 953 - RNA, 118 nt, Homo sapiens
ggcagaaagaagguauuuguuguacugaauuaaauaguaauguuugcugagcaccaacuauuaggggcucaggaaacauugcuauuuaguucagugcaacaaacaccuccuuucugcc

SEQ ID NO: 954 - RNA, 76 nt, Homo sapiens
caucaggcuaugauccucaguuguguguaaaauuagggcuuucaaucuacacacaacugagcaucacagccugaug

SEQ ID NO: 955 - RNA, 84 nt, Homo sapiens
guuuuccuaagagucuuuuuaaagcuacuacuaaacagaaagaguagcucuuuaguaguagcuugaaaaaacucguaggaaaau

SEQ ID NO: 956 - RNA, 66 nt, Homo sapiens
auuggugagauagaguguagugucuggguagcuacugaaucuggggaaugcaaucuacucauuaau

SEQ ID NO: 957 - RNA, 82 nt, Homo sapiens
cuaggucuaaugaugccauuuaucuuuugaagccaccacuaugaagggccauuucaaaggauauugggggucauaggccuag

SEQ ID NO: 958 - RNA, 71 nt, Homo sapiens
cccuuccugacagcccgggcuguggcaguaggcagggcucccucccacaagcucagggccugcgggaaggg

SEQ ID NO: 959 - RNA, 174 nt, Homo sapiens
uuguaggaaaugcaugaaaaauuauuagugauaggaaaaaagaccucugggaccuuauaugucaguuauaaaagacagauuguuaaaacuauaaauuuaucucucguggaacugacauccaagguuccagagccuuuuucccuucacugaggauuuuuuacguaauuccuacag

SEQ ID NO: 960 - RNA, 107 nt, Homo sapiens
gucugagacaauaaaaaauauguagggagagaguuuugagucuugggauugaacuuuucucaaaacuuugggcuuuucuuugguguucuugugguguagucucaggc

SEQ ID NO: 961 - RNA, 69 nt, Homo sapiens
gauggagacauggaacagugugguuguuaagaaugugaucucugaagccagacuacccagguuucuauc

SEQ ID NO: 962 - RNA, 79 nt, Homo sapiens
cugccuuccaggcagggugcaggagccuuggagaaggugcuagaagcugggguuccugugccaagggcugggaaggcag

SEQ ID NO: 963 - RNA, 61 nt, Homo sapiens
acucaaauaagaaccacacagaggacuaaucuuugagaaucuguguauuuuguauuugagu

SEQ ID NO: 964 - RNA, 130 nt, Homo sapiens
ggaagaugaaaaaggagauauuaacaugacuaucuauugucuucuucaugaaaaugauggugacacaauugagcgugaagaaguaauagguggugaugucaaacguaccauucauaauuuauugucuucc

SEQ ID NO: 965 - RNA, 73 nt, Homo sapiens
aauuacuucaaacugccuuuccuguugaguagguuuugaacuaccugcuugacagaugguguuagaaguaauu

SEQ ID NO: 966 - RNA, 67 nt, Homo sapiens
uccacuccaagcauuaccaccuuugugcgauaauacaguuagcacaggcggucauugcuggaguggg

SEQ ID NO: 967 - RNA, 121 nt, Homo sapiens
ggaauucucacugccccucuuccuaauguguguucuaacacaaauucaccugugacugcauuacagaggcgaauuuauguuagaacacaugucagggagaagggugugauaggggaauucc

SEQ ID NO: 968 - RNA, 81 nt, Homo sapiens
aaaaauuauauaauuagcugacaguccugguugucccauaagcuuagacaaccaggaccuucagcuaaguacauaauuuuu

SEQ ID NO: 969 - RNA, 133 nt, Homo sapiens
ggguuucugaugagaaugguauguguauucauguaugugucauguccugacuuguuucugccucugcauguaccugcaagucagcgugugugugcaugcgugugucucacacaucccucuggcauagagaucc

SEQ ID NO: 970 - RNA, 74 nt, Homo sapiens
ccaaaauacacucagcccaggaggagcagcucuccaguacagcugucugcuccugcccugcucggguauuuugg

SEQ ID NO: 971 - RNA, 68 nt, Homo sapiens
ccacagccuagcuuggguuuacuggucucuggaaugggguggagacugguuccuaugccaggcugugg

SEQ ID NO: 972 - RNA, 76 nt, Homo sapiens
uguuuccuaaacuugucugaucguagaacucacaguauuucaggugauuuugaugaucaagcacguauggggagca

SEQ ID NO: 973 - RNA, 75 nt, Homo sapiens
ucuugugguacauauuugaugcaauaaauacugugcuuaggucauuauuuguuugcucaaacgugcaccacaggg

SEQ ID NO: 974 - RNA, 108 nt, Homo sapiens
gccgcucacagguaucuuaaucggaacuuugcagcggagacuucucaggaacaaauacuuagaaagucuccguggucaggugaugucuauggaacuccagugaguggu

SEQ ID NO: 975 - RNA, 68 nt, Homo sapiens
auuaauugcaagugguccuuguuuagggugaauuaacaaccccaacuagcaagguucuagcaauuaau

SEQ ID NO: 976 - RNA, 73 nt, Homo sapiens
uuugggucaagacccaaggagcaagcuggggaggcuucuucuccccccuugcuucuuggguuccuggcccaga

SEQ ID NO: 977 - RNA, 77 nt, Homo sapiens
ggcuuuuucaaaggaggaaagccaggguguuaaauauccuccuucauacgcucagcuuccuuccuuaaggaaaggcc

SEQ ID NO: 978 - RNA, 200 nt, Homo sapiens
ggggagaucaauaaaugagugguuaauuaauuuuauuaacgaguugguuuugcguguuggggucauuaguguucuuguaguugaaauacaacgaugguuuuucauaucauuggucgugguuguaguccgugcgagaauaaugacauaugcuuuauuuuuguuaagugugguuuuaguaaugggguuugugggguuuucuu

SEQ ID NO: 979 - RNA, 72 nt, Homo sapiens
aguagcaccaagguaaggucggcugucuccugauaucuuuucauaaugcccugcuaugccugagguguuauu

SEQ ID NO: 980 - RNA, 75 nt, Homo sapiens
cuccuucuuaccagcgcguuuucaguuucauagggaagccuuuccaugaaacuggagcgccuggaggagaagggg

SEQ ID NO: 981 - RNA, 81 nt, Homo sapiens
cugcugcccaccagaggacgggguacagccuguggcaggagcaccggccaccucacucccucccucuggguggggcagcag

SEQ ID NO: 982 - RNA, 55 nt, Homo sapiens
ucucccuucaaaugggucucguugcugaaauaacuaauccauuacagaggggagg

SEQ ID NO: 983 - RNA, 120 nt, Homo sapiens
uuccuucuuacuagcucugugacuuuggccaaguccccucaucuuucugaugucaaacagaaauggaaguuuagaaaaaugaagggacuugccuaaggucacaacuagcaagagagggaa

SEQ ID NO: 984 - RNA, 67 nt, Homo sapiens
aauuuucagaauaugggaaagggguuucacauugagaauuuccucuuucugauguagauugagaauu

SEQ ID NO: 985 - RNA, 104 nt, Homo sapiens
uucauuuucacaaaccugccuguggguuuaccacuuauaagcacugugauacucagagccuggcuuuaggugguugcacaggcagggauuuggagggaaaugaa

SEQ ID NO: 986 - RNA, 81 nt, Homo sapiens
gucacacugagcaguauaucauuucauggaggaaaaaaaaaguuuuaccaugaaaaaugcuauguuguaucacagugugac

SEQ ID NO: 987 - RNA, 121 nt, Homo sapiens
guguaucguacugccuagcuuugccugcaggagcaggugggacccccagagccugcauggacagugguggggugccagccugcccugcuagcauggaguugggugcagcgggaugguacau

SEQ ID NO: 988 - RNA, 59 nt, Homo sapiens
ggcagugucaacaguuucuaaaugcugggcaaaucuucaagugaaacugagacacuguu

SEQ ID NO: 989 - RNA, 71 nt, Homo sapiens
ugggugggaaaugaggggugaggcuuguuuuauaggauuccuaucuucaggcuccccucagauuccacuca

SEQ ID NO: 990 - RNA, 109 nt, Homo sapiens
cugggucugaaggucccugaggucccaagagaacccugccucuccugcuucuuauuuagguugcuagugagaguccuugggguucuuuggaagaagacuccaggcccag

SEQ ID NO: 991 - RNA, 75 nt, Homo sapiens
ugcuccaguaaggucuccaggacugcccaggccacaugaaggaggccagaggggcuauggagcaccacuggggua

SEQ ID NO: 992 - RNA, 59 nt, Homo sapiens
gaagggaggaaggccucucuacauauggaaaagcccaugcguggaguuccccuccuuuc

SEQ ID NO: 993 - RNA, 65 nt, Homo sapiens
ggucuuguaaauaagcugacaguaaagcuguaugguacauacuguccagcuuagcauauagggcc

SEQ ID NO: 994 - RNA, 61 nt, Homo sapiens
ggagccauuaaaggaguggagcagagauugaauuacugacuuccuuccugccaguggcucc

SEQ ID NO: 995 - RNA, 66 nt, Homo sapiens
gagugaaaaaaauuuggaggggagaacaguaagcacggugagcccauccaaaugaaguuuucauuc

SEQ ID NO: 996 - RNA, 66 nt, Homo sapiens; identical to SEQ ID NO: 995

SEQ ID NO: 997 - RNA, 68 nt, Homo sapiens
aacuuaucuaaaugguuaaaugagcauacaggucaaaaaguaugcucacuuaaccacucagauagguu

SEQ ID NO: 998 - RNA, 80 nt, Homo sapiens
uauacaggaaaaugaccuaugaauugacagacaauauagcugaguuugucugucauuucuuuaggccaauauucuguaug

SEQ ID NO: 999 - RNA, 91 nt, Homo sapiens
uggggguggaacaagcuaacauugcugaagugcucagacagugccuggcaccuagugagcacucgacaaauguuagccauccucauccuca

SEQ ID NO: 1000 - RNA, 68 nt, Homo sapiens
uauuucuagaacucuauggcuuugacgugcucauagauucuacucugaagccaugguuguuggaagug

SEQ ID NO: 1001 - RNA, 132 nt, Homo sapiens
gaauggggaaagaccaagcucugcagcgggugggccccccuuucauaugcccagaucugugcagcccagacacgccuaggcuggguaaugaaggcacacuuccuccugcugcagaacaccaacucuucauuc

SEQ ID NO: 1002 - RNA, 65 nt, Homo sapiens
aacugaauuacuucuuccauggaauaaguagacucuugucuugaucugggagagugaauucaguu

SEQ ID NO: 1003 - RNA, 58 nt, Homo sapiens
ggucuuuggacucucucuccuuccuuugcagauggaaaggcagagaggaccagagacu

SEQ ID NO: 1004 - RNA, 81 nt, Homo sapiens
gcgcggggcacgcuggucauuguaguccaguccauaugagcucccggggcacuggacuacaacucccggcaggcucugcgc

SEQ ID NO: 1005 - RNA, 66 nt, Homo sapiens
gguauauuuacaucuugagguauggggaguuacuuaagucaccauucaucaagacacaaauauacu

SEQ ID NO: 1006 - RNA, 57 nt, Homo sapiens
uuucucaucacaacccuaggguaccagguacguggugaguugggggacgaugggaga

SEQ ID NO: 1007 - RNA, 79 nt, Homo sapiens
gugugaaagacagagugugugugcugaguacaaagacacaaauuggcccgaggcucagcuacgcaugcuauuuucacau

SEQ ID NO: 1008 - RNA, 86 nt, Homo sapiens
uaggauguaacagaacauggaggcagacagacguggguucaaauuccaagucuguuccacguucgucugucccauguuacaucuua

SEQ ID NO: 1009 - RNA, 65 nt, Homo sapiens
cuuccugucaccuugcucuccuaucaacaugucauuuuguaaaaggggcagcagaagauaggaag

SEQ ID NO: 1010 - RNA, 70 nt, Homo sapiens
ggaggagagagaggcucagaguggguugcagaggaacuggugaauaaauucuugagccuucuucuucucu

SEQ ID NO: 1011 - RNA, 71 nt, Homo sapiens
auggguggaagggagaaaacuuguggcuuauuguaaaaguggccauguguuauuuucuucucucuauccau

SEQ ID NO: 1012 - RNA, 71 nt, Homo sapiens
gagugggagaggguagauuuuggaaguagucacaguugauccuauaguuccugguguaccuccucccacuc

SEQ ID NO: 1013 - RNA, 83 nt, Homo sapiens
uaacuacugagauguguaucauauauauguauguaugaaaaugacuugaaguauacguauguaucacacaguuacaguaguua

SEQ ID NO: 1014 - RNA, 56 nt, Homo sapiens
uucucucccagcucuggucuaaaguaauuuuggugcugaagggcagagggagggaa

SEQ ID NO: 1015 - RNA, 128 nt, Homo sapiens
uggguaauaagcauaggaugaggaauuugcaaauugauguguaaaugugaauaucaacgaacaaaaaauaguagccugugcauauuuacuaucaaaaugcaaauaccucacucuacacauauuaccca

SEQ ID NO: 1016 - RNA, 71 nt, Homo sapiens
auuuggucaagcugacagcuaugagcaaaaugcuacacaggaguugcuuguggcuauucuuaugaccaaau

SEQ ID NO: 1017 - RNA, 69 nt, Homo sapiens
gccaaucuuaguguaccagaguaugccauggaaucaggccaggaugagcucagguacuuagagauuggu

SEQ ID NO: 1018 - RNA, 76 nt, Homo sapiens
ucaccuugaagugucucuuguaaaagauaacucccugcauuguagaaaugucuuugacaagagaggauuaggguga

SEQ ID NO: 1019 - RNA, 65 nt, Homo sapiens
gaauuuauaauccaucuggggucucucaugugaagauauaggaaccccagauggccugugaauuu

SEQ ID NO: 1020 - RNA, 84 nt, Homo sapiens
uguguguguauggacucaggucuggccaucuguacucaucugugaauauaaguauagucagucauaccugaguccacaugcaca

SEQ ID NO: 1021 - RNA, 69 nt, Homo sapiens
auaucucucaucuuuuuauauuucaucuccacaccuuuccuuuugugggauuauggagaggagagaugu

SEQ ID NO: 1022 - RNA, 91 nt, Homo sapiens
uucaaagagauccaguuacuugcucaagacuggaaaaagugauauucacccaaauucugugacuuugagcaaguuacugaaccucuuuggg

SEQ ID NO: 1023 - RNA, 81 nt, Homo sapiens
uuuuauuucaugcacuacuuggcuuuacugauuaauaugccccauggcauucaauaaagucaggcaguggaggaaauaaga

SEQ ID NO: 1024 - RNA, 121 nt, Homo sapiens
agcuaaggaauucaaagcugagauaacaccccaucuuuaauucaugcaauuggggaaaauaaauaaaacaacaugaguuaaaaaggggggugucagucuuaaaaaucuaaacuccuuggcu

SEQ ID NO: 1025 - RNA, 92 nt, Homo sapiens
acagcaguuauuuuccauuccauuugccugcugagugagcuuccagggacuaaugccuacuucagcaaggcagaagggagguaagcugcugu

SEQ ID NO: 1026 - RNA, 96 nt, Homo sapiens
uuuuauucccucucuuuccccuauucuuauaugugcuccagcuuccccauugucccuggagcacauuuaggaauaggggaaagggauggaaugaag

SEQ ID NO: 1027 - RNA, 86 nt, Homo sapiens
cuguaaucacaucuaaagacuagacuucgcuaugaccaggccauaguaaacaucauaguaugucuagucuuuagguuugauuacag

SEQ ID NO: 1028 - RNA, 55 nt, Homo sapiens
ucaauucaacuugacaaacauuuacaaacaauaaguguuuguugaauugaauuga

SEQ ID NO: 1029 - RNA, 75 nt, Homo sapiens
guguggucccaguucagaaguguuccugaguaacuugugcuuauaacucaggacacuucugaacuuggaccauac

SEQ ID NO: 1030 - RNA, 68 nt, Homo sapiens
gauaaauggcuucucaguuucauaaugaaaggaauauuucauuuugcagagcugaggaacuguuuauu

SEQ ID NO: 1031 - RNA, 86 nt, Homo sapiens
ccuccagggcuguuccaucucuuccuagaagugcuuggagagauuagagcagcaugccugggagccagauggggcaacccuggagg

SEQ ID NO: 1032 - RNA, 69 nt, Homo sapiens
cagccucugccauguuggaauuucaaacccaaaacagcugcuuggaaggagccagcaugccagaggcug

SEQ ID NO: 1033 - RNA, 105 nt, Homo sapiens
cuaauuucacugauguaaacauuguuaaacaauuucaaaugcaacuuuggaaacauuguuucugaaccuguuuaauaauguuuaaaaaugcaucaaugaaauugg

SEQ ID NO: 1034 - RNA, 99 nt, Homo sapiens
cauucuuugcagccaguauucauuucugcuuguucugaaaucuaucccaucacuuaggauuuggaaacuagcagacaugaagauuggcuacaaagaaug

SEQ ID NO: 1035 - RNA, 85 nt, Homo sapiens
ggcacaggccgugggccgcggcgcgcgggcucgggucugacucagucccuuggcacugcgugaccuugggccugcugccugugcc

SEQ ID NO: 1036 - RNA, 75 nt, Homo sapiens
uggauaauccacucugcugacuuucaagauuauuauauuauucaauucucaggaauguugcagagugauugucca

SEQ ID NO: 1037 - RNA, 76 nt, Homo sapiens
ccgcccgcgcccucccccacucccuccagccgaagccccccccucgcguugcccggaugugggaggccgcgggcgg

SEQ ID NO: 1038 - RNA, 78 nt, Homo sapiens
cugcucuagccuaauuuuagaucuggucugcuucaguuucacuccaagcagacuugaccuacaauuagccuagagcag

SEQ ID NO: 1039 - RNA, 59 nt, Homo sapiens
caggguggacauaaauugucuguuuucucuuaucaaacagggcguuuauuuccaucuug

SEQ ID NO: 1040 - RNA, 112 nt, Homo sapiens
auuuucuugcaaacauaaagccauggguucugaaaugucuucaagucagagauugaguucacuaacuucgggacauuuuuagaaucuauggcucuauuguuuacagggaaau

SEQ ID NO: 1041 - RNA, 79 nt, Homo sapiens
cguauucucccaucauucuagaugcaaaacugccauugaauacagugggaauuuugaguuuguuugaugagagaauaug

SEQ ID NO: 1042 - RNA, 57 nt, Homo sapiens
cccuacccacucccacccuugcucugggagccuggcugggguagggacugggugggg

SEQ ID NO: 1043 - RNA, 111 nt, Homo sapiens
uuaggcuaacuggcaaacacuauugcuuuccaauucuacugugaauuagcuuacaagucuauuuaaaucaugguguaauugaaggacaacgguguuggccaauuagccuaa

SEQ ID NO: 1044 - RNA, 65 nt, Homo sapiens
ucugucucccucccucugucugcugcuggggucccauguuggcaggcaaguugggaggagaugga

SEQ ID NO: 1045 - RNA, 61 nt, Homo sapiens
gugugaggccuggguggaggccugugcacgucuucuguguguggucuuuccagccucacac

SEQ ID NO: 1046 - RNA, 56 nt, Homo sapiens
cagaauggacggugccucccuggcucaaguguccagggacagcggccuccauucug

SEQ ID NO: 1047 - RNA, 70 nt, Homo sapiens
acuuuccuccucccuuugcuuuauuuugccaagauuaugcuagaaggaaaaggcgagaggagaggagagu

SEQ ID NO: 1048 - RNA, 95 nt, Homo sapiens
gcaggcuuccuggcuuuggggucagaaaguucuagaugguaaugaaaagcugggcccuucuuagauuaacuguuccugaaacuccagaagccugu

SEQ ID NO: 1049 - RNA, 98 nt, Homo sapiens
caguguuugcuguuacuggugcugcugucaucacugcuaaugcuguuaauuauuuugcucggcagugauguauacagcagggguuaugucaggcacug

SEQ ID NO: 1050 - RNA, 133 nt, Homo sapiens
cugcagcugcuacuccauccccugcugcacuaaauugacacuugggcaagcaauggcucucgucagucacuccgaagcugcuacuuccagaagugucgauuuagugcagcgggggaugaggugccagcugcag

SEQ ID NO: 1051 - RNA, 96 nt, Homo sapiens
uacagcagccuggcugccaacgaggacaagucuaaggcaggaaguacaucucacguccugcuuagauuugauccuuuggcugcucaagcugcugug

SEQ ID NO: 1052 - RNA, 84 nt, Homo sapiens
ucuucuccccagcagucuuugggccacuauaaucagagccaagauuuuaaccuuggcugcguagacagacucuuugggagaaga

SEQ ID NO: 1053 - RNA, 65 nt, Homo sapiens
uuuuccauuccacugcucccuuggcagcucauuccuuugagcuaccagaguauugaaauggaaaa

SEQ ID NO: 1054 - RNA, 55 nt, Homo sapiens
gguggcuuccugucaguuugguauuauugauaugauccaacugcaagaaguuacu

SEQ ID NO: 1055 - RNA, 71 nt, Homo sapiens
agugaagcccguuauuguucauuagcacaaagaauguguaauaaauauaaugaaagacugcuggcuuuacu

SEQ ID NO: 1056 - RNA, 68 nt, Homo sapiens
gugaguuuucuaauaagucacaucuuuuucaugugaguggugagcagugacuuauuguaagaauucac

SEQ ID NO: 1057 - RNA, 84 nt, Homo sapiens
ucagguuuccuuucuagucuguauaugccugugugugcccaucugcagacuguaggacaugacucacuggaaaaagaagccuga

SEQ ID NO: 1058 - RNA, 72 nt, Homo sapiens
auccucagucggcuguauagguggaugcucaguuugaugacgguauccgccugaaugagucaugcugggggu

SEQ ID NO: 1059 - RNA, 65 nt, Homo sapiens
caugcuggaccauggcccacccucacccacucugccgcugagcagggccacaugacuccagcaug

SEQ ID NO: 1060 - RNA, 106 nt, Homo sapiens
uuccucccucccuccgaguugaucucccuugagcuuugacacacgguaccuaaugaaggugggguguguguggguggggagggugauguggggguguagggaggag

SEQ ID NO: 1061 - RNA, 96 nt, Homo sapiens
uagcacuccccuugaaugucacagcuggagagugaccuaacagaucauuaagccuggucacuuuacagcugugugccgucaaguugaggggugcua

SEQ ID NO: 1062 - RNA, 63 nt, Homo sapiens
guucugccccugcugucugguggaccucaggaggucaaaucaaggacgcaagaagggcggagc

SEQ ID NO: 1063 - RNA, 120 nt, Homo sapiens
uccagagcccagccuggcacauuaguaggccucaguaaauguuuauuagaugaauaaaugaaugacucaucagcaaacauuuauugugugccugcuaaagugagcuccacaggcucugga

SEQ ID NO: 1064 - RNA, 65 nt, Homo sapiens
agggaggggcaagcuggcagugccugggaaaagcccgagaaaagcccugucggcucccucuuccu

SEQ ID NO: 1065 - RNA, 65 nt, Homo sapiens
cagagcccccauugugccugccccggagccgccucaauggagcucccuggcacaaaggggcuuug

SEQ ID NO: 1066 - RNA, 91 nt, Homo sapiens
aauaaguaacauaugaacacucaucaacugugccugacaugccaagugccacaugucaggcacagacaaugagugugcauaauuacuuauu

SEQ ID NO: 1067 - RNA, 68 nt, Homo sapiens
agcugcaaccaggcggccugugggagagcacuaaggaaggccagccugcagguccagcuguugcagcu

SEQ ID NO: 1068 - RNA, 64 nt, Homo sapiens
aauuacacccauggcagcucaguugcacccuaagcaaauuaggugcugauccaaagguguaauu

SEQ ID NO: 1069 - RNA, 102 nt, Homo sapiens
cucggggugcagggcaugggggcagggagggcaggcuggccucagccucuccccggggacugggcccagccuuccugccccugcuguucccaccacccugag

SEQ ID NO: 1070 - RNA, 93 nt, Homo sapiens
cuauaauuccacugaggggugcuggcggugacauguaccaugaagucagaaucugagugguuugucaccagaacccccaggguagaauuauag

SEQ ID NO: 1071 - RNA, 91 nt, Homo sapiens
uuuucaaagcaaugugugacagguacagggacaaaucccguuaauaaguaagaggauuugugcuuggcucugucacaugccacuuugaaaa

SEQ ID NO: 1072 - RNA, 67 nt, Homo sapiens
gggaggggccaaagagggaggagaucuacugcguucuguggcccucuccucccuuccuguccuuccc

SEQ ID NO: 1073 - RNA, 67 nt, Homo sapiens
uaaugagagcagcaaacaaaguugugcggcugagugauugguaugcauuguuuuguuucuuucauua

SEQ ID NO: 1074 - RNA, 135 nt, Homo sapiens
guuauuaaucaggaaucgccagcaccucaaauuauuuaggcuugcaauuaggauggaaaguggacaaaugccacauuccauccuauuuguaugccuaaauaaugugcaggggugauggucaggauaguuaaugac

SEQ ID NO: 1075 - RNA, 67 nt, Homo sapiens
guaguggugcaugcugggaacacagccucucuuuaacacacucugcauucccagcuuucaccacuau

SEQ ID NO: 1076 - RNA, 69 nt, Homo sapiens
gggaaagaacaucuaggucuaaguucuggcucaaagacuuccuagauuugugaccuugcauucuuuccu

SEQ ID NO: 1077 - RNA, 55 nt, Homo sapiens
gccuggugucccgccaugaacggucacugcggaugacuguggugaagcgccaggc

SEQ ID NO: 1078 - RNA, 77 nt, Homo sapiens
ggcuguugccccugagagacugggcagggccggcagcucuuugcuugcugauucucucaucucccagagcaacagcc

SEQ ID NO: 1079 - RNA, 92 nt, Homo sapiens
uugcucaagcccugcuucucuaagaagcuugcccugauucugcuggagagggaaaugagggcaggcuucgcagaagaacagcacuugagcaa

SEQ ID NO: 1080 - RNA, 70 nt, Homo sapiens
aggcagaaaccgcaucaaggaaccaauugaacagacauguguccuauucaucuuugugcccuuucugccu

SEQ ID NO: 1081 - RNA, 123 nt, Homo sapiens
ccaggcagcccugggagaucucuucuucaaggcugaggcccagagagaggccacauuccucagguugccuuuugugggccucaguuucugccaucugacaauugucuccucaaagcugucugg

SEQ ID NO: 1082 - RNA, 79 nt, Homo sapiens
ccucccuuuccuacaccuuugaaaacaagccaccaugcacggccgauuggcuuguuuuaaaagguauacagaagggagg

SEQ ID NO: 1083 - RNA, 74 nt, Homo sapiens
gauaaacuuccaaggaagucccuuauggccuuacugaugaaugugguuaaaagggcuuccuucaaagguuuauc

SEQ ID NO: 1084 - RNA, 122 nt, Homo sapiens
gcccuguccccugugccuugggcgggcggcuguuaagacuugcagugauguuuaacuccucuccacgugaacaucacagcaagucugugcugcuucccgucccuacgcugccugggcagggu

SEQ ID NO: 1085 - RNA, 69 nt, Homo sapiens
uguggugcacguuugagcaaacaaauaaugaccuaagcacaguauuuauugcaucaaauauguaccaca

SEQ ID NO: 1086 - RNA, 63 nt, Homo sapiens
ugauugagccgcagaaguguccuacaauuguuggcauugucaggacuuuugaaagcuuaauua

SEQ ID NO: 1087 - RNA, 86 nt, Homo sapiens
uuucuuucucugccucuaucuccccacuuuauuuuucaggaaaggauggaaaaguagggguggagggcgaagagguuggagaggag

SEQ ID NO: 1088 - RNA, 60 nt, Homo sapiens
uaaucucagcuggcaacugugagauguucauacaaucccucacaguggucucugggauua

SEQ ID NO: 1089 - RNA, 66 nt, Homo sapiens
cuccuuucucuuucuuuccccagacuuugggaaucacccaacugauggaaagaaccaggaaagggg

SEQ ID NO: 1090 - RNA, 98 nt, Homo sapiens
ggggcagggcugcuaggauucacagcaguccauagaggcugcuuucauccacuucagcccacucugauggccugcugggagucagccuucucugcccu

SEQ ID NO: 1091 - RNA, 95 nt, Homo sapiens
uccugggcacucuuggcagccucguaggaggggcuggugguguggacaguccuguggccccucacaugcagagguuuccggguuucugcccaggg

SEQ ID NO: 1092 - RNA, 75 nt, Homo sapiens
gagcaccuccuauauuccgggcacuuaugcaugucaucucauuguauucacauuaagccugggagagagguguuu

SEQ ID NO: 1093 - RNA, 72 nt, Homo sapiens
agguagggacuguggggacaggaggggucugcguauuccucuuggauccccugccugucuccaucccugccu

SEQ ID NO: 1094 - RNA, 66 nt, Homo sapiens
gauacuuagcugcgugguagaauguuggcuguguuuuacagcacgguguuucacgguuuaaguauu

SEQ ID NO: 1095 - RNA, 68 nt, Homo sapiens
uuguucccucuuuccucuguauguuagcuuggccaaaaaagaugcuuacguaaggaggaagggaacag

SEQ ID NO: 1096 - RNA, 74 nt, Homo sapiens
gacagccuacuuggacugagccugauccagaagaaugucuuugcaagcaacggguuuaaaucccaugggcuguu

SEQ ID NO: 1097 - RNA, 65 nt, Homo sapiens
uuuccuucuguucuaguuagcuguaggcuuggguagaauucagcaguuaauuggagggagggaga

SEQ ID NO: 1098 - RNA, 90 nt, Homo sapiens
cccaggcuugugcucucuagguucuggucccugggacaguggucacacagacaaaggagguggacgcagccgagggagcaggggccuggg

SEQ ID NO: 1099 - RNA, 76 nt, Homo sapiens
agucucaagggguagcugucucaucaaacuuagagggcucccuucccugcccugaggcuggcuaccacuugagacu

SEQ ID NO: 1100 - RNA, 79 nt, Homo sapiens
cacgucucuggagaaauggggucucaggaugaguggagucucagcuuuaucugugacacuuuguuucuugagagaugug

SEQ ID NO: 1101 - RNA, 71 nt, Homo sapiens
uucagagaggaugcuuaauuuuuuuguauugccucccuuuuaggagauaaaaaccaagcaugcuuuuugga

SEQ ID NO: 1102 - RNA, 80 nt, Homo sapiens
cuguucuguguauggcacugguagaauucacugugaacagucucagucagugaauuaccgaagggccauaaacagagcag

SEQ ID NO: 1103 - RNA, 82 nt, Homo sapiens
ccagacacagcucauccgauguacaauaauuucucuuuauacaauuuaagaaaauauuguauaucagaugagaugugucugg

SEQ ID NO: 1104 - RNA, 71 nt, Homo sapiens
ggaggcagagaagggacaggaaagaagguggccaaugacucuguggccuugcugugccuuugucugccucc

SEQ ID NO: 1105 - RNA, 84 nt, Homo sapiens
agguacugaggucccaucaaugacuaauaaaauagcccccacaugguggcuguuuuauuauucauuugagggacgucaguaccu

SEQ ID NO: 1106 - RNA, 121 nt, Homo sapiens
cuggggugggcugguaaggaucugugccaaccuugcgggugggggagaagggagggggcaggugccuagcagauucccuucccccuuucccucaaccugggcuccccgccagcugccccag

SEQ ID NO: 1107 - RNA, 90 nt, Homo sapiens
ugcucaagugcuguucuucugcgaagccugcccucauuucccucuccagcagaaucagggcaagcuucuuagagaagcagggcuugagca

SEQ ID NO: 1108 - RNA, 76 nt, Homo sapiens
augugaagugucauauguacuauggcugacauguacguuucguguuauguagucauguguauuaugaauuucacgu

SEQ ID NO: 1109 - RNA, 65 nt, Homo sapiens
aucaggucugcauuuuagaaagauaggccuguccuguuuaagaauggucuggguggagacuugau

SEQ ID NO: 1110 - RNA, 88 nt, Homo sapiens
gugccuggugcauggucagcacucaauaaaagcuuaacauuucuucauucagggaguauucauugagugcuucuuaugagccaggcgc

SEQ ID NO: 1111 - RNA, 59 nt, Homo sapiens
uuuucuuuuguuccaugcuggcugaaccacguggucccagaaguaggaaggaaagagaa

SEQ ID NO: 1112 - RNA, 66 nt, Homo sapiens
gagagagcaguggcauucugagcagggcuggagcucgggcccccugacucaggcuggugcuuucuu

SEQ ID NO: 1113 - RNA, 55 nt, Homo sapiens
gcacgcgcagugcugccggccaccgcggcuccgcgcgcuacgggcaugcgcgugc

SEQ ID NO: 1114 - RNA, 64 nt, Homo sapiens
ucucuucucgccuuuuccccuuuucuucuccaaugggagaauguaggagacaagggagaggaga

SEQ ID NO: 1115 - RNA, 87 nt, Homo sapiens
augggguugggccagcccaggagaauagauaauaugcagccaauauuaaguguaauguguacucuucgggcucaggugugacuuuau

SEQ ID NO: 1116 - RNA, 114 nt, Homo sapiens
gggggcaguguuaaaggagguaaggaguggcugaagguagaguccacgauguugcuaaggguuggacuugaccuuaagcacacuuguucuauuagcuccacuggaacugcccuc

SEQ ID NO: 1117 - RNA, 56 nt, Homo sapiens
cauggcccuguuucugcugccccugggaaucucugggcagccaaagaggggcugug

SEQ ID NO: 1118 - RNA, 61 nt, Homo sapiens
agggccugggccagcacccuuugaggcccacaacagggcacacaggggagggccaggcccu

SEQ ID NO: 1119 - RNA, 69 nt, Homo sapiens
gcagcuguuguugauuuuuuuuccaaauuagcacauuauguguuuggaaaacagacaaaaaacagcugc

SEQ ID NO: 1120 - RNA, 70 nt, Homo sapiens
guuuuggacgaagcuuuucucacagugguaguuccaguuauacccacugugacucggggcuguucagaau

SEQ ID NO: 1121 - RNA, 59 nt, Homo sapiens
cccccagcugagggaccagcucuacuuccaccuggaguugcacagucucaggcuggggg

SEQ ID NO: 1122 - RNA, 66 nt, Homo sapiens
gcaggagaagaagaugugcgcggacaagcggccccaaacguccccucgcaggucucuuucucuugc

SEQ ID NO: 1123 - RNA, 66 nt, Homo sapiens
cauauucuagauccauuccaaaguaaaagcugacagaacuugcugauggguuggaagugggaugug

SEQ ID NO: 1124 - RNA, 81 nt, Homo sapiens
gguuauuuggaccaauugugagagcagguagucuccuccagcaggcaguggcucauggcucucacaaugggacggauaacu

SEQ ID NO: 1125 - RNA, 109 nt, Homo sapiens
caggguggggagcuugaaagggucuugcaggcagagcgugggugacugacuccucagguaggccugaccugcacucugcugcagacccucggcagcgcagcccacucug

SEQ ID NO: 1126 - RNA, 104 nt, Homo sapiens
gcagagauagagccacaugcucacucagauauauuaggguuacagagcaguuuaucacaguauguaauuauauguuugugugauuguuugagucaugucucugu

SEQ ID NO: 1127 - RNA, 64 nt, Homo sapiens
ugcaaaugggaauguauaaaguacuuaagaguaaauuuaaaguacuuuagaaguaccauuugca

SEQ ID NO: 1128 - RNA, 80 nt, Homo sapiens
ucuuguguugagacuucgugguggugcuaagaaaaggaagaagaagucuuacaccacucccaggaagaauaagcacaaga

SEQ ID NO: 1129 - RNA, 97 nt, Homo sapiens
uaauugccagauauggaggguuuuuauauggccagggugauaaaacaggcugguuauuaaccuggcagguagagagaaaacccauugaugguaauug

SEQ ID NO: 1130 - RNA, 71 nt, Homo sapiens
uggggcugggauggagcugugugcagggcgcauguccaaagccccuguacaguggcugggggccagccuca

SEQ ID NO: 1131 - RNA, 120 nt, Homo sapiens
uuccugacagauggcuuuccagggguaggugugagagacccagaaguagggcucuguaauuagucucccuucacccuuagcccuguccucagccaccucuggacaagauaauguuaggga

SEQ ID NO: 1132 - RNA, 62 nt, Homo sapiens
cauugaugcgccauuuggccuaagcaaacgguaagauuugcagagccaaaugagcauuaaug

SEQ ID NO: 1133 - RNA, 62 nt, Homo sapiens
uaugacauagccaaccuuuaaaaaaaaaugaaugauuuauuuaaaagguugaaugugucaua

SEQ ID NO: 1134 - RNA, 80 nt, Homo sapiens
cuugguuuggcagcauuuggcaucaggaaggaggacguuauauucuccccucucuugcugcucaaugcuaauaggccaag

SEQ ID NO: 1135 - RNA, 151 nt, Homo sapiens
ggcuuggaggcagaagagaagcagggcguucgaggcuggggauuagaguugggggaacucuggcacuggggaagccagaguuuccagagucaccccuaacucuuacucacuguguggccuuggggagcuugggguuacuucucucuaagcc

SEQ ID NO: 1136 - RNA, 121 nt, Homo sapiens
guccguccagcuugcauuuuccucuuuuccagguaccagagucuugguuuugcuucaggaaaccucauucuuggugucugcaguugagguaagauugauccccucuguuccauggaugggc

SEQ ID NO: 1137 - RNA, 55 nt, Homo sapiens
ggucauuguggagaggcacuuagauuuggugucagugcuucuguuaaugaugacu

SEQ ID NO: 1138 - RNA, 127 nt, Homo sapiens
gauuuugcuggaggcuguugcuuuugaaaaucacuguucuucuucaaagucuuuccuuuacaaagaaauugaggcuggaagaggagaagggaccuuucaaaguuagugacauuaccaaagcaggauc

SEQ ID NO: 1139 - RNA, 91 nt, Homo sapiens
ggcgcggcgggacuuucgcugaccgcggcucaguuucucaguuucggaaacgggaacuggggcgggaagggggaaggaagggcgccgcgcc

SEQ ID NO: 1140 - RNA, 75 nt, Homo sapiens
uucugcagaggcggcacacagugaaugaggagauacagacagaugccuucagauggagcugugugcucugcagaa

SEQ ID NO: 1141 - RNA, 75 nt, Homo sapiens
cugacucaaguaagaaacagaauuggaauuugagguaggauaucccagccccacauuuuguauuuuuugagucgg

SEQ ID NO: 1142 - RNA, 91 nt, Homo sapiens
uuggccugggucuggcccuccccccucuucuuuggagccuuccuucugaggacaggcccuggggaagggggagggaaagggacugggccaa

SEQ ID NO: 1143 - RNA, 55 nt, Homo sapiens
cccugugggguccgccuguccggccccaucagcgggguggccaggccccacaggg

SEQ ID NO: 1144 - RNA, 83 nt, Homo sapiens
gaaauauuagugucauuacuucuaaauggagggguaagaauugcuucuuaccuuuuaauuuagauuuaaagaaauaauauuuu

SEQ ID NO: 1145 - RNA, 98 nt, Homo sapiens
ucugugugcguggagguaagagagcgucagaaggucaggcuguccauagaaugcuaaggacauccuagcaccgucugacaucaguugcagcacacagg

SEQ ID NO: 1146 - RNA, 82 nt, Homo sapiens
uuuuuuuuuuuaauggucauagcuguagaaaacaacauacuucuuguuuguuuucuauagcuaugaccguuacaaaaaaaaa

SEQ ID NO: 1147 - RNA, 85 nt, Homo sapiens
gacuggcacugaugccuuugauuugaguaaaagacccaucauuugggggagucuuuuguuagaaucaaaggcaucugugucaguc

SEQ ID NO: 1148 - RNA, 72 nt, Homo sapiens
gccuauuuaucucauuauauagaagaacaauguucuuaguuaauucucggcuagguaauggguuaaguaggc

SEQ ID NO: 1149 - RNA, 66 nt, Homo sapiens
guuuuccucuacaaaugucaccagcagcugugucucauuuuguuggcaacauuuguuggggaaaac

SEQ ID NO: 1150 - RNA, 67 nt, Homo sapiens
uucccuaguuaccaauuuuacucgguaguagcugaaaugcccuggaacuaaguuggucauuggggga

SEQ ID NO: 1151 - RNA, 72 nt, Homo sapiens
aguaggaacuguggucauugcaggguaaaguugcacaccuacucauucuuuugugaugaucauguuuuuacu

SEQ ID NO: 1152 - RNA, 78 nt, Homo sapiens
ucccugcuuuuauuuguagcuucccaaagcuuuugcugguaauaaaaggauuguaaaguugacaaauauaagcaggga

SEQ ID NO: 1153 - RNA, 64 nt, Homo sapiens
uuugguauguguuccuggaaggcucacauuaacugacaguaagguccugggaauuuauaccaaa

SEQ ID NO: 1154 - RNA, 151 nt, Homo sapiens
gaguucaucugcuccugcuguuuauucuccaccugaaguucuaauccucuguuugugacaacauaaucauuuccacagcaaccaauugugaaguugcaaagcaaggauuagacuucagguggggaauaagcaacaaggggcugaugaacuc

SEQ ID NO: 1155 - RNA, 77 nt, Homo sapiens
auuguauaguguucagaggugagagugagcccauccuugcugaauaggggcuucucuagcuugugaaucugugcagu

SEQ ID NO: 1156 - RNA, 69 nt, Homo sapiens
ggggcugucuccagggcaggugcaggugcugcugagggcuggcuuucugucauggccuggggcagccuc

SEQ ID NO: 1157 - RNA, 86 nt, Homo sapiens
uuugguauuuaaaagguggauauuccuucuauguuuauguuauuuaugguuaaacauagaggaaauuccacguuuucaguaucaaa

SEQ ID NO: 1158 - RNA, 86 nt, Homo sapiens
uuugguauuuaaaagguagauuuuccuucuaugguuacguguuugaugguuaaucauagaggaaaauccacguuuucaguaucaaa

SEQ ID NO: 1159 - RNA, 86 nt, Homo sapiens
uuugguauuuaaaagguagauucuccuucuaugaguacauuauuuaugauuaaucauagaggaaaauccacguuuucaguaucaaa

SEQ ID NO: 1160 - RNA, 85 nt, Homo sapiens
gcuuuuuguucuaaggugcaucuagugcagauagugaaguagauuagcaucuacugcccuaagugcuccuucuggcauaagaagu

SEQ ID NO: 1161 - RNA, 90 nt, Homo sapiens
guuacaggguggacaggugcuaauuccucucuucuggcugcacuccacuuucaguaauggcaacuggcaccugcaaauccccuuugugac

SEQ ID NO: 1162 - RNA, 118 nt, Homo sapiens
ucuuagggcuccaaaucugccuuggguucaaaggaagguugcaguuggaugugacuccuuucacaaaagaagcgaggacucucugcagcccuuccuguccucagaaugggcucugaga

SEQ ID NO: 1163 - RNA, 102 nt, Homo sapiens
acagaaagcuucaagucucuguaggcagcucacguguaggggcugcuggggaaggucuguugcucuugauguugcugcccauaaggagaugaugcuuucugu

SEQ ID NO: 1164 - RNA, 58 nt, Homo sapiens
gggagggaguucucugaggaagaagccacagcagauuuuccucacagacuuccuuucc

SEQ ID NO: 1165 - RNA, 77 nt, Homo sapiens
ugggggugguggccagagggguccucagacaacucaacaagggaaguauugugggcccaccucugccuccacccuca

SEQ ID NO: 1166 - RNA, 176 nt, Homo sapiens
auucacguauagacacugaaaguucugcguccacucaguucucuucccuauaggcaaugaugcuauuaauuuuuauaaaauaucuuuggaagaauaaacaaaaaguaaauagcaucauuaccuguagggaagagaacuaaguggauauaaaaauuuuccauuuuuuuuauguggau

SEQ ID NO: 1167 - RNA, 85 nt, Homo sapiens
cucaggcugugacccuccagagggaaguacuuucuguugucugagagaaaagaaagugcuucccuuuggacuguuucgguuugag

SEQ ID NO: 1168 - RNA, 70 nt, Homo sapiens
aagccugcaucuuuuuccaaguuuauuuuauacugccauaaggaaagugaguggaaugaguuguaggcuu

SEQ ID NO: 1169 - RNA, 79 nt, Homo sapiens
ccacuugccugccgcugggucugaggaccugacagugccgggcacacagcagguguucaguaaguguguuggcaagugg

SEQ ID NO: 1170 - RNA, 78 nt, Homo sapiens
gaaagguauuagacugacuauaaaggggucuugggaagggaucuuacuccucuuugauaguugguacuuguaccuuuu

SEQ ID NO: 1171 - RNA, 110 nt, Homo sapiens
caggcccugugugcuguuuuccuuccuguccugcccuggcugagagcgggcuuaaugaauggggcucaguuuagggugggaggaaggucggcagcaggagccagggcuug

SEQ ID NO: 1172 - RNA, 61 nt, Homo sapiens
ucuguggauuugauugcuuuuuuucuuaucugucugaagaggagggcaugcaauucacaga

SEQ ID NO: 1173 - RNA, 111 nt, Homo sapiens
guuuguugauagauugaguuuguuuaggacugguguugggucugcagaaagucuauauuggccagaucagauauucuauacuaguuucuagcauucucacuuucaacagau

SEQ ID NO: 1174 - RNA, 80 nt, Homo sapiens
agagguuggugguaaugggguggggaacagucaaagggaucccacuggaggcugcuccucaacccaccuucccagccucu

SEQ ID NO: 1175 - RNA, 69 nt, Homo sapiens
ccuggaggcugcugggugaccucgggcacaucccuggccuucucugaggcugcccugccugccuccagg

SEQ ID NO: 1176 - RNA, 97 nt, Homo sapiens
aaagggaccuugagaacggaaauuuucaaguguguuuuguaacccuuagcaaaaggagagcaaacaccuuuaugaaauucuggcaugugguccuuuu

SEQ ID NO: 1177 - RNA, 67 nt, Homo sapiens
uuuuagcagugaucuugcauguugguugaaaaacaaaauggauaugcauagaucuuucuugcugaaa

SEQ ID NO: 1178 - RNA, 68 nt, Homo sapiens
acacaaagcuaaggugccuguguuuauucuguguuggagagucaacaaaggcugccucuguuuugugu

SEQ ID NO: 1179 - RNA, 81 nt, Homo sapiens
uucuuucuguagagaaugaguugguacauaaggaaccucauuauagugacuuauguacccacucauauuccccagagagag

SEQ ID NO: 1180 - RNA, 63 nt, Homo sapiens
aguguuuuguacaauuucuugugagugcgaagcucaaaaagccgagaaaaugggcaaaacacu

SEQ ID NO: 1181 - RNA, 68 nt, Homo sapiens
ggccuuuucuaacaaagaagcugcauuuaagagccuuagggaugaagugcccuuuuuuggaggaggcu

SEQ ID NO: 1182 - RNA, 68 nt, Homo sapiens
ucuuuugcauaaucauuuaucugaaaggacaagaaauaauuugcaauuucagagugugaugcaaaaga

SEQ ID NO: 1183 - RNA, 68 nt, Homo sapiens; identical to SEQ ID NO: 1182

SEQ ID NO: 1184 - RNA, 115 nt, Homo sapiens
caaauacauuaaguagcaguagagugcuuagaagagcuuuggcaccaggccacucuguaacaggaacuugcuuggcaaagagcugcuuuaagcacauuugcuguguauguauuug

SEQ ID NO: 1185 - RNA, 71 nt, Homo sapiens
gugacuauauauuaaugagacucaguaauccaacccacaccugagaacucgucucauuacuuuauagucau

SEQ ID NO: 1186 - RNA, 56 nt, Homo sapiens
gucaaauauuaugcagcuuggauacccaauuuaguaugagcugcuuuguauuuggc

SEQ ID NO: 1187 - RNA, 56 nt, Homo sapiens
ugacaguuuuauagagugcuuccucugcagagugugaggcacaucauaaacuguua

SEQ ID NO: 1188 - RNA, 78 nt, Homo sapiens
ggugagagcucggcucauagaauauuuguaagaaaauuaaagauuugcucuucagauguugggggccaugcucuuacc

SEQ ID NO: 1189 - RNA, 79 nt, Homo sapiens
auuucacacuccuuagugaguucugugaaauuuccaugcuucaucauuuacagcuacucacaaaaaguaugugugaaau

SEQ ID NO: 1190 - RNA, 73 nt, Homo sapiens
guguaguuuucacugggggaaggaaagguguuauauagaaauguauacauuuuuuauuuccuuaaaauugcau

SEQ ID NO: 1191 - RNA, 100 nt, Homo sapiens
gugauaggaucaucaagcagugauaggaggguaggaggcaaacccggacaugaacucaaugccuccuacccucccaucaccgcugcucuccucuugucac

SEQ ID NO: 1192 - RNA, 84 nt, Homo sapiens
ccucgcuguucucuauggcuuuuuauuccuaugugauucuacugcucacucauauagggauuggagccguggcgcacggcgggg

SEQ ID NO: 1193 - RNA, 118 nt, Homo sapiens
ucaauaggcucuggcagagggaggagaugggcacugaguuagaauuuggggcaugcagaauggccuccaaaaugucucagguuuucucaggccacaucuucuucccugugccuguugg

SEQ ID NO: 1194 - RNA, 75 nt, Homo sapiens
uauggugcaugguauaauagccuaauacacagaauguacacuauguguaccuagguuauuguauucuguaccaua

SEQ ID NO: 1195 - RNA, 94 nt, Homo sapiens
gucuggggcuggaucaugugagcucuguaacacagugcuggguuggcccacuggguauuguguuugcagagcucuggaacugguugucccagac

SEQ ID NO: 1196 - RNA, 76 nt, Homo sapiens
ugccagaguugggaugcgugggaggacacagcucauuguggcaaaccucagcucccuggcaugucugacucuggca

SEQ ID NO: 1197 - RNA, 68 nt, Homo sapiens
uuaagcaggugauuauaguaaacauauaaggcaugugggccuauuuguuugcucuagcuccugcuuaa

SEQ ID NO: 1198 - RNA, 64 nt, Homo sapiens
ucagacaugugcauuccugaggccagcugaguaguguggucuuggugaauuccuuuauguuuga

SEQ ID NO: 1199 - RNA, 66 nt, Homo sapiens
aggaaaggcuggagugggagguaguucaagagaaaguguuuauuucuccuuccugcugucuuucuu

SEQ ID NO: 1200 - RNA, 72 nt, Homo sapiens
cauuaucuguguguauuuagauuacucauaaauauguguugaaugaguuaaauuuagauaccucggaugaug

SEQ ID NO: 1201 - RNA, 93 nt, Homo sapiens
aggcauaaauugcugaccucuauuuaauuuucugaacugcaagaauuaugggcccaaaguucagugaauuggaagagguaagcuuuuaugccu

SEQ ID NO: 1202 - RNA, 76 nt, Homo sapiens
caaagggaguuaacugguaagauguacguguuuuggggugcccucuaugugcuuuuacaauuuuuuuuucucuuug

SEQ ID NO: 1203 - RNA, 67 nt, Homo sapiens
cugucugguuuaguggaugcugaugccauuucuccuuaugaaugguccagcauugguugccaggcag

SEQ ID NO: 1204 - RNA, 94 nt, Homo sapiens
aggccuggguuaggagggcaguggugggguggguggggagccuuggucauccccucucugcugaccccaccuccucccugucccuuccaggccu

SEQ ID NO: 1205 - RNA, 94 nt, Homo sapiens
uuuagacccuuuguagauaaaauuggggcagauccuagaagcugcacacacucacagguggcuuccugggacacugccugaaucugggucuaaa

SEQ ID NO: 1206 - RNA, 67 nt, Homo sapiens
ugagcaucuuaccggacagugcuggauuucccagcuugacucuaacacugucugguaacgauguuca

SEQ ID NO: 1207 - RNA, 69 nt, Homo sapiens
ugcuccucgggcuccugguugcccuggccgcuugcugccuggacucacugccaggagccugggggagca

SEQ ID NO: 1208 - RNA, 82 nt, Homo sapiens
gucccagaguagcaggaucuggcagaaggaaauuuccuucuaacccucaaagaauccacauaaaucuuguuacauuugggau

SEQ ID NO: 1209 - RNA, 82 nt, Homo sapiens; identical to SEQ ID NO: 1208

SEQ ID NO: 1210 - RNA, 82 nt, Homo sapiens; identical to SEQ ID NO: 1208

SEQ ID NO: 1211 - RNA, 82 nt, Homo sapiens; identical to SEQ ID NO: 1208

SEQ ID NO: 1212 - RNA, 82 nt, Homo sapiens; identical to SEQ ID NO: 1208

SEQ ID NO: 1213 - RNA, 82 nt, Homo sapiens; identical to SEQ ID NO: 1208

SEQ ID NO: 1214 - RNA, 72 nt, Homo sapiens
gggcuuugugguuuucaugccugaugauggccaggaacccuucucaguaggcauugaagaccagcagagucc

SEQ ID NO: 1215 - RNA, 81 nt, Homo sapiens
uaguucuaucuuuuggcauguggccucuggguuauuucacaagacaccuucccagucgcccaggcuaaaagauuggggcua

SEQ ID NO: 1216 - RNA, 55 nt, Homo sapiens
gggccagaccucuucucagggaagaccgcgggugucagggaagaggaucuggccc

SEQ ID NO: 1217 - RNA, 77 nt, Homo sapiens
ucugaagagguaagagaaacaguccuaagugauucuauccacuucauuucaugauuguuacuuuuaucauuuucaga

SEQ ID NO: 1218 - RNA, 68 nt, Homo sapiens
cucgccugaacucauuacugcucugauaaaugacucauuagcauuguaagaaauggguugcaggcggg

SEQ ID NO: 1219 - RNA, 71 nt, Homo sapiens
gcaccggcaguuuucgguccccagggagguacgaggaguuugcuuccugguggacggagacuggccggugu

SEQ ID NO: 1220 - RNA, 78 nt, Homo sapiens
uccucggaccuggcuaagcuuccaaggcccuccuggagggccaggaaucgggccgggguuugggccaggcucugagga

SEQ ID NO: 1221 - RNA, 58 nt, Homo sapiens
ucuuucugauuucuuugucauuuaagucugcgaugguuugacaggagauacagagaga

SEQ ID NO: 1222 - RNA, 77 nt, Homo sapiens
auugucuaucauccuuauuaauuauuguuauuacauuauaauaagaauauuugaugguuucuggaugguuaggcggu

SEQ ID NO: 1223 - RNA, 60 nt, Homo sapiens
uugggggaaugagcaauauguguuugcugauagaaguaccauauggcucaucuucuucaa

SEQ ID NO: 1224 - RNA, 73 nt, Homo sapiens
accagaggcugggagucagcagcaggaacccagggccagccaguggaggcugcugagauuccagaucuuuggu

SEQ ID NO: 1225 - RNA, 83 nt, Homo sapiens
cuuagcagagcuguggagugugacaaugguguuugugucuaaacuaucaaacgccauuaucacacuaaauagcuacugcuagg

SEQ ID NO: 1226 - RNA, 69 nt, Homo sapiens
cuguugggaauauaaugaaaacucugcccuguacagaggccagauguuuucaugcauauuccccaacag

SEQ ID NO: 1227 - RNA, 119 nt, Homo sapiens
ggagcccuccugucccagagaagguaggauugagcggcaccgccagaaacccuggcugcuuuuuuccggauuggguugugugugguguguuuauccugagaugguauaggcagggcuuu

SEQ ID NO: 1228 - RNA, 65 nt, Homo sapiens
ccccgcccgaugaagaagaucccaggguaagucuagcccuggaucucuuggguaucggggugggg

SEQ ID NO: 1229 - RNA, 99 nt, Homo sapiens
gcuguccugugaaauacaaaucucucacccauggccugaauauguuugcaaacuaagcagaucaugggaaggagaauguguuggcgucgcugggauggu

SEQ ID NO: 1230 - RNA, 71 nt, Homo sapiens
ccagggacagguaaacgcaggaaggaauuaaacaaagcauguugacuucccagggcgugccugguuccugg

SEQ ID NO: 1231 - RNA, 81 nt, Homo sapiens
ucugggucccuuaaagaggugauauuuuuccgugguuguugaccugcuggcaacccuugucaucuucagaggagacccaga

SEQ ID NO: 1232 - RNA, 71 nt, Homo sapiens
gucauuaugcuccaucuugucaguaaucuucuuguuaaagagcacucguugacaugaugagcaauaauggc

SEQ ID NO: 1233 - RNA, 105 nt, Homo sapiens
cuuggggccuuggccucugcuggcuggcuguaaccugagaagcugugucacuucuuucuucagauucucaggggacaggcugaccaggaggacaggagccccagg

SEQ ID NO: 1234 - RNA, 67 nt, Homo sapiens
gugcgcagacuaauugccuguggcaaauguugccugcaaauuucaagggcaauugaguccugugugc

SEQ ID NO: 1235 - RNA, 95 nt, Homo sapiens
ccuuuuguguccuguggccaggcugggggggcugugacacguggagauugcugacauagcucuccuccucugaccuugacaguggcaauaaaagg

SEQ ID NO: 1236 - RNA, 131 nt, Homo sapiens
agggaagaaagagaguuggggucucaggaugguggggagaaggagcugugguggggcccaguguagaaagaggaggccuauagcuauuuucucccucuguuagggcagaucucagcucacuuauuuuccuu

SEQ ID NO: 1237 - RNA, 71 nt, Homo sapiens
cggucucaccaaacgccccaaacucuccuccacacccccucugagugcccuggggcgccuggcugaggcug

SEQ ID NO: 1238 - RNA, 76 nt, Homo sapiens
gggugggagcugagauggcuggcccuguaaaacguaauuuugggccaaauacuaagcuugucugagcuucccaucu

SEQ ID NO: 1239 - RNA, 63 nt, Homo sapiens
gagaaacaggagcugucuccccaaagcccacuaggcguggggaagaugugaucuguguuucuc

SEQ ID NO: 1240 - RNA, 63 nt, Homo sapiens
uggcugagaaguucuggugggaaggaaccauggagggcccaucuggauauccuuccucagcua

SEQ ID NO: 1241 - RNA, 78 nt, Homo sapiens
ggggcgggagguaaggagcaaggcaugaagaaucuggagacucagacuaugucacgucuugcguucccugcccgccuc

SEQ ID NO: 1242 - RNA, 55 nt, Homo sapiens
gggagcagcagucagucaccaucuggccaccauuuggugaccccugucuguuccc

SEQ ID NO: 1243 - RNA, 82 nt, Homo sapiens
ugcagcugcacuggccgugcaugauauggcugcugucaaugaaggcaguuguaugcagagcacugcugggcugucggcugca

SEQ ID NO: 1244 - RNA, 66 nt, Homo sapiens
cguagcagccuccucucgcgcccacuuuauuugggggcaggcgugggaggaccuaggccugcugug

SEQ ID NO: 1245 - RNA, 94 nt, Homo sapiens
ccagcagagguuuagcugugagucaugggugugagcuuauuccauaaaaucucaggagcccaagacuguacaguuaaagacucccaucugcugg

SEQ ID NO: 1246 - RNA, 97 nt, Homo sapiens
uuucccagggagaugcuaggagugugcuuccauggaauaugugagcccauggaagagcaagcccagggaagcacaauccuaguaucccacugggaaa

SEQ ID NO: 1247 - RNA, 89 nt, Homo sapiens
gggagccugcaagugucaggugaguccucaugcuggacucugcccucaagggcggggcgugggucucauuucccacuggccaggcucuc

SEQ ID NO: 1248 - RNA, 118 nt, Homo sapiens
gaagaaggggaauggggagaauggcggccaggagaagacauaugacauuccccagggucaauggugcggcccgugugucuaucuacuggcccuccacuccuccugcgccacuuucuuc

SEQ ID NO: 1249 - RNA, 84 nt, Homo sapiens
cuuguuuugcagcccgggaaacugaggcacagagcuacagagguucucaccuggugucucagagguccuggggguggaagcagg

SEQ ID NO: 1250 - RNA, 94 nt, Homo sapiens
uccuuuuccuccuuuccuuccuagcacugcuaagcaagacacagggagugacagcuuugcuuagcagugcugggaaggaaggcagagaaaagga

SEQ ID NO: 1251 - RNA, 73 nt, Homo sapiens
gcugucagagcggguuaggcucggggaauugguucucuggaucaucucccgggagccagccccuccuggcagc

SEQ ID NO: 1252 - RNA, 90 nt, Homo sapiens
uguagguagccuguggaaaggagagaggagaccagaguagaccaacuagaucuccuagcucaucucuucauucauucaugcaugccugca

SEQ ID NO: 1253 - RNA, 66 nt, Homo sapiens
cucucucucccaccuccuguaaucagcaccccuggggaugggugugaggggggcagguagagaggg

SEQ ID NO: 1254 - RNA, 106 nt, Homo sapiens
caccaugcccguguugagucaggccucggucuccucaccuaugugauggccuuuggcccucaacccucaggagacggaggccugacuuacccaagggcgcauggug

SEQ ID NO: 1255 - RNA, 73 nt, Homo sapiens
cuacuacagggcaacccuuuuccacccagugaucuuaggauugauuaucuaugaaggguagaccaugugguag

SEQ ID NO: 1256 - RNA, 73 nt, Homo sapiens
gcagagagaagcagaugggcaauaccgagcaaaauuuucuuacuggauauugcccaucuguuuuccuuuuugc

SEQ ID NO: 1257 - RNA, 87 nt, Homo sapiens
acugauauauuuaccacuuacuauauaucgauguacauuacuauacauaguacaaugauauacaguaagugguaaauggauguuagu

SEQ ID NO: 1258 - RNA, 79 nt, Homo sapiens
gucagccaugagggagggcaccugaccuugggaguucugucucgcccuaggguggagugcuuuuccucgguugguugau

SEQ ID NO: 1259 - RNA, 92 nt, Homo sapiens
gauguaauagaaaccuuuuauucaggagaggucacugccagggacugaagggggugaucuggcuccugcuugaaagguuucuccauuguauc

SEQ ID NO: 1260 - RNA, 66 nt, Homo sapiens
cauaacucucauauacugugguucugagaucuuuauagccacauuacgguauauggcugaguugug

SEQ ID NO: 1261 - RNA, 89 nt, Homo sapiens
caggugguuguuaauuuuuggcguuguguaauuaaacuaguuuuguuuaauguuaucuuuugccaguaucuaauuagcaaagccaucug

SEQ ID NO: 1262 - RNA, 56 nt, Homo sapiens
cccuuacgcacguggauuucccauugaggucagugggaaucguguguacgugaggg

SEQ ID NO: 1263 - RNA, 68 nt, Homo sapiens
caguaaauugucuuucuguaaguguccaaaaaaaaaucaaggaagcuuacaaaagacaugauuuacug

SEQ ID NO: 1264 - RNA, 76 nt, Homo sapiens
uuguacauucaguguacugugaauguauaugcacaccagugguuacauuuauagcaguacaacugagaaugugcaa

SEQ ID NO: 1265 - RNA, 68 nt, Homo sapiens
caggaaauggugcacucugcucugauacguauuaacaguugucguuagcagagucaccguguuuccug

SEQ ID NO: 1266 - RNA, 82 nt, Homo sapiens
uccucuagagcuccaaagugaagauaaaacuccuguuccacucagggaguuuguaucuucaaagugaaagcuuccuggggga

SEQ ID NO: 1267 - RNA, 82 nt, Homo sapiens; identical to SEQ ID NO: 1266

SEQ ID NO: 1268 - RNA, 68 nt, Homo sapiens
agccagaaagaggcacauuucuagaugauuagagaacuucaggugggaacguuacucugcuucuggcu

SEQ ID NO: 1269 - RNA, 126 nt, Homo sapiens
gagagauauguuuccucagugaguguccuacuaacugauacuuuuaguguuagagucugcccuguugacucccaacacuaauuuauuaaauaguugcugacgucauuguuuuaacauuuauuucuc

SEQ ID NO: 1270 - RNA, 59 nt, Homo sapiens
cgcccuuccuccacucuuccuguuggaguccugaucggaggagugcgggccggagggug

SEQ ID NO: 1271 - RNA, 113 nt, Homo sapiens
gaaggcuggagucacuuaagguaguugauaaagggcucucucaguucucaggucuagaaacaggaggcaaagggagaucuuaaucaguaaucuugccacccucuacagucuuc

SEQ ID NO: 1272 - RNA, 70 nt, Homo sapiens
ucugcccuucauuugcucuuggcuagcugacuucacucuccauggcugcagagcagucgaacggggcaga

SEQ ID NO: 1273 - RNA, 94 nt, Homo sapiens
cgcccauucccugggcccugucuggugguggcuggccuuggagagcuggccucucagcacagcaccgggcaccagggcucaaggucagugggug

SEQ ID NO: 1274 - RNA, 109 nt, Homo sapiens
ugggucccuggacacgaccucgucuccugcucucacuccauucucuaguggcagcagccacucugggacugagggcaugggggaugaguugaaagaacagugggaccca

SEQ ID NO: 1275 - RNA, 65 nt, Homo sapiens
aggguagugggaaaggcaaggcuggcaaaaaggggcccugccuggccauuucccccgauuacccu

SEQ ID NO: 1276 - RNA, 63 nt, Homo sapiens
ggccuuguucccuucccacccaaguucuugggccucaucauggguagaggggcuggcaagguc

SEQ ID NO: 1277 - RNA, 66 nt, Homo sapiens
gggaggcacaggaggaugccuaguauucugauacuuuucaaagggcaugcuucugagaugucuccu

SEQ ID NO: 1278 - RNA, 75 nt, Homo sapiens
gggcaggggugggguggggagaugucucagugcccccauagcccaguccuuucucuccccccacccucccugccc

SEQ ID NO: 1279 - RNA, 55 nt, Homo sapiens
gcgcugcugggcugggggaugacgugaugucuauuucugggccuccuggcagcgc

SEQ ID NO: 1280 - RNA, 93 nt, Homo sapiens
cgggccccgcucccgcccucggcucgccuggcccagaccggaagcagcgccgcacugccugggccuggcgcggggggugagcacaggggcccg

SEQ ID NO: 1281 - RNA, 70 nt, Homo sapiens
uccuuggauauugcuuggaggcucugaguucauaaguacagaaugguuuccaagggguaugcuuuaagga

SEQ ID NO: 1282 - RNA, 67 nt, Homo sapiens
uuuguucucccguuuccuguguaugguucagccccagugagccacaggagacagggccaggagcgga

SEQ ID NO: 1283 - RNA, 99 nt, Homo sapiens
guucuuauuguuguugucauuagcuguuuaagcguaugcauaugacuuaucacaucuaagaugcuugaauaguuuuggauagcauauauucauaagaac

SEQ ID NO: 1284 - RNA, 93 nt, Homo sapiens
gucuucagcuugcccagcccugcucaccucccagcacggcccauccugaaucaguggggccugagcaggggucugggcagagacucugaagac

SEQ ID NO: 1285 - RNA, 75 nt, Homo sapiens
ucccacagucgggaggaaaagaaagaagacucuguuguucauuguuuuuaucuuuuucuccagaugccuguggga

SEQ ID NO: 1286 - RNA, 76 nt, Homo sapiens
ugacaugcgccacuuagagcgggacgacauugauguacaguguuaauauuacgcucuaaguggcuucuguauguua

SEQ ID NO: 1287 - RNA, 64 nt, Homo sapiens
gcuggcacucucauuguuacauuaguuauuaauaaacuccuuaacaaugggaggaagugcuagc

SEQ ID NO: 1288 - RNA, 76 nt, Homo sapiens
guccugucucugaguaacaccuuuacaugccgauucucauaaaaauguucacuauuuacucagacauuggcagggc

SEQ ID NO: 1289 - RNA, 84 nt, Homo sapiens
uucuuguuuuuaguaggguguucaaaugugccuuuucuaacaaagagacauuugaggagagcccuacuagaugaaaggcaggaa

SEQ ID NO: 1290 - RNA, 103 nt, Homo sapiens
ugcuaucauuuccuuuucucaguuuggaaagaaugcaaagaauuacucaaaguagauaacuucauauuuuccacuuguggaaagaggagaacagcugauggca

SEQ ID NO: 1291 - RNA, 84 nt, Homo sapiens
gagaagggguggccugcauuuuuuuucaugcucaaagcaugcuugugaguauugggagaaaugagugcuauucaggcccuucuc

SEQ ID NO: 1292 - RNA, 88 nt, Homo sapiens
gcugaggugcccagaugagacagcuggggaauuccugcuaccuggaugcuagaguuccugggcucucaucuugguuccaagccucggu

SEQ ID NO: 1293 - RNA, 104 nt, Homo sapiens
aggauagcugagucaccuaagagcacagcacggcugcagagggcauaaagcggaccagaucucugcagcuguugcugugccuggagagucacccgugcuguucu

SEQ ID NO: 1294 - RNA, 99 nt, Homo sapiens
ggaaugcaauagcuagaauuguuuuucucugaccugaaguucaaccaacuccuuccugcuuugguccagagagacagcuaguugugaauuaugcauucc

SEQ ID NO: 1295 - RNA, 108 nt, Homo sapiens
gcucuccugcucuguucagaccagggugaggaauguaagguggaucauagggaacuucuuuucccauguugcauuccugcucagguggcggagcugaacaaggagggc

SEQ ID NO: 1296 - RNA, 120 nt, Homo sapiens
gcagaagaaugaacugcuccuucucccauacccauugcauaucggaguugugaauucucaaaacaccuccugugugcauggauuacaggagggugagccuugucaucgugaaucuucugc

SEQ ID NO: 1297 - RNA, 126 nt, Homo sapiens
gcacagcuaaugccaugcaaauuggcacagaggcaaucagccugacucuaaaagcugccccacuggccgcaggcuggcucauugucuuuucugucaauuugcaucucauuacccagaaggcugugc

SEQ ID NO: 1298 - RNA, 103 nt, Homo sapiens
gagugugaaccuucuguaacucgcagcugugcuaacuuuuggagguuucuugaaaaauucuagucaguuuggguuaaagaaugguuucaguaaugucacacuc

SEQ ID NO: 1299 - RNA, 115 nt, Homo sapiens
agaaccaucucuugcuucuucugucagcaucuucuuccuguaccaucuauaaugcuguugcauaggaccaggggagaugcuggccugaagcaggggcagaggucacugugguucu

SEQ ID NO: 1300 - RNA, 147 nt, Homo sapiens
uuguuuguaggaagcuacaaagcucacucuuacccaaagucagcaacccuuuuuacaugcuuuuucagguacccggcaaagcaaauggguuggugacuuugggcaagagagagcuuuuuagcuuccuuguuucaaaguagcagacaa

SEQ ID NO: 1301 - RNA, 92 nt, Homo sapiens
uggagauugcaggcagcuuuuacuuaucuaugcugcccacgcuuaacauggaaaacugaaagcugaccuuguguuccuuuaaaaaaucucca

SEQ ID NO: 1302 - RNA, 163 nt, Homo sapiens
guguugcucuuugaaaucaugcuaagaggaaguugugaugcaaaagacuauauguggguguuauaaggcacccaccagaugauuuaugaggcacccacauauagccuuuugcuucacaacuuccuccuagcaugauuucacagucccucaguuacagcagcac

SEQ ID NO: 1303 - RNA, 96 nt, Homo sapiens
gcccuaccaggcaugauacuggaguugucccaugggcccuggaauaccauggguagcucuggucuaaugccucaagaaauacaugggggguggggu

SEQ ID NO: 1304 - RNA, 107 nt, Homo sapiens
acggcccuauggcuugguuuccagauaucuggagaaaagugugcuuucucuucuuccaugaaaucacaaauuucucuagauauuuggaaaccaagucacaggguugu

SEQ ID NO: 1305 - RNA, 77 nt, Homo sapiens
gcuugggaaacauacuucuuuauaugcccauauggaccugcuaagcuauggaauguaaagaaguauguaucucaggc

SEQ ID NO: 1306 - RNA, 89 nt, Homo sapiens
acaaaaauacaguugaugacuugaugaaagggcugcaccuucaagccauagaugcagcccuuuugucaagucaucaacugcauuuuugu

SEQ ID NO: 1307 - RNA, 83 nt, Homo sapiens
cuucucuuauucucccuguuuucauccuacuuuuaaguaauaaauuuggcauuaauggaaggggagcagggaggaaggagaag

SEQ ID NO: 1308 - RNA, 133 nt, Homo sapiens
uugaguuuagugcauguaaaauguucccagcaaaguucugcuggagguaagccuuuuuagauccaagauuuucaaccuaagauuuaccuccagaaguauuuugcugggaaaauuuuacaugcaccaaacucaa

SEQ ID NO: 1309 - RNA, 89 nt, Homo sapiens
augaguaaacacaugcacauaaucaacugugccugacauguggcacuuuguguugcagacacagcugaugaugugcauguguuacucau

SEQ ID NO: 1310 - RNA, 89 nt, Homo sapiens; identical to SEQ ID NO: 1309

SEQ ID NO: 1311 - RNA, 78 nt, Homo sapiens
gcagugggaaggggggccgauacacuguacgagagugaguagcaggucucacagugaaccggucucuuucccuacugu

SEQ ID NO: 1312 - RNA, 80 nt, Homo sapiens
agauaauuagucaaauaaacagaugaauauuugugggaggaaggacacaaauauucaucuauuuauuugaucaauuaucu

SEQ ID NO: 1313 - RNA, 71 nt, Homo sapiens
guauauauaaugauuuuacgggcaguugaugacuugaaaccuagacugucuguuagaguuauaguguauac

SEQ ID NO: 1314 - RNA, 83 nt, Homo sapiens
gguuccuuacugugcuauggagaaauuuguuaccuaaguuuuacccaccaguaauaaguuucuccaaagcacagaaaggaauc

SEQ ID NO: 1315 - RNA, 69 nt, Homo sapiens
acaaauguauucuguccaaguggaagccgguuaaguuccgauauccucagcucgacagaacauauuugu

SEQ ID NO: 1316 - RNA, 71 nt, Homo sapiens
cuaccuucacuaguaguucuccuuuagucuuggucucacucauuaguagagaaccuugcuagagagggugg

SEQ ID NO: 1317 - RNA, 75 nt, Homo sapiens
aaauugggaggcagaagauuuuguuucaagucucgauuuugccaccuacuagaugggaucucugccccucaguuu

SEQ ID NO: 1318 - RNA, 66 nt, Homo sapiens
acccccacauuuuugagucuucauccuuuauguuaaacauuggggugaagaauaaggagugggggu

SEQ ID NO: 1319 - RNA, 69 nt, Homo sapiens
ucucauggagcuuagggucagugaagaucuaaaauacaucaacacuuagaucuauuaggugcuaugaga

SEQ ID NO: 1320 - RNA, 74 nt, Homo sapiens
ggacccugacuugucucgcgguuacugggccggcgcgagcacgcgaggcucgggggcggcacggggcgggguuu

SEQ ID NO: 1321 - RNA, 112 nt, Homo sapiens
gucauguaauagugcuguuuuuucucugcucacacuuccucccccugugauuuaacacuaaguacucggggaggagcugaacacgggaaaaaccaagcuauuacugcaugac

SEQ ID NO: 1322 - RNA, 106 nt, Homo sapiens
gguuguguaggcacaguucaggaaucagaggaaugugucaaguuucucauucaaacggaagcaugacuuuguugauuucugagguggcagacgugccaacgcaacc

SEQ ID NO: 1323 - RNA, 89 nt, Homo sapiens
guuucuguaguauaauauccccccaauauucccaugcccuauucccaagauuuugaggcauauuuggggggauaugauaucacagaaac

SEQ ID NO: 1324 - RNA, 90 nt, Homo sapiens
augaguaaacauacgcacacucaucaacugugugugacauguagcacuuuggguugcaggcacaguugaugaugugcauguguuacucau

SEQ ID NO: 1325 - RNA, 79 nt, Homo sapiens
gcgcgguuaccugggcagcagcuccgggcaccgagguccccuucacguuucaguuccuggagcugcucgggaaccgcgc

SEQ ID NO: 1326 - RNA, 164 nt, Homo sapiens
uuucuagaaguuugucagugcaugauagaaaaguaguguuuuuuugggagcagcaaaaaauuaacaucucuucaccuucccaggugaacagaagaugaaaguugcuuuucugcuuucaacuuuaagcaugcuucuugccaugauuguguaaaaacaucuaggaa

SEQ ID NO: 1327 - RNA, 67 nt, Homo sapiens
uuuucuugauuuuuuucccuguggccuuuucaaugauaaaggcauuuaggagaccagaauaagaaaa

SEQ ID NO: 1328 - RNA, 59 nt, Homo sapiens
gcuccuucaccccccaccucauguagaagggugcugaggcgucgggagggaggaggagc

SEQ ID NO: 1329 - RNA, 92 nt, Homo sapiens
cacaaaagaggcuaguuucagacugauuucacaaugcauguuuggucacauuaugaaaaguagucugaaaaacugaaaaugcugcuuuugug

SEQ ID NO: 1330 - RNA, 70 nt, Homo sapiens
cagccuggagccacuguucucauuccgucuuguguuagcagaacaaugaacugcagcaggcacugggcug

SEQ ID NO: 1331 - RNA, 79 nt, Homo sapiens
ccagcuucaccaagcccgugcuaggcaggauguggaaaucaagccugucuuccaguggggcacggggguggggagcugg

SEQ ID NO: 1332 - RNA, 108 nt, Homo sapiens
gaaaagaaacucccaguuaauucagaguugcuuaugucaggugagagggguagacaccaauucucucucaccuggcauaagcaauucacaauuaacugaguucuuuuu

SEQ ID NO: 1333 - RNA, 68 nt, Homo sapiens
gucuagucauacccaccccagaccuuugaaaguaccaaugaagaauguucugggguuguggacuaggc

SEQ ID NO: 1334 - RNA, 114 nt, Homo sapiens
ugauuauaauguccacagcugaaggcacuauuucacaauugagauuacuacuuuccagaugaaaaaaaauucugagcuguggaauaaugccuucagcuacacacacuguaauca

SEQ ID NO: 1335 - RNA, 74 nt, Homo sapiens
uuucuacuauuagcacaauuguaauauuuaucaaacaggcagcuguuuuaauguuacaacugguaaaguagaaa

SEQ ID NO: 1336 - RNA, 112 nt, Homo sapiens
aguuuuuaaaaagaauuuucuuaucuguauuagaaauauaagaauguggguuuucaugaaaacucacauuuucauaugacgguauagauguauuuaauaauuucuaaaaauu

SEQ ID NO: 1337 - RNA, 69 nt, Homo sapiens
gaucccuaagggugcugcucucugugacugacauccgguuaggaguagaggcaguuuccccuggggauc

SEQ ID NO: 1338 - RNA, 92 nt, Homo sapiens
guuucuggaugcuaaguguggagaaggaggucuuggaggcccaguuaugaccacacuuccaagccacauucuccaugacuguagccaggaau

SEQ ID NO: 1339 - RNA, 95 nt, Homo sapiens
auuuccuaauaaauuaacccagcuuuucaaaauggguccccuagaacuguacccagggacuguuuuugaaaaguugaguuaauguacuaggaaau

SEQ ID NO: 1340 - RNA, 77 nt, Homo sapiens
cucacugaaucaagauguaucgacucuauucaugucugcggacaucuuugaauccuuuacaucugagacucaguggg

SEQ ID NO: 1341 - RNA, 63 nt, Homo sapiens
uaggucaaaguaaacagauuauacaagaauaauauuucuugauccccugugaaccuugaccug

SEQ ID NO: 1342 - RNA, 73 nt, Homo sapiens
ugagcagcauggccauccugggcuucccuuaacacgagggcugggauugagcaagggaugggcgggcugcuua

SEQ ID NO: 1343 - RNA, 81 nt, Homo sapiens
cagucagaaaugagcuuauucauaaaagugcaguauggugaagucaaucuguaauuuuauguauaagcuagucucugauug

SEQ ID NO: 1344 - RNA, 70 nt, Homo sapiens
gaggaugcaaggaauggcuaggguuacccucugcugaagcaggaaacagcucagcuaugucugcaucuuu

SEQ ID NO: 1345 - RNA, 84 nt, Homo sapiens
cccuguccaccucaccucccuccccucucauccaucgucagccauggcucaccgggacagggcaggggaggugggagggcaggg

SEQ ID NO: 1346 - RNA, 100 nt, Homo sapiens
ccauacuuacauuuuacccggcagucaauauuuucacuuggauucuguggaccaagcauccaagugaaaauguugacugccagguagauugcaagugugg

SEQ ID NO: 1347 - RNA, 81 nt, Homo sapiens
uuuuacagacuugcugcucugaguuagcuugacccuccacuguuaagguggggaaagcaauucaagcagcagauugugaaa

SEQ ID NO: 1348 - RNA, 76 nt, Homo sapiens
gagggggcauguggacucgaguaucaggcccgcccaagccuggagucccgccugaaacacggaucccagccuccuc

SEQ ID NO: 1349 - RNA, 71 nt, Homo sapiens
uguuugguaguuggggucggguuuguaguauugcagugugcuuuaacaagcaugggcuuugacaucagaca

SEQ ID NO: 1350 - RNA, 72 nt, Homo sapiens
gggcuuugagguuuucaugccugaugauggccaggaacccuucucaguaggcauugaagaccagcagagucc

SEQ ID NO: 1351 - RNA, 72 nt, Homo sapiens
gggcuuugagguuuucaugccugauaauggccaggaacccuucucaguaggcauugaagaccagcagagucc

SEQ ID NO: 1352 - RNA, 73 nt, Homo sapiens
auaggggaaggggugaguugggagggguuguaggggcucccuucuccccuuuccacuuccccugguucccuau

SEQ ID NO: 1353 - RNA, 107 nt, Homo sapiens
gcaacagcaacagcagugaauaaacaaguuaucaccacagcccuuguucuuaccccuuacagcugggagcagaggcugggagaucgaugcugcuugucagcuguugu

SEQ ID NO: 1354 - RNA, 88 nt, Homo sapiens
aacucuauagaaaucagcaagacaauuaaugaggaaauacacaaauaauuuccagcuauuaauguuuuugcugaauuugaauagaguu

SEQ ID NO: 1355 - RNA, 70 nt, Homo sapiens
gcccggcuauuuggcgggagcagaaauugccuguccgguuuuaugaucugcucagccugagcagccgggu

SEQ ID NO: 1356 - RNA, 59 nt, Homo sapiens
aauuagucacagcuagagccugaaauuuaucacagaaaucucuggcugagaggcugauu

SEQ ID NO: 1357 - RNA, 87 nt, Homo sapiens
gaccucagagguuggugacuuacaacauaccauggagcuuuacccaugcccagguccgaucagugugucccaacuguagcugggguu

SEQ ID NO: 1358 - RNA, 55 nt, Homo sapiens
gccucggcacucucaccuucucgguuggccugcaagguggaagcuuggcugaggu

SEQ ID NO: 1359 - RNA, 130 nt, Homo sapiens
caguaagcaggauaugcagacauguaggaggucuaaccggcugcugaaaacuuggacccucagggccugacuacagaggcuggauggacuugccuacugugugcagguccaacuccugcuuggcuuacug

SEQ ID NO: 1360 - RNA, 72 nt, Homo sapiens
gagaugugaaguuugagaugucuauuacucaucuaaguggaguuugcaaguaggcagucagauauacaucuc

SEQ ID NO: 1361 - RNA, 92 nt, Homo sapiens
gggaacuaaauucauuccugaugccagaucugaucgagucaguaugucuucagcuugaucagauuuuaaaaucaguuuugaaagugguuccc

SEQ ID NO: 1362 - RNA, 95 nt, Homo sapiens
gaucauguaaugggcagcuaauacuccuagugggggggguuccuaauuuggcugcucuccccacuuuuguauuguuaaggcaccgaggcaugauc

SEQ ID NO: 1363 - RNA, 104 nt, Homo sapiens
guaaggggaacaaaugagaucguguaggcgaugccacuuugcacauucugaagcacuaaaugaaugugcaauggugucaccacauggucuuuugccucuuuugc

SEQ ID NO: 1364 - RNA, 72 nt, Homo sapiens
ggguuuucaaaggaggcagaguagccaagcucuuggcacaagagccagcuguacugccugcucaggaaaucu

SEQ ID NO: 1365 - RNA, 116 nt, Homo sapiens
uguaggugaaaagcuuagcacagguccuggcugauaaacaauaguacuuuauaaucaccauugaggaguuuauuuuauuguuuauuuccgggauuaucaggguuuggccacuugca

SEQ ID NO: 1366 - RNA, 64 nt, Homo sapiens
cugcuuucaaucuccucccagugguggcagaggagccucccuggggcugggggcgggagagcag

SEQ ID NO: 1367 - RNA, 100 nt, Homo sapiens
gagacucuaaaaacauguggcuguaaaggcaacaagaaagagucaaaacuuucucccuccuguuuuuguugccuuucuggccgcauguuaucagagucuc

SEQ ID NO: 1368 - RNA, 62 nt, Homo sapiens
ggagagggaaaggcuuuggagucagucuuguccucuggacuuuuuccacuagccccuucucu

SEQ ID NO: 1369 - RNA, 112 nt, Homo sapiens
uccgggccaaauccccuaaggugguaggaaggcggguaagggcuggaccuucgggaggguguugccagcccaguggcuccgccuucacaccccuuacuucucccggcccggg

SEQ ID NO: 1370 - RNA, 80 nt, Homo sapiens
aaugagcaaacccugaacucuaccaaaucacaaaucucauucccaggugauuagugauuugguggagcucaguguucauu

SEQ ID NO: 1371 - RNA, 98 nt, Homo sapiens
gguguguuaaguguuucaaaucacugggguaccauuuuaugagccaaaagaacucauuuaccaaauggguccccagggccuggaauaacaaaugcacc

SEQ ID NO: 1372 - RNA, 79 nt, Homo sapiens
ucacaggaaagcaaggaggaguguguggcuuuccaggucuccauucccgaaugcugcauaacuccccugaguccuguga

SEQ ID NO: 1373 - RNA, 109 nt, Homo sapiens
uuuuccccaagauuuccauuacugcuauaaauuuuucagcguggcuuuuauguaaaugcagcaagaaaggcaagacagaaaaauuuauuuguaagcuuuagggggaaaa

SEQ ID NO: 1374 - RNA, 130 nt, Homo sapiens
ugagucuuaagcucuaaacauaaucaguucccuaagcaugggcaggcuugggaccugccauuggcaaucucagcauuggcaggccugggaccugcucuuugucugccuguguuuucucaauggaggcuca

SEQ ID NO: 1375 - RNA, 104 nt, Homo sapiens
accaagguaaguuaacugcauuuucagugggugcagauuuaucaucagaggcaugauaaucaugcaaccacuagaaaaagcaauguguuuuccauggccuuggu

SEQ ID NO: 1376 - RNA, 78 nt, Homo sapiens
gaauaggaaauuguccaggucauuugauggagauaggauucaaguggcuaucaaugaccugaagacaugguccuauuc

SEQ ID NO: 1377 - RNA, 85 nt, Homo sapiens
gauguuaaaaugggaguuuuuaguaacuugcagcaaccuuuaagaucaggaggcuguugggaguugcuggaagucccuugauauc

SEQ ID NO: 1378 - RNA, 58 nt, Homo sapiens
guucccugaaugcuuuccuguuugauacccuguguguacagugaagggaacagggagc

SEQ ID NO: 1379 - RNA, 79 nt, Homo sapiens
gggauuuuacugcaguugguuuagaauuucuagggguaggagguuucaccuggagagagaggccaacugcaaagaucuu

SEQ ID NO: 1380 - RNA, 90 nt, Homo sapiens
uuaauuucaccagggaggcugagacucugaauuuuucccccuugcaggagggaauaauuuagauuuucuuccaucccugucagaaguuga

SEQ ID NO: 1381 - RNA, 95 nt, Homo sapiens
uggggaccacuagauagaaguuuaagguugggcuuuaaaaaaugccaugccaauuuuugaaucccaccucuacuccuaucugcccuggguuccua

SEQ ID NO: 1382 - RNA, 78 nt, Homo sapiens
gcugggguaccuacagggagacggcagucccaggacugcuggggccuggggcugaccuuuccucuggccggccccagc

SEQ ID NO: 1383 - RNA, 57 nt, Homo sapiens
ggcuucagacuccuuggggcucagaucaaagguagcagauccgccaagccugaggcc

SEQ ID NO: 1384 - RNA, 146 nt, Homo sapiens
aggcagagagcagcauuugagucauuuuggcacagccugcaguguggcuucugcucaggaaugacagugggaaugcagcauuauccaguaggaccagacugcaggcucugggcuagaugaccuggauucaaauccuggcucugcuu

SEQ ID NO: 1385 - RNA, 80 nt, Homo sapiens
gugggugcaguuuacguacuuagugcucuaucugcuuugaggcgggcagagggaaguauuggugcggggagggcgcccac

SEQ ID NO: 1386 - RNA, 128 nt, Homo sapiens
uaaugaccagaguccagggcacugccuggaauuaauggcuggcugggaaaauggcccgggacacaguaaggaccauuaagcccagccaguuauuaauccccaguaagagcuugaugccaaggucauua

SEQ ID NO: 1387 - RNA, 90 nt, Homo sapiens
gagcugggagaauugucugaguucccuggaguagcucccagcauggggagauacaauuaggggaugaccuuagguaaugaagcucaguuc

SEQ ID NO: 1388 - RNA, 93 nt, Homo sapiens
gauaguggagaagugaacucaucuuuggcaauguggcccaaagacaugaucccagggcuauuagcuaaugguggguucugcguugucacuguc

SEQ ID NO: 1389 - RNA, 76 nt, Homo sapiens
cguuuuaaaggaagcuggaguaaauucuguaaaguggagacguuuuuggcaggauaugcaccagcugcuuagaacg

SEQ ID NO: 1390 - RNA, 81 nt, Homo sapiens
agcuuuccaggaucuccugcaauuacacugguuggaguuagccacgaauuaaugaguguaguuguagggagcgggaagguu

SEQ ID NO: 1391 - RNA, 95 nt, Homo sapiens
auagucuuagguuuaccgaaaagugacaaagauggugcauagagaaggaaaucuguguaccaucuuuguaacuuuucuguaguuauaaagauugu

SEQ ID NO: 1392 - RNA, 66 nt, Homo sapiens
uuuauaggaugccauuuaagaucugucugucuggcauguuuagaucauuuuaaauggcucuauaaa

SEQ ID NO: 1393 - RNA, 75 nt, Homo sapiens
cucagaugaugucuucagggaauuuuuggugggagggacccauuuucauucaacuucuuugaagacccauuugag

SEQ ID NO: 1394 - RNA, 91 nt, Homo sapiens
ggaacucuaugcagggaaaugccaccucugugcccuaguuuccucaucuguaaaauucucaggggacaggagugcuuccuugugggguucu

SEQ ID NO: 1395 - RNA, 86 nt, Homo sapiens
auuugucaauuuucacaaagguauucucauuuuggaagcaagugucuuguucuccaauuggcauacuuuuaagaaguaugacaaau

SEQ ID NO: 1396 - RNA, 76 nt, Homo sapiens
aaguguuuauaggcaggggcccaauugugccuaugccaugcaaguuguuggcacuuggcccagccucaggacacuu

SEQ ID NO: 1397 - RNA, 87 nt, Homo sapiens
ccagcaaaauuaccuuugugaugccuaagccguguucauacauauaagccagauugaacauggcuugcgcguugugguauuuguugg

SEQ ID NO: 1398 - RNA, 149 nt, Homo sapiens
gcacagcaauggggccaagagacuggggugggauccaugugguaucugguaucugucaucuucugcagcacuuacauucuuccuguggagauggcagaagccagcauuuuugugucucauuuaauccaucuggccucuccauguugugu

SEQ ID NO: 1399 - RNA, 77 nt, Homo sapiens
ccaaagucauacagagggccagggacuuaggcuuucaugcuggacucuuuucccuggcucucuggcuuggauuuugg

SEQ ID NO: 1400 - RNA, 83 nt, Homo sapiens
ugaauaucauuaggaauggauuauggaaaggucucauauccucaaaggcugagaccucuuccacaguccccucuggguguuca

SEQ ID NO: 1401 - RNA, 88 nt, Homo sapiens
uuaugcucauuuuaucauucauuuagcagacacuuuguauauaccuacuauguaccaggcacuguuauggaugaugcuuggagcauag

SEQ ID NO: 1402 - RNA, 80 nt, Homo sapiens
ucacauguccaauucuguaaaggaagaagagguaagaagaagugaagcccucuucuuccuuugcagaguugaauaugugg

SEQ ID NO: 1403 - RNA, 110 nt, Homo sapiens
gaugucagcggaaccauggggcuaaaguuuuagugcuggaagguugucuauguaguuuuuuucagacauccuccaguggugcaacucagccccaugguuccucugacauc

SEQ ID NO: 1404 - RNA, 78 nt, Homo sapiens
uggugauucccaaaucuguaugcccagaccagagcauuuugcauauuuggaccggacauauagauuuggaaaucacca

SEQ ID NO: 1405 - RNA, 78 nt, Homo sapiens
uacagggacaaaacucagugcagaagagcccucuugagcacucuccuuaacucuucuacacugaguuuuuucccugua

SEQ ID NO: 1406 - RNA, 82 nt, Homo sapiens
cucauucucauguauugcacuaauauaucacuggaaugacaacugcuucugaugaucuauuaaugcaauacaucagggugag

SEQ ID NO: 1407 - RNA, 82 nt, Homo sapiens
uuuuccuacgaguuuuuucaagcuacuacuaaagagcuacucuuucuguuuaguaguagcuuuaaaaagacucuuaggaaaa

SEQ ID NO: 1408 - RNA, 76 nt, Homo sapiens
gcuggguccagugguucuuaacaguucaacaguucuguagcgcaauugugaaauguuuaggaccacuagacccggc

SEQ ID NO: 1409 - RNA, 80 nt, Homo sapiens
acuguucucuaaaagguuucuaaaugauguugauguuaaaaaauauaguaucaccauuuaacagccuuuuaaagagcagu

SEQ ID NO: 1410 - RNA, 91 nt, Homo sapiens
ccauugggcuguggccaccggaggagagaaauccuguggccauguguggucauuucaguuucuuuguuuccagcuuggccacacccaaugg

SEQ ID NO: 1411 - RNA, 67 nt, Homo sapiens
cugcccggcggccgccucccagagcugcgggaaacucuggcugcgggaguuugcggucuccgggcag

SEQ ID NO: 1412 - RNA, 90 nt, Homo sapiens
gcuauuagccaugacaaucugaaagaugacugcugugacgguugagugaugaauggcuaagucaucuuuuagauagucaugccuaauagc

SEQ ID NO: 1413 - RNA, 62 nt, Homo sapiens
auggagagcugagaccucugaugaaccuucuaauaugguaaaugggagucuuaauucuucau

SEQ ID NO: 1414 - RNA, 88 nt, Homo sapiens
auugguucccgcccccuguaacagcaacuccauguggaagugcccacugguuccaguggggcugcuguuaucuggggcgagggccagu

SEQ ID NO: 1415 - RNA, 76 nt, Homo sapiens
ccuguuugcuccucugggcccccugagggacuucugggcuuugguccugcccuguggguaaggaggaucagacagg

SEQ ID NO: 1416 - RNA, 60 nt, Homo sapiens
uuggaauacaaaggaucucuagugucugaaagcaggcauugucucucuuuuuuauuucaa

SEQ ID NO: 1417 - RNA, 168 nt, Homo sapiens
auuauuagcaucuugcaguuugugagccaacugaggcauuagaagucaaguaacuugcucaagguuucauguaauagcaaauacugucauagcuaugugagaccuugagcaagucacuugaucucuaaugccucaacugacacauugcuaauauaagauacuaauaau

SEQ ID NO: 1418 - RNA, 102 nt, Homo sapiens
cccuagagcacaguaaggauuaaacauuaaacugcagauauucgucauugagauuagcguuauuaccaugguuuaauauuuaauucucacuguucucuaggg

SEQ ID NO: 1419 - RNA, 56 nt, Homo sapiens
gggaagggcagggucuaugcaccaacugccuuugugcagaaaaccuuuccuuuccc

SEQ ID NO: 1420 - RNA, 81 nt, Homo sapiens
ugcagacucuaaagguugcacagucuggucucuaucugcccucaaugagaccuaggcucagugcagacuuuaaaguuugca

SEQ ID NO: 1421 - RNA, 81 nt, Homo sapiens; identical to SEQ ID NO: 1420

SEQ ID NO: 1422 - RNA, 65 nt, Homo sapiens
ccccccgccauauugcuguaugaauuuagaugauugccuaaauaaauauauaaauaugugggggg

SEQ ID NO: 1423 - RNA, 76 nt, Homo sapiens
uuuucuggcaagcuugggaugagauuccuuaugauuuaaucagauccauaaugaagcucucccagcuuucaggaga

SEQ ID NO: 1424 - RNA, 78 nt, Homo sapiens
ucuuaugucucuccuaccuuuucucaucauuuuuccucuuccagaguuagauaauguggaauaguggagaacauaaga

SEQ ID NO: 1425 - RNA, 66 nt, Homo sapiens
gggaggggcugaggcagugggaacagcaugaacccuucccucacguuucacuggcuuaccccuccu

SEQ ID NO: 1426 - RNA, 56 nt, Homo sapiens
cugcucaccugccuauuuuagguuggcucaucaucacucuaauuggcaguggguag

SEQ ID NO: 1427 - RNA, 87 nt, Homo sapiens
aaggaguucaguauccauaccacacuaguuuuauuuggucucaaucauuucagucugaaugaacuggggugugugugcuaauuucuu

SEQ ID NO: 1428 - RNA, 73 nt, Homo sapiens
uggguccccagggugggaugcugagagggggcugguaccaucuaguccugcuggcaguuugcccugggacuca

SEQ ID NO: 1429 - RNA, 71 nt, Homo sapiens
cuucagcucggacaguuguuucagauguuuccaauucgucggacugcucagacaucuguuccugguugaag

SEQ ID NO: 1430 - RNA, 87 nt, Homo sapiens
gagugucuccuuugagggauuuuagacagaaggggcaggaagaggucagggccccuuucucuggagucacucagugagcggacauuc

SEQ ID NO: 1431 - RNA, 86 nt, Homo sapiens
uccccuaccccauguaaccccauuuucucagacccaucaaaauuuucuguaacuuggggaauagguaugggguuuggaguagggga

SEQ ID NO: 1432 - RNA, 66 nt, Homo sapiens
gggagggacagaaggaggcagggcccauuuucuaggucagaacuccuugccccugcucuuccuccc

SEQ ID NO: 1433 - RNA, 104 nt, Homo sapiens
ucaucagacauaggcuauccagcguuuacauggguacuggccaucuugcccuuuuugggcaucuguguagauucuguaaauccuggaugacagguuucugauga

SEQ ID NO: 1434 - RNA, 76 nt, Homo sapiens
uagucaagcuccaacugagcuuugcuuugcucuauguuuucccaaagcaaagcaaggcucaguuugaacuuggcua

SEQ ID NO: 1435 - RNA, 68 nt, Homo sapiens
cgcaccacccucccacugugguuucuuuguguccguuauaggaggagccaagguggcagaguggugug

SEQ ID NO: 1436 - RNA, 61 nt, Homo sapiens
gccugaaccuucucccuuccucagaaugaaaccauuucugaguuaugggaaaaguuuaggc

SEQ ID NO: 1437 - RNA, 105 nt, Homo sapiens
guggggagcuccaagcaggugggcaggacccaggggucuggugaccaggacagacccccacuguccaucaccuuuccuggcccuguccucagcugaacuucccac

SEQ ID NO: 1438 - RNA, 59 nt, Homo sapiens
ggagcauacaugaaggauuucucuguggcuaguuccacaaaggaaaucaauugugcucc

SEQ ID NO: 1439 - RNA, 91 nt, Homo sapiens
cucaggcgcggguuggggaggauguuuuggaugccgcucugcugacgcuggugcccucuguucuuacauccuccuuaauuuacugccugag

SEQ ID NO: 1440 - RNA, 70 nt, Homo sapiens
ugguuccucaguuucauuuugacccucacuuccagcugcaaauugaggguucaugaaauuauaggagcua

SEQ ID NO: 1441 - RNA, 70 nt, Homo sapiens
ugguuccucaguuucauuuugacccucacuuccagcuguaaauugaggguucauggaauuauaggagcua

SEQ ID NO: 1442 - RNA, 68 nt, Homo sapiens
caauuuggcugcaggggaguaguggcugggauuagcccuguucugcuacuuacuugcauuuuaaguug

SEQ ID NO: 1443 - RNA, 70 nt, Homo sapiens
uuuggauucaauuuauuuccuaggauauuugugcugucaaauacuuugggaaaucaaauucaaauccaaa

SEQ ID NO: 1444 - RNA, 63 nt, Homo sapiens
uucaucccccacaucccuuuucuaaacaagcuuaguguuacuuggggaauguguugggaugga

SEQ ID NO: 1445 - RNA, 144 nt, Homo sapiens
cucccucccucccucgcuggcucuccuucucuccccacccuucccagcgccagcccuccccacugguuugcaucaucacgcagggaggggcugcgugcugagguaagggggggaaacgggugggcggcuggggaauggggggag

SEQ ID NO: 1446 - RNA, 73 nt, Homo sapiens
ccagauugcucagggagcaggaggaugcaggaagcacaggccacccgcuccugcuguuacugaccuaguuugg

SEQ ID NO: 1447 - RNA, 82 nt, Homo sapiens
gcacaugccuacugagaagaauggcagaaucaccugagcgauauaaguuauuucuccauuuuuuucugugugcagcaugugu

SEQ ID NO: 1448 - RNA, 76 nt, Homo sapiens
caggcagccagaggggccuggcacugagcuggcacggaggagaacggcccugcuggcccaggccccucgcugucug

SEQ ID NO: 1449 - RNA, 83 nt, Homo sapiens
ggggcuuucaagucacuagugguuccguuuaguagaugauugugcauuguuucaaaauggugcccuagugacuacaaagcccc

SEQ ID NO: 1450 - RNA, 111 nt, Homo sapiens
cagauucucauccuauauaacucucugagaauucccacagggaaaucugugaaagaauucagaaacuuuccuugcggaaauucucauagagagacauaggacaagaaucug

SEQ ID NO: 1451 - RNA, 76 nt, Homo sapiens
aaggcuuccagcuacuucuaaaccuaaacaguuaugaguauguugcuggcuagaccuagaauuagucagaagcuuu

SEQ ID NO: 1452 - RNA, 81 nt, Homo sapiens
gaucagggcagucgggggcuggcugcugguaccugagcccuguggccagggucucaguggccguucccugccauccugguc

SEQ ID NO: 1453 - RNA, 71 nt, Homo sapiens
aauuggcucaauaucucccuguugcuguaacacuuugggauuuuucuaggugagauauaaauaagccaauu

SEQ ID NO: 1454 - RNA, 78 nt, Homo sapiens
auuugcuccaaacuaaacugugggcucuucucaacagcgugcaguagagaagagccuacaguuuagucuugagcaaau

SEQ ID NO: 1455 - RNA, 115 nt, Homo sapiens
gggaaggacaaagcgggugaauguccauggauuuuguguagaaacacagccuggguguuuucgggaggcaguucuaccaacagcuauugauaucauuucacguugguuucuucuu

SEQ ID NO: 1456 - RNA, 103 nt, Homo sapiens
uugaggcacaaggaaguugggccacuugcccagggaaguuagaaguugggaguggacgccagcacuggacccugggcaggcuggcuccagaguccugccucga

SEQ ID NO: 1457 - RNA, 113 nt, Homo sapiens
cuaccuaacacugagagcucaauaauauuuuguucccuugcuccuucacucuuauuccuucuggaaagaagaguaaggaagagggagagaaacaguuugguauuuuuagguag

SEQ ID NO: 1458 - RNA, 78 nt, Homo sapiens
uaugcucacagcucagugagggauccggucugucuugcucaccauggcauucuuggucccugcauugagaugagcaua

SEQ ID NO: 1459 - RNA, 124 nt, Homo sapiens
gccaccaccaucagccauacuauguguagugccuuauucaggaagguguuacuuaauagauuaauauuuguaaggcacccuucugaguagaguaaugugcaacauggacaacauuugugguggc

SEQ ID NO: 1460 - RNA, 83 nt, Homo sapiens
ucauuuaaccucucuaugccucaucuauaaaauggggcagggaauagugcuuccauaauaggagagguguggagauuaaauga

SEQ ID NO: 1461 - RNA, 90 nt, Homo sapiens
caccuaugccggaagauuauuucauuggcagguauuuuauugcuucuaaaaguuccauuuuacugcaaugaacaucuuuuuacauaggug

SEQ ID NO: 1462 - RNA, 66 nt, Homo sapiens
ccccacccccacuccccagcuggugccgcugggcuugccaggcccgccugggauguccgggugggg

SEQ ID NO: 1463 - RNA, 80 nt, Homo sapiens
acacggggccugguccagcccaacccuugucucagccuggcccaaaagcaaggacugggcuggguuauuauuccuugugu

SEQ ID NO: 1464 - RNA, 86 nt, Homo sapiens
aggguuggccaggcuguguucugaucaucacccugcuccuuaccgcugggugaucuuaagcaaagcacacagcucccucuagcccu

SEQ ID NO: 1465 - RNA, 82 nt, Homo sapiens
cucugucucccaggagacugagggacagucaaggccacugagucaccaccuugcuguucccuuucagucucuccagauggag

SEQ ID NO: 1466 - RNA, 179 nt, Homo sapiens
uuugacuucccaucugacuugggugcguuguugaagcucucagcaccuccagcucaccaucugcaggauagaucaucagaauguaacagaccauuuauucugaugaccuuguuuuauugauguagaaauugaggcccugaaaguaaagcaauguucccaaggucacagcaugaguuaga

SEQ ID NO: 1467 - RNA, 84 nt, Homo sapiens
ugagcuauccccugccuuggcuggcgccgggcuagccacaccuguuugccaucagggcugucucggcccagccaguauggcuca

SEQ ID NO: 1468 - RNA, 78 nt, Homo sapiens
ucaugccacgcaugaccccaagucuuagguuuucuaucucuuuugacaucauaaggcuugggguaauguauggcauga

SEQ ID NO: 1469 - RNA, 90 nt, Homo sapiens
ggccugugcgcauguguggguuugugugagugcccauguaugcacacguguauaugcauguacccacacaggcccaucuccucacaggcc

SEQ ID NO: 1470 - RNA, 73 nt, Homo sapiens
gguccuggcugauaaacaauaguacuuuauaaucaccauugaggaguuuauuuuauuguuuauuuccgggauu

SEQ ID NO: 1471 - RNA, 70 nt, Homo sapiens
auccuucccuguagccuaagucuuuccccucaacuucucuuuguagugcagauuagcuacuuggaaggau

SEQ ID NO: 1472 - RNA, 68 nt, Homo sapiens
cuaauggccuaauaaugcauuagacuugaaucagaaauacuuuggguuguagugcuuauugccauuag

SEQ ID NO: 1473 - RNA, 106 nt, Homo sapiens
uggaaauacuucuggcugaagcauugcucaguaaauugcugauaaaugacuuccaucuggaauauacuuggucagcaauuuaggaagccaugcagauuuauuuuca

SEQ ID NO: 1474 - RNA, 82 nt, Homo sapiens
agcucugucuucucaccacuucuucuggaggauucccugaggaagcugcuggaucuuucagaaggugcugaugaacagagcu

SEQ ID NO: 1475 - RNA, 88 nt, Homo sapiens
uuuccauucuaagcccugcucuucagcacugaaugaaggucaauauuucuaucuuuauuaagagcuaauggcaggugcucgaugggga

SEQ ID NO: 1476 - RNA, 58 nt, Homo sapiens
gccuuuuacuaacacucuuuucacaauucuggcugagagaggaaugugaauaaaaggc

SEQ ID NO: 1477 - RNA, 138 nt, Homo sapiens
guaaauugcucauuuuugaaggugcauuaacucuuccaggccccuaggguaucauuuaguucacuggaauaguaauuuacuaaacuguaccuuaggggccugaaaauguuaaugcaccuccaaaaguuucuaauuuac

SEQ ID NO: 1478 - RNA, 96 nt, Homo sapiens
guccaucucucucuucuucuugaguaacaucagauucuucaucagugccaacugaagucccacucugauucaacuuggcaggagacuuagauggac

SEQ ID NO: 1479 - RNA, 97 nt, Homo sapiens
aggccuggcucagggcugaagggcuggggcuagcucugaccaguucuugcugcucuaccugccagagcuggccagguccuuccaacuucccaggcuu

SEQ ID NO: 1480 - RNA, 105 nt, Homo sapiens
guggggagcuccaagcaggugggcaggacccaggggccuggugaccaggacagacccccacuguccaucaccuuuccuggcccuguccucugcuaaacuucccac

SEQ ID NO: 1481 - RNA, 105 nt, Homo sapiens; identical to SEQ ID NO: 1480

SEQ ID NO: 1482 - RNA, 105 nt, Homo sapiens; identical to SEQ ID NO: 1480

SEQ ID NO: 1483 - RNA, 105 nt, Homo sapiens
guggggagcuccaagcaggugggcaggacccaggggccuggugaccaggacagacccccacuguccaucaccuuuccuggcccuguccucugcuaaacuucccgc

SEQ ID NO: 1484 - RNA, 105 nt, Homo sapiens
guggggagcuccaagcaggcgggcaggacccaggggccuggugaccaggacagacccccacuguccaucaccuuuccuggcccuguccucagcuaaacuucccac

SEQ ID NO: 1485 - RNA, 105 nt, Homo sapiens; identical to SEQ ID NO: 1484

SEQ ID NO: 1486 - RNA, 105 nt, Homo sapiens
guggggagcuccaagcaggugggcaggacccaggggccuggugaccaggacagacccccacuguccaucaccuuuccuggcccuguccucagcuaaacuucccac

SEQ ID NO: 1487 - RNA, 105 nt, Homo sapiens; identical to SEQ ID NO: 1486

SEQ ID NO: 1488 - RNA, 105 nt, Homo sapiens; identical to SEQ ID NO: 1486

SEQ ID NO: 1489 - RNA, 105 nt, Homo sapiens; identical to SEQ ID NO: 1486

SEQ ID NO: 1490 - RNA, 105 nt, Homo sapiens; identical to SEQ ID NO: 1486

SEQ ID NO: 1491 - RNA, 105 nt, Homo sapiens; identical to SEQ ID NO: 1486

SEQ ID NO: 1492 - RNA, 105 nt, Homo sapiens; identical to SEQ ID NO: 1486

SEQ ID NO: 1493 - RNA, 105 nt, Homo sapiens
guggggagcuccaagcaggugggcaggacccaggggucuggugaccaggacagacccccacugucuaucaccuuuccuggcccuguccucagcuaaacuucccac

SEQ ID NO: 1494 - RNA, 105 nt, Homo sapiens
guggggagcuccaagcaggugggcaggacccaggggucuggugaccaggacagacccccacuguccaucaccuuuccuggcccuguccucaguuaaacuucccac

SEQ ID NO: 1495 - RNA, 114 nt, Homo sapiens
gugacucucuccauucagagcaccccuuagacagauucugaguugaguagggcuccccuuaggucugcccugcuuguuguggacugucuaaagggcacugcuguaaagaguuac

SEQ ID NO: 1496 - RNA, 58 nt, Homo sapiens
ugggacaucugugauuucagucuaaugacauuucgugaggcugggauccuguguccca

SEQ ID NO: 1497 - RNA, 92 nt, Homo sapiens
guugucuccuuaauccuugcaacuuaccugagucauugauucaguaaaacauucaauggcacauguuuguuguuagggucaaaagagauaau

SEQ ID NO: 1498 - RNA, 92 nt, Homo sapiens
uuucuccccuuugcuacuucaggucuugagaagagugugcuuuuauggaccauguauucuuuucucuggauggauguagcuugugggagaag

SEQ ID NO: 1499 - RNA, 84 nt, Homo sapiens
cgccgccggcgccgucugucggcagccgcccugggccuaggccgcaggguccacaggcggcccugacaggcggcggcggcggug

SEQ ID NO: 1500 - RNA, 77 nt, Homo sapiens
agcagguagaaaggaggcgcaccuuacaagauuccucaucccuuccuccuugaugagguccuucuuuugugccugcu

SEQ ID NO: 1501 - RNA, 63 nt, Homo sapiens
cugcagccgguugccgggugacgggaugcugccccgcaauguuaccucggcaacgggcugcag

SEQ ID NO: 1502 - RNA, 106 nt, Homo sapiens
gcagucauguuggccaacucucauuuuagguguaagguauaucagccuccuucagucucaggugcaguccuuauaccuaaaauugagggcuggccaagaugacugc

SEQ ID NO: 1503 - RNA, 149 nt, Homo sapiens
accauacggagauaacacaugcggaaaugcuugacacuuaguaggcauuuggaaaaggugaauugacucugaaucaugaaaacugucaaaucacauuuuucaagccuaccacgugccaagcguuuccacgugaguuaucuacguguggu

SEQ ID NO: 1504 - RNA, 116 nt, Homo sapiens
uuuccuaugaguauuuuguguaaacuuguaaaaggccccagaaaagcaucgggguucucaguccaguguguuuuucuggugcuuuuuacaaguuuacaugaaauauugaugggaaa

SEQ ID NO: 1505 - RNA, 112 nt, Homo sapiens
ggagaaaggcaggggacuuggcaagaagccagagcuggagaggucugcucaggccaaccugaccuccuccuugaccccuuuggcuucuggcuucuccuccuugguuuucucc

SEQ ID NO: 1506 - RNA, 69 nt, Homo sapiens
cuguuggggaauaugcaugaaaacaucuggccucuguacagggcagaguuuucauuauauucccaacag

SEQ ID NO: 1507 - RNA, 75 nt, Homo sapiens
ccaggcuuguggccuguucugccuucugaguuucugugcuuuuagguaacuagagggcaggaggccagagucugg

SEQ ID NO: 1508 - RNA, 119 nt, Homo sapiens
gagagagagauuuugugaguuagcuggucaguuccucugcugguuuuuucagagcuaauuuauguagaaguauucagcuggaggagcugaugggcuacaggguccaagaugucucucuc

SEQ ID NO: 1509 - RNA, 93 nt, Homo sapiens
caauaugugugcuaaacugaucaauaauaagauugauacaucuucuacuuggguaaguuaaucuucuuauugaucagcguagcaaacauauug

SEQ ID NO: 1510 - RNA, 86 nt, Homo sapiens
ggggaggcgaagaauaagugccuugauuuugcagcuuuuucuuuccuaagggccugccugggaaggguauugcuucuuguuucccu

SEQ ID NO: 1511 - RNA, 59 nt, Homo sapiens
ucuguuuugugucucucugguguuuggugacauaacauaauaagauggcaggaggcaga

SEQ ID NO: 1512 - RNA, 69 nt, Homo sapiens
uucccgucgccguugcccauggcuucgcacacaggucagugcucggccggggcgggcgcgggacgggag

SEQ ID NO: 1513 - RNA, 75 nt, Homo sapiens
ugccauuuguuuuaucuguucuucagucuguucugucaguacccacaggcaggagagcagaaaggagaaauggca

SEQ ID NO: 1514 - RNA, 65 nt, Homo sapiens
gucugguugcuugaugagauuagaggacuuucacuugucuuguaacugcucauaggaaaccagau

SEQ ID NO: 1515 - RNA, 85 nt, Homo sapiens
acagugcagucacccauaaaguagaaagcacuacuaacagcacuggaggguguaguguuuccuacuuuauggaugaguguacugu

SEQ ID NO: 1516 - RNA, 82 nt, Homo sapiens
aauucuuugaggccacaaggguaucauuuauuaaaugacugcugcaguccucuaaaugggccccuuuugaccugaaagaguu

SEQ ID NO: 1517 - RNA, 103 nt, Homo sapiens
ggaggagggucccauacccagccaucaugccucuggagcugaacacucagggugcaggcacucguggguccccaguuccugagcagcacccggagccuccucc

SEQ ID NO: 1518 - RNA, 67 nt, Homo sapiens
gacuucaggaugcucacaguccaguguccaggcagaacugggccauggcugcuggccaucuggaguc

SEQ ID NO: 1519 - RNA, 94 nt, Homo sapiens
cuuccuguggcccuucaaauugucuucuccacgagguggaaugaagaaaaagaccacccauuuuguagaagguagagaugcuggcaacagggag

SEQ ID NO: 1520 - RNA, 69 nt, Homo sapiens
gcgcuccugcucgcggccucucccagucccggaauuggggcugcggaucuaaggcugggaggggagugc

SEQ ID NO: 1521 - RNA, 80 nt, Homo sapiens
uuuacagaggaggggacagaggcuccagcugcccuagagacagauucaccucucugagccucaguuuucucaucuguaaa

SEQ ID NO: 1522 - RNA, 77 nt, Homo sapiens
uaguguguguguuucuuccacuauauggugauaucguggaagaauaucacaauauaguggaagacacaaacauacua

SEQ ID NO: 1523 - RNA, 105 nt, Homo sapiens
ggggccuugcuaaauguggaggguauccucaugaggggaaauaggaucaaaacaugaaggaacugggcccauaugaggcugcccuugaaugcagaggaaggcccu

SEQ ID NO: 1524 - RNA, 83 nt, Homo sapiens
ucauucuugcaauauugaaacaaacuccagugaacuuguuugaagcugguucaguagagauuguuucaacacugaaggaauga

SEQ ID NO: 1525 - RNA, 69 nt, Homo sapiens
gugaaggaggguucucagaggauccuagcaaagaaaacagcacauaggauucccuggaccauccuuuac

SEQ ID NO: 1526 - RNA, 105 nt, Homo sapiens
ugagagguggcuuuuuccuguggugccaggcuuuuguaaucuuugcucuugaccuucgccgggagggggugcagaaguuuggagcaccauggauguaaccuuuca

SEQ ID NO: 1527 - RNA, 66 nt, Homo sapiens
ugucagcuguucuuuucucuauuccugguucaaagccaacauuaucagaagggagacaaguuggca

SEQ ID NO: 1528 - RNA, 86 nt, Homo sapiens
gguuuggagggcugcguucauuuugagugcuguuguaaucaauuuuagauacagcauuccacaauggaucaguuugcauccaaacc

SEQ ID NO: 1529 - RNA, 67 nt, Homo sapiens
gcauaugggaacaguuuuguuugaaagcaugaucagcauucuuugcaaacaagcuguggccauaugu

SEQ ID NO: 1530 - RNA, 132 nt, Homo sapiens
uguucccugaguuccugggugcugaggaauuaauuacccuccccgcucagccggcccugcugaggucaggggugcaggccugugugggucagggugagauuauccgggacaggucuaaggagcaaggggaca

SEQ ID NO: 1531 - RNA, 80 nt, Homo sapiens
uuagugaggaguucaggcagcgauggagacuuuggcacugagggccagagcgugaagucucccugccaggaucucauuag

SEQ ID NO: 1532 - RNA, 69 nt, Homo sapiens
agugaacugauucuaugcuucugaaucaucugggagcuggggagauuuggggagcagaacugguucacu

SEQ ID NO: 1533 - RNA, 63 nt, Homo sapiens
cccggcgcgagccucgggccgggcgcugauugggcaggcagcggccgacgcggcggcgccggg

SEQ ID NO: 1534 - RNA, 163 nt, Homo sapiens
aggguaaagaaaggauccuaaaagcagcaagagaaaagaaacagauaacauacaauggagcuccaauacaucuggcaguauauuuuucaguggaaaccuuacaagccaggagagagugacaugacauauguuaaagugcugaagggaaaaaaccuuuuacccu

SEQ ID NO: 1535 - RNA, 98 nt, Homo sapiens
ucaucagagaacacuccuccacuguauugagauuucauugugggucagagagugugagcagcaauaaggucagauggggugaggauacaaucugguga

SEQ ID NO: 1536 - RNA, 64 nt, Homo sapiens
uggugggugaaguuaugcugggguggaaagcgggugaagcguuucaggauaaaaggacccauca

SEQ ID NO: 1537 - RNA, 150 nt, Homo sapiens
uaauuugagaguaacaagaaaaauagauugguaagaugauacaccacaagccaguugucguguaugaaacuacauaaauauauaugcacacuacaacuggcuugugauguaucaucuuuccaaggcauucuucuuguuaauauuaaauua

SEQ ID NO: 1538 - RNA, 59 nt, Homo sapiens
cuggcccugagugccccucggcccgguguuugcacuugggcugccagggcaggggcugg

SEQ ID NO: 1539 - RNA, 89 nt, Homo sapiens
gagcaggugagugaugggcaucaacccccauccaggaagaugugaaugcuaucugggcuggggcugagccugucguaccaugccugcuu

SEQ ID NO: 1540 - RNA, 149 nt, Homo sapiens
cuucuucugagauacaguaguaccaaaaauaggcaaaaauucccucauggagcuugcaucuaguaaggggaaauugacaacugaauacaagcuccacgagggagcacaucguauuuuuuugcuagaacaugguaaugcuauggaagaag

SEQ ID NO: 1541 - RNA, 98 nt, Homo sapiens
uauacauagauuccuauaucccuauuaaaauguguguguauguauuucauuggauauagggaucaauacacauuuuaauaggauacaggauauguaua

SEQ ID NO: 1542 - RNA, 91 nt, Homo sapiens
caacuacugauaccuccccuuuauccagcuuugugugcccugggcggguuggcuugguguacaaggcugccaagagaggagggggugguug

SEQ ID NO: 1543 - RNA, 105 nt, Homo sapiens
uauuagaagcauguucaaggagcagccucugggguuaauagaguuuaauuugcaagacaaaugaaagcuuauuuucuccuaggcucucugcucauaauucuagua

SEQ ID NO: 1544 - RNA, 88 nt, Homo sapiens
ccuguucugcgaggaacagugggauugacugaacuaaacaggacuuuccaagcucuagguucaguuauccuauccucagaggaacagg

SEQ ID NO: 1545 - RNA, 143 nt, Homo sapiens
cguccuucgcauuccugggcuggaggaauaaggauccaauugugguuucugcgcugguuaucuuggugccgccgagggggccaccggggaaaaucugcugaauucuuccuuuucuauuuucugccucggcgaggaggagggcg

SEQ ID NO: 1546 - RNA, 101 nt, Homo sapiens
agguaagagccauccaucacacgccucccguucccccacccagagaaauuaaagcugugcugggggguggggggauguguuuguuuuuuaauguuuugccu

SEQ ID NO: 1547 - RNA, 92 nt, Homo sapiens
uagggucugcgcuucugugggggcaggaggggcgucacugugcacagccuagaugcccuggccuguccccgcagggacaagacaagacccug

SEQ ID NO: 1548 - RNA, 86 nt, Homo sapiens
cuuuuguggguugggguaggaggguaagucuuacugaguuuaacaacacauacucagaagaagcucuccuuuucaaggcacagagg

SEQ ID NO: 1549 - RNA, 78 nt, Homo sapiens
uugcagcaggaaauguguuauuauuguaauugucugaugcuaauuauacuuauuacuauaauaaccauuuuguuguaa

SEQ ID NO: 1550 - RNA, 57 nt, Homo sapiens
uucauucagguguauuuauggguuuauauuuacccaauaaauauaacaauggaugaa

SEQ ID NO: 1551 - RNA, 121 nt, Homo sapiens
guguguguggaggggaggugggaggucauaccugagcagucugggggacucuugcucaggggacaggaagaguguucuagaaacugcucuuguuauacccccgcuccaccaaaauacauac

SEQ ID NO: 1552 - RNA, 81 nt, Homo sapiens
ggaacgguggaucaaagagcacagggugagagcuggaaaauaguuaauuaaguuuuuauuccuuuuucuuugugcuguucu

SEQ ID NO: 1553 - RNA, 95 nt, Homo sapiens
ugcugcaggggauuaagggaaguugagggugaaccauuuuggccacuggaucacaaacaaauuggcucgccuuuaagguuuacauggcugcagca

SEQ ID NO: 1554 - RNA, 87 nt, Homo sapiens
ggcccgagggguuaucugccuuccggggacgguaggggauguagacaagagccuagcguuccuggaaacagguguuuaauuugggcc

SEQ ID NO: 1555 - RNA, 139 nt, Homo sapiens
guucccuagguuuccaagguccaaggccccaggaaauauaaagagaccauggcuucucaaacauuaaaguuuagaggagaagccacuggucuauuuauauuuccucugccacuuaggccuuaggaucauuguagggggc

SEQ ID NO: 1556 - RNA, 66 nt, Homo sapiens
ugcugugggucuggagccaaucugguugaacuuuuucagccccugacuggcuccaguguuauggua

SEQ ID NO: 1557 - RNA, 109 nt, Homo sapiens
gcucucauguugcuaaaaauuauuugucuuauaggaggaagagaauuccucaaaucccacaaaggcaacucuucuuccugaagacagcagcuuugccaguaaugagggc

SEQ ID NO: 1558 - RNA, 101 nt, Homo sapiens
agcgguggguguggcccuugggugcagagugggcagcugguuccagagauuuugcagccccgcugguugaucaccuguacccuauaaaaaugucuaccgcu

SEQ ID NO: 1559 - RNA, 78 nt, Homo sapiens
guuuagugguacuauaccucaguuuuaucagguguucuuaaaaucaccuggaaacacugagguugugucucacugaac

SEQ ID NO: 1560 - RNA, 89 nt, Homo sapiens
gaugcagagugggguuuugcaguccuuagcuguugcagaaauuaaguauugcaacuuacugagggcuuugaaggcucuuggucuguauu

SEQ ID NO: 1561 - RNA, 88 nt, Homo sapiens
ggguccucgucccugaagagugugagguugugcuuuuggaugugucccagcagcaccuguccucgcugcuccagggucuggaggaccu

SEQ ID NO: 1562 - RNA, 73 nt, Homo sapiens
gugugugugugagagagagaguggcccccgguguccuccaugcuucucccucucucucuaaauaaauacacac

SEQ ID NO: 1563 - RNA, 92 nt, Homo sapiens
gggaucagguggcccaggugaugguuuucuggugagauugaugguuccugagggucaaauucagagagcgaucgcuugggaaaauugauccc

SEQ ID NO: 1564 - RNA, 87 nt, Homo sapiens
ucucaggcugugacccucuaaagggaagcgcuuucuguggucagaaagaaaagcaagugcuuccuuuuagaggguuaccguuuggga

SEQ ID NO: 1565 - RNA, 67 nt, Homo sapiens
ggacuacgugucccggcaugcccugcguccugccacugacugugaggcaugcugggauuuguagucu

SEQ ID NO: 1566 - RNA, 68 nt, Homo sapiens
uugccauguuagauauugauuucaucauuucugacccuggaaaauacaaucgauguuuaucauggcag

SEQ ID NO: 1567 - RNA, 70 nt, Homo sapiens
ugggggcuugugucacugugagaauauuguaauaguacuacuuucuaugcccacagugacacagccccca

SEQ ID NO: 1568 - RNA, 86 nt, Homo sapiens
uucauugguaagguacuauaccuauuaccaaaggguagguagcauaguaccuuugguaguagguaggguaguaccuuuccaaugaa

SEQ ID NO: 1569 - RNA, 88 nt, Homo sapiens
auuaggagucugagguccaaugacugcaguuggcuuaucaggccaguugcacaagucagcuccagucucuggaccucgguuuccugau

SEQ ID NO: 1570 - RNA, 55 nt, Homo sapiens
aggccucuuguccuuuccuuggaagcuuccacauucaagaggggauuaggggcuu

SEQ ID NO: 1571 - RNA, 65 nt, Homo sapiens
caggcguguggcucccacguggccucacccagaugguucugccaguccugggggcucuaugcuug

SEQ ID NO: 1572 - RNA, 120 nt, Homo sapiens
cauuauguugaggaaguaacagaccuggagucaagaggugugccuuagucacuaaccagaugugugaccuagagcaagucacuugaccucucugggcuucaaauucuuccuuauguaaug

SEQ ID NO: 1573 - RNA, 104 nt, Homo sapiens
uuuuugacugccaucaugauucaggccucagugucauggacucuagagaccggucacuggagguuaugaccaacugaggccugauugacgauggccgucaaagg

SEQ ID NO: 1574 - RNA, 63 nt, Homo sapiens
uuucagaguacaugcuggguuagguguuuaguacagacuuucaaccccguauguccucugaaa

SEQ ID NO: 1575 - RNA, 59 nt, Homo sapiens
ggaacuaguaaggaaaagcaggaaagcuuccauuucuuucuggcuuccuucuugguuuc

SEQ ID NO: 1576 - RNA, 93 nt, Homo sapiens
caauauguuugcuacgcugaucaauaagaagauuaacuuacccaaguagaagauguaucaaucuuauuauugaucaguuuagcacacauauug

SEQ ID NO: 1577 - RNA, 65 nt, Homo sapiens
gaucaaaauugaaccuucucagacuucagauuccugacugugaugagcucuguucacuuuugauu

SEQ ID NO: 1578 - RNA, 78 nt, Homo sapiens
cuuccuucucguuguggagagaaugauaucuugauuucuguuuuggcaucaagcaucucucucccaaugugaaggaag

SEQ ID NO: 1579 - RNA, 69 nt, Homo sapiens
gggagggauggaccugucccuuucuaguguguccucucaacuuggcagggggcagaguucuucccuuuu

SEQ ID NO: 1580 - RNA, 86 nt, Homo sapiens
uuugguacuuaaagagaggauacccuuuguauguucacuugauuaauggcgaauauacagggggagacucucauuugcguaucaaa

SEQ ID NO: 1581 - RNA, 96 nt, Homo sapiens
gggcccagugcugggcugcugggcuuucugggacgaccuacugggcuugcuacacacuccuccucccagaaacuccacacccacagcccugggucu

SEQ ID NO: 1582 - RNA, 72 nt, Homo sapiens
cuguucucuuuuccugcugagccaacugagggggagccuagccaggaggagcggcagauggagugggagcag

SEQ ID NO: 1583 - RNA, 65 nt, Homo sapiens
ugggagccuggcaggccagagggacauucacauaucacaccugucuggcuauaugcuggcuucca

SEQ ID NO: 1584 - RNA, 102 nt, Homo sapiens
agaaagaauagggaagaggguuguccuugcagauucaucacuucuugaagcuuuccagaaguggugauggauuugcaauaagccaucugcuuuuuuuuuuuu

SEQ ID NO: 1585 - RNA, 168 nt, Homo sapiens
cugggauuucaggcgugagccaccaugccuggccuuaacuucuuccuuucugauuuggaugccuuuuauuucuuuguccugccuaauugcucugacaagaggaagggaaggcggccaauaagaguccaugaccaggccagacaugauggcucacaccuguaaucccag

SEQ ID NO: 1586 - RNA, 73 nt, Homo sapiens
ucuccuucucuuccccuuaguuuccuuuaagagugauaaaaauggaaaagggggcugagguggaggaaggaga

SEQ ID NO: 1587 - RNA, 111 nt, Homo sapiens
gcugggguugccugcucccaaagaugaugccgcugggagcucagagggcccaaggcccaaguccuguguccuccagcagugguacagccuauggcagcguggcaucccggc

SEQ ID NO: 1588 - RNA, 108 nt, Homo sapiens
ugacaucauuauucuucgcuuggacugucuuuguuuaagagccacuuaaaauuuuuggcugcuggugaauagagaagccuguuagcugaggaaaacauguugauguca

SEQ ID NO: 1589 - RNA, 116 nt, Homo sapiens
caagccauuacaacauuuccaguaaggcgaaguguaugguguagcugguguaccaugcacuuaaacuuaccaguuauaacguacacuaugccuuauuggcaaugcuguauggcuug

SEQ ID NO: 1590 - RNA, 90 nt, Homo sapiens
cuuaauccucucaauggcuuuugauauccucagguagaugggaggauccccauuuuaccugggagggauacaaggccaagagggguuaag

SEQ ID NO: 1591 - RNA, 68 nt, Homo sapiens
agugaggauugacuugaagaguaggaugguaaauuguacugauucuacugaauuaaucauuucucauu

SEQ ID NO: 1592 - RNA, 74 nt, Homo sapiens
aggggugaugcgcaugauuuuuuuacuaaggacauuauuaagaaugucauuucuaaggucaguuguuuaccccu

SEQ ID NO: 1593 - RNA, 74 nt, Homo sapiens; identical to SEQ ID NO: 1592

SEQ ID NO: 1594 - RNA, 74 nt, Homo sapiens; identical to SEQ ID NO: 1592

SEQ ID NO: 1595 - RNA, 68 nt, Homo sapiens
gaaaugggugauguagcucauucucuuuucuaccucuauggaagaaagaaagagccuguccccauuuu

SEQ ID NO: 1596 - RNA, 66 nt, Homo sapiens
aguugaugugcauggaggcuuucauuucuuagcaaaggagguggaaagaucucuugcuuguuaacu

SEQ ID NO: 1597 - RNA, 88 nt, Homo sapiens
gauguuuuugcuucagcagucaggguuuggggucccaccuguucccacagagccaaccccaagaguuugaguguuugggcagagcauc

SEQ ID NO: 1598 - RNA, 87 nt, Homo sapiens
ucucaggcugugucccucuacagggaagcgcuuucuguugucugaaagaaaggaaagugcauccuuuuagaguguuacuguuugaga

SEQ ID NO: 1599 - RNA, 63 nt, Homo sapiens
cagguuccugccuccugacguaccucacacccagccgggaagucgaugggaugcugggaccug

SEQ ID NO: 1600 - RNA, 65 nt, Homo sapiens
gccuuuucuccccagacuuguuggcauaggauacagagaagccuucaagcucugagggaaagggc

SEQ ID NO: 1601 - RNA, 87 nt, Homo sapiens
ucucaggcugucguccucuagagggaagcacuuucuguugucugaaagaaaagaaagugcuuccuuuuagaggguuaccguuugaga

SEQ ID NO: 1602 - RNA, 66 nt, Homo sapiens
uaucugauucagugauccucuucugacguuauguccauacugaaggggauaauaaugcaucagaug

SEQ ID NO: 1603 - RNA, 75 nt, Homo sapiens
gcacauccuugucuucugguaaaugcccaaauguugcccucuuuuucuggcaauuggcagcaagucaggaugugu

SEQ ID NO: 1604 - RNA, 90 nt, Homo sapiens
aucucucuuguuccuguguuuccaggaguuuugccacauguguuuuccagaaggugguaucaggacuccugggauacuuaccagggagau

SEQ ID NO: 1605 - RNA, 131 nt, Homo sapiens
cugcuugaugauuauucaauggaauugauauugauucacccagucuaagcuaccuuggcucuuuuuuaaguaucuaugguaagacugagugaaucaauaucaacuucuccagugaagccuuccucagguag

SEQ ID NO: 1606 - RNA, 90 nt, Homo sapiens
uuugugacugggugaaaauuguuuggcuggauguccuggaaaauugucuucugggaauaucuauauuguaggguucacuuuugucauaga

SEQ ID NO: 1607 - RNA, 94 nt, Homo sapiens
cacuccaaucugagcugggaugcagugguccuuucaccuguguaacaaggugaggcuuucuuuuaggauccucuccuggcucagcuuuggagug

SEQ ID NO: 1608 - RNA, 76 nt, Homo sapiens
gauuucccugcacucgcuuccuugggcugucuaccuggggauggugcaguccaaguggcucagugucuggggaauu

SEQ ID NO: 1609 - RNA, 124 nt, Homo sapiens
uuuuuccuuguagagaggaaaguuuuagauaaacaacagagaaucaguaaauaauucagccuaugaccuugaugcuuauugauuccugcagcuguuuaucuuucucuaggcuacccaggaaaga

SEQ ID NO: 1610 - RNA, 67 nt, Homo sapiens
auuuuucuuuguuucuaggugagaguuguuuuacaggcacuuucaaaccuagggacauuggaaaaau

SEQ ID NO: 1611 - RNA, 78 nt, Homo sapiens
ccuauguuuaguuuuuauauagaaaucaacucuguuuaggugagugaguugauaaauauguaaguuuuucagcauagg

SEQ ID NO: 1612 - RNA, 78 nt, Homo sapiens; identical to SEQ ID NO: 1611

SEQ ID NO: 1613 - RNA, 70 nt, Homo sapiens
gaagaagguggaggugguguaguugggccuguuuaggaacugauuacaucugagccucuggcccuuuuuc

SEQ ID NO: 1614 - RNA, 71 nt, Homo sapiens
cuuauccuuuuauggugcuuuuuugaaguuaaggaaccuuagcuucagaaaugcugugaucccaggauagg

SEQ ID NO: 1615 - RNA, 119 nt, Homo sapiens
ggaccugcuuuugugagggcagugaagagaggggaaggaguggugucuucauauugagauauuuugagauuccugcuuucuccacucacuucaacugcccaaauagguucugcagguuc

SEQ ID NO: 1616 - RNA, 122 nt, Homo sapiens
ucuuaguguggugguuuugauuguugagcuuucuuuugguggagaaggagaaaggauuuuuaggccaugauuuuuauucucaucaaaaggcauauauugagaccacuucauacccgcuagga

SEQ ID NO: 1617 - RNA, 79 nt, Homo sapiens
aaaaguauuacaggcucugaacuaaguaacuaccagugaguggucugcagccauuuaguuuagagccugcuauacuuuu

SEQ ID NO: 1618 - RNA, 57 nt, Homo sapiens
aaucagguuaccagcagaucauguaaaauucaacucagaauugcuggcugcuugauu

SEQ ID NO: 1619 - RNA, 112 nt, Homo sapiens
uucacuuuuaccugcccagauguugcagccagagcuugagggcaaacuugguuccagugcugacucucucuuuguccucugccaugguugggaucauccgcaggagggugga

SEQ ID NO: 1620 - RNA, 87 nt, Homo sapiens
ucucaagcuaugagucuacaaaggaaagcgcuuucuguugucagaaagaagagaaagcgcuucccuuuugaggguuacgguuugaga

SEQ ID NO: 1621 - RNA, 81 nt, Homo sapiens
ucaauccuuaaccucuuagugcaucucauuaguuugguaauuuauucaucaaaaaugcacuccaagauguggugggauuga

SEQ ID NO: 1622 - RNA, 107 nt, Homo sapiens
ggcuccuguaaaugugggucaggaaucaccagggagguaaugacuuggucugcucuguguucucuggcccuccuugguccuuccaugaaagcccucugucaggagcc

SEQ ID NO: 1623 - RNA, 126 nt, Homo sapiens
ucccgggauaacuacuuccuugugugcaaucucagcaaauggacaggucugugaggagucuccuugggucuccugacuccucaggaugcugccaugugcuggaucaccauuauccugcuuccggga

SEQ ID NO: 1624 - RNA, 107 nt, Homo sapiens
uucuuauuuaauuacagcuauauugaagauacaauauggguguguguggauucauuuauucacaaacauauauauuugcaucuacaauguguuguacauaguaagaa

SEQ ID NO: 1625 - RNA, 84 nt, Homo sapiens
cuccucauuacuuggaccugggaacugcuuaccuguggcugcugccaccaagaagaggaucuugcagguccagcccaugaggag

SEQ ID NO: 1626 - RNA, 104 nt, Homo sapiens
acuagugauacgguauucccuuugguauggucaaagccuguguaauacuuaagcaugucucauacacggcuugaccauuuugauugaauucacaauucacuggu

SEQ ID NO: 1627 - RNA, 56 nt, Homo sapiens
cauuuuccuagucaugugcuucucuggauugccacagagacacuggauggaaaaug

SEQ ID NO: 1628 - RNA, 55 nt, Homo sapiens
auccuugcuaucugggugcuagugcuggcucaaugcaaugcaccugggcaaggau

SEQ ID NO: 1629 - RNA, 83 nt, Homo sapiens
auaaguguuccauaugugggugggcuagcacugccauuuguuuauaaggcugguuggcaucuguccucaugugagacacuugu

SEQ ID NO: 1630 - RNA, 70 nt, Homo sapiens
cuggguggucacauggcaggccccaagaacuuugcccgucagagaggaggcugcugauguccccacccag

SEQ ID NO: 1631 - RNA, 88 nt, Homo sapiens
gaugcuuuucccaccucugcacuuguuucucucuuccugggacucaguuucucaccugagagaagaggguagaaguggaggaagcguc

SEQ ID NO: 1632 - RNA, 105 nt, Homo sapiens
uccagaucucgccacacccucugcaggccacccccacccuuccuucccuuccagguguggucagucggggagggugguggccgggggugaggggcauggucugga

SEQ ID NO: 1633 - RNA, 69 nt, Homo sapiens
gaugggcgucuuaccagacaugguuagaccuggcccucugucuaauacugucugguaaaaccguccauc

SEQ ID NO: 1634 - RNA, 57 nt, Homo sapiens
ccaucuguucacuguguccuccacucccaggccccguguggagacagagacagaugg

SEQ ID NO: 1635 - RNA, 89 nt, Homo sapiens
aucuguggucacaucccaggcagggugcguuagcuuugagcccuugcagauguuuauuaaagcugauguguugacccugggccacaggu

SEQ ID NO: 1636 - RNA, 133 nt, Homo sapiens
gcucuucaucacggcuucaagggguuaggggcuugcuaggaagugccagguugauaaguacuggccaaaggggagccagggccaugagccuggcauaucccaggcaauguccaagcuaggagcauugaggagu

SEQ ID NO: 1637 - RNA, 80 nt, Homo sapiens
acuuuccaucaugagagccagguugacuugcucccgggggccaaacccuagagcaagucuacagaggcucucuggaaagu

SEQ ID NO: 1638 - RNA, 77 nt, Homo sapiens
ggcggcaguccagcuggaacggcagcccagcagggacacaaccccagcucgggcgccggccacgcuaccuugcugcc

SEQ ID NO: 1639 - RNA, 77 nt, Homo sapiens; identical to SEQ ID NO: 1638

SEQ ID NO: 1640 - RNA, 62 nt, Homo sapiens
uuagcagauccaggaauagaagccagagucacuugacucugaauuuguucucuuucuguuaa

SEQ ID NO: 1641 - RNA, 133 nt, Homo sapiens
gcuucuuguccauguccgaccgggccccugugcucaccccccgcgccaggcccaggcagugcggcgcugcuuccggucugggccaggcgagccgagggcgggagcggggcccgcgaggccccucucgagaagc

SEQ ID NO: 1642 - RNA, 114 nt, Homo sapiens
ggagcccuuccuuugugccaggcuggaagcugugugcagaugaucucaucucaucuuuaguacccucuugcgagguaagguuacugucacacagugguuaagcacaagggcucu

SEQ ID NO: 1643 - RNA, 65 nt, Homo sapiens
gcagggguucuuugugcuuugauaacugcguucaugaguugcuggcagagcacagcuaucucugu

SEQ ID NO: 1644 - RNA, 116 nt, Homo sapiens
ccuaguuuucuucccagugauuccaguccugguuccugcacgucucagguuguugaggaaucuuugucuauuugagagaugccaacuaggggugguacugggguguaugagcuggg

SEQ ID NO: 1645 - RNA, 102 nt, Homo sapiens
aaauccuuucuaacagugccuauauugauuucagacccaguuuuguuuuaaaauucaaggacagaauuugguccuguguuuagagguccuuaauaaggauuu

SEQ ID NO: 1646 - RNA, 87 nt, Homo sapiens
cugugaagugcuguggauuucuuugugaaucaccauaucuaagcuaaugugguggugguuuacaaaguaauucauagugcuucacag

SEQ ID NO: 1647 - RNA, 76 nt, Homo sapiens
ccugugcuugugucuguguuucagccccuauguaguagaaaaaaaagcauaggcuuuaacaucagacagguauagg

SEQ ID NO: 1648 - RNA, 94 nt, Homo sapiens
uaaaauacugcuguaaauggcagcucauugaauccaauuuuaagugugauuguuuuuguuuuuaucugagcuuccauugaacggugguauuuua

SEQ ID NO: 1649 - RNA, 74 nt, Homo sapiens
gcaagguuugggaaauaagcugauaguaaagucauguaacacuuucugugcagguuaacauuucuggaccuugc

SEQ ID NO: 1650 - RNA, 81 nt, Homo sapiens
ccucagugugucucccacaugggaggagugaaccaauauggcguccuggcccuccuuacccaucugugaggugcacugagg

SEQ ID NO: 1651 - RNA, 78 nt, Homo sapiens
uuaugauguggaaaaaugucaggaugggaaaaugaugaucuccauuuuuuuuccagccaugacauuucaguauuauga

SEQ ID NO: 1652 - RNA, 84 nt, Homo sapiens
ucucagucuguggcacucagccuugagggcacuuucuggugccagaaugaaagugcugucauagcugagguccaaugacugagg

SEQ ID NO: 1653 - RNA, 67 nt, Homo sapiens
ggaggaaguggcacucugguggcuuugugcaauuauuuuccaagacuaacaggaugcuguuuucuuc

SEQ ID NO: 1654 - RNA, 71 nt, Homo sapiens
cugcacccugguccgggcagcccuccaucucucuaguugacaacccugucugccugcuaacuggggugcag

SEQ ID NO: 1655 - RNA, 103 nt, Homo sapiens
cauugauuugugaaugagcagcuucuccaugcuggugcucaugccucagagugcuccugggugagcagcagcugggaaauugcuuauuuaaccaugauuaaug

SEQ ID NO: 1656 - RNA, 144 nt, Homo sapiens
agguagugugagguaggauuuagaaagugucuuugaagggccaucaaauuuggagcuuauaaaagggagaugaucccaauuagccaaguuuuguggcuuuucucaaaucaucaggaucauagcuagaugcuuccaguauuaccu

SEQ ID NO: 1657 - RNA, 92 nt, Homo sapiens
cuucucaguguucuuuuucuuuccucccacaggaagucuuguaaaugagcacuuggacuuucugagggagauugaaaaagguuuuugggggg

SEQ ID NO: 1658 - RNA, 61 nt, Homo sapiens
uucugguguguauagaguuaaccagguuaccaggauuccuaguuaacuucuuucaccagga

SEQ ID NO: 1659 - RNA, 108 nt, Homo sapiens
aggaagccuguguccugccccucugaccugucuaggcccagcuuuugucuuuguaacuuaaacucccaaaggcaggccuggacacccuguguuggcuucuggcuuccu

SEQ ID NO: 1660 - RNA, 74 nt, Homo sapiens
gggguucguucucucccugaagcacuuguucaacuccuguuaaagccgcgugccucaaggggaggcuggacccc

SEQ ID NO: 1661 - RNA, 72 nt, Homo sapiens
gacuuguuuuguuacucaaauagaguucucguaacuaguuaagugaacuuggauuagguaauuggacaaguu

SEQ ID NO: 1662 - RNA, 79 nt, Homo sapiens
ggcaaggguuggacucuguggccagcagugcccccuucauccccaguaggcaucagagccacagcugucuuccuuugcu

SEQ ID NO: 1663 - RNA, 97 nt, Homo sapiens
gggggagguuggcuggaggaggagaaaggggcgggcaucugggagggucucagccacucucagaggcuuauucaucucauccuccuuucccuccccc

SEQ ID NO: 1664 - RNA, 90 nt, Homo sapiens
ggcagucuuugcuacuguaaacauccuugacuggaagcuguaagguguucagaggagcuuucagucggauguuuacagcggcaggcugcc

SEQ ID NO: 1665 - RNA, 66 nt, Homo sapiens
ugucuaaauugugaagaauaagcauuguagugacaaaugucaugcuugucuacauuucuuuagaca

SEQ ID NO: 1666 - RNA, 66 nt, Homo sapiens; identical to SEQ ID NO: 1665

SEQ ID NO: 1667 - RNA, 66 nt, Homo sapiens; identical to SEQ ID NO: 1665

SEQ ID NO: 1668 - RNA, 66 nt, Homo sapiens; identical to SEQ ID NO: 1665

SEQ ID NO: 1669 - RNA, 98 nt, Homo sapiens
cccuaguguuccagagggaacuguccuuccuggagguguacaggguuaaucucuuaugucuccugggaggagaggccugugcugguuauucacugggg

SEQ ID NO: 1670 - RNA, 79 nt, Homo sapiens
ccugaccuuugaccagcccaggcaucggcccagaccccaccggcgggacugacugaguuaggguugggguuagguuagg

SEQ ID NO: 1671 - RNA, 103 nt, Homo sapiens
ugauauauuugccuauuggauuuguuuaaugaaauauggauuuauaccauaaauauuggagucguguaguccauauuucaauuaauggaucauuuauauguca

SEQ ID NO: 1672 - RNA, 58 nt, Homo sapiens
gcacuauauuuaaaccuguggaugggaauauuccccauucuugguuacgcuguagugc

SEQ ID NO: 1673 - RNA, 113 nt, Homo sapiens
ugaaucuuuuuuuuuaagucuagaaagugacccaguguugugggagaaaugugaaaggcaggcaccaucgcuuucacggcacuuggggucauagucuggaugaccaagauuca

SEQ ID NO: 1674 - RNA, 77 nt, Homo sapiens
cuuuuuauguaaaauggggaugaugauaacaauaguauucaauagcauuauuguuauccccauuuugcauuaaaaag

SEQ ID NO: 1675 - RNA, 68 nt, Homo sapiens
gggggcugugucacugugggcauagaaaguaguacuauuacaauauucucacagugacacaagccccc

SEQ ID NO: 1676 - RNA, 80 nt, Homo sapiens
ugcauguggcuaaauuacaaacucagaggagcagcuuccaaauacgagaauuuucuggguggugauuuagucaacaugua

SEQ ID NO: 1677 - RNA, 81 nt, Homo sapiens
uccuggcuucuggggaucacaugagggaaucuauauugauuauuuuuuaacuccauucaauagaucccuaggaugccagga

SEQ ID NO: 1678 - RNA, 78 nt, Homo sapiens
cagugccuguuggccaaagcucaccagugcugugggaucagacucaggcagcgggcucaaguggccagcagggcacug

SEQ ID NO: 1679 - RNA, 65 nt, Homo sapiens
ccuggucccguggcugagaguggccaccauguggcuuucacccucuaauggccauggugaccagg

SEQ ID NO: 1680 - RNA, 104 nt, Homo sapiens
cgcugccgcagguguugugggcuugguaggugugggugcugccccuugggugcagcucggacgcccaguacugggccaggccuaccguaugccugcaggcggug

SEQ ID NO: 1681 - RNA, 75 nt, Homo sapiens
gggagaggagaguguugagcacaaauuaacuacccuggggaaugaguaucagguguuugacacuuucacuuuucc

SEQ ID NO: 1682 - RNA, 76 nt, Homo sapiens
ccucggaccuggcuaagcuuccaaggcccuccuggagggccaggaaucgggccgggaguugggucaggcucugagg

SEQ ID NO: 1683 - RNA, 81 nt, Homo sapiens
ucucgccgucgccgcggggcuuguuguugacuuugaggaaaacuccugacgucaggggcuggcucucggcgacuggcggga

SEQ ID NO: 1684 - RNA, 69 nt, Homo sapiens
agacaugcagcucuagggcucggaagagaaugcugggguggagaaagagcugugggagcugucgugucu

SEQ ID NO: 1685 - RNA, 79 nt, Homo sapiens
cuuuugugagaaaauaguuuagaauugguuuuggccuuguccccugaagcuauguaucuaaacuauuucucaauaaagg

SEQ ID NO: 1686 - RNA, 86 nt, Homo sapiens
aguugcuccuguacuuagcugcgccucucugacaguacuuguuucaccagagaggcagaagaacacaguuauuacaggcagcagcu

SEQ ID NO: 1687 - RNA, 66 nt, Homo sapiens
uguuuauuuauaccuggucucauuccacaagggauuuguggagugugauucaguauaauauaaaua

SEQ ID NO: 1688 - RNA, 74 nt, Homo sapiens
caggaggggagggggugugcucugcagagaccacacagagugggguccugggcaguacucaccuccacuuccug

SEQ ID NO: 1689 - RNA, 65 nt, Homo sapiens
guggucagagugcaucugcgcaaaaugucugacaguaccguugcacacuugacacucuugaccac

SEQ ID NO: 1690 - RNA, 79 nt, Homo sapiens
gaacaacuguauuagguuggugcaaaagucauugcagcacacaaugacuuuugcacuaagcuaaauauauagguuguuc

SEQ ID NO: 1691 - RNA, 81 nt, Homo sapiens
aauugaagcuaaacuugcauccauguggcuuuuaccugagggcuauuuccuggccauauggccucaaguuagcauucgauu

SEQ ID NO: 1692 - RNA, 91 nt, Homo sapiens
caaguaauuauaaucucucucucuggccaucauuggcgagugcaguguugagcuaaaagugacccagaggaggugaacuauaauuuacuug

SEQ ID NO: 1693 - RNA, 140 nt, Homo sapiens
gggccugggugccgaggccuggggaggaggaggagcugaagcuuggucacuuccgacuguuucugaaggaaagaggcccugggcccacggcuucagcccugcucagaccaacacaaacaagccucacgcaccucaggccc

SEQ ID NO: 1694 - RNA, 57 nt, Homo sapiens
gacaaaagcgggcggcgggccgcauugucugacggcgcucccucucugcuuuuuguu

SEQ ID NO: 1695 - RNA, 70 nt, Homo sapiens
cuccucccagcccaugcucugugccugccagauggcggccccugcacaggugcugcuggcuguggaggag

SEQ ID NO: 1696 - RNA, 66 nt, Homo sapiens
gcuacaggugcugaggggcucuguccucacagccacacuggacuuggccccguggcgcucuguagc

SEQ ID NO: 1697 - RNA, 61 nt, Homo sapiens
gugagcaaggaggauauaaauagaaguuauauaacaucucuuuguugauuccugugcuuac

SEQ ID NO: 1698 - RNA, 72 nt, Homo sapiens
agaccccuggggguuuccuuucauaaugccucaaaauguaggguuauauuguuggaaguccccauggggucu

SEQ ID NO: 1699 - RNA, 67 nt, Homo sapiens
cccuucugcucuguuuucuaauaguauacauucauuuguucuauucagaguguaagagcuagaaggg

SEQ ID NO: 1700 - RNA, 74 nt, Homo sapiens
guagggugugugcguuagaaugcagcacagguaaaccuugcagcaauaguuucuaaugcuguacacaacucugc

SEQ ID NO: 1701 - RNA, 75 nt, Homo sapiens
ggauccagcuuaauggcauguuuccccuggugucucaugaacauugccuaagaagcagccauggagcuuggaucu

SEQ ID NO: 1702 - RNA, 75 nt, Homo sapiens; identical to SEQ ID NO: 1701

SEQ ID NO: 1703 - RNA, 84 nt, Homo sapiens
gggcagugaagagagaggaaggaguggugucuuuagauugagguaucuugagauuccugcuuucuccacucacuucaacugccc

SEQ ID NO: 1704 - RNA, 84 nt, Homo sapiens
gggcagugaagagaggggaaggaguggugucuucauauugagauauuuugagauuccugcuuucuccacucacuucaacugccc

SEQ ID NO: 1705 - RNA, 84 nt, Homo sapiens
gggcagugaagagaggggaaggaguggugucuuuauauugagauauuuugagauuccugcuuucuccacucacuucaacugccc

SEQ ID NO: 1706 - RNA, 69 nt, Homo sapiens
gacaucaccacacuuccuggugccuggugcacugcaaggcaccuagacgcccaguagguggaugauguu

SEQ ID NO: 1707 - RNA, 107 nt, Homo sapiens
cgggauccugagucccacugcuuucugcugcuuguugcgugucucagaggcaaagagaagcaaccuuggaaaugcgacaagcuguggauguggagucagagauucug

SEQ ID NO: 1708 - RNA, 71 nt, Homo sapiens
ccuauaauucaugcaaauugaucccuaaugagauggaaacaagccagguuuuaauuuguugaacuuguggg

SEQ ID NO: 1709 - RNA, 93 nt, Homo sapiens
uggcagaggauuaagugaaugcugaugaaguguccagauucccauaacuuggaauggagcugcauucagcauuccuuuauuauccaucugcca

SEQ ID NO: 1710 - RNA, 68 nt, Homo sapiens
auugaucaaauuucuuuuugugcaugugaguuuuauuuuguaugugcaaagaauuuauuuggaucaau

SEQ ID NO: 1711 - RNA, 90 nt, Homo sapiens
ugguggggcugucaggcguggggaaccuuuccugagagaagaaaggagccgcucuccagguggguucccgacucuggcuggcucccacca

SEQ ID NO: 1712 - RNA, 122 nt, Homo sapiens
gcugcugccugcaacacugaccgagugacaaucugggcuuguugacugggcuggauaguggcuguacugguugggucuaguuggagcccccaggaggucaccacuguggcuaggauagcagu

SEQ ID NO: 1713 - RNA, 88 nt, Homo sapiens
ggggaugaccagugccccccggagcgaagaccccccaucucuccaggauugggggucugcuuagggguccacuuagggguguaucccu

SEQ ID NO: 1714 - RNA, 89 nt, Homo sapiens
ggggaugaccagugccccccggagcgaagacccccccaucucuccaggauugggggucugcuuagggguccacuuagggguguaucccu

SEQ ID NO: 1715 - RNA, 73 nt, Homo sapiens
ucuagucuguaagaagaggcugcacuggcagguuuugaccaaauuguguagaaucucaucugacgugauuggg

SEQ ID NO: 1716 - RNA, 72 nt, Homo sapiens
auuuaucauuacauggagaggaauuuuuucucuuaagccagauugaguuuucuuuccagggaauagaugaau

SEQ ID NO: 1717 - RNA, 69 nt, Homo sapiens
uccuucuguccccuaccccuucccccacagcugggaugggagcggggaggggggaggaggcaagaagga

SEQ ID NO: 1718 - RNA, 60 nt, Homo sapiens
gguccggguccggcccggcuuggccccggcccccgccaugccgggccccgacgccggauc

SEQ ID NO: 1719 - RNA, 79 nt, Homo sapiens
ggguggugaucgggaaagcugcccgaaugaguaagauucugacgcuuguuuggaguaguuuauccucugucuaccaccu

SEQ ID NO: 1720 - RNA, 90 nt, Homo sapiens
gguaggggcacagcaguuggaagcuggagaucccagguuccuggaauacucgggcugggaccuuccgguuucuccugucugcucccuacc

SEQ ID NO: 1721 - RNA, 89 nt, Homo sapiens
ccgccaugcccuagaacucccacuuuuaucugauggggagaggaagcacagcagcucugugggaugaaaugggaggaaggcgauggcgg

SEQ ID NO: 1722 - RNA, 135 nt, Homo sapiens
guaauaagcagguauugacuucuguugagaucaauaucaagauuuguugacccaaagaaguuaaaauugacugaagagugagacaauaaaucuuguuauugacuagaaagcagaagucaauauauguauuauuau

SEQ ID NO: 1723 - RNA, 167 nt, Homo sapiens
cagcaaucugucacauuuuaguuucuguuuccagauagaaaugggggauaauacuggaaauaguaaugcauaaguggacagggucugaccauuaaaauguuuaccauuuccagaaugaugccugcagauguuacaaaauugaaacuggauagguguuagaauugcug

SEQ ID NO: 1724 - RNA, 101 nt, Homo sapiens
gcagcaagaauugauauggguaccaccucacugaauuccacauucaauguugaugccucaguagggugguaugccagaucugguacugcuuucuuugcugc

SEQ ID NO: 1725 - RNA, 74 nt, Homo sapiens
aggucuacuucuguggcuccaagacacucucaagucucuaauggcuucucuuaaagcuaccgaaaguugggccu

SEQ ID NO: 1726 - RNA, 72 nt, Homo sapiens
cugugcugugggcuaacaaucaaacuaggguagucauucaauccccagauuucuuggccccagcuagcacag

SEQ ID NO: 1727 - RNA, 113 nt, Homo sapiens
ccgaggccacgauguagaaguaggggaaguucaugcgcagccgccaggccaggucgaagaaggugagcagcgugcgcgugagccccuugcagaaggcgccguaugagccucgg

SEQ ID NO: 1728 - RNA, 147 nt, Homo sapiens
cuggggccuaggcauuucccucgcuuuauguuuuugguuuuuuuucuuccuucaaucucuuugauuaggccguacguggcuguggcaaggaguuggggaaaaaaauuauaaaaacaggaaagagagaaagcacagccagagccccgg

SEQ ID NO: 1729 - RNA, 147 nt, Homo sapiens
cuggggccuaggcauuucccucgcuuuauguuuuugguuuuuuuucuuccuucaaucucuuugauuaggccguacguggcuguggcaaggaguuggggaaaaaaauuauaaaaacaggaaagagagaaagaacagccagagccccgg

SEQ ID NO: 1730 - RNA, 73 nt, Homo sapiens
uggguggagaggacaggauggggagucacaacccuggcuccagagcccagcccuccggucccccucccaccca

SEQ ID NO: 1731 - RNA, 69 nt, Homo sapiens
gucccagccagcccaguggcaccucccucaggccaacacaauuaggggacagcacugggggacugggau

SEQ ID NO: 1732 - RNA, 123 nt, Homo sapiens
ggugggcgccggagccuccagacccggggucggccucgcccaugcccagcggcugguguggacccccagcugucucagguggggugggguggccccuggguggcggcguuucugcagcccacc

SEQ ID NO: 1733 - RNA, 106 nt, Homo sapiens
cccgcccccgccaaaccucccaccccccgccaccuucuuuucccuggguccugggagcugaggcaggaggagaaguggggggaugggaguggagagggagggcggg

SEQ ID NO: 1734 - RNA, 65 nt, Homo sapiens
ugugugugagaauguguaauguguguuugcguauaaguauauacauuauguaugaucaauauaua

SEQ ID NO: 1735 - RNA, 57 nt, Homo sapiens
cagcauugcugagccuuaccauaugauaacaugcuuaaaagggcuuggcaaaugcug

SEQ ID NO: 1736 - RNA, 71 nt, Homo sapiens
gacggagacugagggauggugggcuugugcauagugguucuggcagcucaucugcaccuugguucucuguc

SEQ ID NO: 1737 - RNA, 90 nt, Homo sapiens
ugcuucuacugaagaucugggcuggcuuugucuccuuccucgguaagaacuuaggcaugggacuuuaguccagauugauugugagaagua

SEQ ID NO: 1738 - RNA, 105 nt, Homo sapiens
gcccuggacuucugacccagucacuguguagugugcuucuugucugaagaagccacagaaaucagacaagaaaguagauacacgcaggaugggauguacuagggc

SEQ ID NO: 1739 - RNA, 70 nt, Homo sapiens
cggggcucuccggggcccccaggccuggagcgcgauccgcacgggcugcagggcccuggagugggccccg

SEQ ID NO: 1740 - RNA, 129 nt, Homo sapiens
aacauaaaucucucuccuuuuuuuuccugcagauaugucaggccucauucuaccuucugagccuuggaagguagaaagaggccugauaaucucuacagaaaggcaacaugggagagggauuuuuauguu

SEQ ID NO: 1741 - RNA, 81 nt, Homo sapiens
aggaaccugcucgaaaguggcagguauccaggggucccuucaaucccugaggaugugugauucuuuugaguaaugguuccu

SEQ ID NO: 1742 - RNA, 79 nt, Homo sapiens
aaaccuuaucagucuguuggaauaucgcugcaaaaccauguuuugaacggguguguucugucagacugauuggagguuu

SEQ ID NO: 1743 - RNA, 66 nt, Homo sapiens
gcagagccugucuccagggacuaggcuugggcauuugggaugagcccugggggacggccgcucugu

SEQ ID NO: 1744 - RNA, 66 nt, Homo sapiens; identical to SEQ ID NO: 1743

SEQ ID NO: 1745 - RNA, 85 nt, Homo sapiens
ucugcucgguuuccaccauguggcucagcaacaaagcagccaugacacguguugccaagaccauguguugggagccaggaguaga

SEQ ID NO: 1746 - RNA, 109 nt, Homo sapiens
ccuggccccucccaucuuuuaaaaucaccugugaccauccucacugagcugaggcccucaacccuuagcuggcuuggugagcaggacaugggugaggaggauggucagg

SEQ ID NO: 1747 - RNA, 83 nt, Homo sapiens
ccuuucuccuggcccagcuuucauuccuugcugacucaggaauuggcagcguucagcugggagcugggccugggcagggaagg

SEQ ID NO: 1748 - RNA, 56 nt, Homo sapiens
cuccccuggucugcagcuguuagucgggcuggaaagacugcgguaucuugggggag

SEQ ID NO: 1749 - RNA, 97 nt, Homo sapiens
ucuaaauuauuaucaugugcucuuuucucaaugugguaauguuaggucucuaacauacgugccauagagaaaagaaguuaagauuguacuauuuggg

SEQ ID NO: 1750 - RNA, 77 nt, Homo sapiens
agaaggaagguggugacuguugugggcaugacagccuccccucuugcucagaaugguucacccauccugcucuuucu

SEQ ID NO: 1751 - RNA, 64 nt, Homo sapiens
gugugcagcacagggagcggcucgggaaggccccaugguggcugcuccccugagcauugcacac

SEQ ID NO: 1752 - RNA, 76 nt, Homo sapiens
gccuggaggcagcagaacggaaaaggcugggcugccucugagccugcgcuuucccucuucugccaccuguccaggc

SEQ ID NO: 1753 - RNA, 67 nt, Homo sapiens
gucagauuagagaggggaaugggaaauuuguugauuuuuuugucuauucuccucuguauuguuugac

SEQ ID NO: 1754 - RNA, 69 nt, Homo sapiens
gggaagggaagaauggggagauggaaagcauuuacuucuuauucugaaccucauuuuucucuccuuccc

SEQ ID NO: 1755 - RNA, 75 nt, Homo sapiens
gggggcuggucucaaggacaggaccuuaccuacucugaaauucuggagcuccuuuucuuggggccuaaagcuccu

SEQ ID NO: 1756 - RNA, 109 nt, Homo sapiens
caucucauugggugaccuuggcaauuccuuuucuuaacaccuccauugucugccugucaaugauguguugggugaagagcucuccaaggcuugaucuaacucugagaug

SEQ ID NO: 1757 - RNA, 148 nt, Homo sapiens
ccuugcuggccggucucccuggagcugaagugccugaggccugcucuggcccagagcgcaugugagugaggccucugcugugggcucugggccggaggcguccucucucugucaguccucgggagguggauccuggcuuugagcgagg

SEQ ID NO: 1758 - RNA, 103 nt, Homo sapiens
guguucugcuaccuuccagguggggcgggcugggaggccucuucuagaggggcccucaggcugcuccaagcccuggaaugcagcccugguggccucagaacac

SEQ ID NO: 1759 - RNA, 69 nt, Homo sapiens
gccccucuccggaauccccuauccuacacccauguagcucuuugaggaugggaucugggggugaggggc

SEQ ID NO: 1760 - RNA, 62 nt, Homo sapiens
uauagguagggcuaauuagaaauuaaucaaaaugauuaaccucuacaguccuucagccuaug

SEQ ID NO: 1761 - RNA, 89 nt, Homo sapiens
ggugaggcaccugcauggugguggggcgggaaagugggcucucucuugcugccccguccuacucucucacugcaagguguuucuucacc

SEQ ID NO: 1762 - RNA, 113 nt, Homo sapiens
gcgcugugggacacuuacuuggcccucuccugcugggcgauuuccacuuguuuucgggcgaugcagggccuggugagagaggugcccaggagguagugguccucauacagugc

SEQ ID NO: 1763 - RNA, 130 nt, Homo sapiens
ggggcccugcccaucuuccccccguucuccuagggcuacagcccccauugucaccaugccuuuuccccucacgggacagugagggccauagcucuaggggcaugggggagaacaggggcaggugggcccu

SEQ ID NO: 1764 - RNA, 101 nt, Homo sapiens
ucugauugaugggccaucaguugcacaguuguugggcagugauugauuuuccaacccagcugcuccagcugugcugcagaugcgccuugucugaagucaga

SEQ ID NO: 1765 - RNA, 67 nt, Homo sapiens
gccaccucaggagggagggagggaguggcucuucccauuccucuugcuccuucacuggguggguggc

SEQ ID NO: 1766 - RNA, 55 nt, Homo sapiens
caucuggagaagcaucaaggccuuuaucagcacuuggagcugccuggaccagaug

SEQ ID NO: 1767 - RNA, 98 nt, Homo sapiens
ucucauuccuccuguuccuccgugcuucccuccugccucugugaagccuucaaggcugggagggaggucagaauggagcccauccuggcaaaaugaga

SEQ ID NO: 1768 - RNA, 74 nt, Homo sapiens
ucguugaagggggauuugugcuuguaacuccuauuaauaggacuugcauguguaaaucuuccuccugucaauga

SEQ ID NO: 1769 - RNA, 81 nt, Homo sapiens
cuggugaugcuuagggagaagugguuagguucacacugugugguugagagcaccccuaccuuccaaagcaauacucaccag

SEQ ID NO: 1770 - RNA, 62 nt, Homo sapiens
ccaccucgccuggccuggaccagaaguggcaccccaaggccugggccuggcaugggaggugg

SEQ ID NO: 1771 - RNA, 89 nt, Homo sapiens
augcuuugcaauuugaggccuucauuucuccgucuggcaaguggacaugcuaguggaccuugaaggccucuucuagcucuuaaaagcau

SEQ ID NO: 1772 - RNA, 93 nt, Homo sapiens
agauuagauggcaggugagagcucuuugaaaaugaaaacauucugcuauuugaaugcaaaguguucuucuuugccugugauguuuccuaaucu

SEQ ID NO: 1773 - RNA, 93 nt, Homo sapiens; identical to SEQ ID NO: 1772

SEQ ID NO: 1774 - RNA, 91 nt, Homo sapiens
uuguggauauugaaguuugaagccuguuguucaucuauagaugcacuggaugggauuggaagucuucagauuucaguaggguuuuccacaa

SEQ ID NO: 1775 - RNA, 125 nt, Homo sapiens
agaaauagacugaagucauuuuugcccuuaggaauuauagugccauuuguuuucauuuugaaaauaaaaacaaaugacaguacgauuuccuccgagggaaaguacuuuaguuguaaaguauuucu

SEQ ID NO: 1776 - RNA, 84 nt, Homo sapiens
gcagggcauguuggaauaaauacaggguuugguauuaagaaagcaaacaaaccuaguacugguucuggcauuuauuagcucugu

SEQ ID NO: 1777 - RNA, 93 nt, Homo sapiens
ucagcaggcagauuuggggaagagggagcuggaaugauguacaugugaaucaucucaguugcuuucuuuuccugucugcucuucuucugcuga

SEQ ID NO: 1778 - RNA, 89 nt, Homo sapiens
gcugggugaggcggggcagggacgcggugggcggggccugguggucucgggcucucugugcccugugcuggccucacagugugcccggc

SEQ ID NO: 1779 - RNA, 83 nt, Homo sapiens
gggcugggguagaagugagguggagcauggagaggaugucgaagccuccgugcccauccacuccucuuucucagaaccagccc

SEQ ID NO: 1780 - RNA, 89 nt, Homo sapiens
guuuuucucccuucuuuuugcagaggaggcaauuugcaaaucguugcuaucugccucccuacaaggaagagauaaauuauaugagagac

SEQ ID NO: 1781 - RNA, 87 nt, Homo sapiens
caaagccuccgcuggggcuguuucuuaacacggaguuacaaacuuuaagaacagacagcuccagacggaaauccacgccaggcuuug

SEQ ID NO: 1782 - RNA, 108 nt, Homo sapiens
gaugacagggaagacaagagaagcugggggagaggaggaccaagcuucuaaggagucaugucucucucccuucagcuucuuuguuugcccuucaaaauucgugucauc

SEQ ID NO: 1783 - RNA, 87 nt, Homo sapiens
gagcugaaggucagagguuuuucagguucucgugaaccucacaagaacaugcugggccuccgaucucaccaacuuguuuaucaguuc

SEQ ID NO: 1784 - RNA, 106 nt, Homo sapiens
auuauuaagcuuugagagaaaugauaaggcagauagagaauuaaauauuaaaacuuucaaguuugauucucuaucuccccuaucauuucuuuuaaagccuaauaau

SEQ ID NO: 1785 - RNA, 83 nt, Homo sapiens
ucacuugaaauaguucuuuuauuuugagucaaguuggcaaccaagguaggcuugaccacaaagaaaagaauuauuccaaguga

SEQ ID NO: 1786 - RNA, 55 nt, Homo sapiens
guugacaauucaaaaacaaaugcuuuaauaaagcaaguuguuuuugaauguuaac

SEQ ID NO: 1787 - RNA, 122 nt, Homo sapiens
uucugcaauucaaaaaugacugaagcugugaacuucaaauuuggcaagauuguaguccucauuaaggaagggaauggaagccaauuuugaagaaaaaugguuuccuauuuuugaguguagaa

SEQ ID NO: 1788 - RNA, 63 nt, Homo sapiens
gaggccuaguaauuuucgauaaagcccuuaauccaaguacuugacugaaaauuaccaggcuuc

SEQ ID NO: 1789 - RNA, 93 nt, Homo sapiens
acaggccacuccaucuguucaaacauaaugcuccaaaccaaggaauauguuccaaaccaaagagcaugauauuugacagauggagaggucugu

SEQ ID NO: 1790 - RNA, 59 nt, Homo sapiens
uguggaaauggguuggauggaguauuuuaauacccacacaucucuaauucaguucuaca

SEQ ID NO: 1791 - RNA, 91 nt, Homo sapiens
ccaggaaaaugcauuuuaaauaagcaucuuguggggccuucagcaucugcaucacugucacagguugcuuauuaaaaaugcauguuccugg

SEQ ID NO: 1792 - RNA, 55 nt, Homo sapiens
ucccagcaggcaccgcuucugcggccgacgcgcguggcggcggugccggcuggga

SEQ ID NO: 1793 - RNA, 120 nt, Homo sapiens
caagauuaugugaugauuuuaaaguguguuauagguuaaaugcuaaguauuuuuauuaauuuaggaaguacuuuggcauauggccuuuaaaauuacauuauuauauuaucguaaaucuug

SEQ ID NO: 1794 - RNA, 82 nt, Homo sapiens
gcaagaaaaaugagggacuuucaggggcagcuguguuuucugacucagucauaaugccccuaaaaauccuuauuguucuugc

SEQ ID NO: 1795 - RNA, 81 nt, Homo sapiens
gagucucagaagacaagcaaggggguugcuuuugauugaucagucaaacacaauccccuucacaauugucuuuggagacuc

SEQ ID NO: 1796 - RNA, 107 nt, Homo sapiens
ggcccagagggagagagacauacagggaggcugcaguggagcagggcaaccucacacuucugcuuccagcucucuguaaggucugacuucacuucucucguuggguc

SEQ ID NO: 1797 - RNA, 55 nt, Homo sapiens
cagcugcauggugaaauggccuggccuggugccagggugcuucaccaggugguug

SEQ ID NO: 1798 - RNA, 70 nt, Homo sapiens
ccaggggaucccugcagggcagcuuaggacaccggaaaccgagugccgggguuggcgcaggggccucugg

SEQ ID NO: 1799 - RNA, 70 nt, Homo sapiens
gcugcccacggcaggcauguggcaguggcugacagggagugagucuggaagcgacccuugucggggcagc

SEQ ID NO: 1800 - RNA, 65 nt, Homo sapiens
auauuugaaaauguggcaguggguguugauggauuuuucuaaucacacugcacauuucuagauau

SEQ ID NO: 1801 - RNA, 62 nt, Homo sapiens
ccggccaaucgcugcguugggaaauuccaccuuuccgcggggcccgggcagcgacuggcugg

SEQ ID NO: 1802 - RNA, 122 nt, Homo sapiens
augagggaaauagcagucauauugagaguugcauggcuuguugaauacuuggcuggaauccuauaaaaggagaaaucauuaagugucaguuaaucccuguagcucuuuguuauuguucucau

SEQ ID NO: 1803 - RNA, 72 nt, Homo sapiens
ggaaucgaaacugucauuggaugcauuugguucaucagauccagauucaguucgaugugcaguucugguucc

SEQ ID NO: 1804 - RNA, 61 nt, Homo sapiens
gaggagaacaaggccauggucuguugucaaaaaaugcacacccgugcgcuuugcuuuccuu

SEQ ID NO: 1805 - RNA, 66 nt, Homo sapiens
gggggugagggagaggcugugggugccccucucuuggggcucacccccauccaucuuuccaccucc

SEQ ID NO: 1806 - RNA, 85 nt, Homo sapiens
uuauagaauuggaaaugcaaggagaagaagggaccacucuggaucuuacauuuggucccaagaucuugcaguucuggcuuuguaa

SEQ ID NO: 1807 - RNA, 66 nt, Homo sapiens
cuaggggaugggcaagguagaacucacccucucuuggaagugggcaucuaucugucugacucuuag

SEQ ID NO: 1808 - RNA, 121 nt, Homo sapiens
cauuaagacacuccagggcauguuuuauugguucauuaauacaguacaugccuuagguguauucaaccacucgggcccuauauuaauggaccaauaaaauguacccgggagugccuuaaug

SEQ ID NO: 1809 - RNA, 79 nt, Homo sapiens
uacaaauauuugcugcuucaucuauccugugaggagguuaaaaaacucuuuuugggaugaguggggagcaaaauuugug

SEQ ID NO: 1810 - RNA, 70 nt, Homo sapiens
gaagaagaugcugcuuguucacgggcauuuuuauuacauuaggaucucugagcucgugcaguacuucuuc

SEQ ID NO: 1811 - RNA, 68 nt, Homo sapiens
cacccacaauauaccugugugggugagcuuaaaggaaggaaaaaacuggauagguuauaucgugggug

SEQ ID NO: 1812 - RNA, 76 nt, Homo sapiens
ggguguuaguuuucacucagagcugugcuugccuuuuguauuuggcaagugcagcucugaguuaaaacaaacacuu

SEQ ID NO: 1813 - RNA, 67 nt, Homo sapiens
guucuccacggucccuucuggcccuaucgcgcuucuggucuuagggccaggccagacuggggagggc

SEQ ID NO: 1814 - RNA, 128 nt, Homo sapiens
ggugggcaggcacuaugggggaagaggaaggggcagcagggaugggugggagcucaggcaagcuggcaaagcauccucccagcucugcucccaguuauuccucuucccucucacugugcuggcccgcu

SEQ ID NO: 1815 - RNA, 76 nt, Homo sapiens
ccuuucuaccauacuuuuccugggaguacgcacucguaauuugaagagcgacuuuugggagaggguggaaggaagg

SEQ ID NO: 1816 - RNA, 102 nt, Homo sapiens
uugcucuaucagagugagguaguagauuguauaguugugggguagugauuuuacccuguucaggagauaacuauacaaucuauugccuucccugaggaguag

SEQ ID NO: 1817 - RNA, 56 nt, Homo sapiens
ugugucaauaugcgaugauguguugugauggcacagcgucaucacguggugacgca

SEQ ID NO: 1818 - RNA, 67 nt, Homo sapiens
ucucuagagagccugguguucacgcccaggacaagcccuggggaaaugagagccaagcuccugggga

SEQ ID NO: 1819 - RNA, 67 nt, Homo sapiens
gcugcauaaugacaauaaucauuaacuuuagguuuauucugggguuaaugaauuauuauagugcagu

SEQ ID NO: 1820 - RNA, 66 nt, Homo sapiens
gguaacaaagagcaagagaaguaccagcaaguccauuagccacucugcuucucucucucuguuacc

SEQ ID NO: 1821 - RNA, 67 nt, Homo sapiens
ucauuugaggaacagcugggguggaaugaaucacauuugguuugggccucagcauuuccacagauga

SEQ ID NO: 1822 - RNA, 129 nt, Homo sapiens
agggaggaggaggccuugauggugcgcauucgagcugaucuuuucugauuccagugggaccucucucugccaaccuccacuaggagucucaaaaagacucagcccugcuucauccagacuccccucccu

SEQ ID NO: 1823 - RNA, 69 nt, Homo sapiens
agggggcagcuugugucccgcuggugucaucccuuccuugagguccagugguggaaaggguagccuccu

SEQ ID NO: 1824 - RNA, 65 nt, Homo sapiens
uagguugauuagguugauacuaauugauauaggaugauagagauuggauccaacugaccaaccua

SEQ ID NO: 1825 - RNA, 67 nt, Homo sapiens
uggaaugaggauugucuuuuccacugcuuaugauuuuagaguguggagaaggacuguucauguucca

SEQ ID NO: 1826 - RNA, 67 nt, Homo sapiens
gggggacacuugucugagauuggauggcugguaagauggcgguucccaguuguuuccaaggucuccu

SEQ ID NO: 1827 - RNA, 102 nt, Homo sapiens
cccuuuuauuccuccuucuucugugauauugggaguguauaguugucauugugacaaacccuuugcugucaguaucuauaguggauggggagaaaaggaggg

SEQ ID NO: 1828 - RNA, 102 nt, Homo sapiens; identical to SEQ ID NO: 1827

SEQ ID NO: 1829 - RNA, 61 nt, Homo sapiens
gagagagaucuuuucuguguuuauggauacuugagcaaaaauacagaaggcagacucucuc

SEQ ID NO: 1830 - RNA, 92 nt, Homo sapiens
ccaggcgagucacgcaugcucugagaacuccacaaugucaaaccccguuagcaggauugugggguucuguggaucaugugggaccugccugg

SEQ ID NO: 1831 - RNA, 73 nt, Homo sapiens
agaaagaaggcaggacgguugugcaggcuccgaagaggcggagcccucguuccgcagccaccgcugucuuucu

SEQ ID NO: 1832 - RNA, 94 nt, Homo sapiens
ucacaagaccuaguugugaggcccugcuguagugcuuacuauguauacuggcuguguaaucacuagagcggggacucacaucaaggccuuguga

SEQ ID NO: 1833 - RNA, 89 nt, Homo sapiens
gcagaggaagcauuauggccuggaagcuaggauagggcugguucucacugugcacugucuagcuguguggcccggcaagcuaccucugc

SEQ ID NO: 1834 - RNA, 107 nt, Homo sapiens
ucuaaaaacaucuguugcucuccccaguccaagaugaggauauuuugguccagagaaguaagaaguuuccucaucuuuggacugcggagaguaacaaauguuuuaga

SEQ ID NO: 1835 - RNA, 79 nt, Homo sapiens
ggauggcauggcguagaaugaaaugcuuuuucaucaaaaugcaaagaugaaggagauguuucagagugcccggccgucu

SEQ ID NO: 1836 - RNA, 104 nt, Homo sapiens
ggucauuacuagcaguuaaugauugguuuguuaguuaauggcccaaggcaaagcugagggcgguuaagacucuaacaaacgaguugugaauuguagcaauggcu

SEQ ID NO: 1837 - RNA, 137 nt, Homo sapiens
aggguggaacauaugcaguugaacuuugagagauaaaugaggaagcuagaaaugaagaaaccuuccuuuaaguuauguucuuuaugucugaguuucuugguuuucagaccaaauaguuucccuguuugugccacucu

SEQ ID NO: 1838 - RNA, 63 nt, Homo sapiens
uuugcucaucuucucaccaggacagcaagucaauugcacaaguccccugaugggaagagcaga

SEQ ID NO: 1839 - RNA, 73 nt, Homo sapiens
ggagaggaggugccugcugcggggagcaagcaugggccaggguccuggcccccugcagggguagccccucuuc

SEQ ID NO: 1840 - RNA, 59 nt, Homo sapiens
cucccccauggcugacagaccacgaugugcagaugcuccgucuguuggcacagggggag

SEQ ID NO: 1841 - RNA, 88 nt, Homo sapiens
cugugcaaucaaucauguauucaguugucuuuggguaggguuagcuccagggagccaaagacaucugaauacaugauggacugcgcag

SEQ ID NO: 1842 - RNA, 111 nt, Homo sapiens
uucacucacaaaguuauugacaagcauuuuucacagcaacagcucuucucugugacccucgugagcuguuuacaugaaaaaugcucuuccuuguagauuaaugagagugga

SEQ ID NO: 1843 - RNA, 96 nt, Homo sapiens
ccuggcaauccaacugcugcuguuugccgucauugccuugaugucauuguucaggugggaggcaggaaggguaaggagaaaguagugaaugucagg

SEQ ID NO: 1844 - RNA, 86 nt, Homo sapiens
gccccgcacccaaggauggagggucacaccccgaaccugagagucuggacugggguguucugcccuguguacccuaggagcggggc

SEQ ID NO: 1845 - RNA, 86 nt, Homo sapiens
gccucuaauggagucucuuugaguagagcagggguaccugguaacaacuggguccuacugcuuggaucagggggcugcauggaggc

SEQ ID NO: 1846 - RNA, 62 nt, Homo sapiens
cggggggaugugggggugaguuucaaggguggggccuccgggauuugucccuguacccccug

SEQ ID NO: 1847 - RNA, 65 nt, Homo sapiens
cugaacuaucaccuaauccuggagaagcuacaauguccaacacugggguuaagugaggaguucag

SEQ ID NO: 1848 - RNA, 99 nt, Homo sapiens
ggcggggaggggcagguguguggggagggccuggggagcgccuccccagccgggcagcgcuuccccagccaggccccgcagcuggaccccggcuccguc

SEQ ID NO: 1849 - RNA, 115 nt, Homo sapiens
caggaauaucaaugcuggcucuuggggauucagugccagagugggaggauccugagaaaucugagaucucacccaccuuuggcaugauuucuuuccuggcuugugaaaauuccug

SEQ ID NO: 1850 - RNA, 124 nt, Homo sapiens
gcuucuaagugggcagugcugccccgugccccuccagacuucucuucccagcagggcagcagugcauggcacccugggauagaaggccugcaggggcagaggggaggcugaacaugcugggggc

SEQ ID NO: 1851 - RNA, 56 nt, Homo sapiens
ugcccacaccaggcccuggcuucgggcccagcaugagccugggccggcggugggua

SEQ ID NO: 1852 - RNA, 77 nt, Homo sapiens
cuccuguaauagugauucuccacugggggccaagagcccucccuguuccccuacugagaaucacugugagaugggag

SEQ ID NO: 1853 - RNA, 73 nt, Homo sapiens
cuuacugaagggccaggggcaggcuggaaggcaggguccccaguccaguggcaccuuggcccucagcaguaag

SEQ ID NO: 1854 - RNA, 88 nt, Homo sapiens
cccacccacucuguuccccuuuuccugccaccuucuucuccagggaccagaaacaaggcaggaggagggacccagggccuaggguggg

SEQ ID NO: 1855 - RNA, 60 nt, Homo sapiens
ggcagcuaauuugcaccuguucuguguggacucugaucaggugugaaugagacagcugcc

SEQ ID NO: 1856 - RNA, 112 nt, Homo sapiens
gccauuuacucauuaagcugaugaugauggaguuuuuaaaaccugcucuuuguaauggacaguagaccuuaaaaaucugucauaaauugcucaauugaggaaaucaaauggc

SEQ ID NO: 1857 - RNA, 108 nt, Homo sapiens
uucuguaaauggugauuggguucccagaccuaucuauaaaagugaauccagcccacaguguauucacuuuuauagacaggucugggaacccgaucaccacguauagaa

SEQ ID NO: 1858 - RNA, 104 nt, Homo sapiens
ggagagaaagaggaauaggaauaguuccuuucccugcuccaaaguuuuaaacguucuaacuuacuaguagagaaaggaaaauaguucuguucuuccgucucucc

SEQ ID NO: 1859 - RNA, 56 nt, Homo sapiens
acuuuucaagcugguuuuuggacagucuacauuuggacagaagcuagcaggaaagu

SEQ ID NO: 1860 - RNA, 79 nt, Homo sapiens
uuugaacaaguuuuccuuuacugaguaccaaaccauguaaugauaacuuggacuuuaauaaaagggaaaugaguucgaa

SEQ ID NO: 1861 - RNA, 136 nt, Homo sapiens
auuuccaaaaggaccgccuccggaagacggcauuuccaggagugacgcuaaggcuuccuaggcgcgguuucucgggcacugccugcaaugucauucccagaaguacuaccuucaggaggcggguccuggugggaau

SEQ ID NO: 1862 - RNA, 64 nt, Homo sapiens
uuccccuaagauacaaaugucaauauuggauuuagucuaguugaauggaugugucagaggggag

SEQ ID NO: 1863 - RNA, 112 nt, Homo sapiens
ucuuaacaauguuucugugaaugacuuugaagauuuugcucugcuggagcauuucucaggagauguucaggggaaauccucagagucaaccacaccacggauaaaguugaga

SEQ ID NO: 1864 - RNA, 83 nt, Homo sapiens
cagaaguaaaugaaggguaaagugaugugcuagugugacugcagucugacuaauuugaaucuauuugcccuccaucauuucug

SEQ ID NO: 1865 - RNA, 107 nt, Homo sapiens
agaaaggaaccaguccaaagcaaagcaguguuugccagaaccgggacagaaaccugcucucucuggcgcuggcaaaugcuggggugcugcuggagugggcccuuucu

SEQ ID NO: 1866 - RNA, 171 nt, Homo sapiens
uuucuauaauggugcuuuagcaauaaugauggaggugcaggcauuuccugaggauuaaugaccagcugggaggaaccaguggcccuuggcucugccucccagccagccauuaauucuaaggaaaugucuuuugcugaggucguuacugcuauuauaagcuuaaaauggaaa

SEQ ID NO: 1867 - RNA, 56 nt, Homo sapiens
guggggcaauguucugcuuauaauguuucaagagguucaaagcgugcaggccccau

SEQ ID NO: 1868 - RNA, 55 nt, Homo sapiens
uucauggaauguuaaauaaugcucuauugagcauugcuugaaaccaggucaugaa

SEQ ID NO: 1869 - RNA, 71 nt, Homo sapiens
ugccagaaaggaaaugagguuugucuggcugagccggucauggcaggcaagccucauuuccgucuuuggca

SEQ ID NO: 1870 - RNA, 102 nt, Homo sapiens
gggaugaaaaggaaggguggacgugucaaugaggaaccaguagcagcugcaucugcugcugguuacaguuauuggcauccaaauaccuuuuuaugucauccc

SEQ ID NO: 1871 - RNA, 69 nt, Homo sapiens
ggaggggaacaggcuuggugacgagggccuucccugcccccaccugucacuccagccuggagccccucc

SEQ ID NO: 1872 - RNA, 78 nt, Homo sapiens
aaaagcuaaauaaucacccugagcagauuuugcggagaccuugcucaaccuguucagggauaauuaugccgagcuuuu

SEQ ID NO: 1873 - RNA, 147 nt, Homo sapiens
uuuacgaaagguaggcacugucucuacacuucugggaagaaagccuggugauacguaaugcucccccuagcagaaaaauaguggucaccagaagcaucucuccauaagauaaggugagacaaauagugcugggccaaaccuugugaa

SEQ ID NO: 1874 - RNA, 142 nt, Homo sapiens
ucuccagaaauccugcccaauuuucucgguuaaagguacguguaguaggcauugcuuuuucucuuuggggacaaaacucaggaggauugccccuugaugaacaaggcuaaccugcugauucuuugaagcaaggaacuggaga

SEQ ID NO: 1875 - RNA, 99 nt, Homo sapiens
cauuaacaaaagcaccaaaaggaauguuuuccagaccuagaugguuugagaagcaucuagguuuggaagauagaguccuuccuuuagcuguaguugaug

SEQ ID NO: 1876 - RNA, 106 nt, Homo sapiens
auuuuuaaaaagaacagcacaguuagcauuacuauuuauaaagaagacauaaggauguguauucauaaauagauaaaauuaacuagugcuauucugaugugagaau

SEQ ID NO: 1877 - RNA, 63 nt, Homo sapiens
uuacaucaaaaugagacaagaaacaggagcauaacacuguauucuugucucaaggagauguaa

SEQ ID NO: 1878 - RNA, 109 nt, Homo sapiens
agcccucaaaccugcugggugugaucucaagggagggugcaggccucccccuccucucaccuugcuugcuucccuccugugagaucugcagcucccacccaggagggcu

SEQ ID NO: 1879 - RNA, 82 nt, Homo sapiens
ccuccuuaaagcacggcuugagauauugucagcuguuaaaguaauauuuaaucguagaugauaccaggugugaucaaggggg

SEQ ID NO: 1880 - RNA, 93 nt, Homo sapiens
aaauauuaaauucuaguuaaugauaugcaugcugaaacguuaacaaccuauaaauacuuaagcauguauaucauuaacuagugcucaauauuu

SEQ ID NO: 1881 - RNA, 90 nt, Homo sapiens
uacggugaacaaagcccucggagagcucacagcuguggcccagggaacacauuccaccuggcucagcugugaguucuuccuugcacugug

SEQ ID NO: 1882 - RNA, 65 nt, Homo sapiens
aaacccuaaccagauguucugauuaucaccauuagugaagagauuggaauauuaguacaggguuu

SEQ ID NO: 1883 - RNA, 83 nt, Homo sapiens
uggcucuaagucucuguucuuuuggaauuaggcuucucuagcccauggagaggaggucugugugaaaggauagggaagagcua

SEQ ID NO: 1884 - RNA, 101 nt, Homo sapiens
uggauucaagagaucaccaucaucagacuggcucaguuucucagugccucaauugcagaugccugagaaagaggguuugauggucuuuggucuggagucca

SEQ ID NO: 1885 - RNA, 84 nt, Homo sapiens
guugugaaaugagggagaaaggaaggaacagggguccgggaagaguaacugucuuguucucaucuuucuucuuuuccuugcagc

SEQ ID NO: 1886 - RNA, 79 nt, Homo sapiens
aaggcagaauguccuuccaccuguuuuaugcuguaagacaaacuuccaagugcgaggcaguguggagggcuguugccuu

SEQ ID NO: 1887 - RNA, 128 nt, Homo sapiens
gggaagaaaugggaaaaucacuagauccaugucuuugagcaggugagaggguauaaguucuaaugcauaagcacuggcuuuauuaguucaucuguuuuaacaggaucaagauuuaucuuuguuuuccu

SEQ ID NO: 1888 - RNA, 80 nt, Homo sapiens
gcaucucaauaggcucuaacuguuaugguacagaugguucauuauauagucugcuguuggcaguugggcugcggagaugu

SEQ ID NO: 1889 - RNA, 87 nt, Homo sapiens
uuuucagaauggaaugaguuauauaagagauacugaauaacucacuuggaguuguucucugucucuuauguacuuauguacuggaga

SEQ ID NO: 1890 - RNA, 105 nt, Homo sapiens
uuauuuuaccuucuuguauaagcacugugcuaaaauugcagacacuaggaccaugucuugguuuuugcaauaaugcuagcagaguacacacaagaagaaaaguaa

SEQ ID NO: 1891 - RNA, 69 nt, Homo sapiens
cuccaggacaggcuccaggggcuggggcacaggcuccucugugggcacagccccugagucucccugggg

SEQ ID NO: 1892 - RNA, 67 nt, Homo sapiens
uuuuucuacccugcagcuaugucuggguccugccacacaaggcuuccagauuagucaggaagaaaga

SEQ ID NO: 1893 - RNA, 114 nt, Homo sapiens
gaauuaaacacagcgggccaaauucugccccuggauaugcaugcacaauuuccauugacuucaauggggguuuuguuguguguauccaagggcagaauccagcuuaauuaauuu

SEQ ID NO: 1894 - RNA, 79 nt, Homo sapiens
aucugaaacagaaccuuugcccuccuuuccuacucugcaaaacccugauaggcuggggagggaaagggauacuucaggu

SEQ ID NO: 1895 - RNA, 62 nt, Homo sapiens
uggccagaccgggaagggggaggcagcaacccgcucccaagucccucccuccccauuggcca

SEQ ID NO: 1896 - RNA, 56 nt, Homo sapiens
acugacgaccacaaguuggauggguggaccuuucaugcauccuauuguccguuagu

SEQ ID NO: 1897 - RNA, 63 nt, Homo sapiens
accccccaccaacuucugacugggcuucucagaaaugcacagccugcaugggagugggggggu

SEQ ID NO: 1898 - RNA, 88 nt, Homo sapiens
gguuuuuacuccaaguuauuuucacagcagugugcugcuuuuguuguugacaaaaguaguugcugcucugaaagaggcaugaaagacc

SEQ ID NO: 1899 - RNA, 116 nt, Homo sapiens
gguugcaacuuaugucugauguuaguacccuguggcuggaaguggucaaagcuacgcauugaucuccucuacuuccaggccaagaaggguaaaugcaaugacugacaaaugcaacc

SEQ ID NO: 1900 - RNA, 87 nt, Homo sapiens
ggcgggcagcuguggugcauuguaguugcauugcauguucuggugguacccaugcaauguuuccacagugcaucacagaggccugcc

SEQ ID NO: 1901 - RNA, 67 nt, Homo sapiens
caaaucuagagacaguuuggaguagugauuaccagcauggacucucaagccagacugucuggguuug

SEQ ID NO: 1902 - RNA, 78 nt, Homo sapiens
ucagcagaggcuuacuggaaaggccauuccaaaauguagauaaugucagugaagugcuugcuaguagguagcugcugg

SEQ ID NO: 1903 - RNA, 66 nt, Homo sapiens
guggcauagaucaaugcacugaagcuuuguaauucccugaagggcuuuuagcauugguagugccac

SEQ ID NO: 1904 - RNA, 67 nt, Homo sapiens
ggagggaaggcugggggcagggacgucaguaaagguggagcugaccccugggcucugggcucccucc

SEQ ID NO: 1905 - RNA, 102 nt, Homo sapiens
uuuauuuaguaaacauucuuugagucuacacuauguacagaugugcugcuauguaguagcaaagauucaggaugugcccucaaggaaugucugucaaguaag

SEQ ID NO: 1906 - RNA, 80 nt, Homo sapiens
gaaguauaguuucuuuuuuguggggaugcuuugcauuuugcuugcaacucacauuccuagagaaaagagaacaguauuuc

SEQ ID NO: 1907 - RNA, 80 nt, Homo sapiens
guggggcagguggaagggugagcaaagaggugcugggaugucuccccuccuccccucccacccuuuucaugcggccccau

SEQ ID NO: 1908 - RNA, 85 nt, Homo sapiens
auagcccagaaguuugguuuuuggucaccuuggaaacuccuuuggagauucuugggaugauuugggaggaaaaaaagggggcugu

SEQ ID NO: 1909 - RNA, 72 nt, Homo sapiens
ucuugagagcugaugguggugcugaccauccuucuggggaaggggguuuggugucaccaucaacccuuaagg

SEQ ID NO: 1910 - RNA, 76 nt, Homo sapiens
uugguucagcugguaugcuuuccaguaucucauucuuuauuuauaugagacugggaggugugaccuauggagccag

SEQ ID NO: 1911 - RNA, 96 nt, Homo sapiens
uucuuagaggauugccuuugucuggcugcuuguuuugauggguguaaaacaaauaagauuagaccgagcagcccaacugaaagcgauagcugggag

SEQ ID NO: 1912 - RNA, 77 nt, Homo sapiens
gaacaggaggagggauugguggugguuguugaugaugaugauuauugcuaacuaugacuauuaugccuacccuguuc

SEQ ID NO: 1913 - RNA, 67 nt, Homo sapiens
ccuaaugagugcuguggagagcuguuuacagcuaagugagcuguaauggcuuucugcggucauuagg

SEQ ID NO: 1914 - RNA, 72 nt, Homo sapiens
uuaggacauugcuugaugauucauagcaagguccuuuagacauuaaugugaguuaucuaaguacaguccuaa

SEQ ID NO: 1915 - RNA, 79 nt, Homo sapiens
accugcaauaggguccacagggauagcuggggucuccaucucugacaagacacccccucuguaggccacccuuguaggu

SEQ ID NO: 1916 - RNA, 69 nt, Homo sapiens
ggcagagauuaggcugggggcuuuaggaagcuaccugcuucuccuuccugaaucccugccuauuuugcc

SEQ ID NO: 1917 - RNA, 68 nt, Homo sapiens
cagggacauggagucugcggccgcccagguguaaaccaggacccugaggaugggcagcuccgucccug

SEQ ID NO: 1918 - RNA, 89 nt, Homo sapiens
gugccauauucuaaacuguucugagaagcugcaucugaauucaaagaaggggugcagaaguagcuggaagagagagaccagaguggcac

SEQ ID NO: 1919 - RNA, 91 nt, Homo sapiens
ggggaggauggguggugggagagaagagaggaauugucaaaagugcagugauuuagugucugucucuuucuucccuucucccucccucccu

SEQ ID NO: 1920 - RNA, 86 nt, Homo sapiens
auauucuauuagcuacuuuggauguucauucuaaaaacuggacagaaaucuuggaauggauuucccuaaguggguacucagaauau

SEQ ID NO: 1921 - RNA, 70 nt, Homo sapiens
auucuggauucccccuccucacuugccccugcgacagggcaggggaaaguggugggggacaccccaggau

SEQ ID NO: 1922 - RNA, 85 nt, Homo sapiens
acucaaaauccagcuuuacaaagccagauaaaaucuggguaaaaauuggguaaagucuggcuuuguaaauuuggugaauuugagu

SEQ ID NO: 1923 - RNA, 87 nt, Homo sapiens
uuuggauauguugaguuuuagaugccuguuagacaucuaaguuaagauguugaguggguguuuggauauauaagacugaaguccagg

SEQ ID NO: 1924 - RNA, 69 nt, Homo sapiens
gucaaagauggaaaagaaaugaguagcugacaauggcuuugguuuuguuuuuuuuccuuuuccuuugau

SEQ ID NO: 1925 - RNA, 88 nt, Homo sapiens
uagugaaauauugaggcagcaauuuuuuacaaaaaggucauccucugcucuauuuguuaccuuguuauugcugucucaacauuuacua

SEQ ID NO: 1926 - RNA, 66 nt, Homo sapiens
ggcagggauacaggugugugaagggucacuugcccucccuguugucucacacccuggccccuuguc

SEQ ID NO: 1927 - RNA, 116 nt, Homo sapiens
gcucuggauaccugugugugaugagcuggcaguguauuguuagcugguugaauaugugaauggcaucggcuaacaugcaacugcugucuuauugcauauacaaugaacaucagagu

SEQ ID NO: 1928 - RNA, 82 nt, Homo sapiens
uacuaaaauccugcuaauugauacacugugguuuuuggccagccagggucuuauuuccauaaugucaguuggugguuuagua

SEQ ID NO: 1929 - RNA, 79 nt, Homo sapiens
ggucacaaucaacauucauugcugucgguggguugaacuguguggacaagcucacugaacaaugaaugcaacuguggcc

SEQ ID NO: 1930 - RNA, 71 nt, Homo sapiens
gaggaaaauguaucuucgugucuuuauuaugucaucagcuuauggcuugaagcauaaagauaaauuucuuc

SEQ ID NO: 1931 - RNA, 82 nt, Homo sapiens
ggggcagaugaggagaggcagaauuguuacuuuuaggcuccacaugugugaggguuugugggggaucucugccugcugcccc

SEQ ID NO: 1932 - RNA, 127 nt, Homo sapiens
ccggaggauuccagcgacucgggaggggcgggagggggguccccggugcucggaucucgagggugcuuauuguucgguccgagccugggucucccucuuccccccaacccccccucagccccuccgg

SEQ ID NO: 1933 - RNA, 103 nt, Homo sapiens
gggguaaauuuccuaagcagugugugagagguguacgcagaaauccuguugacaaaauauuuugugcaagugccucccacacacagcuuuaaaauguuacccc

SEQ ID NO: 1934 - RNA, 77 nt, Homo sapiens
gaguuugauuuguggggaggagggagaguuaggaucugcuuauggccuaaccucauuuuccucccuuguguggauuc

SEQ ID NO: 1935 - RNA, 80 nt, Homo sapiens
agaaucacccagauugggaacugcuauuccgugcauuccugcauauccacaggauagcgguucccagucuggaugauucu

SEQ ID NO: 1936 - RNA, 69 nt, Homo sapiens
aauuauccuugguuuuacaaguauggagguuauugaaaaaccccuauacuugugaaaucaaagauaauu

SEQ ID NO: 1937 - RNA, 151 nt, Homo sapiens
uaaauaacaugagauauaguguaagcauauauucuuuuuggugcuagguugaugcaaaaguaagugugguguuugccauugcuccgcauuacuagugcgccagccuagcaccaaagagaguauauacuuauacuguaucucauauuauuua

SEQ ID NO: 1938 - RNA, 73 nt, Homo sapiens
uuuugaacuaguuauuccacacccauuaucuccagaucaaacaagauaaugguguggaauaacuauuucaaaa

SEQ ID NO: 1939 - RNA, 88 nt, Homo sapiens
ggauuaacucauuuaauccucaccugaacuccauguugcuauggaguuuccaacauggauucaaagugaggauuaaaugaauugauuc

SEQ ID NO: 1940 - RNA, 61 nt, Homo sapiens
cccucuacagggaagcgcuuucuguugucugaaagaaaagaaagugcuuccuuuuagaggg

SEQ ID NO: 1941 - RNA, 81 nt, Homo sapiens
uuuuggccauucauaauuauuucucccuguggagcucucaugagauuccuuguacaugagcaauaauugugagugucaaaa

SEQ ID NO: 1942 - RNA, 144 nt, Homo sapiens
gucuuuccaccuagccuuugccaugucguagauuuauaaaaucagggauccuacuuaacuucucacaggaacaaauauagagaaguuaaguagcaucccugauuuuacaaaucuacuauauggcaaaaggcuagguagaaagau

SEQ ID NO: 1943 - RNA, 79 nt, Homo sapiens
uccucacccaugaccccaccugcucucauuucugcaagaaaacaauagaaauuagagcaguuggggucaugagugagga

SEQ ID NO: 1944 - RNA, 146 nt, Homo sapiens
ggcugggcauugggagugagcugcagggaggcagaggggcggccucgggugauggugggagggcgccuggauccagcugugccugaugccugcgcuuuuacuuauaggcccuccccagccacugccgcuguucccaguucucagcc

SEQ ID NO: 1945 - RNA, 96 nt, Homo sapiens
gugccugcugguuuaguucaggucacgggcucuaccuuggagcagggaagggaugguuaagguggaacacgugaccuaggcugagccaacagguac

SEQ ID NO: 1946 - RNA, 77 nt, Homo sapiens
cccucucccuucggcccugacccuuggaggcagucaccacggcaaccccaaaguucagggaggccggggugaggggg

SEQ ID NO: 1947 - RNA, 93 nt, Homo sapiens
acagugcccaaaauuauagguauauagugcaaaaacuuuguaaaaaguucguaaaaagguuuuacacuauauaccuagaauuuugugcacugu

SEQ ID NO: 1948 - RNA, 102 nt, Homo sapiens
aaaacuacaaaaccaaguucucccacuuuaauagaugauacauuuguuuguuuucccauuaugugacucaucuauuagagugggagaaagguuuuugguuuu

SEQ ID NO: 1949 - RNA, 73 nt, Homo sapiens
cauuuggcaggguuccucucuagcauuugguaauaauuccauaccaaaugcuagggagaaacucucccaaaug

SEQ ID NO: 1950 - RNA, 94 nt, Homo sapiens
gagggagccacggucagauuucaaguggucauuucacucuuucucccucugggggacugagacaugauuaacuugcaauaauugugacucccuc

SEQ ID NO: 1951 - RNA, 79 nt, Homo sapiens
agcuguccugugggugaugaggaagugaugacaccaacucccaccaucucgucacuucacagucacaccacagauggcu

SEQ ID NO: 1952 - RNA, 83 nt, Homo sapiens
gcacagucaguggagagagccaggggcuggagguggggcccaccccagccucuggucccagcucugcugcucacuugcugugu

SEQ ID NO: 1953 - RNA, 103 nt, Homo sapiens
gggguaacauuuuaaagcugugugugggaggcacuugcacaaaauauuuugucaacaggauuucugcguacaccucucacacacugcuuaggaaauuuacccc

SEQ ID NO: 1954 - RNA, 77 nt, Homo sapiens
ggaauugcuuauucaccaucaguagcagaaacccagaauuucaagauuuuuguuacugaugguaaguaaacaauucu

SEQ ID NO: 1955 - RNA, 72 nt, Homo sapiens
ugcucugcgggggcuggggcugcaggaugcagugggguagccuugucccuuggccccacccucuucagggca

SEQ ID NO: 1956 - RNA, 68 nt, Homo sapiens
ggcagggcacugacgggcggcucccaucccucccgcuuguggaguguggguagcccucggucccugcu

SEQ ID NO: 1957 - RNA, 135 nt, Homo sapiens
ucacuuccaaauucaaggacuaauaaaaauuggaagcacuccaguaauuuuaaauugcucugcacauugaagagugauuuaaaaucauuggagugauucaauuuuuuuuauauaugcacuucaauuuagaaguga

SEQ ID NO: 1958 - RNA, 84 nt, Homo sapiens
guggcagcuugguggucguaugugugacgccauuuacuugaaccuuuaggagugacaucacauauacggcagcuaaacugcuac

SEQ ID NO: 1959 - RNA, 69 nt, Homo sapiens
gcguccccgcgccgcagguugcuuaggaggaggacuggguuuccugggcguuccugggcgccggggcgc

SEQ ID NO: 1960 - RNA, 90 nt, Homo sapiens
ccuggcgcggcccggugggcuuugugccccgggugccccaccgcccgcgccccuccgggcaucuggcccacaaagcccgggccugccagg

SEQ ID NO: 1961 - RNA, 89 nt, Homo sapiens
ggggcuucgccacugauuguccaaacgcaauucuuguacgagucugcggccaaccgagaauuguggcuggacaucuguggcugagcucc

SEQ ID NO: 1962 - RNA, 86 nt, Homo sapiens
gcccugccggggcuaaagugcugacagugcagauagugguccucuccgugcuaccgcacuguggguacuugcugcuccagcagggc

SEQ ID NO: 1963 - RNA, 74 nt, Homo sapiens
uagccuccauuccucgaggagccacugguuauuuuaauuauugucucuagaggccuuuuagugaguugaggcua

SEQ ID NO: 1964 - RNA, 64 nt, Homo sapiens
uugucaucauccuccgaggguuaggaaugccaugucagccuuuccucauagaaggauaugacaa

SEQ ID NO: 1965 - RNA, 95 nt, Homo sapiens
gaaaccccgggcggagcagagcugggcuuggcugguccaugugauucccccuugcugaccagcacaggccccucucucccagggcccaggguuuu

SEQ ID NO: 1966 - RNA, 59 nt, Homo sapiens
caccggccgcuccaugugaaaccggucaugugagccuguuuacagcagagcagcuggug

SEQ ID NO: 1967 - RNA, 95 nt, Homo sapiens
aagaaggcagagcucaaggagggagucccagaggggugacaguccuuugcucaugcuguggcucacuccuggguucccuucccucucuccuuuuu

SEQ ID NO: 1968 - RNA, 82 nt, Homo sapiens
ggggcggccgcucucccuguccuccaggagcucacgugugccugccugugagcgccucgacgacagagccggcgccugcccc

SEQ ID NO: 1969 - RNA, 56 nt, Homo sapiens
gcuccagcuccauaaacauaagcaaagcuacaugcuuauucuucuggacuuggagu

SEQ ID NO: 1970 - RNA, 67 nt, Homo sapiens
accaccucuagauguacuucuuggcucaccuggcaaggaagacgaagagguuugcaacuaagguggu

SEQ ID NO: 1971 - RNA, 58 nt, Homo sapiens
gguuuuaccugaagagcguaaaguaggugugcuaauuuacagcucggcagauaaagcc

SEQ ID NO: 1972 - RNA, 105 nt, Homo sapiens
aaaugcacucuaaauucuuugcacaucugggaggugguaugaguaauuuuucuaacuugcugcauccuaucuccuguguguuguaugaagugaaagacugcauuu

SEQ ID NO: 1973 - RNA, 105 nt, Homo sapiens; identical to SEQ ID NO: 1972

SEQ ID NO: 1974 - RNA, 117 nt, Homo sapiens
ucuccuacuccccuuggccaauccucacuugucuaucggcccccaucacuuguaagguaaacaaacagcaagugaugggggcugauagacaggugaggauugaagcggacugggaga

SEQ ID NO: 1975 - RNA, 73 nt, Homo sapiens
ucccugccugccagcccuagaccugcuggagcauagagcccuuccuccccaggucuaaguaaguaugcagggg

SEQ ID NO: 1976 - RNA, 84 nt, Homo sapiens
cgcuucgcuccccuccgccuucucuucccgguucuucccggagucgggaaaagcuggguugagagggcgaaaaaggaugaggug

SEQ ID NO: 1977 - RNA, 116 nt, Homo sapiens
uauucgacaaguuuuaagacucuuguguaaucagcccauaaaaucuauuuuagcaguauccauuugcuuauaauuuaugagcugacuacacaauaguuuuacaguuuuaucgaaua

SEQ ID NO: 1978 - RNA, 70 nt, Homo sapiens
ggggcuucuggucugccugcuguuucuaaagcauccaguauggaugcacagcaggagacacacaaguccc

SEQ ID NO: 1979 - RNA, 70 nt, Homo sapiens
ggggcuucuggucugccugccguuucuaaagcacccaguauggaugcacagcaggagacacacaaguccc

SEQ ID NO: 1980 - RNA, 70 nt, Homo sapiens; identical to SEQ ID NO: 1979

SEQ ID NO: 1981 - RNA, 99 nt, Homo sapiens
aggagcucagggccuuuuucuuacccuccuuaccagcaguuuucuuguuuaguguuuuguggguuggggaaggaggagauuagggcugacuuagcucuu

SEQ ID NO: 1982 - RNA, 109 nt, Homo sapiens
aaagauacagaggaaauucaacccagauuagguggcagaagauaauacaguuugcucauuuuuauucugcugcucaaacuggaguugaauucauuuucacuuuaucuuu

SEQ ID NO: 1983 - RNA, 68 nt, Homo sapiens
ggccaggcugaggacccaagucaggccagcugucucuuugcugccuggccugggguccacaccugguc

SEQ ID NO: 1984 - RNA, 78 nt, Homo sapiens
cagugcccugcuggccacuugagcccgcugccugagucugaucccacagcacuggugagcuuuggccaacaggcacug

SEQ ID NO: 1985 - RNA, 116 nt, Homo sapiens
gccaaagcgugugucccucccuggagucaugggggaaugguggggcccucucuuuggcauaggaaggagacaggagggccugacuacucccccaggaggugugaaagcccuuuggu

SEQ ID NO: 1986 - RNA, 87 nt, Homo sapiens
ugcaguccuggcucucugucaugugaguggucccccuugugcuugguggaauugcuggcagugacaggaaggagauuacagacugua

SEQ ID NO: 1987 - RNA, 97 nt, Homo sapiens
uuauaaacuguagccuaauaccuucuuucucuuucuccauucuccuuuucuauuugaguggagggagagaaggcaaggauugggcucuguuuuauaa

SEQ ID NO: 1988 - RNA, 80 nt, Homo sapiens
uguaaagcuauuauuaggauagggaaagagggcugguaaauacgacugguccuuccuuccuuccuggugcuacuuuuaca

SEQ ID NO: 1989 - RNA, 84 nt, Homo sapiens
aggggcccccucuacuuuaacauggaggcacuugcugugacaugacaaaaauaagugcuuccauguuugaguguggugguuccu

SEQ ID NO: 1990 - RNA, 94 nt, Homo sapiens
agccuggccugggaauuaagaggaaggcugucuccaggguccuguuaccaaguccccacaugacaguucacuuuuucuuucucagccucaggcu

SEQ ID NO: 1991 - RNA, 77 nt, Homo sapiens
ggaaggaccuguccguggugcugcuugugagucccagcucugaacaaauuauccagcuucagggacagcuucuuuuc

SEQ ID NO: 1992 - RNA, 65 nt, Homo sapiens
gauauuccuagaggucuccaccucucagcaucucuggcugaaaggugguuccucuguagaauguu

SEQ ID NO: 1993 - RNA, 56 nt, Homo sapiens
uggcauuccaggaucuguggguucuggguuuccaggauucauucuugacaauguca

SEQ ID NO: 1994 - RNA, 67 nt, Homo sapiens
gucuuucccagcccuguaccuggcaaggcuaauaauaccuuaggaagugcagguguugcagaaagau

SEQ ID NO: 1995 - RNA, 88 nt, Homo sapiens
cgcuccaccucccggagaggggcggggccaggcgagccucacccacggccucucguagcucacgcccccucucccggagccuggagcg

SEQ ID NO: 1996 - RNA, 116 nt, Homo sapiens
gcugugccgggagacccagagaaauggccccagcugaggucccagcaggccagucccuguuuuccuccucuacccucacacugggcccacuuugcucagggaaucccaugcacagu

SEQ ID NO: 1997 - RNA, 70 nt, Homo sapiens
ggaagagcagaugugccuugcaucugagugagggugacuuuuacucagaaagugcauaccucccucuucc

SEQ ID NO: 1998 - RNA, 73 nt, Homo sapiens
ucagccacgagggcacccagcugaccuugggagcucugucucaccccaggguugggugcuuuuccuugguugg

SEQ ID NO: 1999 - RNA, 81 nt, Homo sapiens
uucuccgcaugaaucagcucacugcacugcuccugcaccagggaggggccggagugguacaggaggcugauucacggggaa

SEQ ID NO: 2000 - RNA, 56 nt, Homo sapiens
aauagugcaugccagacaucauauaauuaaaugccagcugucugguacucacuguu

SEQ ID NO: 2001 - RNA, 79 nt, Homo sapiens
guucauccauuuguucaguguuuuaagggucuaccaugugccaaacccugaucugggcacugagaacaggaagaugaac

SEQ ID NO: 2002 - RNA, 80 nt, Homo sapiens
uacagggcaggguggggugaaaacaguuuuagggacgcccccuucccauccuuuccucuucaccccccgcccacccugug

SEQ ID NO: 2003 - RNA, 66 nt, Homo sapiens
ggagccacaugucacagugcccugcugccugaacaaggaccagaggccuguggaacacauggcucu

SEQ ID NO: 2004 - RNA, 66 nt, Homo sapiens; identical to SEQ ID NO: 2003

SEQ ID NO: 2005 - RNA, 66 nt, Homo sapiens; identical to SEQ ID NO: 2003

SEQ ID NO: 2006 - RNA, 75 nt, Homo sapiens
uuuagaucaauaaaccauuuuaaaagcuuucaaagcuuuaacucuuggaagcuuuuaaaaugcugugaaucugaa

SEQ ID NO: 2007 - RNA, 90 nt, Homo sapiens
cugggggcaggcccaggagaggucucugugucucauguaucuuccaaggccucuuggagaggagacagaaccauccugggacccucccag

SEQ ID NO: 2008 - RNA, 80 nt, Homo sapiens
cugaaggcaguaggaaguuuaggaaauuguucuauaaaggugggacuugggagcaguuucagacuuuccauauucuucag

SEQ ID NO: 2009 - RNA, 80 nt, Homo sapiens; identical to SEQ ID NO: 2008

SEQ ID NO: 2010 - RNA, 73 nt, Homo sapiens
ccccaggcagcgggcaucauggggacagcaauggcuucuucuuugcugcacccaaggaguuggugacuugggg

SEQ ID NO: 2011 - RNA, 93 nt, Homo sapiens
gagucagcagggcauaggggaacuggcacagggcaggggccacgggagagauaacccagcccagagccaguucccgcuugcucguccugacuc

SEQ ID NO: 2012 - RNA, 101 nt, Homo sapiens
cuggcuucaucugauaaggguuuauuuuugauccagaccuccuuggaauguuuaucuuagggggaaguuggggaggaaugagcucaguagaauugggccag

SEQ ID NO: 2013 - RNA, 77 nt, Homo sapiens
acuuuuacaguaggucacgguauaguuugaagagcaugacuuggucuucaggcugucuggaucuacgcacuaaaagu

SEQ ID NO: 2014 - RNA, 79 nt, Homo sapiens
cagucuccagauauguuaauuucagugcuucuagugcuuccaguggaagcacugauauuaacauauuauuuagagacug

SEQ ID NO: 2015 - RNA, 88 nt, Homo sapiens
uuccucccaacccaaucucucccaggucuuccuuuccuaccuggguugggggaaaggaagagacugaggugggagaggagaggaggag

SEQ ID NO: 2016 - RNA, 79 nt, Homo sapiens
acuuguccacaguaaugcauacaaguuagugaguggaccaagaucugcugcuaauuaguuugcauuacuuuagacaagu

SEQ ID NO: 2017 - RNA, 115 nt, Homo sapiens
uuucucacaccugucaggcccuagcaaugccacucugcuuccuuuaucccauccguacccaaucccgugaaggaggcagaccagggauugccucucccauuuugcagaugaggaa

SEQ ID NO: 2018 - RNA, 83 nt, Homo sapiens
aggcaggcacgcagagcucuuuaaauauugcugagcauuuccuggaucagcaugauauuuaaagauuuuuguuccaccugccu

SEQ ID NO: 2019 - RNA, 97 nt, Homo sapiens
gauuugacacauuuugauuucugcuuaggaaaauaucuguuaauccuauuagauagaguaggagaggguccugagcaggaaugcaaaagaucaaauc

SEQ ID NO: 2020 - RNA, 142 nt, Homo sapiens
gggaggacacagaggcacaggggcaugaggacccugcccugggugguggcagagcugggauuugaacccggguuugcaugacucccagcccuguuccuguccucucaggggcugcacccucccccugccccuuccuccuccc

SEQ ID NO: 2021 - RNA, 84 nt, Homo sapiens
uggagcccacccaucucaagggcagucccucccagauccugccuggauguuuggagagggcugauagggagugacauggcuccg

SEQ ID NO: 2022 - RNA, 140 nt, Homo sapiens
gugccuucacuagagccaaaaguagauuaaaaaucagucacucauuaauacuuugccuagcuacuaaauuggaggugccuaaacaagauacuaaugaggugacugagucuuaaccugguuuuggccuccacuaaagguau

SEQ ID NO: 2023 - RNA, 72 nt, Homo sapiens
aggcagacacuguguuugaugccaauaaugguugccaguggcaccgagguuggcaucagacccucuuugucu

SEQ ID NO: 2024 - RNA, 58 nt, Homo sapiens
uugcagacagugagagugaaagguguuuuauucuuacuauugacucucaaauuugcag

SEQ ID NO: 2025 - RNA, 106 nt, Homo sapiens
uccugcacagaguccuugaaaucuuggcuguccucugucccuucgagcacaugcugaaugggcugagagguggccggugugguguucugggauuagggaugcagga

SEQ ID NO: 2026 - RNA, 105 nt, Homo sapiens
gccugaucagaauuaaaauugcuguuggaauuuccugucaaagcaacucauuuauucucugagcucugcacuuugauuggacauugccuucagcaauagucaggu

SEQ ID NO: 2027 - RNA, 136 nt, Homo sapiens
aagugcucagauaacaccuccaggaagccaucucuggccuccauaacccauguauggcuuuguccucaucacaaaaccauacauggguucugcaggucagagauggcuugcuguuuuugucacuuacauagcacuu

SEQ ID NO: 2028 - RNA, 75 nt, Homo sapiens
gcccacccagcacugcuugcugucacuggcucuauuuccaucacucgggacagauggcaggaagcaguggugggc

SEQ ID NO: 2029 - RNA, 89 nt, Homo sapiens
ggcccggcagugggggccuggcuggcucggaagggacugcaggugagaugcugggugggacucuagggccagcccugcccucccgggcc

SEQ ID NO: 2030 - RNA, 114 nt, Homo sapiens
ucuguaacagugcauagagagcaucauuauuccuagugcuuacgacagagccuggcacauaguacacacucaguaaguacuggaugaaugaaugaaugcauucuauuuuacaga

SEQ ID NO: 2031 - RNA, 77 nt, Homo sapiens
gcuuggccauguuaguccuagaagccacggagaaggacccuucugauuggcuuucaggacuuaucuaacugcuaagu

SEQ ID NO: 2032 - RNA, 55 nt, Homo sapiens
gugucagcauaaggaguugaggauuuggcaacgaugcucaaguucugacugauau

SEQ ID NO: 2033 - RNA, 78 nt, Homo sapiens
ucucagucaucccaguaggcauuagcaccuguuaaaagcuccucagauagguguuaggcagugcugguucagcugaga

SEQ ID NO: 2034 - RNA, 56 nt, Homo sapiens
cuuugugccccgggugccccaccgcccgcgccccuccgggcaucuggcccacaaag

SEQ ID NO: 2035 - RNA, 71 nt, Homo sapiens
ggugcugccgucagaaggcacaaaauauuuucaguggguuuagccauguuauugugcucuggcucagcacc

SEQ ID NO: 2036 - RNA, 82 nt, Homo sapiens
ggagucaccuucagaagaggaggcggcuugaccugggggcaugaaugcuaccaccaggcccuuuucuccugggacuggcucc

SEQ ID NO: 2037 - RNA, 94 nt, Homo sapiens
ucucugccccagauaaauacugugcuugagugcuggagcaugucuucccagauggccacaucuccaguacugaguacagugucugcugcagaga

SEQ ID NO: 2038 - RNA, 88 nt, Homo sapiens
ucuggggccggucacucaguuuuuggccucugcugcaguccucauacuguuccaagaguggcagcgggaacugagaggccccuccaga

SEQ ID NO: 2039 - RNA, 65 nt, Homo sapiens
cauauggccacagcuuguuugcaaagaaugcugaucaugcuuucaaacaaaacuguucccauaug

SEQ ID NO: 2040 - RNA, 125 nt, Homo sapiens
uuagacaccaguucugcucauucugaagucauaauucaugucauugaaugaaaaucucauuuaaugucaugaaauuagcauuuaaugacaugcauuaugacuacagaaugaguagaauuguuuaa

SEQ ID NO: 2041 - RNA, 66 nt, Homo sapiens
guuuuccccaacaaauguugccaacaaaaugagacacagcugcuggugacauuuguagaggaaaac

SEQ ID NO: 2042 - RNA, 85 nt, Homo sapiens
aguuauuccacccaggcaauuuucuguugcauuagauacaagucuaugugauuauguaacagaaaauugacucugcaaaauaacu

SEQ ID NO: 2043 - RNA, 103 nt, Homo sapiens
gccugacccagaacacaauucccagagggcuaggcgccgcucggagccugcaguccucacgcgcgcuuagacucuugggaguuguaguacgaauccgucaggc

SEQ ID NO: 2044 - RNA, 95 nt, Homo sapiens
ggggcagcccaguguggggagugggcagauuuggguccauacccugcggggccugugugacuugagccugucugcuucugcugcauuucuguccc

SEQ ID NO: 2045 - RNA, 82 nt, Homo sapiens
ccugccucccaggcgggcugugcagauguuaucaugggcaugagcugacucacccuugcgacaucuaagcccgcugggcagg

SEQ ID NO: 2046 - RNA, 81 nt, Homo sapiens
uuaaaguccggaguggguguggcuauacgacacacaaccagaaugauuagauugacuuucuggcacaccuacucacuuuga

SEQ ID NO: 2047 - RNA, 101 nt, Homo sapiens
ccccggcccgcccgccggggagugggagggcgauggcgccccgccuccggcucuuacggagagcgcgccucccccucaacuccggcggcggggagccgggg

SEQ ID NO: 2048 - RNA, 123 nt, Homo sapiens
ugauagcccugcccuuucccaggcuucugugcagggaccuuugcugccugcaaacaguagggacaccuguuuucugagcagggaaggccagcaucugaaaucuuaggaauggggcugcuauua

SEQ ID NO: 2049 - RNA, 73 nt, Homo sapiens
ggauucacgucuuccagccaaaaccaucucaaacaaguaguuugagguuuuugcuggaagguaauuugaauuu

SEQ ID NO: 2050 - RNA, 108 nt, Homo sapiens
gaugacacgaauuuugaagggcaaacaaagaagcugaagggagagagacaugacuccuuagaagcuugguccuccucucccccagcuucucuugucuucccugucauc

SEQ ID NO: 2051 - RNA, 77 nt, Homo sapiens
agaagcacgcagcaggcgggcauucccacagcaaaucagggacaaccgugggaaugccaaccugcuuauuuguuuuu

SEQ ID NO: 2052 - RNA, 138 nt, Homo sapiens
cugcucacgugggcacuuggcauguucaggcagguugacgucuccacucugcuccguccgcccagcaugucacugaguguggguggggugcagagaugggggugcagggugcaccugagcacuggccacccugggcag

SEQ ID NO: 2053 - RNA, 154 nt, Homo sapiens
gcacaaacgugacuuccaacauuuuuuauuuaucuuucccuuuucuuuuccaagauguaacuacggaucagacacuaaggaccuucacguuucgcugauguaguuuuuggaggaaaaaggggggggagugaagggcgucgguuuuuuuuugugu

SEQ ID NO: 2054 - RNA, 78 nt, Homo sapiens
gaggggucuuagaggagcaccgagacugggugagauaauuuguauugagguuuuggugaaggcuccucugugcuucuc

SEQ ID NO: 2055 - RNA, 89 nt, Homo sapiens
ucucacacuuuaguuaugacucccugugguauuuuacaagugaacuaaguuuaugaaacaccacaggggcugauaacuaacaugugaga

SEQ ID NO: 2056 - RNA, 67 nt, Homo sapiens
cuguccucuguccucaagucugagcccaagcccccggggccuggggcagggcugggggccgggacag

SEQ ID NO: 2057 - RNA, 69 nt, Homo sapiens
uuccugucucuccccaaauucugggcgguucuguuuccagcacucauccaugauggggggguacaggaa

SEQ ID NO: 2058 - RNA, 90 nt, Homo sapiens
ucucaggcugugaccaucuggagguaagaagcacuuucuguuuugugaaagaaaagaaagugcuuccuuucagaggguuacucuuugaga

SEQ ID NO: 2059 - RNA, 71 nt, Homo sapiens
ucuaagacuccucacauuuucugggaucucaaagaaagauuucccuaugaggaagaagugaggcucuugga

SEQ ID NO: 2060 - RNA, 94 nt, Homo sapiens
gggguuccuagagagaauguggggagaggaauugggaagguugagucuaggcaacuuuugccaggaguuucacuccaaaggcuuucugagcuuc

SEQ ID NO: 2061 - RNA, 110 nt, Homo sapiens
guaggcccuguucauuccucuaucuuaucguaauaagccaggucaccucugaacugaacugaaaucacgacuguucaguguugccugcuuuaugggucuggauggccuac

SEQ ID NO: 2062 - RNA, 70 nt, Homo sapiens
caggccccugggcgcucagcaguucugucggcaagugagcacaagaggagcggggcagccugagggucug

SEQ ID NO: 2063 - RNA, 74 nt, Homo sapiens
ccugcagcugcacuauagaugcuuaaaucccacugauuucaaaaagagguccauuuauggaaaugcucugcagg

SEQ ID NO: 2064 - RNA, 59 nt, Homo sapiens
gcgcugucuuugagcccccgccgagcuuccucguggcgccgggggucaaucugcagcgc

SEQ ID NO: 2065 - RNA, 92 nt, Homo sapiens
ggucccacuagaggauguuuaguuugcccacagcaugagugagggagcaagccuugagcagcuguggcaauucaaaugucuuuccugggacc

SEQ ID NO: 2066 - RNA, 82 nt, Homo sapiens
acgggaccuagguccagcaaggcuuaaauguccacccuggagcacaggucacuggugaacgggucgugcuggaucgucccgu

SEQ ID NO: 2067 - RNA, 94 nt, Homo sapiens
acgaauacuaccugcucuuaccugcucacacuguuacuccagaaauaccuagacuagaguaacaguguaggcagguaagagccaggcuauuugu

SEQ ID NO: 2068 - RNA, 93 nt, Homo sapiens
guuggcacuagcuguacccaccuugccuggggcccccgugcugggggucgcccccaagaugguggcggccccagggaggacuguacugccagc

SEQ ID NO: 2069 - RNA, 108 nt, Homo sapiens
ugcagcacucagucagaucccucaucucuguuacagaggugcuuugcgaaaugacugguggcauuucaucacuguaaugagggagaagggaagggacuuucugcugca

SEQ ID NO: 2070 - RNA, 55 nt, Homo sapiens
gggugugcucagagcagggggccuaaagaauggcuccucuguuuauaacacaccc

SEQ ID NO: 2071 - RNA, 93 nt, Homo sapiens
ucuauuucucaauucaucugcucuuccucucacugagcugauguuuaaaacaauuccugaguggagguugagcagaggaagaaaaaaaguaga

SEQ ID NO: 2072 - RNA, 81 nt, Homo sapiens
ggcugcccuggcucaguuaucacagugcugaugcugucuauucuaaagguacaguacugugauaacugaaggauggcagcc

SEQ ID NO: 2073 - RNA, 111 nt, Homo sapiens
guaccuacuguaucuuuucucuaauuagagauggcguauagacuggcucauuacuucugccuaaugagccaggcuccaugccaccucucuaaucagaaaagagauagguac

SEQ ID NO: 2074 - RNA, 83 nt, Homo sapiens
ucauguccuuuacuuuuuugcuccugucuccagacuuuuauaguaaguagaggcaggagcauuucagaugguaucagacaugg

SEQ ID NO: 2075 - RNA, 65 nt, Homo sapiens
ccugagccuuagccagcagaggacucuuuugauccauguccuuaggcuguugagcucagcucagg

SEQ ID NO: 2076 - RNA, 72 nt, Homo sapiens
cuggugccuuccacacugggggcggagcccucugcagagagccuggcucugcguccuguggcugagugccag

SEQ ID NO: 2077 - RNA, 89 nt, Homo sapiens
cuccuuccuuuauuugcuguagagauucucaguuguugugcugaaauggcuuacacuggggauccagcugcacaauuguucagaaggag

SEQ ID NO: 2078 - RNA, 84 nt, Homo sapiens
auuauagcuucuguuccaugaccugccucugaacccaagccucuuggauucuauucagagccagggaauggggugaccuauaau

SEQ ID NO: 2079 - RNA, 91 nt, Homo sapiens
guaagugcuuuauucuuuucuuuguagguucugggucccuccgagcaaaauuugaucuuucagaaggaccuaguaaacccacgacacuugc

SEQ ID NO: 2080 - RNA, 136 nt, Homo sapiens
aauaaugguggcagaaaggagguguuuguugcacugaacuaaauagcaauguuuccugagccccuaauaguuggugcucagcaaacauuacuauuuaauucaguacaacaaauaccuucuuucugccagcguuauu

SEQ ID NO: 2081 - RNA, 98 nt, Homo sapiens
gaaccaggaucuguuuaaccccaaggaugauucuaaaggaggacuuauuuucuucagcucuuucagaaucauccuugagguuaaauagaugcugguuu

SEQ ID NO: 2082 - RNA, 111 nt, Homo sapiens
uaggguugaggugccagauagagcuguagguaauauggagcuggaggacuggaaacugaaacuaaauauuccacuagcccuauagcugugucacuguggcaucuaacucua

SEQ ID NO: 2083 - RNA, 66 nt, Homo sapiens
gcuguaugugaaaaugucaagugcuuuuuaagaauggauuuuacacuugccauuuucaagugcagu

SEQ ID NO: 2084 - RNA, 79 nt, Homo sapiens
uucaccuggccccaaagccuaugcuuuucucaccacaucuuauccuuuagaagaguuuagacuuuuggggcagggugga

SEQ ID NO: 2085 - RNA, 68 nt, Homo sapiens
cugcagagcuaggcugagugaaugaagggcuaggugaggucugugaacugcugggcuuggguuuguag

SEQ ID NO: 2086 - RNA, 71 nt, Homo sapiens
cuguuuugucauuucgggcauggaguccugguucuauugcagggccuugucuccauggaaaugaaaaauag

SEQ ID NO: 2087 - RNA, 76 nt, Homo sapiens
ccuguuggccacugguccuguuaucuuuccacguccccuacuucauuuugaguagguaagugccaguggcagcagg

SEQ ID NO: 2088 - RNA, 123 nt, Homo sapiens
gggccuugauuccagaagaaggagcucucugaauauggguuuacuaguugguggugaauucaugagucgccaacuauuaggccuuuauguccagauauuauccuaauuuauggaguaaggucc

SEQ ID NO: 2089 - RNA, 59 nt, Homo sapiens
uucgggugcuguuugccugugugugccgugaacuucaagugguaggagcagaacccgaa

SEQ ID NO: 2090 - RNA, 65 nt, Homo sapiens
cuggucuguugucuacccucccguggugauugaagccauucacccucaggggagacagagaccag

SEQ ID NO: 2091 - RNA, 70 nt, Homo sapiens
uggcucaguuccaccaguacccagaccugggggccagccggggagcuggggcagcugugggaaugagcua

SEQ ID NO: 2092 - RNA, 69 nt, Homo sapiens
uguaggagugggagcaagggugauuuguggaaugagcagcucugaagacaaacuucuccuaauccuaug

SEQ ID NO: 2093 - RNA, 82 nt, Homo sapiens
ucaugugguacucuucucaagagggaggcaaucauguguaauuagauaugauugacaccucugugaguggaguaacacauga

SEQ ID NO: 2094 - RNA, 56 nt, Homo sapiens
guggaaggcugagguucaaaggcugccuguagcaggcgccggcccuuagcuuccac

SEQ ID NO: 2095 - RNA, 71 nt, Homo sapiens
gagaagugaaaauuuagcaagggcaaauucacgagggacucugaguaucuugcuaaauauuuuggcuuuuc

SEQ ID NO: 2096 - RNA, 80 nt, Homo sapiens
ccuugggguaggugcucuuauucgccacauuuuacaaaugaggaaacuggguguggggagguuaagggacuuacccaggg

SEQ ID NO: 2097 - RNA, 67 nt, Homo sapiens
aaauguugaccuccugaauguuuucauaccaguuuggauuggaaaacagaaggguagguaaacauuu

SEQ ID NO: 2098 - RNA, 97 nt, Homo sapiens
uauggaggggcaacaaggcuguccuagagacaucagauguucuauguuagaauggguuucauguuucuauuggauggaugggagaugccacuccaua

SEQ ID NO: 2099 - RNA, 82 nt, Homo sapiens
uucuguugaucuccuaacugcccuaugcugcauguuccuccccaguccgugcagcacaggggcaguuagaagauaaacagaa

SEQ ID NO: 2100 - RNA, 102 nt, Homo sapiens
ggggaucgucaucuggggaagggauccuuacgguguaauggggguggccgugucaccaccuaugcgcuaauacggguccccuccacucaaaugagggucucc

SEQ ID NO: 2101 - RNA, 106 nt, Homo sapiens
ggggguggcccagccuaaggaguccugcccuggaugguccagagcuagcagcaggagagguggcacuggauuauuugggguccacuaccaggggugggauacuccu

SEQ ID NO: 2102 - RNA, 63 nt, Homo sapiens
gccaggggcuggguagcucugaaggaagcauuaggcuucagcaagucaccucacagcccuggc

SEQ ID NO: 2103 - RNA, 71 nt, Homo sapiens
aagggcugaugagcagauagugggaagacaggaccuucucacaccgccucucccacccugccauggcccuu

SEQ ID NO: 2104 - RNA, 136 nt, Homo sapiens
cauuaccguguaaucggacuuuuuggaaaaguauagcaggcucuaaacuaaauggcugcagaccacucacugguaguuacuuaguucagagccuguaauacuuuuguuucuagagaacaguucuggcaggguagug

SEQ ID NO: 2105 - RNA, 80 nt, Homo sapiens
uguggccgccaacaugccugcuggucaggcccaguuccuucacccagcccugggccugagcacgggugcuggaggccgca

SEQ ID NO: 2106 - RNA, 83 nt, Homo sapiens
caccagggacccugaggccaugagagauccugggggcccaaaacagaaaaucccugagauaugcugauggccugguccuggug

SEQ ID NO: 2107 - RNA, 94 nt, Homo sapiens
cugggcugggggcagagaggaggaauuucaacaugaaauguuuuguucauuaacagagaacauagggggaaauucccuuucugccugggcccag

SEQ ID NO: 2108 - RNA, 86 nt, Homo sapiens
uuagauuggcagauguguugugugggagugaggaaaggaaauuuccuauguuaauuucuuucugacaagcacaugugcaaaucuag

SEQ ID NO: 2109 - RNA, 74 nt, Homo sapiens
ggcccaggagugccugccccaugguuugagaugaggccacacccccuccaagcccggggguggggcucugggcc

SEQ ID NO: 2110 - RNA, 79 nt, Homo sapiens
uacugaggugugagcauaugugcugcaaccacugggcccacuggcucguggugugugcgcaggugcagauggcucagug

SEQ ID NO: 2111 - RNA, 85 nt, Homo sapiens
ccuguaggcuuucauggguauauuuacuggugaguugacaaaagaugcgucaccucugccaggagauauuuccugaagcuacagg

SEQ ID NO: 2112 - RNA, 71 nt, Homo sapiens
ggugucugacuuggccauucagacaauugcccccuugugggaaugcgggaaugaaugguacaguggacacc

SEQ ID NO: 2113 - RNA, 132 nt, Homo sapiens
cuuuucugucaccccugggcugagccguccuguucgcugcuggcccuucucuuccugggagcgcucaucauugcccagcugccagaagaggagggguuagcauugguggagggaagcagggggagggaggag

SEQ ID NO: 2114 - RNA, 75 nt, Homo sapiens
ccucugcgcugccccucacucugcccucccucaucugcacuggcaguggugggcacagugggcuggaggcagagg

SEQ ID NO: 2115 - RNA, 56 nt, Homo sapiens
auucauuguugucgguggguugugaggacugaggccagacccaccgggggaugaau

SEQ ID NO: 2116 - RNA, 67 nt, Homo sapiens
accgagagccugcggcuggcguuugaggcggauggcagugcccugagcgcggcggcugggucucggu

SEQ ID NO: 2117 - RNA, 96 nt, Homo sapiens
ugaagaugcuagauuguggaaaggucagagauuggaaugcuagauuccuuagcaugcuaaauuuuagcuuuucuguaaaaauuuuagagauuuuca

SEQ ID NO: 2118 - RNA, 89 nt, Homo sapiens
ggucgcgguggcugaugacagaacaauguggagaaaagugugaugugucaaauccuuacuuuguucugggcauugugcuaaauguggcc

SEQ ID NO: 2119 - RNA, 71 nt, Homo sapiens
agccaccgcacccgcauguccugguccuuucagggcucccugaggcggccaggacagagguggagguggcu

SEQ ID NO: 2120 - RNA, 71 nt, Homo sapiens; identical to SEQ ID NO: 2119

SEQ ID NO: 2121 - RNA, 71 nt, Homo sapiens
cacccgcgggcccggggccuugcacaacucuuuaaauaaccauguuuugcaaggcccgcgccgagcgggug

SEQ ID NO: 2122 - RNA, 85 nt, Homo sapiens
gcuuuuugagcaggcagauuguaggcuaagacauaacagcuucccuuuguuguuucauugcuaugaucucuugcuagaaagaagu

SEQ ID NO: 2123 - RNA, 87 nt, Homo sapiens
cccucccgcuucaccggcuaccccgcccccacacucuuuucccacccaaggugugaagggcgggagacugggaggagaaagggaggg

SEQ ID NO: 2124 - RNA, 68 nt, Homo sapiens
uucuccuguugcaucugucauauauuaugcaauuaggcagaauuuggugauagauuaaaaagggagag

SEQ ID NO: 2125 - RNA, 60 nt, Homo sapiens
uuuucuggaaggggagacagagacauuaggcaaagagcuuagcuuucucuccucaggaaa

SEQ ID NO: 2126 - RNA, 82 nt, Homo sapiens
ggagagugaggagggaggagguucagaggcaauauggauuuuucccaucuuucuugguuuugaugacucccuccaauuuuuu

SEQ ID NO: 2127 - RNA, 72 nt, Homo sapiens
uuugggagacuuugacgaaagagucauuaaguucauuugcuucauuuguuuuccaagucaaagaaucccaaa

SEQ ID NO: 2128 - RNA, 108 nt, Homo sapiens
guagauugaagccaguugauuagggugcuuagcuguuaacuaaguguuuguggguuuaagucccauuggucuaguaagggcuuagcuuaauuaaaguggcugauuugc

SEQ ID NO: 2129 - RNA, 66 nt, Homo sapiens
uucucaggaagcucuccugaaugccagugcuugccucacugagauuuaggagaaguucucugggga

SEQ ID NO: 2130 - RNA, 76 nt, Homo sapiens
gcagcuggaccuuugagccucugcucucuccccgguuuguguuggggagaggguuggaggauguaggaguggcugc

SEQ ID NO: 2131 - RNA, 79 nt, Homo sapiens
agacagagaagccaggucacgucucugcaguuacacagcucacgagugccugcugggguggaaccuggucugucugucu

SEQ ID NO: 2132 - RNA, 78 nt, Homo sapiens
gccuugugacucccuaccaucuuuaguucucucugucgccuguugggaggggugaggagagguggcaaggagcaaggc

SEQ ID NO: 2133 - RNA, 82 nt, Homo sapiens
gguauuugaacuccuccagaaauguuuuacucuaacucuguaugcauggucagugguagagcauuugggagggugaagugcc

SEQ ID NO: 2134 - RNA, 78 nt, Homo sapiens
cagacuggaaaaucucugcaggcaaaugugaugucacugaggaaaucacacacuuacccguagagauucuacagucug

SEQ ID NO: 2135 - RNA, 60 nt, Homo sapiens
gugaguugaaacauuggucacacuauauaaaguuuguauaugugaaucaguguaacucau

SEQ ID NO: 2136 - RNA, 65 nt, Homo sapiens
uuuaggggacaccauacucauguugguuccacaccagugcaacugaacauguguguggcccugga

SEQ ID NO: 2137 - RNA, 87 nt, Homo sapiens
cuagcaugaguggcauggcacuagggucagcaguucuggcagaaacuucuggacauccagacuaugacccaggugaugugaugcuag

SEQ ID NO: 2138 - RNA, 72 nt, Homo sapiens
acugauugaugaacuucagcuuuuggcuuggugagagcauaaaauaagagcagcugagguuuccaaauuagu

SEQ ID NO: 2139 - RNA, 70 nt, Homo sapiens
ugggagugaucaacauauacuguauuagcaccuaaaacuccuuugguguguguguauguugugacuucua

SEQ ID NO: 2140 - RNA, 83 nt, Homo sapiens
uugagaagauaaaagguaggaaggcaaaggagaggacagaagaugaacuucuuuuuuuguuggcuccauguuuucuuucucaa

SEQ ID NO: 2141 - RNA, 67 nt, Homo sapiens
agggccugcggugggccaggugcucgggucagggagcagaaaggcgauguggcccaccugagguccu

SEQ ID NO: 2142 - RNA, 84 nt, Homo sapiens
accuugggcagaucguuuaacuucucucugcuuuacaguuacaagcgguaauacaaagagacaggauuauaugaucuccaaggu

SEQ ID NO: 2143 - RNA, 59 nt, Homo sapiens
uauugcugcugucucagcuguugcugccacuacaacuucagcagcuaggcaaggcaaua

SEQ ID NO: 2144 - RNA, 82 nt, Homo sapiens
agaccaugcacugauucagacaauucuuccacugccucugaugucagaucacuuguauccugucuguuucgguauguggucu

SEQ ID NO: 2145 - RNA, 95 nt, Homo sapiens
gcagggggcagggagcugggggcacugggugccugggcucugccacccacaggugggcagccuuggucucccgggcccucagccuccucuucugc

SEQ ID NO: 2146 - RNA, 80 nt, Homo sapiens
gaguccugcagagagagaggaaaguguuguuuucagaccugguuccacuaacagcuucuuuuccucucuuucaaggacuc

SEQ ID NO: 2147 - RNA, 87 nt, Homo sapiens
uccaugugcuucucuuguccuucauuccaccggagucugucucauacccaaccagauuucaguggagugaaguucaggaggcaugga

SEQ ID NO: 2148 - RNA, 59 nt, Homo sapiens
gggggugggucaugggcucuaagcugcucuucugucugucugagcuuaugaacaccccc

SEQ ID NO: 2149 - RNA, 73 nt, Homo sapiens
acugccuggcagagggcagggccaggauucaaagucacaucucugacuccugcugcccgcccucuggggcagu

SEQ ID NO: 2150 - RNA, 67 nt, Homo sapiens
gccagcuggcccaagaauagcuggccaguggccuugcuuuuggcuggccacucuugggaaagcuggc

SEQ ID NO: 2151 - RNA, 69 nt, Homo sapiens
gcccuucgggaagccagaggccccaugggaaggagugccuagccuugggggucugugacuuuggggggu

SEQ ID NO: 2152 - RNA, 57 nt, Homo sapiens
uggggaggguugggggaggcugccacacugccgugguuucuuccgccaaauucccca

SEQ ID NO: 2153 - RNA, 79 nt, Homo sapiens
agucaguggacuucacauuucucugacguuugaucuuaaauaagagcagcagacuaggagaggugagaaagugcugauu

SEQ ID NO: 2154 - RNA, 90 nt, Homo sapiens
ucugcuuggccgauuuuggcacuagcacauuuuugcuugugucucuccgcucugagcaaucaugugcagugccaauaugggaaaagcagg

SEQ ID NO: 2155 - RNA, 159 nt, Homo sapiens
ggagagaggaggucuauuggacaagaaccuugugagaugguuugguggugagaguggggaggcaggggaagugcgcagagagaccaucgcuucccucugcuccuugguccaugacacaacaucuauuucucagaagcucugggcuggugacuucucucc

SEQ ID NO: 2156 - RNA, 72 nt, Homo sapiens
gcuguuuggaaugcaugcugucucaggguugggaugcaggacaagaggggagggagcaugcagagaggcggc

SEQ ID NO: 2157 - RNA, 100 nt, Homo sapiens
uacauauggaaauucgacagauguacagaaaugcuacacaggacgggauguuucuuuauggcauuuccuugugcaucucauuggagaaaagaaaugugua

SEQ ID NO: 2158 - RNA, 66 nt, Homo sapiens
ugggacuggcagcagaggacagaauguguaaaggagagaaaaacaaacugugccucugcaguccua

SEQ ID NO: 2159 - RNA, 126 nt, Homo sapiens
ggagggugggugcucugcccaguugagugguaggagcugguguguugcuguauucucaggagcuguguggaggagagucaguauucuagcucuugcugauggaugugggcaggcgugaagccuucc

SEQ ID NO: 2160 - RNA, 66 nt, Homo sapiens
gccuguggggguggugugggggaggcuguacauuuucuuggagucuucccauaccgguacacaggc

SEQ ID NO: 2161 - RNA, 121 nt, Homo sapiens
gucagaugguacaauuauaguuauuuugcagagucaauuuucuguuacauaaucacauagacuuguaucuaaugcaacagaaaauugccuggguggaauaacuuucagguguugguuugac

SEQ ID NO: 2162 - RNA, 67 nt, Homo sapiens
caguccuguugccaucugcaucucugggguucagagaggaagcuagggaucaguggcauggggacug

SEQ ID NO: 2163 - RNA, 79 nt, Homo sapiens
gcagggcgugcaggagggagggagcagugauuaagagccaaagcucgcaucagaccugucuccucuugccaagucuugc

SEQ ID NO: 2164 - RNA, 84 nt, Homo sapiens
ccuuaaaguacuguagcagcacaucaugguuuacaugcuacagucaagaugcgaaucauuauuugcugcucuagaaauuuaagg

SEQ ID NO: 2165 - RNA, 87 nt, Homo sapiens
auaugggguaggacagggagguaauggaaucaucugaagggcccggguaccagauggugacaucuauuuccgcugucaaacccauau

SEQ ID NO: 2166 - RNA, 82 nt, Homo sapiens
cagucacguccccuuaucacuuuuccagcccagcuuugugacuguaaguguuggacggagaacugauaaggguaggugauug

SEQ ID NO: 2167 - RNA, 97 nt, Homo sapiens
agacucagugcaugagaaguccugcuggucaaucacagccccggagagucugaccagggcuaugguugaccagcaggauuucucauggagugagucu

SEQ ID NO: 2168 - RNA, 60 nt, Homo sapiens
guccacugugccuuucucaguagcagcagccagugcugguggugaggaggaaaaguggac

SEQ ID NO: 2169 - RNA, 100 nt, Homo sapiens
gugccuugugugugaguaugggcugggagaucacucugguggugcugggcuuaagggacaccagugugauuuucuggccaguaguucuuaaggaaggcau

SEQ ID NO: 2170 - RNA, 87 nt, Homo sapiens
ucugucuguugggcuggaggcagggccuuugugaaggcggguggugcucagaucgccucugggcccuuccuccagccccgaggcgga

SEQ ID NO: 2171 - RNA, 87 nt, Homo sapiens
gggguugguuguuaucuuugguuaucuagcuguaugagugguguggagucuucauaaagcuagauaaccgaaaguaaaaauaacccc

SEQ ID NO: 2172 - RNA, 85 nt, Homo sapiens
cucaggcugugacacucuagagggaagcgcuuucuguugucugaaagaaaggaaagugcauccuuuuagaguguuacuguuugag

SEQ ID NO: 2173 - RNA, 86 nt, Homo sapiens
uuggccuugcugggauguuucaugacuacucugcaguucuuaucaaccuccuuuagcauacucaugaagcauccuagcuaggcuaa

SEQ ID NO: 2174 - RNA, 82 nt, Homo sapiens
uucuguuuaucuucuaacugccccugugcugcacggacuggggaggaacaugcagcauagggcaguuaggagaucaacagaa

SEQ ID NO: 2175 - RNA, 84 nt, Homo sapiens
ggucuuuugaggcaaaguucugagacacuccgacucugaguaugauagaagucagugcacuacagaacuuugucucuagaggcu

SEQ ID NO: 2176 - RNA, 105 nt, Homo sapiens
aaagauuuauauacaauaguaaaagcaauugagaggaugucuaauuggggcuuguguauacucuaaacguccuuucaaucacuuuauuauuguguauugaucuuu

SEQ ID NO: 2177 - RNA, 102 nt, Homo sapiens
uuugugauuucaaauuauguuacaauucuauaauuugacaauuuuuaauaauuccauaguuuuggcaaauuauagaauugcagcauaauuugaauucacaaa

SEQ ID NO: 2178 - RNA, 82 nt, Homo sapiens
ugguacuugaagauagguuauccguguugccuucgcuuuauuugugacgaaucauacacgguugaccuauuuuucaguacca

SEQ ID NO: 2179 - RNA, 71 nt, Homo sapiens
gggaggguccuucccggggcugcugugauacagaacaccugugccgcccccacccugggagggucuuucuc

SEQ ID NO: 2180 - RNA, 82 nt, Homo sapiens
ugguaccugaaaagaaguugcccauguuauuuucgcuuuauaugugacgaaacaaacauggugcacuucuuuuucgguauca

SEQ ID NO: 2181 - RNA, 78 nt, Homo sapiens
cagacuguagaaucucuacggguaagugugugauuuccucagugacaucacauuugccugcagagauuuuccagucug

SEQ ID NO: 2182 - RNA, 100 nt, Homo sapiens
gaggaguuaagaguucauucggcuguccagauguauccaaguacccuguguuauuuggcaauaaauacaucugggcaacugacugaacuuuucacuuuuc

SEQ ID NO: 2183 - RNA, 82 nt, Homo sapiens
ugaugagugguagccaaugauaugccauuacaacaauagagauaaugcaauagccaugucauaaaaugguuaccccucauca

SEQ ID NO: 2184 - RNA, 72 nt, Homo sapiens
uguccaguaggaugaacucagagaaccucacccgggccgcgguugccccugcugaauucguccuccugggca

SEQ ID NO: 2185 - RNA, 77 nt, Homo sapiens
gcaaagcuuguuccagcacugacaccaucgaaggaucccagaccacaccuggugcuuagcccuggaauaugcuuugc

SEQ ID NO: 2186 - RNA, 82 nt, Homo sapiens
ugguacuugaagagaaguuguucgugguggauucgcuuuacuuaugacgaaucauucacggacaacacuuuuuucaguacca

SEQ ID NO: 2187 - RNA, 83 nt, Homo sapiens
caaacccuaggucugcugacuccuaguccagggcucgugauggcuggugggcccugaacgaggggucuggaggccuggguuug

SEQ ID NO: 2188 - RNA, 90 nt, Homo sapiens
gucuccuuuggaucuuuuugcggucugggcuugcuguuccucucaacaguagucaggaagcccuuaccccaaaaaguaucugcgggaggc

SEQ ID NO: 2189 - RNA, 67 nt, Homo sapiens
gcggagguagcagcguuggcggucccucaggcucuagcuugaccgccaccuccgucugcuccuccgc

SEQ ID NO: 2190 - RNA, 98 nt, Homo sapiens
gaagcauucuggaaacaucuguuauuucaaugauaccaccaaaucuuccucuaggacuuaguaguaucauugaaaugacagaugucuucagauguuuc

SEQ ID NO: 2191 - RNA, 99 nt, Homo sapiens
ccagcccugccacaucuuuaacagaaaguucuucuccugcuaauccuucugaauccaaagggauuagcagaagaggaacugucaggguggcugggcugg

SEQ ID NO: 2192 - RNA, 67 nt, Homo sapiens
uccagguuacuguaaagaugaaaugaaaucauauuaauauaugcaaacaucuagaacagugccuggg

SEQ ID NO: 2193 - RNA, 67 nt, Homo sapiens; identical to SEQ ID NO: 2192

SEQ ID NO: 2194 - RNA, 67 nt, Homo sapiens; identical to SEQ ID NO: 2192

SEQ ID NO: 2195 - RNA, 67 nt, Homo sapiens; identical to SEQ ID NO: 2192

SEQ ID NO: 2196 - RNA, 70 nt, Homo sapiens
ggcucuguguccagacgccagcugccugcucagccccauggcuggcugcggcuggcauggacccagggcu

SEQ ID NO: 2197 - RNA, 84 nt, Homo sapiens
gccugcuucugugugauauguuugauauuggguuguuuaauuaggaaccaacuaaaugucaaacauauucuuacagcagcaggu

SEQ ID NO: 2198 - RNA, 56 nt, Homo sapiens
uggcuugugaacauugcucagccuccugcgagacauuagcacuuguucucgagcca

SEQ ID NO: 2199 - RNA, 75 nt, Homo sapiens
aaucaaguaaaucugagcagaaguaagguuuguuuugcaggaauaaaccacuacuucugauaguguuucuugauu

SEQ ID NO: 2200 - RNA, 83 nt, Homo sapiens
acuuagcuccagagcuuggggguugucguuaagcccuuccuuuccaucagaggcugaugaauccccaaacuccugggcugagu

SEQ ID NO: 2201 - RNA, 72 nt, Homo sapiens
gugguggugauugaagagcagauguuuggcuucccuauauuauuuaucuugcucuucucuaauccucaucac

SEQ ID NO: 2202 - RNA, 64 nt, Homo sapiens
gagcgccugccccggugggugggaagcaggacucgggcgcucaugcagcgagcgggcggcgcuc

SEQ ID NO: 2203 - RNA, 89 nt, Homo sapiens
agugucauuugaaagggccuuccaguuugcucaguuggaaaguguuacagaguuuuaaagggugagcuggaaggcucucagcuggcacu

SEQ ID NO: 2204 - RNA, 86 nt, Homo sapiens
cgcuauuucccucccacuuucagcagucugguuuauuccauggguggaagaggaagccaaguuggcugagugugaagggaauggcg

SEQ ID NO: 2205 - RNA, 81 nt, Homo sapiens
aggugaguaggucgcauggaaaauggaaaucuacagaaaauucuaggaguuuuuggcaucaacauuuccaaccucucaccu

SEQ ID NO: 2206 - RNA, 73 nt, Homo sapiens
cccagggucuggugcggagagggcccacaguggacuuggugacgcuguaugcccucaccgcucagccccuggg

SEQ ID NO: 2207 - RNA, 79 nt, Homo sapiens
aucucuuucagauaagcagcgugguuuggugcagacacaaacaguagcacugaaucacaugcugcucuuuugaagagau

SEQ ID NO: 2208 - RNA, 55 nt, Homo sapiens
agcuugcuccucucgucgugcauguccugggacuuuuugacaggaggugugagcu

SEQ ID NO: 2209 - RNA, 66 nt, Homo sapiens
ucaaaccuacuuucuuuuuagauuuccugaugcagguaaggaaggaaaugugaaggagugguuuga

SEQ ID NO: 2210 - RNA, 69 nt, Homo sapiens
gugcccauauucuguaugguuaagugcgugccaacuggcuuuuacugcaugcggcucuaauuugggcac

SEQ ID NO: 2211 - RNA, 114 nt, Homo sapiens
agggaauuggaaauaguaugcgguuuuggugacucauuagcagucuguaaaggaggcaucuuccguuacuuacugcuaccugacuugucaguaugaauguggcuccuauucccu

SEQ ID NO: 2212 - RNA, 76 nt, Homo sapiens
gaugaaguagacagaggaggcagcauaauacuagaccuucuuaguaagcauguucucuuccucauucuucuucauu

SEQ ID NO: 2213 - RNA, 89 nt, Homo sapiens
guuuugcuguugucggguggaucacgaugcaauuuugaugaguaucauaggagaaaaauugcacgguauccaucuguaaaccgcaggac

SEQ ID NO: 2214 - RNA, 67 nt, Homo sapiens
gcauuucugaaugaacugacaauuuuucuuuaguauaacuaaagacguugagguucuucugaggugu

SEQ ID NO: 2215 - RNA, 127 nt, Homo sapiens
guggcaguggguagggaaucaaacaucagaugaccuucuuccucucugguuucuccccaccgcuguaucagaccaggaaggugaaagagggucaugcugacucuccuaacucccaucccucugccac

SEQ ID NO: 2216 - RNA, 76 nt, Homo sapiens
ugauggcucauuccccuucuaucugcaccaaaaccucugugacuguguccugcagaucaagggagaugugccauca

SEQ ID NO: 2217 - RNA, 57 nt, Homo sapiens
ucuuagaugcccaguuaaaugggacuucuuucucccacucuaacuggugcuuuaggg

SEQ ID NO: 2218 - RNA, 60 nt, Homo sapiens
gagaaguugcccguguuuuuuucgcuuuauuugugacgaaacauucgcggugcacuucuu

SEQ ID NO: 2219 - RNA, 68 nt, Homo sapiens
uggaggaugggggaggcaaagccaaguuuuuggugacauuagauugauuuugguacccaccuccucca

SEQ ID NO: 2220 - RNA, 104 nt, Homo sapiens
ucuggauuguagagaaaaaaauuuggucauucauucugauguuuugucugcguaguaccaaacaucuggaaguugggugacagacugaauuuuucacauccaga

SEQ ID NO: 2221 - RNA, 125 nt, Homo sapiens
guccugaugaacaacuaacaaucguccgcccccacagagaagcacagggcccagccauacccaccucuccgcucugcccuggugcucuucuguccaccuggagagccacagccugaucucaggac

SEQ ID NO: 2222 - RNA, 81 nt, Homo sapiens
ugguacuugaagggagaucgaccguguuauauucgcuuuauugacuucgaauaauacaugguugaucuuuucucaguauca

SEQ ID NO: 2223 - RNA, 59 nt, Homo sapiens
aaggaagugccagaaaugucagaagaaagccuauuuucaugggauuuccugccuuccuu

SEQ ID NO: 2224 - RNA, 61 nt, Homo sapiens
ggagucaugcuucucugagguucagugugguuacuucuauuucacagagacgucugacuuc

SEQ ID NO: 2225 - RNA, 98 nt, Homo sapiens
acucugaugcucaccuuucuccucauuucuacagucgcugcuuuuguguaacguuggcucagcagcccuguaggaguuagggggauuggcuuuggagu

SEQ ID NO: 2226 - RNA, 77 nt, Homo sapiens
gccggcuucggccauuuccggcgcggcgcccuucggcaaguuccgcagucgccugucggaaauggcugccggccggc

SEQ ID NO: 2227 - RNA, 126 nt, Homo sapiens
acauguuucaacaacaaaaaauuaacugauuccuucuaaaaguugaagggucaauauccacugccaaggagccuucagcuuuuagaaggaaucgguuaauucccauuuuuguuguuguugacgugu

SEQ ID NO: 2228 - RNA, 61 nt, Homo sapiens
augggcuuagagaaguuuucagccaauggaagcucaugcugagcgcuuuucucuggcucau

SEQ ID NO: 2229 - RNA, 110 nt, Homo sapiens
uaauugcugauuuuucuauauuuauggaaaacuggcauuucauaaauaucaaauugugauaucaucuacuuguaugcugguuuucuaugaauauauaaauuuuguaauua

SEQ ID NO: 2230 - RNA, 70 nt, Homo sapiens
ucugugaugcaaacuuuguuuaccagaagguuuguuaccaggugguaaacaaaguguuugcccuuauaga

SEQ ID NO: 2231 - RNA, 78 nt, Homo sapiens
guccggcugccuguguugagugccucuguguccccaguguguggcauauaguaaguacucaauaaagguuugcuggau

SEQ ID NO: 2232 - RNA, 81 nt, Homo sapiens
cuguugauaggcugaggccugcaguagacugugggcucaggagcaggugacagucugcuggagucuuggcuuccucagcag

SEQ ID NO: 2233 - RNA, 73 nt, Homo sapiens
ggggagguggcaggaagaggacagaaauaaaaacuuacacuacuuucuuucuuccuuucugcccucccucccu

SEQ ID NO: 2234 - RNA, 80 nt, Homo sapiens
gugggauugguuuucuuuguccagacagcucuccuaaccagaaaggcuagaccuguuuguuaagaaagcuucuauccugc

SEQ ID NO: 2235 - RNA, 80 nt, Homo sapiens
cacuccuugccuggcaaggcuugauugcuuugaacagggaugacauuuaagcagcagagucuagcuagguucuaggggug

SEQ ID NO: 2236 - RNA, 82 nt, Homo sapiens
gaugacuuaagucauaugugucccaagucucuagaauuuuaggcaaauggaguuuggggcacaaauguacuucucagucauu

SEQ ID NO: 2237 - RNA, 77 nt, Homo sapiens
gaaucuguugccuccagguguuaacacagaauuaagcauccacaauugcugaaagucaccuggggcaugguggguuu

SEQ ID NO: 2238 - RNA, 77 nt, Homo sapiens; identical to SEQ ID NO: 2237

SEQ ID NO: 2239 - RNA, 77 nt, Homo sapiens; identical to SEQ ID NO: 2237

SEQ ID NO: 2240 - RNA, 77 nt, Homo sapiens; identical to SEQ ID NO: 2237

SEQ ID NO: 2241 - RNA, 77 nt, Homo sapiens; identical to SEQ ID NO: 2237

SEQ ID NO: 2242 - RNA, 77 nt, Homo sapiens; identical to SEQ ID NO: 2237

SEQ ID NO: 2243 - RNA, 77 nt, Homo sapiens; identical to SEQ ID NO: 2237

SEQ ID NO: 2244 - RNA, 77 nt, Homo sapiens; identical to SEQ ID NO: 2237

SEQ ID NO: 2245 - RNA, 77 nt, Homo sapiens; identical to SEQ ID NO: 2237

SEQ ID NO: 2246 - RNA, 97 nt, Homo sapiens
ucacuguucuuucucuugagaaaggagagcuuaaugugucugauuccaggagcugagaauuaagcuguccuuucucagaggagguagaauacagugg

SEQ ID NO: 2247 - RNA, 133 nt, Homo sapiens
guggggaugcuggggucucacaaggccuugaugugaguccccgcucuagugauuacacagccaguauacauaguaagcacuacagcagggccucacaacuaggucuugugaucccagagcucaucuuccucac

SEQ ID NO: 2248 - RNA, 66 nt, Homo sapiens
uggggguuagggggucagaguaagccuauggcuguauggcugcccuccuugacuccuacaccccca

SEQ ID NO: 2249 - RNA, 68 nt, Homo sapiens
cucagaguaacaguuggcuuacaucuucagugauucgucugcaagguguauacgauugugcuucuggg

SEQ ID NO: 2250 - RNA, 59 nt, Homo sapiens
guggguuuacuagguccuucugaaagaucaaauuuugcucggagggacccagaaccuac

SEQ ID NO: 2251 - RNA, 71 nt, Homo sapiens
guucccuuaccaggcuccucuuugcucuccgcagcagaaucaauaggggggaggggccuggaguggggagc

SEQ ID NO: 2252 - RNA, 74 nt, Homo sapiens
aaauauguaaaagcaacuuagcagguaaugcaauauaggaggaaaaauagcuccuugcugaguucuucauguuu

SEQ ID NO: 2253 - RNA, 92 nt, Homo sapiens
cuuaacauaaggcugauucucucgaacugugcgaccggcagaagcagaugugugugaacuggacacagauugaagaaucugccccuguugag

SEQ ID NO: 2254 - RNA, 102 nt, Homo sapiens
uagggacuaagaguuuguugaccacauuuccacuucauaaacagaguuauccaaccaagacuuguuuagaaacuagaaauguagucaaacacacugucccug

SEQ ID NO: 2255 - RNA, 69 nt, Homo sapiens
gauaauuuauugugcacugucucauuuaaugcuuguggcaaccuaaugaggcagguacauuugauuauu

SEQ ID NO: 2256 - RNA, 129 nt, Homo sapiens
acuuuuuuaugccaccagggauuaggcagugaguuacugugcucagugcuauuuaauguacaagacagaaauuuauuaaauggcaaugaaguaguaauuacuaaacaguucccuaguggcucaaaaagu

SEQ ID NO: 2257 - RNA, 61 nt, Homo sapiens
ggagggcuaugcggcgggggagacggggcaggccccuccuccuuuguccgcccugcccucc

SEQ ID NO: 2258 - RNA, 88 nt, Homo sapiens
guggacauaucagauaguugacauagcacugacugcuggaauaagcaaaucuaaaugcagucugugcugggcuguacugcuuguccac

SEQ ID NO: 2259 - RNA, 79 nt, Homo sapiens
gagggcuuauguguaaggaugaggcacuccaggucauuugagacacuguggguuguuuugacuuuuuauuuuagcucuu

SEQ ID NO: 2260 - RNA, 138 nt, Homo sapiens
cauuaaauauaggagacuuuuuguuauguggcagauggauaauaaaggaaugcugaaugcagcuccauuccaaguuaugggaaucuggacacuucaucagcauucacuuaauccucugccauagcuccgccuuugaug

SEQ ID NO: 2261 - RNA, 70 nt, Homo sapiens
gcccgggucucugcaggcgggcuucgcccggccaagucaggcggcgcggggcgcucugcagaccccgggu

SEQ ID NO: 2262 - RNA, 77 nt, Homo sapiens
ccugaucucuggccuagauggacaaugugggugugcucucugugucuucccuguccaucuguuggccgagggucagg

SEQ ID NO: 2263 - RNA, 75 nt, Homo sapiens
gggaccuucgcggcgcaaggcggggucgcggccggcccgggggcugugcggccaacggcugcucgcagggguucu

SEQ ID NO: 2264 - RNA, 66 nt, Homo sapiens
uguuuaaucccaaaucugucaggccuuguuaaauuugauggggccugaaaggucugguguuaagca

SEQ ID NO: 2265 - RNA, 139 nt, Homo sapiens
uagggccucacgguaugcccaacacugccuggcaagcaucggguguucaguaaauguaaguuauaugccaccauagcacgcacuuauuggacaugcguuuuaugccaggcagcacagguaacauggagucuuggcccua

SEQ ID NO: 2266 - RNA, 104 nt, Homo sapiens
uguaaggucaaagcugcuuagagacagggaaggccugagggcuggugacgcucccauggccuuugggauccccagcucucuccucccucucacagccccuugca

SEQ ID NO: 2267 - RNA, 87 nt, Homo sapiens
gcaccucucuggguuaaagauaguuuuugccaaauauacugaccucuggaauauucuucugcgguacuauuauugacccugaggugc

SEQ ID NO: 2268 - RNA, 93 nt, Homo sapiens
gugacugucugugggggaaagcaacugaugaacugucuccucugcugugcucagagauaguucuguaguucuuucucucaaaauaucagucau

SEQ ID NO: 2269 - RNA, 76 nt, Homo sapiens
uccucuguggagggaauuuggguuagaugcuaggcacaauccaaucgucagcuaucuguaaauucccuucagagga

SEQ ID NO: 2270 - RNA, 136 nt, Homo sapiens
augguucuggugauaauugcugaauuuccgaauuaauaggaaaacuggcacaauacuagauaauaucagaguuuguuauuugugaagugccaauuuuauguaauuagggaaaauugcuaauuaucacuggaacuau

SEQ ID NO: 2271 - RNA, 71 nt, Homo sapiens
ucacaggugauggagagagacagagcucagcugagagaccagugcuggccugucucuccucuguccuguga

SEQ ID NO: 2272 - RNA, 79 nt, Homo sapiens
aagucugugcccaggguuagaugcuagucuugucuuguuucaggaguaagucugguuauuuguagcuggggucagacuu

SEQ ID NO: 2273 - RNA, 83 nt, Homo sapiens
agaggugugaguauaaagcagcgagacugauuugaggugugcagcuucuggagucagucucauuacuuucuacugucaccucu

SEQ ID NO: 2274 - RNA, 87 nt, Homo sapiens
aaauauuuggucaauguaacuugucaagagccauagaaaaacaucuauuugaaauaucuuuugacaggauggauggacugaguauuu

SEQ ID NO: 2275 - RNA, 107 nt, Homo sapiens
uuccaggugggaagaggcccagucuggggaucuuaguuugagaaaccaguguugggaucuauaacugggaccucagaaugggcuuaguaugaagguucaguuuggag

SEQ ID NO: 2276 - RNA, 58 nt, Homo sapiens
ugccuguugucugcucucguuccauguccugcuggauggcacagcagggugacgggca

SEQ ID NO: 2277 - RNA, 84 nt, Homo sapiens
ucaggccugggcugggcugugugucucuguuuuggaccguugcccugguccuuggcagagagacacuccccuuucugggccuga

SEQ ID NO: 2278 - RNA, 84 nt, Homo sapiens
ucaggccugggcugggcugugugucucuguuuuggacuguugcccugguccuuggcagagagacacuccccuuucugggccuga

SEQ ID NO: 2279 - RNA, 60 nt, Homo sapiens
ggggagcugaggggaucuugcaagaaaucacauuguuccugccccagauucccgcuccuc

SEQ ID NO: 2280 - RNA, 81 nt, Homo sapiens
ggucaugugagacgugcucucugucauggcagggaugaccucgcagaccuugcugugaucaggagugacccccucaugacc

SEQ ID NO: 2281 - RNA, 87 nt, Homo sapiens
cccaggaugcaggagccucugccucccuccuguggcaguagggggaauggcaggucauagcggggggugcagaggcuucuuccuggg

SEQ ID NO: 2282 - RNA, 90 nt, Homo sapiens
ggaggagugcauggcacccacgacuguaaacuccaauaauauuuucuguaauaaaugugaggaguucacaguugcugccaucccuccucc

SEQ ID NO: 2283 - RNA, 108 nt, Homo sapiens
uuguaccugcuacugugacucuuuuccaugucuguuuccacauugguguagcaaaggaaaaugaggagacgcauuuggauaaaugucgagucauagaauuuggugcaa

SEQ ID NO: 2284 - RNA, 92 nt, Homo sapiens
aguuaauuggucuuuuuucuuuucuagcccuucacacuacugaaguaauguuauuaaugugaaggacuaagagaagaaaaagaauauuaauu

SEQ ID NO: 2285 - RNA, 100 nt, Homo sapiens
cuaggccugugggagggcggcgcuguggguccugccugccgucaguuuucucucuccugggggucagggagacuuggagcucugucccuucuuggcuuag

SEQ ID NO: 2286 - RNA, 69 nt, Homo sapiens
cgggcggugugggcgcgucggguccuucucccuuugucugcagugagugauccgcgcgcccccugccug

SEQ ID NO: 2287 - RNA, 120 nt, Homo sapiens
gcuguuuuguuuccaacucccagucauaauccuuuguucaugacauuauaaucaucaccacaaguggcuaauugugaugucacaaauggaggauuaugacucaaaugaggaauaaacagc

SEQ ID NO: 2288 - RNA, 64 nt, Homo sapiens
ggaaggaugugucacucucaggagguuguaagucauugggacgccuccagggaugauuccuucc

SEQ ID NO: 2289 - RNA, 67 nt, Homo sapiens
gaggcccugugcaaagcaggacuuuuuguugcuuuauccaacugugcaguccugugaugugggccuc

SEQ ID NO: 2290 - RNA, 84 nt, Homo sapiens
ucugugcugucaccugcguaugcugccaccaggugggugcugaagccauccucguagcagcauaguaggugccuccugcacaga

SEQ ID NO: 2291 - RNA, 165 nt, Homo sapiens
ucacuguugugaacacuugcuuucacuugcuaugcaccugaugacgagggguccacagccaugcccguguucaugaaaggucaccacguucugcuucucaucaugggcaugugucguauccccgaggcugaggcaagaagagagaaggaaaguaaguggcaguga

SEQ ID NO: 2292 - RNA, 59 nt, Homo sapiens
aucacauuuuuauagcaggagcugugaggaagcucauaacuucaugcugugaaugugau

SEQ ID NO: 2293 - RNA, 119 nt, Homo sapiens
uacucuguuauuuaaauaccaaugcacaacauuucccaaagaaaccuuucuuuaugaauucuggaagaaaacuuucuuugggaaagguugugcauuguuuuauuuuaaguuccagggua

SEQ ID NO: 2294 - RNA, 65 nt, Homo sapiens
gugaggauuggagaaccaggauuucugcuaucugaccagaguagaaaucuauucuccuuucucau

SEQ ID NO: 2295 - RNA, 95 nt, Homo sapiens
gggcccauugcugggcugcugggcuuucugggagcaccugcuggcuugcuacacacuccuccucccagaaacuccacacccacagcccugggucu

SEQ ID NO: 2296 - RNA, 80 nt, Homo sapiens
agagggauuggaaaccucaccucgggauggcugugauuuuaguccauccauuucugcaggugcuggcuuccuuuccuuuu

SEQ ID NO: 2297 - RNA, 65 nt, Homo sapiens
agcagcuuuggcccgguguuaauuaccuccucuuggagaaaggucugcgccuggcccuggcuguu

SEQ ID NO: 2298 - RNA, 79 nt, Homo sapiens
guuuauuuugagaguguuugcuguauaauuggacuuaauaaaauguuuagagguacaguaggcaugacuuuggguagau

SEQ ID NO: 2299 - RNA, 72 nt, Homo sapiens
aauaauuuucucuuugggucucaguuuccucaucuaaaaagugaggaaauuggaucaaaugaguggguuguu

SEQ ID NO: 2300 - RNA, 95 nt, Homo sapiens
uuacaaauuguuuagaaaauaguuauguuugcaaggagggauagggaacguauauaauccugucucuccaguaguagcuauuuuuaccuuuguga

SEQ ID NO: 2301 - RNA, 76 nt, Homo sapiens
uaagcaguuagcauggggauuaugccagaagaggaagauaaucucuuuggcugccauuuccaugcuccuuuguuug

SEQ ID NO: 2302 - RNA, 75 nt, Homo sapiens
aaggaaauuauuugauguaggcugagccacagcugaacagauaaguggcucagcugucugucagagccuuuucuu

SEQ ID NO: 2303 - RNA, 95 nt, Homo sapiens
agcuuauuuaauaugacaucaguugaauaaagccagcugugaguaauuaucuccgauauuugauuuccagcuguuuuguugaacuguuaugggcu

SEQ ID NO: 2304 - RNA, 88 nt, Homo sapiens
gagggucuuauaaagcaacagcaaccuucccuaaagugauuuuucacugagacagcuacuuuagaaggaugcuguaacacugacccuc

SEQ ID NO: 2305 - RNA, 103 nt, Homo sapiens
ugcuuuuuuccaaucugcuccucuaauugauacgguucuggauaagaauaauccauuaauagccacgaguaucguauuaaaggaaguagaccugccgaaagca

SEQ ID NO: 2306 - RNA, 84 nt, Homo sapiens
ccugagauuggaggaaggagccaguucuacucucagcuucucuucucccuggagaggaggugagaagagaaagggcuucucagg

SEQ ID NO: 2307 - RNA, 78 nt, Homo sapiens
gcuuuccuuugugcuugaucuaaccaugugguggaacgauggaaacggaacaugguucugucaagcaccgcggaaagc

SEQ ID NO: 2308 - RNA, 72 nt, Homo sapiens
cuguucuuuuaguaaaaugugguaaaggaacaagcacaugugccuuccaucagccauguuguacuggaauag

SEQ ID NO: 2309 - RNA, 145 nt, Homo sapiens
aaauugcuuuauucuucuuucauucuuguaaacuaauuucuguucauguuacaaagcauucagcaugaugcuauacccuaccaugcugaaaugcuuuguaauaugaacaaaauuagagaggggaaagagaagaaaccugcaauuu

SEQ ID NO: 2310 - RNA, 72 nt, Homo sapiens
cuggggauuucauagggcaaacaaauuauucagacagaauaaugugugucguuguuugcuguauuuccccag

SEQ ID NO: 2311 - RNA, 95 nt, Homo sapiens
gugauucuuuucuucccuaaggaagcugaugcaaaggguuccucagaaguaguuaauugaacccucugcaucagcuucuuuagggaaggaaucac

SEQ ID NO: 2312 - RNA, 74 nt, Homo sapiens
uuucuguguguuuauugauauuucacaucugaauugugaugacugaagaauaauaucaaugagcauaccagaaa

SEQ ID NO: 2313 - RNA, 92 nt, Homo sapiens
uggagaagacauccugguugguaaucacugcugaugggccagaaagcaugaccugugucaucagcaagggucagccaggguguuuguuuuua

SEQ ID NO: 2314 - RNA, 65 nt, Homo sapiens
ggaugcaggguguggacucauguauccugguauccuggaaaaguugaguucacauccuaguauuc

SEQ ID NO: 2315 - RNA, 66 nt, Homo sapiens
ggggcugugucacugugggcauagaaaguaguacuauuacaauauucucacagugacacaagcccc

SEQ ID NO: 2316 - RNA, 66 nt, Homo sapiens
ggggcugugucacugugggcauagcagcugguacuacuacaauauccucacagugacacgagcccc

SEQ ID NO: 2317 - RNA, 74 nt, Homo sapiens
cuucugugccgaggcaggacaacuggaaugaauuaugcacauucauacuuguuaaacugccuuggcaccagaag

SEQ ID NO: 2318 - RNA, 67 nt, Homo sapiens
ucucaacuuuguuuccuguugguucaggaaucaucugugcacuuaaaaagggaagcagggcuugaga

SEQ ID NO: 2319 - RNA, 86 nt, Homo sapiens
auuacaaaucucaagaguuuuauaugcaguugccaaaaaucucucuuuugacaaauugcacaggaggcauuuugagauugugugau

SEQ ID NO: 2320 - RNA, 76 nt, Homo sapiens
gaguggggaagggacaagaccaaugggaaaggcaagccagauggggaauuuuccaguccuguuccuucuaccacuc

SEQ ID NO: 2321 - RNA, 58 nt, Homo sapiens
agagcuguuuuuccaaacuauugagcauggugacuuagugauuggaaaaacuaguuuu

SEQ ID NO: 2322 - RNA, 67 nt, Homo sapiens
uguguuagaaacaguugucaagugugguuccuuuacgccaugagacugggagcuguuucuaaacaca

SEQ ID NO: 2323 - RNA, 74 nt, Homo sapiens
caggaagcugguuucauauggugguuuagauuuaaauagugauugucuagcaccauuugaaaucaguguucuug

SEQ ID NO: 2324 - RNA, 56 nt, Homo sapiens
uagugccaaggggaauauugggauaacucuauucuaccccauucccuugugugcug

SEQ ID NO: 2325 - RNA, 83 nt, Homo sapiens
cugggcgggccucugagcagcagcccugcacucgggcucaccauagugcccugggucuaggugcugugggaggcccugcccgg

SEQ ID NO: 2326 - RNA, 88 nt, Homo sapiens
cuccugccccugcagaguuccuucaccccagcccaguucauucuugcugaaugaacgaagguggaggaggcggugcaggggucaggag

SEQ ID NO: 2327 - RNA, 80 nt, Homo sapiens
auuuuuaucucucuugucuuaauacuuaggaacauugagaugugugagucuuuguggccagggugggagagaucagaaau

SEQ ID NO: 2328 - RNA, 68 nt, Homo sapiens
acccagcacaaagcaggcaauucugagaucuccuuugccucucugaauuaaacccuuugugccugggu

SEQ ID NO: 2329 - RNA, 162 nt, Homo sapiens
gaccagggccuuacccgcaagccacagggaccuugacuucacggcucugacucugagaggccacucuaacuacuugccuguucugagcaguggagcuaggccucaucagcugacagaaagccugcuguuaaguuaauguguuuuaaauuaaggccauugguu

SEQ ID NO: 2330 - RNA, 61 nt, Homo sapiens
auucuuucaagaagcuggaagucugugugagggaacaggcuucaagguucuuggcaggaau

SEQ ID NO: 2331 - RNA, 66 nt, Homo sapiens
cucugcuagaagguggggcagggauucagcccccggugcugucccugacucucuuucugcguggag

SEQ ID NO: 2332 - RNA, 67 nt, Homo sapiens
gcauuuaccgguacucacuccaugcugggcauugggcugagagguggcuagagagcuggucagaugc

SEQ ID NO: 2333 - RNA, 101 nt, Homo sapiens
uugcaggcuuccauccagcuuaacguuauuguaccagggcugacagccugcugggugcaaagcccuguuuuggauacggaggagcuggggaagcucugcag

SEQ ID NO: 2334 - RNA, 75 nt, Homo sapiens
cuccuaaaggguuaaaguguaugggcuuuauuuuccaaacugucgcaaagcaccugcauuuuacucuuguaggag

SEQ ID NO: 2335 - RNA, 89 nt, Homo sapiens
caugagaaacuguggucucuaggcugacucuucuagaaucagaacacugcgggcauucagggcagcaaagaguccucaguuuccucaug

SEQ ID NO: 2336 - RNA, 120 nt, Homo sapiens
aggggaaaaaggugggagacuuggcaagaagccaugaaucaggagaggucugcucaggccaacuugaucuucuccuugaucccuuuggcuucuugcuucuccucuuuccuuuucuccucu

SEQ ID NO: 2337 - RNA, 67 nt, Homo sapiens
uucugucuucucuauuauaagcugggugucuaagagauagacaguauauggugguagaggcacagga

SEQ ID NO: 2338 - RNA, 119 nt, Homo sapiens
gaucccccuucauugacuccgaggggauacagcagcaauucauguuuugaaguguucuaaaugguucaaaacgugaggcgcugcuauacccccucguggggaagguagaaggugggguc

SEQ ID NO: 2339 - RNA, 67 nt, Homo sapiens
gggggcggggaggaugaggggcacuggucggguguucucugaugucccggcucuauccccagcuccc

SEQ ID NO: 2340 - RNA, 90 nt, Homo sapiens
ggugcacagagaacacaggggcaggcaguggacccaugcagcuccgugagggccagggguguuugucuccuuuguguccucuguuguauc

SEQ ID NO: 2341 - RNA, 66 nt, Homo sapiens
gaaugaccuucauccacuaaagaagggauguuuuuaaaaaccucgcaaguggaggaaggcucauuu

SEQ ID NO: 2342 - RNA, 64 nt, Homo sapiens
gcagauuaggaagagggcagugcuucuugcuccucaggauggugcucuccucuccugcaucugc

SEQ ID NO: 2343 - RNA, 65 nt, Homo sapiens
aggauggggaaagggagggaacgaaaguccuaguaaaaggagcuuccauccucuucccucauccu

SEQ ID NO: 2344 - RNA, 95 nt, Homo sapiens
ggcuagguuggagccagccugcauuugucucucuaucuuggaagcaaacuuagaauguagagauagauguggccuggaugcugcuaacucuagcc

SEQ ID NO: 2345 - RNA, 69 nt, Homo sapiens
ggcaggcagagcgccaugcuucuuccugccgcacagaaauuaaccccaagccauggccucugcccugcc

SEQ ID NO: 2346 - RNA, 87 nt, Homo sapiens
gugagccaggccuuggagguagcacgcggggagaagggcagggcacgagguggccugacgcugcuggacucugaagucugugcucac

SEQ ID NO: 2347 - RNA, 69 nt, Homo sapiens
agcaucccuggcugguggaagggcaugcgugagggugcuugacgccucucucgcuaaccaggugaugcu

SEQ ID NO: 2348 - RNA, 78 nt, Homo sapiens
aagggggaaaccagcaugacucuagcaugcuggcauccuggugcccuuugcagcuaaggucagacuguuucuccucuu

SEQ ID NO: 2349 - RNA, 133 nt, Homo sapiens
cuuggacuguggaugcagaagaccuggguucaaauccugccuggcucacuucccaggcgguggcuccagacaagucacuuggggagcaccguugggaggugagggcgagcccacaaacaugcauagcuucagg

SEQ ID NO: 2350 - RNA, 76 nt, Homo sapiens
agcuacuucaggacgguuggcugaauggcaacagugauggaauauuuauauuuagccacaugugcugaauguggcu

SEQ ID NO: 2351 - RNA, 91 nt, Homo sapiens
aguccaguguggucuccacucucauggaauuuccauucuacuaaggagguuggaagaguuuaugagaguuugagucaaacgcacuugggcu

SEQ ID NO: 2352 - RNA, 64 nt, Homo sapiens
ucgccugugguucauugauucugacaucuaauuaaauugaucaucuacagugaucacaaggcga

SEQ ID NO: 2353 - RNA, 67 nt, Homo sapiens
guguguguguuugcauguuggaguugggguggauuaugcucuucaauuucaaugcaacgcugcacac

SEQ ID NO: 2354 - RNA, 65 nt, Homo sapiens
ugcugugguuacucagaaaccagcaacuaugucagguuccugguuuacagaguaaaccaauagca

SEQ ID NO: 2355 - RNA, 97 nt, Homo sapiens
cgugagugggcagaggugaggggcuggggaccuggauccuuuggcaggaagcucacucucccugucccgccccaccccuccuguguuccagcucacg

SEQ ID NO: 2356 - RNA, 77 nt, Homo sapiens
ugguacagauauaacuugcacuguaggaaugccuaaguguaccucgcuuccuacaaugcagguuaaaucugguauca

SEQ ID NO: 2357 - RNA, 71 nt, Homo sapiens
auggauauuuaccugauagauuaggaugguugacuuuagaguagucuugcucuauuaggcaaaugaucuau

SEQ ID NO: 2358 - RNA, 117 nt, Homo sapiens
cacugacucaaagaauaacuugcauaggaaggggacagugagugugcuuggggcccauagauuuugggugagagaaccacugcuuccuuccaacugaaagacguaaugaguuuagug

SEQ ID NO: 2359 - RNA, 65 nt, Homo sapiens
aggcuccaaaccacaugcuggacuuucauucucaaaagcaauccauaugugccuuuugagagccu

SEQ ID NO: 2360 - RNA, 84 nt, Homo sapiens
guggucgaggcaagacucuagcagggcaguugggagccauggaggguuucagccucccaugccucuggggucaucucuggccau

SEQ ID NO: 2361 - RNA, 93 nt, Homo sapiens
cccucuccugcccuguucauaccugccuagcuacccacugcaacaaaaugagaaaugggccaugcaggugggugggacauuccaggcagaggg

SEQ ID NO: 2362 - RNA, 58 nt, Homo sapiens
cuacucuggagagugacaaucauguauaacuaaauuugauugacacuucugugaguag

SEQ ID NO: 2363 - RNA, 58 nt, Homo sapiens; identical to SEQ ID NO: 2362

SEQ ID NO: 2364 - RNA, 58 nt, Homo sapiens
cuacucuggagagugacaaucauguauaauuaaauuugauugacacuucugugaguag

SEQ ID NO: 2365 - RNA, 68 nt, Homo sapiens
cuugauuguugacauugguggcagcuguuacugccaaucuaucuucaaccaacugugaacauaucaag

SEQ ID NO: 2366 - RNA, 76 nt, Homo sapiens
gcccagcauggguguggcugcccauugguccucugaagagccucaggggcuuguggcagcagguguaugucugggc

SEQ ID NO: 2367 - RNA, 76 nt, Homo sapiens; identical to SEQ ID NO: 2366

SEQ ID NO: 2368 - RNA, 115 nt, Homo sapiens
gggcugcaggguuggggugcagggacgccgaggagcugaagaguagcauuuaaaaaguuugaauuuuucagcuuccuucccucccugcacauucccaaacuccacuugccagccc

SEQ ID NO: 2369 - RNA, 71 nt, Homo sapiens
gagcugggguggaccgcgguuucugcugagagcauggcggcuacaggggaaacugaggcagcccacagcuc

SEQ ID NO: 2370 - RNA, 104 nt, Homo sapiens
uccgagcuaaugacaaagcagaugugugggcaaggcagccagcuuugucuuucagguggagagggcugccuugucaguaaaucaaaucaguucuuggauuuggg

SEQ ID NO: 2371 - RNA, 67 nt, Homo sapiens
uuucuuggguuauuuuuccucucaucuuuugaauuugaaaagaacugagggaaggcaccugaagaaa

SEQ ID NO: 2372 - RNA, 58 nt, Homo sapiens
cuuccccaggucaucagccagaaggagggagacuucuucuuugauuccuugagggagg

SEQ ID NO: 2373 - RNA, 73 nt, Homo sapiens
uuugcugccuugcuucuaaccaauaacacccugaaugcaucaggcuuuucaagucagaagugaggcaagcaaa

SEQ ID NO: 2374 - RNA, 67 nt, Homo sapiens
gaggcaagcauuuacauugagagagugcuuaaaaucaagacuaauuucuucauuguugcucugccuc

SEQ ID NO: 2375 - RNA, 84 nt, Homo sapiens
gcccuccccucauguucagggaagaccagcugcuuccuguuugugugaagaauucggcuguuuucccgaguggugggugagggu

SEQ ID NO: 2376 - RNA, 75 nt, Homo sapiens
cugagcccacuuggacagaggucucucucuguaccuccuuacagauuccaucccugguccaggccuggagcucag

SEQ ID NO: 2377 - RNA, 67 nt, Homo sapiens
uuggaggauucaggagcagccucccagagcacccugauuguucugcugucccugacugucacuccga

SEQ ID NO: 2378 - RNA, 70 nt, Homo sapiens
uuguuccuccauuacacugucccccaguuagggauuuggccucugacaguguaaugaguugggagagcaa

SEQ ID NO: 2379 - RNA, 66 nt, Homo sapiens
ggcuuugguaacucuggagcaagggcugugagcagcgcugagcccugcuccaggucaccuggggcc

SEQ ID NO: 2380 - RNA, 95 nt, Homo sapiens
caccccccaaaaacgccuaaaugaagauagauggauucccuuaccagcaaagggcgaaggggaugcccucuaucugcaauaggaauggcggggug

SEQ ID NO: 2381 - RNA, 91 nt, Homo sapiens
ucaagagguaauuuaucuuggucacccuuccuucuacagagcacuccagccuggagguuaauagaaaaggaggcuguggcugccaucuuga

SEQ ID NO: 2382 - RNA, 84 nt, Homo sapiens
uccugggaaaguuggacuugaauuggcacugaguccuucccucguuuggauucagaugggguuugaguccuagauucaccagga

SEQ ID NO: 2383 - RNA, 72 nt, Homo sapiens
ucuaaccgcccugugggggaacgggaggccccaagccccugggaguccuggucuccucuagaguguguugga

SEQ ID NO: 2384 - RNA, 70 nt, Homo sapiens
ccuggaccucugggugccacugucuguacauguccagcuuggcaggcagcuggcauccuaaggauucagg

SEQ ID NO: 2385 - RNA, 73 nt, Homo sapiens
cugugccaugugggucaguucauucucaggccucuuucagaguagagcauuggcuguucccaaauguguacag

SEQ ID NO: 2386 - RNA, 89 nt, Homo sapiens
cuggcucagguguauucuacagugcacgugucuccaguguggcucggaggcuggagacgcggcccuguuggaguaacaacugaagccgg

SEQ ID NO: 2387 - RNA, 106 nt, Homo sapiens
gggugcucugaauuaauggugggggaagguaaucccuuugugccuguggggagcuucagaucuguccacagggcacacaggugagaaacagccccaagauguaucc

SEQ ID NO: 2388 - RNA, 65 nt, Homo sapiens
gccuccccugcccuggcuugggaaaggcccuccaaaggauagcccgagcuaggaugggaggaggc

SEQ ID NO: 2389 - RNA, 71 nt, Homo sapiens
agggagggagcaggagagggaaggaaaggccacgcaaucccagcccugcccccucccucucuccacucccu

SEQ ID NO: 2390 - RNA, 92 nt, Homo sapiens
agaucuggagugcagugcacuugaggccaaggaaggugaacagaugagaugauuguuacuauuuaggccucaggguauaagauccuggauuu

SEQ ID NO: 2391 - RNA, 133 nt, Homo sapiens
auucugacuuacauuucucccaguggacaccggccagaugcagaaaccaaagagcuuggugccgguacugccucuuccuucuuuuauaguuugugcauuuggauguguuuagcaugaucugcgagugcagggu

SEQ ID NO: 2392 - RNA, 69 nt, Homo sapiens
gccguucagucagagaaaaauuuggaguaaccagcaguggguccauccagauccucucucugcaacggu

SEQ ID NO: 2393 - RNA, 74 nt, Homo sapiens
gggccggggugcugugaguuaccuuugguuauagggagguggugacccaugguggcuccaagugcccguggccu

SEQ ID NO: 2394 - RNA, 69 nt, Homo sapiens
gaguuggcguuuccuguucugggugcuacugccaaacguuaugguacuuagagucgggaugcacaacuu

SEQ ID NO: 2395 - RNA, 74 nt, Homo sapiens
gggcagagguucugcucugggcugaagacaaggcuagaagaugucagucugugcccagaccagcccugcugccc

SEQ ID NO: 2396 - RNA, 67 nt, Homo sapiens
ccuugcucaucccccagugccucauuuuauaaauaaaaggcagugcaguggagggauagaagcaggg

SEQ ID NO: 2397 - RNA, 79 nt, Homo sapiens
uuggaucugggggaggggcaaacagguuggagggggaggcuuccacuccaggcuguuguuucucuccuaaaguauccaa

SEQ ID NO: 2398 - RNA, 72 nt, Homo sapiens
guuugagaaaagcaacguugaagaugcugcugaucuugguaauacauuugcagagcgugcuuaucaucagac

SEQ ID NO: 2399 - RNA, 80 nt, Homo sapiens
auccucacaucuguuucugaccuucccaccauuugggugugaauccugaaugugguaggugucaggaaagaguagaggau

SEQ ID NO: 2400 - RNA, 95 nt, Homo sapiens
uugaugcuaaaagauggauugauacuucuuucauccuaucagccuuuuagauugauaggaugaaggaagguucaucaaguuuuuccagacaucaa

SEQ ID NO: 2401 - RNA, 61 nt, Homo sapiens
caggcagcaaugaaauagugcuccgaaaaauuacauucccagcaauuucagagcgugccug

SEQ ID NO: 2402 - RNA, 58 nt, Homo sapiens
ucgaggcuagagucacgcuuggguaucggcuauugccugagugugcuagaguccucga

SEQ ID NO: 2403 - RNA, 56 nt, Homo sapiens
ggggagccagacaugcccacaucugcaccucaggucugaggcugaugggucucccc

SEQ ID NO: 2404 - RNA, 68 nt, Homo sapiens
agcaugagcuuagaagucaggcaggccuggauuuuaauucuagcacugccguuuucuaacuauaugcu

SEQ ID NO: 2405 - RNA, 68 nt, Homo sapiens
agcaugagcuuagaagucaggcaggccuggguuuuaauucuagcacugccguuuucuaacuauaugcu

SEQ ID NO: 2406 - RNA, 68 nt, Homo sapiens; identical to SEQ ID NO: 2405

SEQ ID NO: 2407 - RNA, 102 nt, Homo sapiens
gguagguccguggaggaauucuaagcauccaucucuucuucaccuuucagugaggguggaaagaugaagauguuuaaggauuggagguuugcagagccuacc

SEQ ID NO: 2408 - RNA, 89 nt, Homo sapiens
ugcauccccagacgcagccugguguggugugcuggaccacaaagaaugucucaguaacugccaauccaugguugaguuaaggagaugca

SEQ ID NO: 2409 - RNA, 80 nt, Homo sapiens
ucagcgugccaggaaguggcugggcuggguugguggucuaucuuacgcccaggcucgcuccgucacuuccacaucgcuga

SEQ ID NO: 2410 - RNA, 89 nt, Homo sapiens
ccaaggugcuagcucagaugccacagagaacgagaccuuccccuaaugacagagucugucuuugugugcaucugugcucccauucuugg

SEQ ID NO: 2411 - RNA, 174 nt, Homo sapiens
ggccccucgcgcccggccccucgguuucccggcuccuuggccccccgguuccccagcuccccggcgcgccuucccgcgggugaggcuugggcuccgacgcgggccaggcggcccgggagcauugccggggagggccugggggccgugggcuggaggggcgggcgggaaggggcc

SEQ ID NO: 2412 - RNA, 77 nt, Homo sapiens
uagaaauaggguucuuuaagugccugugauauaccaggcccaggaggucacaggcauuuaaagcacugugauuuuua

SEQ ID NO: 2413 - RNA, 58 nt, Homo sapiens
ggaaagcugaguggcagcuugcagguauuguacugaccugcgcugucaaagucuuucc

SEQ ID NO: 2414 - RNA, 87 nt, Homo sapiens
ucucaggcugugucccucuagagggaagcgcuuucuguugucugaaagaaaagaaaaugguucccuuuagaguguuacgcuuugaga

SEQ ID NO: 2415 - RNA, 88 nt, Homo sapiens
ucucaggcugugacccucuagagggaagcgcuuucuguuggcuaaaagaaaagaaagcgcuucccuucagaguguuaacgcuuugaga

SEQ ID NO: 2416 - RNA, 66 nt, Homo sapiens
ggaaagagugaucagggauugcauggcuauuauuuguaccauggcaaugcccuggcucuccuuucc

SEQ ID NO: 2417 - RNA, 167 nt, Homo sapiens
cgcccgccuugcguccagccugccgggggcucccaggccggcgcccgagcucuggcuccgugucuucacucccgugcuuguccgaggagggagggagggacgggggcugugcuggggcagcuggaacaacgcaggucgccgggccggcugggcgaguuggccgggcg

SEQ ID NO: 2418 - RNA, 127 nt, Homo sapiens
acauaaaucucucuccuuuuuuuuccugcagauaugucaggccucauucuaccuucugagccuuggaagguagaaagaggccugauaaucucuacagaaaggcaacaugggagagggauuuuuaugu

SEQ ID NO: 2419 - RNA, 60 nt, Homo sapiens
acagaguguaaugagaaugcaguugguuauguucauaccaauucucauuacaaucuuugu

SEQ ID NO: 2420 - RNA, 79 nt, Homo sapiens
gagcuacucaagaacuuugaucagggagugauguauaucuuuaaugugaaagacuauuggugguucuugagaauggcuu

SEQ ID NO: 2421 - RNA, 71 nt, Homo sapiens
ccuuggccaucagggcagaugcuggggaaggcguaucucccagaagucucaucuccuuggugggcccaagg

SEQ ID NO: 2422 - RNA, 65 nt, Homo sapiens
ucacugggcuuuggaagccagggcaacacagucccaguugcucaggcccccaaagccaacaguga

SEQ ID NO: 2423 - RNA, 105 nt, Homo sapiens
auugcaugguggguauccuuuuguucagugucuugguuggcuguggcuagucagugagaagucagcugggacucuaaaccagauagggcacuuaccaucugcaau

SEQ ID NO: 2424 - RNA, 64 nt, Homo sapiens
gugagacagugugugcaggcaccaccaccuuaauccugcuguugccugacaugcugauucucau

SEQ ID NO: 2425 - RNA, 93 nt, Homo sapiens
uuugcccucuaggagcuucagucuguuuggagaaauggacauguagauaaauguuauaacucacguagaaaugaagugcuuagagaaggcaga

SEQ ID NO: 2426 - RNA, 81 nt, Homo sapiens
uccuuuuguuuugcucuuauaugguggucuugagucuuuucucuggcuuuucaaaccuaguaagacuaagacacuaaggga

SEQ ID NO: 2427 - RNA, 76 nt, Homo sapiens
gcaacaccuccauuguuuuuaaucgacuccaggaccaagccccugacguagaugcugaaacauggaggcauguugu

SEQ ID NO: 2428 - RNA, 137 nt, Homo sapiens
guccccuccccuaggccacagccgaggucacaaucaacauucauuguugucgguggguugugaggacugaggccagacccaccgggggaugaaugucacuguggcugggccagacacggcuuaaggggaauggggac

SEQ ID NO: 2429 - RNA, 79 nt, Homo sapiens
gggaaauaguaagggaagcuaugugguccagaaaaaaaauaguuguggaccugaauggcuugccauuauuacauuuccc

SEQ ID NO: 2430 - RNA, 123 nt, Homo sapiens
cuggcuacauuaaacaaguaaauuuguagcuuagcacgguuuacuuaacaagcccaguuaugacagagcuggagaggagagaaagcuguguuggagaggcaggaaggugugauguucagccag

SEQ ID NO: 2431 - RNA, 92 nt, Homo sapiens
aacaguagagacacuauggucagacugccuggguaaaaacuuagcucugucauuuacuuaguaucuggcuuuggacaaguuucugaacuguu

SEQ ID NO: 2432 - RNA, 122 nt, Homo sapiens
ugcucauuuuuagcuuauuucuuguaccuugcagcacacucuacgcacucagcccuuaagggguuuacuuuacaaacugugugccuguaagauguauuagcaauaagauagaaaauugagca

SEQ ID NO: 2433 - RNA, 122 nt, Homo sapiens; identical to SEQ ID NO: 2432

SEQ ID NO: 2434 - RNA, 56 nt, Homo sapiens
ccccacccucgcugucccccgcuagaugcccucguugggggugcgaggcugugggg

SEQ ID NO: 2435 - RNA, 86 nt, Homo sapiens
uuugcuggucaaaggccuaaagccagaagcaggaaaucuggaauuaaauguuucuuguaucuggaaagaggcaugacuaagguaaa

SEQ ID NO: 2436 - RNA, 66 nt, Homo sapiens
ucccauuccuaguuccuuccgccucuuuucuucaggggucugcugaaaggaaguagggaaguggga

SEQ ID NO: 2437 - RNA, 80 nt, Homo sapiens
gaaaagcugacugcuagaguccaucaguuaagcucuaaggcauguccuuaacugaugaacucuggcugucagaacuuuuc

SEQ ID NO: 2438 - RNA, 80 nt, Homo sapiens
ugagaaguuaugucuuuagccacuugccucuuucauuuuguugggagagugcacauggcugaagauagugauguuucuca

SEQ ID NO: 2439 - RNA, 113 nt, Homo sapiens
gugauuagagucuuaaauauuuuguccugucuggaucagugggugcuugguuccuuaacaaaucagcugccucagugauugggaaggcaggaugguaagagcuuuuagaucac

SEQ ID NO: 2440 - RNA, 91 nt, Homo sapiens
cagccuggguaugcgugaccccaaaacagcugguuaauucccugaaaagaauugagugccagaugugggggaucguguaaccugagggcug

SEQ ID NO: 2441 - RNA, 88 nt, Homo sapiens
gguuccucugaagucagcauggcagggauuaguaguagcugggaggggacaguuacucaguuccugccaugcccugcagacuggagcc

SEQ ID NO: 2442 - RNA, 70 nt, Homo sapiens
ccuggguggccucuggcagauaucaguccuuccugagaagaaggacugaaucugcugagccagcuucagg

SEQ ID NO: 2443 - RNA, 87 nt, Homo sapiens
gcauuaggcccagcuuccuuccaugcugucacugcccacagguaguuguggccacugugcguggagggaggugguggccaguaaugc

SEQ ID NO: 2444 - RNA, 112 nt, Homo sapiens
ggcccuucccccugacaccccugccucuguuucucuucuaggccuuuccaaggacucauccgaaagccugguaagaggcacuggcuguggaggggucacugggaauagggcc

SEQ ID NO: 2445 - RNA, 68 nt, Homo sapiens
uacccuccucuggccucccucccuuuccuaaacuggggagggcugugguggggcugggggcgggggug

SEQ ID NO: 2446 - RNA, 74 nt, Homo sapiens
uccagacagaggaccuagcaugugcccaggcccagggugugaccgggggcaggugcagggcugcuguaucugga

SEQ ID NO: 2447 - RNA, 89 nt, Homo sapiens
guggccccucagaucugccuuggaccacugugcucccaggaggcagaugaggccccugguggcagguggcaggggcaggggcaggccac

SEQ ID NO: 2448 - RNA, 67 nt, Homo sapiens
ccacuagggugagcuuugaggaugacagucuauuccauuguuguuuuccaagcugucccauuggugg

SEQ ID NO: 2449 - RNA, 69 nt, Homo sapiens
gggggugcacucagcugccacuguccgccgccugucccuggggagcauggcagcugagggcaggccccu

SEQ ID NO: 2450 - RNA, 67 nt, Homo sapiens
cuuaaccuccuccccucugauuugaaaaaguccauuugacuuuagaucagaggaagaaguaguugag

SEQ ID NO: 2451 - RNA, 88 nt, Homo sapiens
ggccuuggauggagaagacuggagaggguauggaagugcuuggacguaggacaucugccucucuggucuuuguccaucccacagggcc

SEQ ID NO: 2452 - RNA, 66 nt, Homo sapiens
cagcugggggacugcuuuaggaggucgagccucagaccucccaugaggcgugucccugggcagcug

SEQ ID NO: 2453 - RNA, 62 nt, Homo sapiens
uguggcuguguccuagauuuaugaacaauggauuguuuugaagucuagauacaaaugccaca

SEQ ID NO: 2454 - RNA, 149 nt, Homo sapiens
ggggguggcccucccugcagucagcggcaggccggagccagcucuggccuuggcagggcggacacggugagagucagcuccaccugugccgugucaaggccgggagcgggcuuguggcugccguucagcucacuggggccuuggccucu

SEQ ID NO: 2455 - RNA, 74 nt, Homo sapiens
cccuugggcugcgguuuaagacaggcuucacaguauuuacuguuuauaguuuugagcugacagcuauuuaaggg

SEQ ID NO: 2456 - RNA, 66 nt, Homo sapiens
uaucccccagugcccaccucagugcccgguguagcgaaggucuggggauggggcuggugagggaug

SEQ ID NO: 2457 - RNA, 74 nt, Homo sapiens
acuucugguucuuccuccgugggagcuggguucuccaguggccuuccucccacggaggccgggccucaggaagu

SEQ ID NO: 2458 - RNA, 78 nt, Homo sapiens
gacggcuuuggagauuauggggaacauauggcccuaccgccgggcucuuuaucugcauuuucucauaaaacugccguc

SEQ ID NO: 2459 - RNA, 81 nt, Homo sapiens
uggggagcagcggggccccccagugaaccucucaccguuugguagaggguggcacucugggggcuccucuguacuuuccua

SEQ ID NO: 2460 - RNA, 102 nt, Homo sapiens
aacauuucuucuaauuugaagauuugugcauguugaauuaaucaugucgauuuaauuauuaauucaacgugcacaaauugucaaauuacaagaauaaauguu

SEQ ID NO: 2461 - RNA, 76 nt, Homo sapiens
guaacugcugucauguaaugugucauagcaugugccaggcacugugcuaugcaugucauaugugagcucaaguuau

SEQ ID NO: 2462 - RNA, 96 nt, Homo sapiens
aagugccugugguguaggagucagucacuccuaucucuagaaaaggaugguggcuaggagaguugucugauuuuuacauaaucccagaaaguacuu

SEQ ID NO: 2463 - RNA, 94 nt, Homo sapiens
cucagacagugaugguuuucagaguggauugaaaggagauuggcuacuucugcuucaaaacauccuggaaauugucugccuccugaauucugag

SEQ ID NO: 2464 - RNA, 101 nt, Homo sapiens
ggcgcaucuccucuccaccuccuguugccaagacaaccugccggcagcucaggcccggcucagccgcggcagcagggagggggggaggaggaagcugugcc

SEQ ID NO: 2465 - RNA, 56 nt, Homo sapiens
uuuagcgaggccuugauccagagcagcaccacugggccagggccucuggagcugga

SEQ ID NO: 2466 - RNA, 65 nt, Homo sapiens
guggcuguauauauuuugcauaucuacauacauauuacuaugcaaaguuguauacacaaagccau

SEQ ID NO: 2467 - RNA, 90 nt, Homo sapiens
aagcauuugugugcauaaaauggguaauugcacacacaaaugggcaauuuuguaugcaauuauccauuuugcauacgcaauuauaugcuu

SEQ ID NO: 2468 - RNA, 71 nt, Homo sapiens
cccacaaggcacguguguccugaccuuuuauugcuuucuucuggucccagauacugugucuuaacuguggg

SEQ ID NO: 2469 - RNA, 55 nt, Homo sapiens
cugggcagugcuguucagaggagcaaugaacacucuggaaguacuguuagcucag

SEQ ID NO: 2470 - RNA, 88 nt, Homo sapiens
uuuguccaucuagccccagcuuuccccacuugucugccuuuuucucuggaggaaagguggggagcuggggaagagguguuaugacaga

SEQ ID NO: 2471 - RNA, 114 nt, Homo sapiens
cugcugaugccucuuggaauauuaaaugcuuagaaagcugucgucgggaucacauucuggaaucuugaccauguagucaucugagugggugugacaggaaguauacaccagcag

SEQ ID NO: 2472 - RNA, 84 nt, Homo sapiens
cggcccucucccuucacucauccucacggaggaccugaaagauggaccugcugugggaaugggaauggggaagaaguggggccg

SEQ ID NO: 2473 - RNA, 81 nt, Homo sapiens
ugccuuggcaguuggugcugaaaaaaaaugugucaacaaacacaucagacacauuugcagugucaaccgccuccagaggca

SEQ ID NO: 2474 - RNA, 100 nt, Homo sapiens
agggacaguguguuugacuacauuucuaguuucuaaacaagucuugguuggauaacucuguuuaugaaguggaaauguggucaacaaacucuuagucccu

SEQ ID NO: 2475 - RNA, 104 nt, Homo sapiens
ggugcaaaauuuaaggaggcaccuacucccagggucaugcaaaagccaacuuugcauuugcacaauccugugagugagucccuccuuaaauuugaggcuguacu

SEQ ID NO: 2476 - RNA, 55 nt, Homo sapiens
ugcuugaguauggaacuauggcucuaauugcaguguuccaugcuauguuuaagca

SEQ ID NO: 2477 - RNA, 57 nt, Homo sapiens
gauuuuucugugcuggagcacuucuugggagaugauccagggcagagcuucaaaauc

SEQ ID NO: 2478 - RNA, 87 nt, Homo sapiens
aggauaacagguguauagucacuguuuucucagagcuggucacaugaaaggagaaagcagugaugcauacagcuguauuuauauccu

SEQ ID NO: 2479 - RNA, 96 nt, Homo sapiens
gcagcuggauuugugggcaggauuuuaguaauugaaacugggaggucauuuuauuuucacuuauugacucccugucacauuuucucaaauagcugc

SEQ ID NO: 2480 - RNA, 116 nt, Homo sapiens
ccugcagugcugacugccaugcuugggagagggaagggauuucuucaccuguaucugggacuggaucucuuccuccuacccccaagcuccugcuucucagcacuaauuccugcagg

SEQ ID NO: 2481 - RNA, 100 nt, Homo sapiens
aaccucagcccuagccuuuggaggccuccagcuggacuguaggaggagcccaaggcagcuggaguucuccaaaggacuugaggggcucuggacagagguu

SEQ ID NO: 2482 - RNA, 95 nt, Homo sapiens
gcagcuggugccugccuggcccccagggaccuggcaagucuggaagugaggccagguccccagggcucaggcugcaggggccaaccacaagcugc

SEQ ID NO: 2483 - RNA, 134 nt, Homo sapiens
gcacucccaaggaguuugguuuuguuuggguuuguucuagguauggucccagggaucccagaucaaaccaggccccugggccuauccuagaaccaaccuaagcucgcgcaucauuccuggaacaucaagagugu

SEQ ID NO: 2484 - RNA, 78 nt, Homo sapiens
uucagcauccauuuacuugcuucuucugaaagccuugcauucaggaguaagugugaauggauaaauaaaaaggcugaa

SEQ ID NO: 2485 - RNA, 146 nt, Homo sapiens
ggcuggggcagggcugggacaaguggcagagcuguucccagagucuguuucuucugaugauuggaaacucccuggcagccaagaggaagaggcaguccucggagcccaagcugccaguccuggcucugcuuccuggacagccagcc

SEQ ID NO: 2486 - RNA, 92 nt, Homo sapiens
gcagccgaggaaacagacagagccagguggguguguauacugguaggagaccucuccuggcucuuucuauuuucuuagugaaauagggcugc

SEQ ID NO: 2487 - RNA, 104 nt, Homo sapiens
cauaauagcuauuugauugggggugagauauuuugcauauuggcuuggcgcugauagcggaauuucaucaacucccuuuuuucaugcuuuaaaacugaauuaug

SEQ ID NO: 2488 - RNA, 102 nt, Homo sapiens
uuuuauaaccauuauccuuaguuucucauuucauaaugagaugaaacccaucauaagccauucucauaacgaaaugagagacugaggguaauggucauaaaa

SEQ ID NO: 2489 - RNA, 67 nt, Homo sapiens
uucuuuauuuguaaggcagggccaguaaaaccauaaauauuacuggcucugcuuuacaaacagggaa

SEQ ID NO: 2490 - RNA, 95 nt, Homo sapiens
aauuuuaguauccuauucucugaccuucgcguaccuuuaaucaagcaaugaaagaauagggguaugugaagaucagagaaugggauacggaaguu

SEQ ID NO: 2491 - RNA, 120 nt, Homo sapiens
uccuugaaaaauuaauuggucagguuuugcuauaauggauaacaaccuacguuagagauaccgcauaugaacaaauuauuagucuuuauagcauacauugacuaauuaauuuuccaggga

SEQ ID NO: 2492 - RNA, 85 nt, Homo sapiens
aaggucagauuuaauaaaaaaugcaucugguguguguaccagaaaaacacaggaguuggauggauuuuuuauuaaaucaggccuu

SEQ ID NO: 2493 - RNA, 71 nt, Homo sapiens
ugcccuagcagcgggaacaguucugcagugagcgaucggugcucugggguauuguuuccgcugccagggua

SEQ ID NO: 2494 - RNA, 66 nt, Homo sapiens
uuugugauuuuagggcuguuuugguauucuuuaugguaaaguaaguaaauggcucugagacacgga

SEQ ID NO: 2495 - RNA, 79 nt, Homo sapiens
cauuuuacuccugacugauuacauuacauauugauauuagugagcaucaguauguagugcaaucagucaggagaaaaug

SEQ ID NO: 2496 - RNA, 127 nt, Homo sapiens
ggaacuaggcacugaugaaaaaggauuguuaacagacagaagggagggagagugccaacccccgccacacacacauucucucucccuuccgucuguuaauaauccacuuucaucagugcccaguucu

SEQ ID NO: 2497 - RNA, 73 nt, Homo sapiens
acuacaagucccaguaugcauugcaguuuuugcuuaacuucagauuagagcacugcaugcugggaccuguagu

SEQ ID NO: 2498 - RNA, 59 nt, Homo sapiens
aacagcagaagguauuaguccauauuaaguacuaauuuguucuaauauuuucagcuguu

SEQ ID NO: 2499 - RNA, 66 nt, Homo sapiens
uuuaauaauggaggagguaauaagaugucuauuuauucauauuuuaugcccuccuuuauaauuaaa

SEQ ID NO: 2500 - RNA, 63 nt, Homo sapiens
guggggauuuugugguuugaagaaggcucucuguggaauuucuuugaacuacagaaacccugc

SEQ ID NO: 2501 - RNA, 75 nt, Homo sapiens
guugcuauuucccucaguugagggcgaaguuagcaaauccguagcugcaagucucaacuugggggagggggcgac

SEQ ID NO: 2502 - RNA, 84 nt, Homo sapiens
caaccaagguacagcacgcacuaaguguaugccaagcugacaaccaugcuuggcauauacuuagugcaugcuguacccugguug

SEQ ID NO: 2503 - RNA, 67 nt, Homo sapiens
aauuagaaauuaggagguuaucccccaaauaggaauauuaauggguuugaguuucuaguuacuaguu

SEQ ID NO: 2504 - RNA, 67 nt, Homo sapiens; identical to SEQ ID NO: 2503

SEQ ID NO: 2505 - RNA, 55 nt, Homo sapiens
uuccagagaagagcucuguuuuucuaggugagaauuaggcaagcuuuuccuggag

SEQ ID NO: 2506 - RNA, 96 nt, Homo sapiens
uaaggcauagauauggucaaguguucuggaaaauugcuucuggcuuuaucaaguacuagaggcuuaguuuucagagacuuaacguguuuaguuuua

SEQ ID NO: 2507 - RNA, 66 nt, Homo sapiens
uuuuccauuugcuuauuuugcugagaaugaguugaaugcacaucagcgaaacaggcaaacggagaa

SEQ ID NO: 2508 - RNA, 76 nt, Homo sapiens
aagggaaggguaaucugggauauuuauuagguguaguuaccuuugccuaaugaaugucuuuuguuacucauuccuu

SEQ ID NO: 2509 - RNA, 78 nt, Homo sapiens
aaggcaauuugagagaugucuuaggaugguuuugaucaugugagguuaucaucucagguacagauuuuagaaugucuu

SEQ ID NO: 2510 - RNA, 65 nt, Homo sapiens
uuucuuaucugcaggaggcauccacuguaauacaagaaagagaagagucuccaugcagaaggaag

SEQ ID NO: 2511 - RNA, 105 nt, Homo sapiens
gcccccauucuuucucuuucccucugcagcccaaaauaucacccuaguaugguagcaccuucuagauuuuuggggugacagagauggggagcaaggagagggggc

SEQ ID NO: 2512 - RNA, 67 nt, Homo sapiens
ggggagagccacgaacagggcugugcguucaauuugguugcagagagcccugaacguggcccucucu

SEQ ID NO: 2513 - RNA, 146 nt, Homo sapiens
aguaauaauaucaaggcucucuuuuuugcucagcaguaaucugauucucuagcugugauaaacugcucugccuuuggccuucuaguuuagccauuuaggaauuggauuauugucucauaaaacagaggggcaaugauaucauugcu

SEQ ID NO: 2514 - RNA, 66 nt, Homo sapiens
uucuucaugggaaagaaucacuuaauggaacagauuccugaguuagauguuuucuucccaggagaa

SEQ ID NO: 2515 - RNA, 66 nt, Homo sapiens
uagaugauuucuaaucccuaguggaguguacucaccagaugccuccaggugggcuagaaacaucua

SEQ ID NO: 2516 - RNA, 71 nt, Homo sapiens
gcacccagccccauccagaccaguggccucaggggacgauggauuacugggaauuuggugggguggggugc

SEQ ID NO: 2517 - RNA, 83 nt, Homo sapiens
acuauaauucccaucagacccuggggcucgaguccccuagaagagcagaggagggaguccuagggucuucugggaacuguagu

SEQ ID NO: 2518 - RNA, 70 nt, Homo sapiens
aaggaaauacuuguguaucuagggagauguuguuuauaauagugucucaaaugaugaguagguguuccuu

SEQ ID NO: 2519 - RNA, 75 nt, Homo sapiens
guuccaagcuguaaggcacagcuguauaggcccugccagcaaggccaucgcagcagugcuuugauagcguggggc

SEQ ID NO: 2520 - RNA, 79 nt, Homo sapiens
gcugccauccugggcaguuuugagugcuaagaacuggaaaucuacccaaagcagucaauuugcugccaugggaggcagu

SEQ ID NO: 2521 - RNA, 81 nt, Homo sapiens
guccugagcaccaaugggucaagccagugcucuugcuucccuccugcugagagcacuggccuugguccugggugccaggau

SEQ ID NO: 2522 - RNA, 81 nt, Homo sapiens
accagaauugguauggguaccaccucacugaauuccacauucaauguuggugccucgguagggugguaugccagaucuggu

SEQ ID NO: 2523 - RNA, 143 nt, Homo sapiens
caccuaaggccuggaguuaaucuggggccugauggucaccagggacccagguguccaccuagggccuagugaccaacuagggccugauguccaccuggagucuaguauccgccuuggcccugaugcuacuugaggccugggug

SEQ ID NO: 2524 - RNA, 68 nt, Homo sapiens
ggacagacagggguucuccuggaguaccagaaaguguaguuguacugcaggggaugcucugccugucc

SEQ ID NO: 2525 - RNA, 87 nt, Homo sapiens
gggugcacaggguggcgcgugggggggucagcugggcuucagccccucccaccuaggcuggaccccgcgcagugcucucuggcaccc

SEQ ID NO: 2526 - RNA, 72 nt, Homo sapiens
gcuccaauugggcuagcugcucuucacucccuccuggaagcugaugagcgggugccuggcgucgaauggggu

SEQ ID NO: 2527 - RNA, 67 nt, Homo sapiens
ccagggagcagcgcuggggccuccagacacacacccuucccuugaggccacaaugacugccccuugg

SEQ ID NO: 2528 - RNA, 57 nt, Homo sapiens
uaauagacuucauuaucuggcuugcuggcccacagcaaauuagaugagaggcuauua

SEQ ID NO: 2529 - RNA, 79 nt, Homo sapiens
ggauacaugagaugguugaccagagagcacacgcuuuauuugugccguuugugaccugguccacuaacccucaguaucu

SEQ ID NO: 2530 - RNA, 68 nt, Homo sapiens
uguugaacagucacccugggaguuuggugagcagcucucgcuccaugcuuucagggucacugucaaca

SEQ ID NO: 2531 - RNA, 66 nt, Homo sapiens
gguggcagguuccgagaugaggaggaaccgcacugagaagccuccucugcauccgaacccgccacc

SEQ ID NO: 2532 - RNA, 174 nt, Homo sapiens
cagggcagaugccucagguuuaaagucacaucaaaccgagugugaaccuucuguaacucgcaacugugcuaacuuuuggagguuucuugaaaaauucuagucaguuuggguuaaagaaugguuucaguaaugucacacucagggucaugacugcucaacuggucauuagcccug

SEQ ID NO: 2533 - RNA, 69 nt, Homo sapiens
uguuuuagcuggcccauuuugaaaauugaggucauggaugauggcuuccugaguggggcagcaaaagca

SEQ ID NO: 2534 - RNA, 72 nt, Homo sapiens
auugugacagguaaacacuuguuuugaaagcuugcaggcauacuauuaaaacacaaguguucuugacacagu

SEQ ID NO: 2535 - RNA, 82 nt, Homo sapiens
ugggggaaauauaauugggagagaagggaauuaaugcuaucaggugucucuuaauuucucagucucucucauauuaccccca

SEQ ID NO: 2536 - RNA, 95 nt, Homo sapiens
ccaggaauggcucugagcuacuggagggagggaugguggucaccgcaugcugaaaccacauccugcccuucagcuuuggcucaugcuaguucugg

SEQ ID NO: 2537 - RNA, 67 nt, Homo sapiens
gccgggagaggcggcgcaggggcccaguccaccgagcgccgggcggcccuugccugcacuccucggc

SEQ ID NO: 2538 - RNA, 68 nt, Homo sapiens
aaacugacucuggcuucaguguggcccauggcuuggaguaagauaggcuggaggcaaagaggcaguuu

SEQ ID NO: 2539 - RNA, 108 nt, Homo sapiens
gggcagaguaugggcuugggcugggaagcuggguauuugcuuugggaaccagaaaacuuucaaguggcucagcacccuccuuggcccaccucugauaccuaccugccc

SEQ ID NO: 2540 - RNA, 110 nt, Homo sapiens
ggggagagcuacuggaugcaaagcucugguuuuggaggaaggaugccucaaaagcuagucuuggcacucuuccccuuaccagaaucucugucuauguagcagccuucccc

SEQ ID NO: 2541 - RNA, 82 nt, Homo sapiens
gggaauaggaaaaggaagguaacugacaguuguuuggcugcuaacugccagguauuuugucuaucuuuugcaucuaauuucc

SEQ ID NO: 2542 - RNA, 95 nt, Homo sapiens
cuccuuauccacagcacaaugaaaccccaagagaauccaucuggagagagcgaaacgggauggauuccggguguuuuggggugagggacaggggg

SEQ ID NO: 2543 - RNA, 123 nt, Homo sapiens
acaaugaauccuauucacauccuguguaacuccaaggggaugcuauggggaaaguuuccauauaugguaauuuuccccauagacuccccacaguuuauacaggauaugaaucugguccauugu

SEQ ID NO: 2544 - RNA, 61 nt, Homo sapiens
guggggagagcugagggagcuguggcuggcauugcacaaagcuuccuuuauuucacuccac

SEQ ID NO: 2545 - RNA, 70 nt, Homo sapiens
cuguguauuguuuaauauauauguguggguauaucugugucuguguauauauauguaaacuaaaacacag

SEQ ID NO: 2546 - RNA, 56 nt, Homo sapiens
guaggcacuguuuuugcugagguauugggguuaaucucaguggaaaugaggccugc

SEQ ID NO: 2547 - RNA, 56 nt, Homo sapiens
gcagggagcacagagaugaagauaaaaggcgaaaugucuaucuuugaguccucugc

SEQ ID NO: 2548 - RNA, 82 nt, Homo sapiens
gcagagaugagaguggcaguugaaggagcuuugaaauccuggagcagagccaaggccucuuugccugcacacuccacucugc

SEQ ID NO: 2549 - RNA, 93 nt, Homo sapiens
ccaugaaugaaugucagaguccagcaucucagaggccaucauuaaaugaggagcagucuuuguagaagcugaacucugaaguaugcaucaugg

SEQ ID NO: 2550 - RNA, 80 nt, Homo sapiens
uaggccaucacacucaggagcaugucucucuuccaugccuccaaaaauggcaaagagagacaucugagucagacggccug

SEQ ID NO: 2551 - RNA, 99 nt, Homo sapiens
cugcggaagaggugagugcagcgggaaccgggagggagcgggcaggcggccgggccaccccgcgaccccucugggacccgcggcacugcaacuccgcag

SEQ ID NO: 2552 - RNA, 68 nt, Homo sapiens
uuaucuaugccauggaaucaccuccagcuaguaagggcaggcuggaaaggauuccgugauacagauaa

SEQ ID NO: 2553 - RNA, 161 nt, Homo sapiens
cugcugagacccauuaaagcaauggggggcugccaaguacucacaucccagacucaucaacuuguuuuuuugcugaccacucagucagucagcaagagcaaugugauaaguccuggaugauaaacaugguucuguugcagagacaaaauggaucacagcag

SEQ ID NO: 2554 - RNA, 61 nt, Homo sapiens
uuugccacccccagagccuugacuggucagaugcaucugggucaagggucacaggggcaga

SEQ ID NO: 2555 - RNA, 123 nt, Homo sapiens
gcacaaagucggagcaaugacaauuggaacuccauggcuauuccauugaaagucaauugaauuucaauuuccuucaaugggaaaagccaggaggaaccaauuauuguugcuuuaacauugugc

SEQ ID NO: 2556 - RNA, 118 nt, Homo sapiens
ccauauagugaguucguuuccauaaauaaaaacgacuucuccccuugaagaagcagacuaagaagacacugcuuuuugagggaagggaggaggcauguggcugggacuggcagugugg

SEQ ID NO: 2557 - RNA, 78 nt, Homo sapiens
cucuguaguguuuaguuauggucgcccugguaguucuuuuuaguccgaccggguugacuauaaaugaaggcagcagag

SEQ ID NO: 2558 - RNA, 74 nt, Homo sapiens
gagauuagcgaaagggauucuggccaaaucccugaucaaguugcuuggcacagaauuauugauuggcaaaucuu

SEQ ID NO: 2559 - RNA, 100 nt, Homo sapiens
uaucucacagggaauugaugugggugaggcauuuuauuuguugcauuuguggaugcagggacaaauuagagccucccauuuuaucaccuuaauggagaua

SEQ ID NO: 2560 - RNA, 100 nt, Homo sapiens; identical to SEQ ID NO: 2559

SEQ ID NO: 2561 - RNA, 120 nt, Homo sapiens
ggcaggagugguuaaccggcuuuuaauaacucauuuugcugaaugauuucuggugaggagagaaaaccuuaaucccagagauaaagcacagaguggggggugguugaagucagcccugcu

SEQ ID NO: 2562 - RNA, 115 nt, Homo sapiens
gaaguaagauauacaugaugaaggagcaucagcacagacagccaacguucaggcaugggggagaguaaggacgugagugucugauggugguggucacuugucaguguucugcuuc

SEQ ID NO: 2563 - RNA, 78 nt, Homo sapiens
ccugggaagugcugaguauuuccucuauagcgaucauaggacaugaccguguagagcaaacacucggugcuccccagg

SEQ ID NO: 2564 - RNA, 57 nt, Homo sapiens
ugcaggaagggcgccugccuuagacagcacagggacuggggggugcccugcccugca

SEQ ID NO: 2565 - RNA, 56 nt, Homo sapiens
cgcucgaugaggcccacgagguggcggcgcagcuccucgcgggccucggacgagcg

SEQ ID NO: 2566 - RNA, 66 nt, Homo sapiens
ccugccagucagugugggaugggccagugggagaagagacugggcauccuccacugaccaggcagg

SEQ ID NO: 2567 - RNA, 76 nt, Homo sapiens
gggggaaagggguggguugggagggguuguagggcuggagacccacuuccccuccuccccguuccccugguccccu

SEQ ID NO: 2568 - RNA, 79 nt, Homo sapiens
ggagggacuggguuggggagagaugaagacccuguggaccagggcucacucuucuucucuuguucccccaggguccucc

SEQ ID NO: 2569 - RNA, 88 nt, Homo sapiens
ccagcaagccccuaaugcaucuucccccucagacugcaggcuguaaucuccgcacugaggugaagucagcauuggguggugguguugg

SEQ ID NO: 2570 - RNA, 162 nt, Homo sapiens
cugggaaugagauucaagcuguguuuuuucugcuucuuauaguccaucaucaccaguaauaaagagccugcaaauuugucagccaaguccugacaguaaaaucuuuauugcuggugaugauguaagaggcuaaagggacacagcuugaguuguagaucccag

SEQ ID NO: 2571 - RNA, 70 nt, Homo sapiens
guucggaaagcccuagguggucacagccacagcagcgcugggcuggugcuguccuggggguugcccgggc

SEQ ID NO: 2572 - RNA, 93 nt, Homo sapiens
acuguuaggccaaagaucuuaggcaguuccagaguuuuacacagcccaaggagcucugggaauugccagauaucuucuuuggcugagaauagu

SEQ ID NO: 2573 - RNA, 65 nt, Homo sapiens
cuccugagccaugaugggccccaguccaaugaaaccuucuguggcagcaucaugguguccagggg

SEQ ID NO: 2574 - RNA, 87 nt, Homo sapiens
uggcagagggucaguaagaguagaggaguuaaagagaaauguacuauucccuuuugacccuguuauucucccugaccuagauuguca

SEQ ID NO: 2575 - RNA, 65 nt, Homo sapiens
agguggagcaguguugggugaaagacagcaacuucaagggggucaccugacacugcaacccauuu

SEQ ID NO: 2576 - RNA, 103 nt, Homo sapiens
gcugggauggggugaggccucugaggagcugcgugagacccacucuccaucauuguggaugcacagucaggccccuuagggagccaggaccccaaaacccagc

SEQ ID NO: 2577 - RNA, 64 nt, Homo sapiens
ggggagaaggcacaacacagcugcugaaaauuggugguugcaguuguugcugcuucugcucccc

SEQ ID NO: 2578 - RNA, 70 nt, Homo sapiens
gucucuaucccagagcuccagaaauauaugugcuauaaacugagcuaauuuggggcugggagcaggagac

SEQ ID NO: 2579 - RNA, 78 nt, Homo sapiens
ggguugauuucuuguugccacugccuggccugaagacagugcuuggcucagcgguggcagcagacgaagcagcagcuc

SEQ ID NO: 2580 - RNA, 79 nt, Homo sapiens
gagcacagggccgagggggcugggcgggcuggguggccucuuccagaucuguuucaggucuccucgccccacagugcuc

SEQ ID NO: 2581 - RNA, 55 nt, Homo sapiens
cugcugaacccucgagggucugagcuggcaggcuuuccugaggguguggcggcag

SEQ ID NO: 2582 - RNA, 112 nt, Homo sapiens
gcucucaucuggcugcauucaugucauucuugcaucucugggguccuuuuaaccauggccuucccagagggugcaggggaggcaaaugucagcaucccagaccaaggagagc

SEQ ID NO: 2583 - RNA, 145 nt, Homo sapiens
ucuguaauuaugguuuauaacugcaguaaucccaaagaaaucagucauuaccauagaucacaaguaaacguuaacuacuguuaaugaccuauuucuuacggauuauuguuuucguaaaccaugaccauaucaccacaaauacaga

SEQ ID NO: 2584 - RNA, 59 nt, Homo sapiens
guucuuaaacaccaaaggauguggggauguuuuccagauguucuuugguguagaaggac

SEQ ID NO: 2585 - RNA, 83 nt, Homo sapiens
gcagggaaaaugagggacuuuugggggcagauguguuuccauuccacuaucauaaugccccuaaaaauccuuauugcucuugc

SEQ ID NO: 2586 - RNA, 70 nt, Homo sapiens
ucugaaaaacgugcaaacugucuugaaaacagggccuggcaacugagacaguuugcaagcgugauucaga

SEQ ID NO: 2587 - RNA, 100 nt, Homo sapiens
ccagagaaaggaaggagggggcugaauucgcaggcccaagguguucacacuuguccagaccugggccuugagaaucauguuucuucccucuucacucugg

SEQ ID NO: 2588 - RNA, 74 nt, Homo sapiens
uaugaaaagagcacgcucuauuuaggagaauucuauuuaauuugaucuccuaacuauaaaguggcuccuucgug

SEQ ID NO: 2589 - RNA, 69 nt, Homo sapiens
gauuuaaagagauggagagaggccauuuggcuggccccaaauuugaccuacuuuucccucucauaaauc

SEQ ID NO: 2590 - RNA, 121 nt, Homo sapiens
uaguugaagacagcguaagucuguguuuugguaucacagcuugguaucaccagcuuaagguauccccccuuaagcugggauguugauguuguacuacagagaucuugcagcguuacaacua

SEQ ID NO: 2591 - RNA, 84 nt, Homo sapiens
guuuggaauaccggguuuuggaucuauuugaucaauuaauucucuuugaguaacugaucaaguuccuaauccugugccucaaac

SEQ ID NO: 2592 - RNA, 95 nt, Homo sapiens
cuuucuaaugucaugacaccuuucucuuguacaguuucuucuaccucuaguuuuucaaagaccugaaacuguaaaagaaaggugucacaagaaag

SEQ ID NO: 2593 - RNA, 55 nt, Homo sapiens
ucuaauaacuacagcccuucaguuucucaaagaacucagggguugagagguuaga

SEQ ID NO: 2594 - RNA, 104 nt, Homo sapiens
gauggaaaguauggaacaaacaggcccugcugacguuuuggcucugcuaagccuuccuccgagcuaaagcaucugcagcaucuuccuguucuagacccuuuauc

SEQ ID NO: 2595 - RNA, 111 nt, Homo sapiens
gggucuaaggauucuagauauaugaggguuggaggccugcgugucccaggaaucuaugaauuuggggucugagggucccaggcuucugugaguugagagucuaagagacuc

SEQ ID NO: 2596 - RNA, 92 nt, Homo sapiens
acaaguaaccuggugaccugauuuugaacugcaacucaaaggagguaagugaagaagagugcggucacagugagguggccgggaaaacuugu

SEQ ID NO: 2597 - RNA, 67 nt, Homo sapiens
ugggcaaauuacuuaucucuguuccguuuauuuaucuguaaaccaaugaagauaguaaaaaugccca

SEQ ID NO: 2598 - RNA, 70 nt, Homo sapiens
acagccaaacccaaacuccagacccugcaccgccugggguaguuucuucugggguuuugguggcggcugu

SEQ ID NO: 2599 - RNA, 91 nt, Homo sapiens
ccaggaaaaguuguucuggccccucaucugguuucaugaaggacaauaucuagcaugagagugacagggguuagaauaauggacauuuugg

SEQ ID NO: 2600 - RNA, 119 nt, Homo sapiens
gcucagaaaagucaccuagguggcggcagggcagggcagugccagacggggccauguggaaccagccuuaugcugguagaugcccugcucuguaugagccuuagaauggaaaguugagc

SEQ ID NO: 2601 - RNA, 93 nt, Homo sapiens
gcugugaaacaauugccauauuuuuuaaaguguugucuguguuuucuuagaggcauuccugcucgaaaagaugugguaacuucauuccacagc

SEQ ID NO: 2602 - RNA, 108 nt, Homo sapiens
aaaugaaaagucucagcaauuggaaaaccaggauuuuguuuugccuccuuccauauaggaaacauuuguaagauagaauucuggcaguuauuuguugaagggucauuu

SEQ ID NO: 2603 - RNA, 92 nt, Homo sapiens
gagggcaaagaggagugggugugggcaggcuggacaggaaggcuguuguccugucagcacccugcccacaugcccacccagccaaggcccuc

SEQ ID NO: 2604 - RNA, 92 nt, Homo sapiens
ugggagaaaucugagagccauguguuccacaggccucugguccuuguucaggcagcagggcacugugacauguggcuccuuggccccuucca

SEQ ID NO: 2605 - RNA, 92 nt, Homo sapiens; identical to SEQ ID NO: 2604

SEQ ID NO: 2606 - RNA, 138 nt, Homo sapiens
ggagguaacgggacugguggugggagguuagagccugaacuggaagucuuuggaagugggucaauuuuuagagcgcuguuuccagagcaacccuuagaccauggccuuuagacuucccacugucgguuucuggccucu

SEQ ID NO: 2607 - RNA, 96 nt, Homo sapiens
uuccuuaacuuugcugagccuccuuuguaaaauggagaaggaaaaacauguuguacaaacccuucucuuuuacaggggaggaaagugagaaaggaa

SEQ ID NO: 2608 - RNA, 76 nt, Homo sapiens
ucucccaacauauacaaagagagaaugcauuuggacguguugcuggugcagucucuuuuguguagcauaggggaga

SEQ ID NO: 2609 - RNA, 67 nt, Homo sapiens
auacugaagugggggcucugaagggccauuugguggaugguaaccuuuggaagucccugacuaguau

SEQ ID NO: 2610 - RNA, 75 nt, Homo sapiens
auuguuaagguuucaaggcuguugguuugcagaggauccugauggagaccaguggccuuaagaaauaggagcaau

SEQ ID NO: 2611 - RNA, 55 nt, Homo sapiens
cuccccaaggcuuccaggcauuugcccaucuggugaggccuccggagcagggggg

SEQ ID NO: 2612 - RNA, 78 nt, Homo sapiens
cuugauaagcaggugauguaaggcuggggaggccugggcaugagaccuccuccucauucuugcaucccugaagucaag

SEQ ID NO: 2613 - RNA, 97 nt, Homo sapiens
ggaccaaaggaacuuuucuggucuauuggguaaauauguauuaaaguaauuuuuaaaauacuuacauacuuaauaggcuggaaguggucaaugguuu

SEQ ID NO: 2614 - RNA, 131 nt, Homo sapiens
uuucccaagcucuucaugcagccucccugcccccacccucucaguguuguuuucccuuucucaaggggaagacuguccuaggaggggcugcggggcagagacagacugcaggaggaagaggaaaggggaga

SEQ ID NO: 2615 - RNA, 78 nt, Homo sapiens
augaggaagagagaaaagugugugcagagggcaggaagaaagcccaagcucugugcauuacacuuuucucagucucau

SEQ ID NO: 2616 - RNA, 81 nt, Homo sapiens
ugcaggaagucugggaggugagucacuaaaaagcagccccaguucaaagugcugaugggacuugccucccgccccccugca

SEQ ID NO: 2617 - RNA, 90 nt, Homo sapiens
aguggcaaguuagccuccugacccacuucucuccugcuuucacucugguguaugaagggggaugagggaggggccagagagguggccacu

SEQ ID NO: 2618 - RNA, 75 nt, Homo sapiens
aucuguaaugcaaacaaccacugauuaaccuaagaguaauuuguugcguuagauguggauguuugcuucacagau

SEQ ID NO: 2619 - RNA, 130 nt, Homo sapiens
aaaaagaauguaaaccaauaacguaaucccuuuucuguaggacugugugccugcacauauauaucucuaggcaugugcagacacacauaucuauagaacagggauuauguuauuggguuacuugcuuuuu

SEQ ID NO: 2620 - RNA, 56 nt, Homo sapiens
ugguguaaugcuccucaagacagggaggcgagagcuucuauuccaugcuaacacca

SEQ ID NO: 2621 - RNA, 96 nt, Homo sapiens
gagucuaauaguuggcaaaaacaaacugauucuaacccguagcuucaagccuucaugaguuagaauugguuuguuuuugcuucccaaccaagacuc

SEQ ID NO: 2622 - RNA, 82 nt, Homo sapiens
cuccauaauauagacacuauugguugcuaauuggcgccaguaggcuggugcuaauuguccuaaugcacucugcuugauggag

SEQ ID NO: 2623 - RNA, 119 nt, Homo sapiens
ggaagaaauaucuaguuggcacuggcuuacuucuccugaccccccugggguuguuaugcuauccgcaucucaggaucagguggguagggagcaccagccuccaacuucuguccucuucu

SEQ ID NO: 2624 - RNA, 85 nt, Homo sapiens
gucaggaaucccaggugggacaggggugggggcacaguagccucuggcacuguagcaccccagcuucucccuccuagccucugac

SEQ ID NO: 2625 - RNA, 80 nt, Homo sapiens
ugguucaauuuuaaguaggguuuggaacugggauuggaaggacagcuuggcccaguucacagaccuagauuuaggaacca

SEQ ID NO: 2626 - RNA, 65 nt, Homo sapiens
ugcuugaauuugucaaaugucacacacucuauuucaaacaugugagauuugacaucaugugagca

SEQ ID NO: 2627 - RNA, 140 nt, Homo sapiens
uucagaacuuuagagauuuucagcuccaaaagccaaacucuacccucaguuaugugugugcaauuaguugcaugugcauaauugagggcagaauuucgcccauaaaauuuggaauaaucuggaaauucuuaaaaucugga

SEQ ID NO: 2628 - RNA, 58 nt, Homo sapiens
gcuggaacucaagugaacacauggcucaaaauccauugcuguucucuagaaauccagc

SEQ ID NO: 2629 - RNA, 58 nt, Homo sapiens
gcuggaacucaagugaacgcuuggcucaaaauccauugcuguucucuagaaauccagc

SEQ ID NO: 2630 - RNA, 58 nt, Homo sapiens; identical to SEQ ID NO: 2629

SEQ ID NO: 2631 - RNA, 67 nt, Homo sapiens
aaccgcacugguccaggcaagcauaacaagagucagaacaguagugcuugcugggguugaggcgguu

SEQ ID NO: 2632 - RNA, 95 nt, Homo sapiens
guuuucacaggauuaauggcugguugggguuaaugucucucagcuaugccaugggccaucaacucuuuucagcuggccauuaauccccaggaaau

SEQ ID NO: 2633 - RNA, 76 nt, Homo sapiens
cugaggacauucuagugggggguagaugucacaucgucauauuucucuggcucuaccaccacuagaagaaccucag

SEQ ID NO: 2634 - RNA, 68 nt, Homo sapiens
uguugaacaggcccccugggagcuuggugagcagcucucgcuccgugcuuucagggucgcugucaaca

SEQ ID NO: 2635 - RNA, 104 nt, Homo sapiens
ggcuggacagaguugucaugugucugccugucuacacuugcugugcagaacauccgcucaccuguacagcaggcacagacaggcagucacaugacaacccagcc

SEQ ID NO: 2636 - RNA, 94 nt, Homo sapiens
cauucaacauuuauucaauaaacauuuauugagcaccuggcacaguacuuggcacaugcugggcacucaguaaguaucuguugaauaaugaaug

SEQ ID NO: 2637 - RNA, 73 nt, Homo sapiens
gaagcaaccauccagaggaaaaagcccuccagccaucuacagagggugcagcaauuuuccuggauucuguuuc

SEQ ID NO: 2638 - RNA, 71 nt, Homo sapiens
uugaagaccagaaauuguuauauauacaucuguuuaucucucuauguauguauagcaucuucuaacuucaa

SEQ ID NO: 2639 - RNA, 84 nt, Homo sapiens
cuguguaccugggcacaggugcacacacaggaguaaacaggcaccugcauggacccuguguguacaccuaaccuacacacacag

SEQ ID NO: 2640 - RNA, 92 nt, Homo sapiens
cugaggaccacuaccugagcucugcccuuuguccugugagccaguccaugggagccuggguucuagaggacaaagcagcccucagcucucag

SEQ ID NO: 2641 - RNA, 109 nt, Homo sapiens
ggcugcaccugaacuuguugguauggugggaagagcuuggacuuucaagucagucaucuggauuugaauccuggcuuuaccacuuaccagcuuugugaucuuggcaguc

SEQ ID NO: 2642 - RNA, 81 nt, Homo sapiens
acuccaacguggccaucugcuuagcccaucugccugucauccccccaaacagcaagugccugcugacagguggcauggagu

SEQ ID NO: 2643 - RNA, 79 nt, Homo sapiens
cccacgacuucuugucagcgugaugcuuccagcacaguuuuguugaaaaaugccuuuugugcugacaagaccacguggg

SEQ ID NO: 2644 - RNA, 66 nt, Homo sapiens
aacugaagcuuagagaggcaaaguaacuugcuugggcaauuuauuucaccucucugaggcucaguu

SEQ ID NO: 2645 - RNA, 86 nt, Homo sapiens
gugcugaggugggagucaggggagggguggagagaauugagggguugggccaggccucccaccuccuagggcucccgcaccagcau

SEQ ID NO: 2646 - RNA, 66 nt, Homo sapiens
ccucucagucuucuuggaggcuucuugaagcugaagaaguuaagcaguaguuaaggagaggagagg

SEQ ID NO: 2647 - RNA, 74 nt, Homo sapiens
ccauauagcaguggucagggaccucaagaaggcaaccuugcuuugcaaugaaauucuuggaucacuggaugugg

SEQ ID NO: 2648 - RNA, 59 nt, Homo sapiens
ccuccaagugcgaguaguaggccgccaggacaugguaggcuauggcucgcaucuggggg

SEQ ID NO: 2649 - RNA, 136 nt, Homo sapiens
ggagaaagcagggucgcaugggcuucccagggccucucucuugguccccauccugucaccugcacagugagugaugagggugaggaagagaggggaccaggccaugcuggagauuguccugaguccugucuucucu

SEQ ID NO: 2650 - RNA, 70 nt, Homo sapiens
caucucaggccaucugcagagaagaaaggugguaccuaacauuuuuucuugucagcacuugguaggggug

SEQ ID NO: 2651 - RNA, 89 nt, Homo sapiens
gucagcagugccuuagcagcacguaaauauuggcguuaagauucuaaaauuaucuccaguauuaacugugcugcugaaguaagguugac

SEQ ID NO: 2652 - RNA, 81 nt, Homo sapiens
gugggaagugcccuacuuggaaaggcaucaguugcuuagauuacauguaacuauucccuuucugaguagaguaagucuuac

SEQ ID NO: 2653 - RNA, 60 nt, Homo sapiens
uguccuaguccaugaugccuggcugagugagcaauaccggcuggagucagagagaggaca

SEQ ID NO: 2654 - RNA, 110 nt, Homo sapiens
ucaucgagccccgcgguggccacacagggugcgggcucaggacaggccgggccucgggagaaggcccuguccugggcgcugggccaccccguggggccacuggaugauga

SEQ ID NO: 2655 - RNA, 74 nt, Homo sapiens
aagaugagaggaugugaccuguggcccacccagcacucagcaccccugggccuuggcugcauccugggcaucuu

SEQ ID NO: 2656 - RNA, 68 nt, Homo sapiens
ggggccagccucaucccacugccagcugacccucaguuccucaaagacagugagugaggacaggccuc

SEQ ID NO: 2657 - RNA, 84 nt, Homo sapiens
ggccugaguccuuguagacucugaguacggugcugagcagggaagagacaggcucuggcuuaggguuuagaaggaacacaggcu

SEQ ID NO: 2658 - RNA, 104 nt, Homo sapiens
ucaggcagccuuucugacccauguagggucacagaccccagcccacacugggcauggccuaugggagggggcugugugcaccugcaggaaaggauacagccugg

SEQ ID NO: 2659 - RNA, 87 nt, Homo sapiens
cuggcuagacuagggaucagugaaggaggaagcuggcaaggcuggcgggccaggcugagcguuucuucuugauccuggcacagccgg

SEQ ID NO: 2660 - RNA, 68 nt, Homo sapiens
gcagaaagaacccugggccucaugcgucuuaugauucccaugagaaggcuggggucuggguguucugc

SEQ ID NO: 2661 - RNA, 78 nt, Homo sapiens
ggaagcagagcuaauucuuucggggaccggggcuaaggacaugggugaguucuguuccugaauuuggugugagcuucc

SEQ ID NO: 2662 - RNA, 138 nt, Homo sapiens
gcauugagaaccuauuauauggccggcauuguuaugcuagaggccaaugacagucagaggugggcgguugaaaguaaugcugcugauugucguugucaucugguagagucaugcccaucacguaacagcugccaaugc

SEQ ID NO: 2663 - RNA, 79 nt, Homo sapiens
uacaagagagaaaaugagggcagguaucaaccauaccaaauuauucuaugggauauccuguuuuccauuuuaccuugua

SEQ ID NO: 2664 - RNA, 85 nt, Homo sapiens
gcuuccagcauggacugcucccgggccuccuuucuggaacugccuugagaaaggaggaccccuccugagcaaccacaugggaagc

SEQ ID NO: 2665 - RNA, 74 nt, Homo sapiens
uaagcaagggagacagcagaaacuagagcacuugaguaaaagcuggaugcuuaggucccuguuguucauguuua

SEQ ID NO: 2666 - RNA, 92 nt, Homo sapiens
cuggguaggccuugaagggugaucuucacguaagccuguggccugagcaagaaagcugcacacgggcagcggaggaaccagcaggagcccag

SEQ ID NO: 2667 - RNA, 84 nt, Homo sapiens
uaaaauagggcugccguccuugaauugaucagcacauugagaauguggcauuagauuaauucagggaaugcaguaaagauuuug

SEQ ID NO: 2668 - RNA, 90 nt, Homo sapiens
ggcagcaggggaggcgggagaagcagccgggccuaggccgcaccaggccgcggaguggcccuacgcugcugcuucccgaccgaggcugcc

SEQ ID NO: 2669 - RNA, 94 nt, Homo sapiens
gagcacaguuugggaaaugcugucagagcugccuucauauuagcacagaaaaguggagaaggcagauucuuacggcaguugauccaaggugcuc

SEQ ID NO: 2670 - RNA, 112 nt, Homo sapiens
gggucuagugaugggaggaaggccugauuugggaagcagguucuucaggaugaaaagcuuaacccuuuccauucccugacagccucuuucaaaacagucuuuccucagaccc

SEQ ID NO: 2671 - RNA, 57 nt, Homo sapiens
gcagacaguuaucccuuucuagucuggcucgugggacucuagagggagucagucugc

SEQ ID NO: 2672 - RNA, 112 nt, Homo sapiens
aaauaaaugaaguguuauagaauacauuuaagauccaaaugagauaaagagacauacccguagacuuauaucucauuuggauccuaaauauauucuauaacauuuuuuauuu

SEQ ID NO: 2673 - RNA, 84 nt, Homo sapiens
acugagaugcuugaagagauggaugugcacacggaugaauuucagcggugcaacuuuucaucaucaaccucuuugagccucagu

SEQ ID NO: 2674 - RNA, 75 nt, Homo sapiens
uuaaagaugggucuuucuuucucuugguguuucucacugugguacucacuaggagaaagaaagagcuggcuuuaa

SEQ ID NO: 2675 - RNA, 113 nt, Homo sapiens
gcuuagauucagcugaaacucaucggaaaucagaucugaugguggccucaguucugaugacuacacuaacuucauccgaucagauuuccagugagucaggcugguugcugagc

SEQ ID NO: 2676 - RNA, 72 nt, Homo sapiens
gggaggaugggacgcguggggacugaaggcggcaucugccugaauaaagcccucgcgcgcucugagccuccc

SEQ ID NO: 2677 - RNA, 79 nt, Homo sapiens
uuaacuauaagucauaugugacacgugauuacauuucacauaacauguaaucacaugugucacaugugauuacaguuaa

SEQ ID NO: 2678 - RNA, 104 nt, Homo sapiens
ggccccauacuguuuccucucgguugcuucuaaggcuccugaaacugcagccagugagccuuucaggaaccuugggaguaacugacagggaacagcaaggggcc

SEQ ID NO: 2679 - RNA, 108 nt, Homo sapiens
ucgccgauaggcucagcgacuacaacucccagcaggccacgcgccgcggcccgccguguacucuuggcgcagggccuucugggagcuguagugccccggccgcggcgg

SEQ ID NO: 2680 - RNA, 90 nt, Homo sapiens
aagcauauaauugcguaugcaaaauggauaauugcauacaaaauugcccauuugugugugcaauuacccauuuuaugcacacaaaugcuu

SEQ ID NO: 2681 - RNA, 89 nt, Homo sapiens
auaucaauagauacacauaaauugugcaugugcaugcagccauucuaugagugugugcacauguacgcagauauguguaugccugaugu

SEQ ID NO: 2682 - RNA, 75 nt, Homo sapiens
ucagacaucucggggaucaucaugucacgagauaccagugugcacuugugacagauugauaacugaaaggucugg

SEQ ID NO: 2683 - RNA, 113 nt, Homo sapiens
cagcagaucccuucagggugguggaaauggaguucugcaaaguacugcugcuguugcugcugcagacuuugcaugaaucucauuuacccuggauccuggggcccaugcugcug

SEQ ID NO: 2684 - RNA, 85 nt, Homo sapiens
ucccacaugaccagagcuucccauccuccaugcaugggaaucuacgaccaaacuuagauuuccacaggaugguggggggguggga

SEQ ID NO: 2685 - RNA, 85 nt, Homo sapiens; identical to SEQ ID NO: 2684

SEQ ID NO: 2686 - RNA, 117 nt, Homo sapiens
agacugauucagcaucaucaucaccuaccacccagguccgucauuauucaauaauagcuaucuuuuaccaagcauuauuaaauagcucauugaccuaggugaugaugauaccagucu

SEQ ID NO: 2687 - RNA, 76 nt, Homo sapiens
augcuccuaccauuagaagggcuggaagaaggcaucucccucagccuucuuccagcucuucuaaugguaagagcau

SEQ ID NO: 2688 - RNA, 83 nt, Homo sapiens
ccuacucagaguacauacuucuuuauguacccauaugaacauacaaugcuauggaauguaaagaaguauguauuuuugguagg

SEQ ID NO: 2689 - RNA, 112 nt, Homo sapiens
uaaacacugaggcuuugauguuuauacgauauucuuccccacuaauuaacugcacuaaugaaguuaauuguggggaagaaugccguauaaaacaucaaagccucgauguuua

SEQ ID NO: 2690 - RNA, 88 nt, Homo sapiens
aagaaacagccaucugaaacucucugugguauuuguggcaaucaguauuuuaauaaauaugauaaggaguuucagauggcuauuucuu

SEQ ID NO: 2691 - RNA, 126 nt, Homo sapiens
ugucuucuuugagcaggcaauaacuuggacccaaguugcaaaccaucuccuuagcugcaugauaucuuuugcuaaggagacaguuugcaacuugaguccaaguuaauugccugcucaaacaagaca

SEQ ID NO: 2692 - RNA, 88 nt, Homo sapiens
cagaugcagccacaugcuaccaugaaggaagaagagaccaaugcaaagccggggcuuccuccuucacuguagcauguggcuacaucug

SEQ ID NO: 2693 - RNA, 81 nt, Homo sapiens
gauacucgaaggagagguuguccguguugucuucucuuuauuuaugaugaaacauacacgggaaaccucuuuuuuaguauc

SEQ ID NO: 2694 - RNA, 67 nt, Homo sapiens
cuagcccgggccuauggacuaauuacaagguguggggcucugcggugguucugugggcccuggcugg

SEQ ID NO: 2695 - RNA, 66 nt, Homo sapiens
ggggcucgugucacugugaggauauuguacuaaugguguaugcuauacccacagugacacagcccc

SEQ ID NO: 2696 - RNA, 68 nt, Homo sapiens
uucaaucucuucaccuugagcccugggcaguuagaacucaucucugggcggcaggguggggaauugga

SEQ ID NO: 2697 - RNA, 100 nt, Homo sapiens
uaccuucaaugucagaaaugauuuuucugacgaugucuaaaugugguagauuacacguuauuccaaauuaucagaaaaaucaucucugacauuuaaggua

SEQ ID NO: 2698 - RNA, 76 nt, Homo sapiens
ggaggacggaagaggaacuuaggagcuaaaugcugucccucucuauuuugcuccagaauguucuuuuccuuucucu

SEQ ID NO: 2699 - RNA, 82 nt, Homo sapiens
guuggccagggaguaggcaguagcuugagauauaaggaauuucucuuugaggucucggaacugcugauugcucucugccagc

SEQ ID NO: 2700 - RNA, 55 nt, Homo sapiens
gagccucuucaaaacagagcccugacaauuaggcagucugaguuuugaaaggcuu

SEQ ID NO: 2701 - RNA, 117 nt, Homo sapiens
auuuauccuuguauccuggaaaguugggauuuaucauuucuuuauaagaaacaauaaauaagaaacuuucuuauaaagaaaauauaaaucccaacauuccacgauacaggcauaaau

SEQ ID NO: 2702 - RNA, 67 nt, Homo sapiens
ggaguucuacauuuguugaugauuauguacagacugaugucugucugccccauugaauguaagcucc

SEQ ID NO: 2703 - RNA, 76 nt, Homo sapiens
auucaucccacagauuuccuaagcaucaaucuugggccaagcacugauugaugcuggggaacucuguggaaugaau

SEQ ID NO: 2704 - RNA, 84 nt, Homo sapiens
aaauggcaaccgcauccuugguugauuuucuggggcuugagccgcacaggcuuaagaaaaacagucauccugcgguuuccauuu

SEQ ID NO: 2705 - RNA, 83 nt, Homo sapiens
caucugcaaaacuccucucuuuccaugaucauguugaaauuaucugagcaugguugggaggcagagagggcaguuuuuaggug

SEQ ID NO: 2706 - RNA, 87 nt, Homo sapiens
ucucagccugugacccucuagagggaagcgcuuucuguugucugaaagaaaagaaagugcaucuuuuuagaggauuacaguuugaga

SEQ ID NO: 2707 - RNA, 86 nt, Homo sapiens
uucucucugcuuucagcuucuuuacaguguugccuuguggcauggaguucaagcagcauuguacagggcuaucaaagcacagagag

SEQ ID NO: 2708 - RNA, 81 nt, Homo sapiens
ugcaagccagcuacguuuucuagggcucaaccaaugaagcagugaucaaguucaagcccagaggaaaauggcugacuugua

SEQ ID NO: 2709 - RNA, 86 nt, Homo sapiens
uauuucccauggugcaccugucucucauucccauaacaggaaggaggguuuucuggggcugagacacaaguggaucaugagaagua

SEQ ID NO: 2710 - RNA, 80 nt, Homo sapiens
uuuugccguguuaguggaucuuuucacuuggguuuguacacaucaaaauccaagugaaaaugucaaauaacacagcaaaa

SEQ ID NO: 2711 - RNA, 67 nt, Homo sapiens
uggcagcuacaaguguuuugguuuuauguuuuuagauacauggccaagauuacuuuugugacugcca

SEQ ID NO: 2712 - RNA, 86 nt, Homo sapiens
gugagccuuucuggacucuuggguccuaucugauaaaugauugcuucaauacacuaaaugggccccaguguccuagaaacguucau

SEQ ID NO: 2713 - RNA, 68 nt, Homo sapiens
ggaaggcagagaggcuuggcucugaaggguaggcaccaauccaggcccggcccuccucucucccuucc

SEQ ID NO: 2714 - RNA, 131 nt, Homo sapiens
ggaucccggcccauggugcucacaggcccccgccccggguagcugggaagggcgugcgggcugcguggccuccccuccaagcugcccagggacagggacggccagaggagagcagcccagggccaggaucc

SEQ ID NO: 2715 - RNA, 86 nt, Homo sapiens
cuccuccucccgugccuugccuuucuccucauuccagcaacugcuuaguuuggcugaugaggguagaguuagauuugggagaggag

SEQ ID NO: 2716 - RNA, 99 nt, Homo sapiens
ggagggcugaauuugccuggugaaggauaacagcauugagucgugaggcuuuaguugacuuauuuguuguuauaauaaaccauuauucauucauucucc

SEQ ID NO: 2717 - RNA, 66 nt, Homo sapiens
ggguggcugcagggggugguaucggggagggcucccaaaugccccuccauccccaugcacccaccc

SEQ ID NO: 2718 - RNA, 96 nt, Homo sapiens
aaccagcaucuauuuaaccucaaggaugauucugaaagagcugaagaaaauaaguccuccuuuagaaucauccuugggguuaaacagauccugguu

SEQ ID NO: 2719 - RNA, 71 nt, Homo sapiens
gcuucccuccaacugacuguccuaaucaggcuccagaggggaggcugauuggagcugcgguggguggaagc

SEQ ID NO: 2720 - RNA, 105 nt, Homo sapiens
gagaagcagccaccgagaaggggcaagugagcggcaaggccgugguuccacauucccaaaccacgcuuuguccuuccugggguccccguagguggggcucuucuc

SEQ ID NO: 2721 - RNA, 112 nt, Homo sapiens
gggggacagugaugccacuaugcuccuaaaaugccucucacagagaacaggagucgguuuccuaccccuguucgucugcuagaggucuuugacggcagugccacuaucuccc

SEQ ID NO: 2722 - RNA, 100 nt, Homo sapiens
augcuuccccuggcucccuucguuccccccaccccacuuggccugcaugcgggagugugugcgagggagugggaggacgucggggggugagggaaggcau

SEQ ID NO: 2723 - RNA, 59 nt, Homo sapiens
ggcggacgcccgggggccgggaugcgaggggcggauccggcggcgcccggggcuccguc

SEQ ID NO: 2724 - RNA, 69 nt, Homo sapiens
uucagacuauggaagguucauucagcuccauacaaaacccccuguauugcugagaaccacauauuugaa

SEQ ID NO: 2725 - RNA, 101 nt, Homo sapiens
ucaagacuauuuauucuacgguuucaagaucuguccagaccauuaaccacaauggcauuaaaauggucuggacagaccuggaaccccuguaguauucuuga

SEQ ID NO: 2726 - RNA, 113 nt, Homo sapiens
uuuuuucucuuuccauuucaguggcuucauuucugccagaauuuaacauugacagggugauguugccucuuuucuggggggaaaaagaagcucucuguugucaagaaaaaaaa

SEQ ID NO: 2727 - RNA, 66 nt, Homo sapiens
cccacuccaccuccagcugcuccaaggcauuucuuccugugauguucuagcagcuggugcaguggg

SEQ ID NO: 2728 - RNA, 143 nt, Homo sapiens
agggaacauuuuuuggacuucuuaucccaggcugcugaaccuuaggaguccagggguugcaucuggagcaaagagaugucccaacagccuugcccugagguugagagaggaugggcugggauagggguccaugggguuucccu

SEQ ID NO: 2729 - RNA, 85 nt, Homo sapiens
gccgggcguucuagcuacccuugguacagcaggcaccaggcccuggcagaagcaggcugggcuggggguggcuggcagcccuggc

SEQ ID NO: 2730 - RNA, 73 nt, Homo sapiens
aagguccgugcucaugaccacuggguggaacccuucucaacaugguacccguggucccagagucacaggccuu

SEQ ID NO: 2731 - RNA, 55 nt, Homo sapiens
uugccucccaagagggaaaauagucuucgcagacauucccuuaucuggcaggcag

SEQ ID NO: 2732 - RNA, 127 nt, Homo sapiens
ccagggcugcagggagcuuuacacacgggcccugggaaguugauuggaagcuagcaguucaucucugcacugccagcucucaacggcccuuuggccuguugaaaagcgcccagaauggcaacccugg

SEQ ID NO: 2733 - RNA, 114 nt, Homo sapiens
gguacucugacaugaaacagcaugaauauuaugcacacuugaauaauguauaaguuaaauaaauuauauuauuuaagugugcacaauagucaugcuguuucauaucacaguacc

SEQ ID NO: 2734 - RNA, 112 nt, Homo sapiens
gacagccacccaaguucuacggcagauaccugguguuuucagacccagaaaauaaaugcccagcuugggucaugauaacaccuggaauggcugagaggcuuugguugcuguu

SEQ ID NO: 2735 - RNA, 79 nt, Homo sapiens
cgcucccgccccgcgacgagccccucgcacaaaccggaccugagcguuuuguucguucggcucgcgugaggcaggggcg

SEQ ID NO: 2736 - RNA, 88 nt, Homo sapiens
ggcccgcacaccugggccgagccggggccgccucgggagccccucgcuggcuccugggcgccccacucggcucagcaauguccgggcc

SEQ ID NO: 2737 - RNA, 71 nt, Homo sapiens
ccaagccuucugcagggacuuuguucaggcaaaguugugacuugacucuggacaaggccggugaagcuugg

SEQ ID NO: 2738 - RNA, 105 nt, Homo sapiens
agaugucuguucacuuccuuuugcauccacccucucccucuccuguaaaacacaaagugagagucuagggaaaguauggagugcuggagggaauggcacacauuu

SEQ ID NO: 2739 - RNA, 76 nt, Homo sapiens
gcccagccaccaggcugcagguggaggcucaggguugauggaucucaagcugcucugccugccuggcugccugggu

SEQ ID NO: 2740 - RNA, 69 nt, Homo sapiens
cuccugcugagcagcacgccugcggguucucuccagucuccuggcacccaggcugccugcacacaggag

SEQ ID NO: 2741 - RNA, 70 nt, Homo sapiens
aaucaccugagacauuuuucaaaauacauaugguaaccauguguauuuggaaaagaauucccaugugguu

SEQ ID NO: 2742 - RNA, 69 nt, Homo sapiens
ggcccucucagggcccuaggagccuuuguguguccugcucacauugucuccagggccucggacagggcc

SEQ ID NO: 2743 - RNA, 108 nt, Homo sapiens
aauccccagagaugugugggggaagggggggcagugcaugugugugcacguguguguucaugcgugcacgugggugucuccuugcccgacgagagauuccuugggauu

SEQ ID NO: 2744 - RNA, 65 nt, Homo sapiens
cguggucugcuuuccaucucugagcuaugaacgguuucauuuucaaagcaggaaaacaaaccacg

SEQ ID NO: 2745 - RNA, 104 nt, Homo sapiens
gcugcccaacagcuguucccuggguuauuuuggucuagugggagucugucaauucuagggcauuuggaccaaaauagccaacagcgggacaaucucuugguagc

SEQ ID NO: 2746 - RNA, 66 nt, Homo sapiens
aggguucuccuggagggcgacuuuuuugggaaucggacccaaggaggaugccuucccugaagcccu

SEQ ID NO: 2747 - RNA, 66 nt, Homo sapiens
aggguucuccuggaggguaguuuuuuugggaaucuagcccaaggaggaugccuucccugaagcccu

SEQ ID NO: 2748 - RNA, 59 nt, Homo sapiens
guugggcggggcuguagagggcgcuggagacacugagucgguagugcagaaccuccagc

SEQ ID NO: 2749 - RNA, 66 nt, Homo sapiens
gagacccagugcaaguguagaugccgacuccguggcagaguucagcguuucacacugccuggucuc

SEQ ID NO: 2750 - RNA, 77 nt, Homo sapiens
ugccuucagggaucaucuugucaguuaugcagcuuuccaauuuuauggcugagaucaagaaugauuccuuaaaggca

SEQ ID NO: 2751 - RNA, 109 nt, Homo sapiens
uaaauucuaauuggaacaggauccaccucaauuuauuccuaaugccucagaaaagcagaacuguuucuaggaauaaauugagauggauucuauuccaauuaacaguuug

SEQ ID NO: 2752 - RNA, 80 nt, Homo sapiens
ggcucacaaagacugauccaaagucacaaauccagucaaucugucuggcaguagagacuugauccagucuuucuugagcc

SEQ ID NO: 2753 - RNA, 70 nt, Homo sapiens
ggaagacugcuuuuaacauaaccagaugguaauuuuuacuaguuggcaguguacugaaagcacauuuucu

SEQ ID NO: 2754 - RNA, 86 nt, Homo sapiens
aggagccuccccagcucgcgggugacgggugugguuuguaaauaguuuaugcaccuguuacauccacguguugcgggacugcuccu

SEQ ID NO: 2755 - RNA, 71 nt, Homo sapiens
aagggccauggcagggugggagaggcggugugagaagguccugucuucccacuaucugcucaucagcccuu

SEQ ID NO: 2756 - RNA, 100 nt, Homo sapiens
ugguuucaggugaauuggauaugaacuguaaaaucugauuucuugucuucagacaguuagucauguuuuauuguaaauguccuugaucucuuuaaagcca

SEQ ID NO: 2757 - RNA, 63 nt, Homo sapiens
aggggacgccuggcucucauugucauugguugcacaaugggguuggggguuggguccucuccu

SEQ ID NO: 2758 - RNA, 78 nt, Homo sapiens
gugcagcugcccuccccaugugugacaguuggugugauuccaauaccaacuggggaucuggggagggcgcaccugcac

SEQ ID NO: 2759 - RNA, 62 nt, Homo sapiens
aagcagcuuccccaaagugccuuggcucccaagggcccuuuacuuacugggaaaaucugcuu

SEQ ID NO: 2760 - RNA, 83 nt, Homo sapiens
gaacaccugagcaucucuguuuggauucccaguuguaauuuuugauucuuugggaguucugacagggucuucaacuaguguuc

SEQ ID NO: 2761 - RNA, 106 nt, Homo sapiens
accacacucagccuucuuccucccuuauccuggaccucuucaacugccuccagcaaauauucaguaagauccagggaaaaggaggaggaaggaggaagccuguggu

SEQ ID NO: 2762 - RNA, 102 nt, Homo sapiens
uuuagucgaggagccugcuuaugcccagagacacucucugaagcagaaguaaagcacaggaaguguuucuuuggcauauaguagguuucucuuucugcuaga

SEQ ID NO: 2763 - RNA, 72 nt, Homo sapiens
ggagaucauguuaccaugacaacugauuauuucauugguccaaugaccaguugccauggugacaaaaucuuu

SEQ ID NO: 2764 - RNA, 71 nt, Homo sapiens
gcuuuccagcuuccucaauaggaauggaaaccaaacuccgaauugaugacuccuuugaggaagccgagagc

SEQ ID NO: 2765 - RNA, 97 nt, Homo sapiens
gaaauucauuguuacugcaguuaauggccaguuuauuagagcguuaaccauccuuggcaaugggcugagucguuuaauguggguaacgaccaauuuc

SEQ ID NO: 2766 - RNA, 68 nt, Homo sapiens
uuuccacauucucacucaggugcagucucuuuuccagguggagauugcuccacaagugaggauggaaa

SEQ ID NO: 2767 - RNA, 78 nt, Homo sapiens
gggaaacagggcacaaugggggcagaugaaaguccacagucuuuaguuucuaucuuuccuucuugugucuaauuuucc

SEQ ID NO: 2768 - RNA, 72 nt, Homo sapiens
ucugggcagccuccuggucuuugagccuggagugaagcugaacccacaggugagagaacaagaggccccagg

SEQ ID NO: 2769 - RNA, 73 nt, Homo sapiens
aaugcacaacucaacaaccuuaggacagcauuccauuaauucugcaaguccugagguugaagagucaugcguu

SEQ ID NO: 2770 - RNA, 100 nt, Homo sapiens
ggugggcaggcagcgcgugggucugucucuggcagggcagagggcggcaggagcagacuuucuccaggcucaagacacaggcccagcgccgcuacccgcc

SEQ ID NO: 2771 - RNA, 114 nt, Homo sapiens
agggggcagauaggacaaaagaccccaucuucuaggcagagggacagcggaacaugaacagugacccaagcauucucugccuagaaguggcaucagcccagcccaucacucccu

SEQ ID NO: 2772 - RNA, 65 nt, Homo sapiens
agaaaacagaucugacuuggcucugugaguccaucucacauacuggguugaguauaauuuuuucu

SEQ ID NO: 2773 - RNA, 106 nt, Homo sapiens
gcuacucaguuuaguccuccaaugugcucccuuuguuuuagauuccaugaauauccuggacccugaggaugaggaggagcacacucaggaagaggacagcaguggc

SEQ ID NO: 2774 - RNA, 143 nt, Homo sapiens
gggucucacaugcugcuacugccagaaccggccucucagcauuuguggaaucagcacaaggguggcguaugcucaggauuggccuacggcugguucugcaagugcugagggucucuggugcccaugugguaguuggaaggccc

SEQ ID NO: 2775 - RNA, 94 nt, Homo sapiens
cauuuccaguuauuacugcuagacaaauggcuuuuaaauuacauccuaaaaggcucacaggccauuugucuuuguaaguaauggcacagaaaug

SEQ ID NO: 2776 - RNA, 76 nt, Homo sapiens
ggugaucagucacauuucgacauaacuagaugucaaaagaaguuuaaguuguaugacgaacugugaugcagucacu

SEQ ID NO: 2777 - RNA, 80 nt, Homo sapiens
cugggacaguaguuauguuggccccugguuccaaugggcuggccuaggagcuuggugccugucaucacugcaauucucag

SEQ ID NO: 2778 - RNA, 66 nt, Homo sapiens
auugcacaagcaauuaggcauuuacacucuaaaaauuaagagaaaaugucugauuguguaugcaau

SEQ ID NO: 2779 - RNA, 128 nt, Homo sapiens
ucagcacaaugcuuggcaaccaacuaaguauucaauacacauugaccauauuauuacuaugaaaguucucagcaugugaauggucaacauguauugagcacuuaguuggaugcuaagcaaguugcuga

SEQ ID NO: 2780 - RNA, 89 nt, Homo sapiens
gggaggcaaacuauagggguuaccuuuagcaucuccccucucugaucacacuauggagggaugccaaaagugccccccauaguucuccc

SEQ ID NO: 2781 - RNA, 113 nt, Homo sapiens
gccuuccaauucuaucaauuccauuguguuucucugguaaccuucccaguucccugucaaagugacuaguuugaggcaucauggccaaauuacauuguugaugaggugaaggc

SEQ ID NO: 2782 - RNA, 89 nt, Homo sapiens
uuuagacaaacaaagcagcggagaggaggagggagcagaacugaaggguguauggcucugcuaaucccugcugcuuugauaaaucugaa

SEQ ID NO: 2783 - RNA, 86 nt, Homo sapiens
gcagggcaaaucuggguuuuaaagaguugauuguugcuuuaucuuuuuagagcuauucauuuuuaaaacccagagcaagacccugu

SEQ ID NO: 2784 - RNA, 77 nt, Homo sapiens
guuuagcaaauggaaggaguucaggcuuccgggcaaguugcuccacuucccggagccucagcuuccuuaccuugaac

SEQ ID NO: 2785 - RNA, 79 nt, Homo sapiens
gugagacaaugggcacuuuugcaaagaggagcagaauuagaaaucucagucuguuuccucugcaaagugccuuucucgc

SEQ ID NO: 2786 - RNA, 66 nt, Homo sapiens
uugagacacagcagugccugccucagcucuucuugggggaaguggggcggggcaccugcuucucaa

SEQ ID NO: 2787 - RNA, 60 nt, Homo sapiens
ugcugucagcacagaccagaucauuccaaauucugugggagaucuggccuugacacagca

SEQ ID NO: 2788 - RNA, 107 nt, Homo sapiens
cgcccccagggguuagagaucccaggagacaggcauaggacaauaauagcaaacgccuuuccuaggccuuucuucuguggaucugugugcacccagaaccaggggug

SEQ ID NO: 2789 - RNA, 60 nt, Homo sapiens
gagaaacagauagaauccuuugcaaagcacuccgucugcaaaggguucuucaauuuucuu

SEQ ID NO: 2790 - RNA, 85 nt, Homo sapiens
cuccaucagcgccugaggccuaagcuugguggcugcagaaucacaaaaaaggcaguggcugagcuuagccuagaaggcuguggag

SEQ ID NO: 2791 - RNA, 72 nt, Homo sapiens
uuguagcagguaugugcugaguguucuucucucacucucugcauuuggagcauucagcauauaauccuacaa

SEQ ID NO: 2792 - RNA, 94 nt, Homo sapiens
aaggcucagucuuuaggguggaguugagaaagacagagcgguguggugugccaaaacaaacuccuacuuucucauucugcucaaggucagccuu

SEQ ID NO: 2793 - RNA, 103 nt, Homo sapiens
agagugcauucugcaggaugagugaaaaggcauuuaugauucuugggggcagauguucuacaguagccugugcuaguucaugucuuucugcagaucacauucu

SEQ ID NO: 2794 - RNA, 113 nt, Homo sapiens
gauuaucauguagccugcuggguguaccgggcucugggaguggagcuaagaggcaccuaauucccccagcgcuccccagagccuccugagccccagcagauaacuucauaguc

SEQ ID NO: 2795 - RNA, 60 nt, Homo sapiens
uguggccaucgcugcccccucgcccagccugggguccgcaggagguagcgcacagccaua

SEQ ID NO: 2796 - RNA, 118 nt, Homo sapiens
cuagcucauaaacuccgacuuaaaagccagucucaguuacucucccugguacuuggaggucccagugccagagagagugacugaggcuagcuuauaagucggaguuucuccaggcugg

SEQ ID NO: 2797 - RNA, 81 nt, Homo sapiens
gguuuucaucacuguuucacugggaucccucacauuagagaaucuaugugaggugccuacgcugaaauggaaagaaaagcu

SEQ ID NO: 2798 - RNA, 74 nt, Homo sapiens
cccugcccugccuccaccccgccuggccugacccagccagggcucuaggaggguuggguggaggcaaagugggg

SEQ ID NO: 2799 - RNA, 68 nt, Homo sapiens
uuucuucccuccguuucccauugccagcauguagguuaaguggagguaaggaagauggagcuaagaga

SEQ ID NO: 2800 - RNA, 106 nt, Homo sapiens
uaggugccggcuggagcugguuaggaucuuuccgucugacuuacagggcaacugacgcccucuguguaaucagacgugaugaccggacuagaaccagcccuaccug

SEQ ID NO: 2801 - RNA, 70 nt, Homo sapiens
acagggccuggacuugauggcuucuuggggucauuacugggccucaagacuccacaggugccaacccugu

SEQ ID NO: 2802 - RNA, 88 nt, Homo sapiens
guuugacccuugagcagagguugcccuuggugaauucgcuuuauuuauguugaaucacacaaaggcaacuuuuguuugaguaucaaau

SEQ ID NO: 2803 - RNA, 81 nt, Homo sapiens
ucccacccuggcugagcaggcacgcugcgcccugugcuccugcgcucccugcgccucgaugcccuuuagccaaauguggga

SEQ ID NO: 2804 - RNA, 71 nt, Homo sapiens
ccuaggccugggggaggggaagcagugacagggccauccuaucugaauucuccccacccucaucuccuagg

SEQ ID NO: 2805 - RNA, 128 nt, Homo sapiens
uggaggccuugcugguuuggaaaguucauuguucgacaccauggaucuccaggugggucaaguuuagagaugcaccaaccuggaggacuccaugcuguugagcuguucacaagcagcggacacuucca

SEQ ID NO: 2806 - RNA, 84 nt, Homo sapiens
gcuucuccuucaugcgcuuuucaggaguguuuuagggcuauauuugcugaggauacauuccugaagguaaugagaaauggaagc

SEQ ID NO: 2807 - RNA, 103 nt, Homo sapiens
cccugccccuuggcccuucuguuuguuuugcuuugcacugaccugaaauggauaccuucacgggucccugcagcggggcagacagugguugggacauguaggg

SEQ ID NO: 2808 - RNA, 97 nt, Homo sapiens
cuuucuccaaaacagcuugaagcugacaaaacacuaagcucugagguccuagagaagcagcaguucagggucuuguuagcuucgagcugcaggaaag

SEQ ID NO: 2809 - RNA, 125 nt, Homo sapiens
cugugucccuuuagccucuuacaucaucaccagcaauaaagauuuuacugucaggacuuggcugacaaauuugcaggcucuuuauuacuggugaugauggacuauaagaagcagaaaaaacacag

SEQ ID NO: 2810 - RNA, 105 nt, Homo sapiens
ugccuccccacuucuccacacuacuucuccaggagccacuuacuggacaccaacuggcugacggugggggucucugagcagguaauugggauaggagcagaggca

SEQ ID NO: 2811 - RNA, 90 nt, Homo sapiens
guaccaccuugucggguagcuuaucagacugauguugacuguugaaucucauggcaacaccagucgaugggcugucugacauuuugguau

SEQ ID NO: 2812 - RNA, 55 nt, Homo sapiens
gcuuugccuggaguuucugguuucaggcaguccugagaucaacucuugccaaagc

SEQ ID NO: 2813 - RNA, 72 nt, Homo sapiens
cuggccccugacugcagccccuggugugguggcuuugggagugaccugccuggguucugugucugaggccag

SEQ ID NO: 2814 - RNA, 66 nt, Homo sapiens
ccucugccucucauuuccugccaguccugggucccuugcugggauggugagaagugaccccagagg

SEQ ID NO: 2815 - RNA, 56 nt, Homo sapiens
acuccacgccuuuugucugcugguuucccugaggaugcaggcuagggaccuggggu

SEQ ID NO: 2816 - RNA, 125 nt, Homo sapiens
uucucucgaucucccaccccuuccccagugccacucaucugucagccucacugguagcacccaugagguaguugcuaccaaugaggcugacagaugggggcagguuuguguggcgccuuagagaa

SEQ ID NO: 2817 - RNA, 78 nt, Homo sapiens
uggggccgcaugaaaagggugggaggggaggaggggagacaucccagcaccucuuugcucacccuuccaccugcccca

SEQ ID NO: 2818 - RNA, 146 nt, Homo sapiens
agccagcggcgggagcaucauuucauaacguaaguaaaauagagagggagugaaauggaauagagagagaauaaaacucccauuacucuguggcuauuugauucucuauguauuuuauucacauaaugaaugauguacuucuggcu

SEQ ID NO: 2819 - RNA, 87 nt, Homo sapiens
uuggggcgugagcucagggguugggagggauuguacugaccugguucccuuuuugucagaccuuccuucccaauucucagcccccaa

SEQ ID NO: 2820 - RNA, 82 nt, Homo sapiens
gggugacugagggaaagaauaaccagagucaaccugaaacccccaggaaucugauuggcuccguguucuuucuuucucaccc

SEQ ID NO: 2821 - RNA, 82 nt, Homo sapiens
ugguaccugaagagagguuuucuggguuucuguuucuuuauugaggacgaaacacaccugguuaaccucuuuuccaguauca

SEQ ID NO: 2822 - RNA, 75 nt, Homo sapiens
gucuuucucucuuucccacccaucuuuguucaucaugcaguagagaaacauugaugguagggaaggagugaagac

SEQ ID NO: 2823 - RNA, 67 nt, Homo sapiens
gcuuuccucggauucccggaugugggugaguucauuugcucgcgugcaggggaagucuggagaaggc

SEQ ID NO: 2824 - RNA, 72 nt, Homo sapiens
cccuuccugcgugacguaggcuggcgugggcucuucccccagccccuugccggugcugccacgugagaaggg

SEQ ID NO: 2825 - RNA, 72 nt, Homo sapiens; identical to SEQ ID NO: 2824

SEQ ID NO: 2826 - RNA, 93 nt, Homo sapiens
gacucgcugccccgcccccuuccugucgccccaggcccggugcuuccgccugggggcgcccgcgugggggggacgggaagaggggccugaguc

SEQ ID NO: 2827 - RNA, 78 nt, Homo sapiens
cuggcccuucuaaccauacacauuguuuccgggaggcuaaauauaaccccucaggcagugguauggauggguggccag

SEQ ID NO: 2828 - RNA, 85 nt, Homo sapiens
cucaggcugugacccucuagagggaagcacuuucuguugcuugaaagaagagaaagcgcuuccuuuuagaggauuacucuuugag

SEQ ID NO: 2829 - RNA, 92 nt, Homo sapiens
uucuuucucuugcugugcugucuguggagccugaaguugccuaugacucagcuucccaggcuccagggagccuggcaccccggggaaaagga

SEQ ID NO: 2830 - RNA, 74 nt, Homo sapiens
gugccucuggguguauuuuauuccucaggagaggugcuguccucagccugaggagugaaugggccucaaggugc

SEQ ID NO: 2831 - RNA, 65 nt, Homo sapiens
cucugucuuccuuugcagucuccaugcuucauaggauguguugcaggggacguggaggagcagag

SEQ ID NO: 2832 - RNA, 93 nt, Homo sapiens
aagucacuuccccaaaggagcauuuuuacuagcuagggaauuuuuuuaauuacuugcuaaaauuaaaugcuuuuguuggcauggauuugauuu

SEQ ID NO: 2833 - RNA, 69 nt, Homo sapiens
gggaggcuggcaucuugccucuuaaaugguccuauuuuggguuacagaaggaguaagagucucccuccc

SEQ ID NO: 2834 - RNA, 65 nt, Homo sapiens
caggcccugacaccccuccugggguugaaggcaggcccugaacaccagcaggggguccaggccug

SEQ ID NO: 2835 - RNA, 123 nt, Homo sapiens
gcuggccuucaggagggccuuggcugggugggcaugugggcagggugcugacaggacaacagccuuccuguccagccugcccacacccacuccucuuugcccucagggcucugccgagccagc

SEQ ID NO: 2836 - RNA, 72 nt, Homo sapiens
gccaggcucugcccaccuagacccccgcuucggccuaacagggagcugggggcugggcugggaggacuuggc

SEQ ID NO: 2837 - RNA, 108 nt, Homo sapiens
gggcugcugggugugugcaguggguucuguggucaggagagugccgucuggaugggagauauuugguugguuuuagcuuggcccauuccugccacugacugauggccc

SEQ ID NO: 2838 - RNA, 72 nt, Homo sapiens
aagaagcuuuggcaggaguaggagagaaaguccuucccuccuuuccucuaccuuuucucccaauuucuucuu

SEQ ID NO: 2839 - RNA, 77 nt, Homo sapiens
ccaugacuaugcacauccaggcuacuuccugacuaggcccuguucaggaagcauccugagguguccauuccucgugg

SEQ ID NO: 2840 - RNA, 77 nt, Homo sapiens; identical to SEQ ID NO: 2839

SEQ ID NO: 2841 - RNA, 66 nt, Homo sapiens
gccucccuaagaccuuucccuccucccacaggcagaugcccaacuaggaggagaggguuugggggu

SEQ ID NO: 2842 - RNA, 75 nt, Homo sapiens
auaucccuaguauauagggauauaauuuuagcauccauuauauaguagauauuaugucccuaauauacaggauau

SEQ ID NO: 2843 - RNA, 138 nt, Homo sapiens
gucccucuagaagcugugggccacucagcgguuguguguguguguccguccccccagagucagaggcuuuugagggagcgugugcaugugcacgugugcgcuggcaacaugaauguggcccggcacugcuuuggggau

SEQ ID NO: 2844 - RNA, 98 nt, Homo sapiens
ccuccucuauauaacuuuucuggggauuuucuauuucuuuuuuccuguaccuacuauggaggauuagaagaugacccagaaaagcuaugauaaggggg

SEQ ID NO: 2845 - RNA, 65 nt, Homo sapiens
ugcuuucuaaaggucggcaaaacucccuuugaagucaaaagagaguuuuacuuaccuaagaagca

SEQ ID NO: 2846 - RNA, 87 nt, Homo sapiens
uggcuucuauaaugcaguuuuguuuuucaaaauaauaaauuagcauuaauuuaggguugugacaagcuuaaucugcugcaaaagcca

SEQ ID NO: 2847 - RNA, 101 nt, Homo sapiens
ggggagcuccaagcaggugggcaggacccaggggccuggugaccaggacagacccccacuguccaucaccuuuccuggcccuguccucagcuaaacuuccc

SEQ ID NO: 2848 - RNA, 79 nt, Homo sapiens
gcuucccuccagggccuguucugauuggcagaugugcuaugaccagucugcacagcuggaauguggccacucaggaagc

SEQ ID NO: 2849 - RNA, 56 nt, Homo sapiens
uucccucugacguggagggaggcaggugguugcccggcuuuccucugcacagggaa

SEQ ID NO: 2850 - RNA, 105 nt, Homo sapiens
gccccucugguggucccccgcugagucuuugguaaagucugcugcaucugccaauucuuuugugagcagauuuguucuaggggugugggggacuaagaaaggggu

SEQ ID NO: 2851 - RNA, 92 nt, Homo sapiens
ugugcucugggggcugugccggguagagagggcagugggagguaagagcucuucacccuucaccaccuucuccacccagcauggccggcaca

SEQ ID NO: 2852 - RNA, 88 nt, Homo sapiens
guccuccuguggggcuggaguccccuggugaggacaugguggccgggcagucucggccccgucuucucacaggggucucccugaggac

SEQ ID NO: 2853 - RNA, 83 nt, Homo sapiens
ucauuccuucaguguugaaacaaucucuacugaaccagcuucaaacaaguucacuggaguuuguuucaauauugcaagaauga

SEQ ID NO: 2854 - RNA, 85 nt, Homo sapiens
ggcucccuuuuuugugucccuucuuuaagagugucugguugcuuugcugacaaacaccucagaaaagggacagaaaguuggagcc

SEQ ID NO: 2855 - RNA, 98 nt, Homo sapiens
gcugggcuucgcagaaggagugggcuccaccucccugggagacccagcuccuucccacucggagguggggccucacccugccucugcuuucucccagc

SEQ ID NO: 2856 - RNA, 63 nt, Homo sapiens
gcccagcuucccagccccuccuuugaacccugcugggugccagaaggagggggcugccugggc

SEQ ID NO: 2857 - RNA, 76 nt, Homo sapiens
uguuuugagcugugcuauuccaaggccgggggaaugcuuaaagaaacccugaucuuggaauggcacagcugagaca

SEQ ID NO: 2858 - RNA, 126 nt, Homo sapiens
ugucuuguuugagcaggcaauuaacuuggacucaaguugcaaacugucuccuuagcaaaagauaucaugcagcuaaggagaugguuugcaacuuggguccaaguuauugccugcucaaagaagaca

SEQ ID NO: 2859 - RNA, 78 nt, Homo sapiens
aucuuugugucucaggccucagccugccaggccugggcuuucugcuuggcagugucuaggggucuggggcaaaaagau

SEQ ID NO: 2860 - RNA, 69 nt, Homo sapiens
cucagggaagcuuuuugcucgaauuauguuucugauccgaauauaagacgaacaaaagguuugucugag

SEQ ID NO: 2861 - RNA, 58 nt, Homo sapiens
uacacagguuuaucucucugaccuuuagcuaauuauuagauugagauaaaugugugua

SEQ ID NO: 2862 - RNA, 66 nt, Homo sapiens
ggaccugucuguuuuucuugccauaccugagaucaucagaaauggcauugcaagggcaggaggucc

SEQ ID NO: 2863 - RNA, 79 nt, Homo sapiens
gcaggugccuuuugaugagaacaucuggggccuucaggagauuuccaugggccucugauuuuagaucaagaggacuugc

SEQ ID NO: 2864 - RNA, 65 nt, Homo sapiens
guuuccguaguaacugugcaggacuuucagggauauuccacacucugccugguuacuagggaaac

SEQ ID NO: 2865 - RNA, 66 nt, Homo sapiens
ggcugggauaucaucauauacuguaaguuugcgaugagacacuacaguauagaugauguacuaguc

SEQ ID NO: 2866 - RNA, 76 nt, Homo sapiens
gcccucggaggacuccauuuguuuugaugauggauucuuaugcuccaucaucgucucaaaugagucuucagagggu

SEQ ID NO: 2867 - RNA, 65 nt, Homo sapiens
agagaggagaagggggaggugauauugcagaaaacaugguaaacucuccucucuuucugcuuucu

SEQ ID NO: 2868 - RNA, 72 nt, Homo sapiens
guggguggggcagggggcccaggacaggccucuaaggcccagucacauguccuggagcccugcccagcccac

SEQ ID NO: 2869 - RNA, 65 nt, Homo sapiens
guaucuggggauauguguucagagugugaagcuucugaacucuuugaaggugugucccaagguau

SEQ ID NO: 2870 - RNA, 74 nt, Homo sapiens
uccuuggugacauaguugucuuggugguacagggaaacucccucuguaacacuggggguucugugucacaggga

SEQ ID NO: 2871 - RNA, 77 nt, Homo sapiens
accucaguggguuacugugauaauaauaugaguucuauauaucaacucauauuuuuaucacaauaacccaaugaggu

SEQ ID NO: 2872 - RNA, 67 nt, Homo sapiens
cuggaggucccagggugguugggcccugggagggugugggcgaggugggccguccugggagcucugg

SEQ ID NO: 2873 - RNA, 65 nt, Homo sapiens
ggguggguucauuauucuugggcguccuggcugugcugugacaccagagacugaugaggccaccc

SEQ ID NO: 2874 - RNA, 74 nt, Homo sapiens
uuuccaguccuaguuguuccacugcgagcaugguuagagugaggcauguuaaugaaugggagcugggauggaga

SEQ ID NO: 2875 - RNA, 68 nt, Homo sapiens
gccccugccccgcccccccaggcccaguaauggguggguaaugagugcugggggagcgggggaggggc

SEQ ID NO: 2876 - RNA, 85 nt, Homo sapiens
gggauggagcaggcugguaccugggcugcagcccggcuggacaccauccagggcuggccgccccaugccuucccugcugcauccu

SEQ ID NO: 2877 - RNA, 69 nt, Homo sapiens
cuuaaaggcuagugcauggaaccuccacucuacucugcaggcagugaagaaccaugacuaguguuugag

SEQ ID NO: 2878 - RNA, 81 nt, Homo sapiens
ucuucugcugcagucaggagugggguggggccccucagggugcucuuggauaccagccccuccccaccccugcagagagga

SEQ ID NO: 2879 - RNA, 66 nt, Homo sapiens
cagacugucaugggguacuacacauggggggucagcacucccgugggucacucacauggggguuug

SEQ ID NO: 2880 - RNA, 157 nt, Homo sapiens
gcacuggugucugaguaauacuccauucaaacaccucacccugauguauugcauuaauagaucaucagaagcaguugucauuccagugauauauuagugcaauacaugagaaugagacucacugaugauguauuuaguacucacaagauggcagugu

SEQ ID NO: 2881 - RNA, 141 nt, Homo sapiens
gggggugacuucgcaugugucugucauugaauucucauggcaucuuugagcaagguguaauucuucaauuuuauagaagagagaaaggaagcucagagagucaaguauuuuuuggagaucacauagcuaggaagugccuuc

SEQ ID NO: 2882 - RNA, 113 nt, Homo sapiens
agcaacgauugauuggauuugaggguuacaauugugggagcacugcuguugucaagugccgcugagcagcucugcuccaucaguugccucagagcaagaacucgguaguugcu

SEQ ID NO: 2883 - RNA, 75 nt, Homo sapiens
uuuggagagaugagugaugggucuuucugagucacagggggagggccaugaaagauucauacacaucuguccaaa

SEQ ID NO: 2884 - RNA, 67 nt, Homo sapiens
ccccaggagggccucucugauuuugcccaacuucucuggacugccugauagagcuugcccucugggg

SEQ ID NO: 2885 - RNA, 134 nt, Homo sapiens
ccuuuaguggaggccaaaaccagguuaagacucagucaccucauuaguaucuuguuuaggcaccuccaauuuaguagcuaggcaaaguauuaaugagugacugauuuuuaaucuacuuuuggcucuagugaagg

SEQ ID NO: 2886 - RNA, 107 nt, Homo sapiens
ugggggggugggugggagcgagggacagauaguugcucgggggucgaggcgggggacgccucgacuuuucgagauaacagguuuguccgauuccccccacgccccca

SEQ ID NO: 2887 - RNA, 142 nt, Homo sapiens
uccuuugucuucucacccuuuguggcaaauugagacgggggaaaacuauuagguuggggcgaaaguaauuucuguuucugccauuacuuuugccccaaccuaauaccucccagcaaaaugcagggguugcggagagaaaggg

SEQ ID NO: 2888 - RNA, 70 nt, Homo sapiens
gaaggggaaugaacuguggcuaccugugugugcuauuguucuuacagaaagccacagugcauugcuuuuc

SEQ ID NO: 2889 - RNA, 81 nt, Homo sapiens
ggguuugggggaacauucaaccugucggugaguuugggcagcucaggcaaaccaucgaccguugaguggacccugaggccu

SEQ ID NO: 2890 - RNA, 82 nt, Homo sapiens
ccugcugcuguaagaauauguuugacauuuaguugguuccuaauuaaacaacccaauaucaaacauaucacacagaagcagg

SEQ ID NO: 2891 - RNA, 119 nt, Homo sapiens
ggggggggggcccggggcuaucggaggugacccugugcaggcuagauggggaccagcuguugggaucgccaaaugcagccugaccggggucccccuccagcccucugagcccgcuuccc

SEQ ID NO: 2892 - RNA, 70 nt, Homo sapiens
gccugggagggcccaggaggaggggccuucagauucaguccaauaaggcccuuccucccucccuccaggc

SEQ ID NO: 2893 - RNA, 68 nt, Homo sapiens
gacucugcucugauggugcuuuugggguaggggcugaacucuacccagggagucaaaggagaaggguc

SEQ ID NO: 2894 - RNA, 128 nt, Homo sapiens
uaggcaggcauucugggcaaagacaaguccaagcuggagauuaacugggcaucccucugccaaaaggagauggcuagauagguugucagcuuuggauucucaggucuuuuuuuuuagaugcaugccug

SEQ ID NO: 2895 - RNA, 117 nt, Homo sapiens
auuuaugccuguaucguggaauguugggauuuauauuuucuuuauaagaaaguuucuuauuuauuguuucuuauaaagaaaugauaaaucccaacuuuccaggauacaaggauaaau

SEQ ID NO: 2896 - RNA, 110 nt, Homo sapiens
gaggcagagaaggagagugguuagaacaugcucaagagccaaacugcacaugcugacugcugaugccagcucugugggccugggcuagcugccuauccucucugugccuc

SEQ ID NO: 2897 - RNA, 83 nt, Homo sapiens
ggggcugaggauuguuugguggggggugcacugaucaguucuuguccccuggugacugugccccuggccagcgaccuggccuc

SEQ ID NO: 2898 - RNA, 56 nt, Homo sapiens
gguaugggugaucugaauauugccuguuuaaacgggcagucagugaugcacauacc

SEQ ID NO: 2899 - RNA, 74 nt, Homo sapiens
gagcaggugccauuggcucuuggccuguuuggguggguggcauucagagagguggaaggucagaugcacuguuc

SEQ ID NO: 2900 - RNA, 75 nt, Homo sapiens
uggcccggggccugggagggagggcgccccuccgcgcucggcagggggcucucucuccccacgaucccggggccg

SEQ ID NO: 2901 - RNA, 63 nt, Homo sapiens
gccuuggcuggcuaccugggccgagcacaaaaaaugagaugcucacccuuguggcagcgaggc

SEQ ID NO: 2902 - RNA, 97 nt, Homo sapiens
uggaguggguggcucaguuugccuuguuacagcugccucuuccuucugagaaauggaagaugguauuuguaggaaugcguuugugugaccggcucua

SEQ ID NO: 2903 - RNA, 63 nt, Homo sapiens
gaaguugcuuuuaauguuccuuucuaugucguuguuaggaaggaauuuuauuugaggaacuuc

SEQ ID NO: 2904 - RNA, 61 nt, Homo sapiens
gccacagaguucauuacaggguaauuaaugcauguuaaguaucuuguaaauauuauguggu

SEQ ID NO: 2905 - RNA, 74 nt, Homo sapiens
gacagaggggcugggcugggcugggcaaccuagacccgggagcccaucuguccagccaccagcguccgucuguc

SEQ ID NO: 2906 - RNA, 71 nt, Homo sapiens
auuugggagaguuucucccuagcauuugguauggaauuauuaccaaaugcuagagaggaacccugccaaau

SEQ ID NO: 2907 - RNA, 198 nt, Homo sapiens
gaggcugcgaggagugagcggcuuguaugggaccaugcagccagagggugacagagccacccagggcuccugacuccagguccuguguguuaccuagaaauagcacuggacuuggagucagaaggccugaguggagucaccuuccccacucucuggcugggugaccccggagcaagccauuugaacucuccgagccuc

SEQ ID NO: 2908 - RNA, 81 nt, Homo sapiens
gccuuuguacccaauggugguugcuugaacuuuauugagaaaaacgauaaaguucuuguugcuggauuugguuaaaaaggu

SEQ ID NO: 2909 - RNA, 83 nt, Homo sapiens
ugcaguggccagcgagguaggugcuuccugucccucauuauauacugguacuuggaacgccaaccuugcucuuuguggcugua

SEQ ID NO: 2910 - RNA, 72 nt, Homo sapiens
uuucaggucgggauggcacaagacuacuaaauuguguguuggcaaaguagugcuguguaucuggaguuggaa

SEQ ID NO: 2911 - RNA, 83 nt, Homo sapiens
uuccaggcuguggguggauaagugaccccccagcuaguuguuagggacuggcuguggcaguuauuuauuuuacugggcuggaa

SEQ ID NO: 2912 - RNA, 82 nt, Homo sapiens
gagccagcgugggguggggugggcuguccgaugguggggugcuuggucccacccauuggugccucccuagaccccguggcuc

SEQ ID NO: 2913 - RNA, 68 nt, Homo sapiens
ugauuuguuuuggagauggauuuaugccaaucaaaugaaugcaugaauaccauccucacaagggauua

SEQ ID NO: 2914 - RNA, 83 nt, Homo sapiens
gggcuggaguccaauuccuuccccaccagcugccuuugaccgccagugacccuggcagcugauggggaggguguccucagccc

SEQ ID NO: 2915 - RNA, 59 nt, Homo sapiens
aagguggugauuagguuuucagguuuagagaagugugagacaaccuaauuaaacaccuu

SEQ ID NO: 2916 - RNA, 68 nt, Homo sapiens
ggcuguggggauuguugcuuauugucugaguuccccaacuggagcuaaguggccaguccugagcagcu

SEQ ID NO: 2917 - RNA, 88 nt, Homo sapiens
gggcucggagagggagagcuuuggguggacugagaugcgacauuggagggaagcaauuaguucgcuuggagucaccucuugggagucc

SEQ ID NO: 2918 - RNA, 81 nt, Homo sapiens
cugaguggcucuggcacaguucacuggaccuuucugcugaaugauguuagggacguccagggacucacagagcaaacucag

SEQ ID NO: 2919 - RNA, 69 nt, Homo sapiens
gccaccgcacccgcauguccugguccuuucagggcacccggagguggccaggacagagguggagguggc

SEQ ID NO: 2920 - RNA, 67 nt, Homo sapiens
aaaggugggcaaaauuucuguuugugugauuacauuuauaauguuaagaaauuuugccaugaucuuu

SEQ ID NO: 2921 - RNA, 77 nt, Homo sapiens
gaugaggaggcaacaucccacauuguuuauugauucauaagguuaagauuaaagugggauucuugccuauguuuauc

SEQ ID NO: 2922 - RNA, 110 nt, Homo sapiens
guccccggcccagcucccaucccagaacccagcucaccuaccuugagaggcucggcuaccucaguguggaaggugggcaguucuggaauggugccaggggcagagggggc

SEQ ID NO: 2923 - RNA, 107 nt, Homo sapiens
cucgguguccaugauggggcagccggggggcuguacgcuuccucugucucugucucugggcagaccauaguccagcgugcugccccuacugcccuggaaaagccgag

SEQ ID NO: 2924 - RNA, 112 nt, Homo sapiens
cccugagagaggagagcacauuuuaaagugaguuagcccaggcccgcccugaaccccagaugcgcgggucugauguuggccuuagaaaugggcucuuccaacuaauucaggg

SEQ ID NO: 2925 - RNA, 94 nt, Homo sapiens
aagucagauggauuuguggcuaguuagcuaaugcuugauuguuuacuuacucagcauuccuugggugacuggcugugaauuaauaugaugacuu

SEQ ID NO: 2926 - RNA, 70 nt, Homo sapiens
ccuucagaguacucuguaauugagugugaagucucaugagaucucuuccucaauuccaagugcauggagg

SEQ ID NO: 2927 - RNA, 62 nt, Homo sapiens
cccuuugaccguuuuccugcccaucagagccacagucagagggugggaagguggaagaaggg

SEQ ID NO: 2928 - RNA, 89 nt, Homo sapiens
uggcaggacagaaaggaugguugucuccuguguugcaagggugacuuccaaagcagaaaauggagauaaccgucugaucaugacuguca

SEQ ID NO: 2929 - RNA, 73 nt, Homo sapiens
guguaugaaaggguuauucaucucgagggcugagcaugaagguccucaguccucagugagugauccugugcac

SEQ ID NO: 2930 - RNA, 104 nt, Homo sapiens
gugacagaagcccagagagaacugaagcuaaauggauauugugagacugguaaucaacaaaaaucacagugucuggguuucagggccuaacucugggcuguuau

SEQ ID NO: 2931 - RNA, 91 nt, Homo sapiens
acaugagaaacauuaacccuuugcuacccagguaaacuuugguaaauauggaguguguguggguggggagauggggugugaaguguuaugu

SEQ ID NO: 2932 - RNA, 89 nt, Homo sapiens
uaaauggaaugccaaccuuuugucaaggaaauuauuguuuucucuggagguaaggagauuuucuuggcaaaagguugagcuuacauuua

SEQ ID NO: 2933 - RNA, 97 nt, Homo sapiens
cccagugaccccccucucauguggccucaugagccuggccagugaugaauggcacuuucaugggcaugagacuccacgugagugggacucagcuggg

SEQ ID NO: 2934 - RNA, 98 nt, Homo sapiens
gugugggagacuggggggagacagagggugcaggaaagaauugcauuagcagccucccuccuuggccugcccuuuguuugcuccuuuaagcaccauau

SEQ ID NO: 2935 - RNA, 66 nt, Homo sapiens
cuggcagaugcaauuagccucugggucccucagaauuagaugcagguggcuaauuguccaugccag

SEQ ID NO: 2936 - RNA, 85 nt, Homo sapiens
gcacuugauacuaaccgagcugucuauauccuagccuugugucaaaggcuugugauguguugugauagcuggguuuaagaagugc

SEQ ID NO: 2937 - RNA, 94 nt, Homo sapiens
cagcuggaugagucggagaggaaaaaccauugaucuguuucugaaaucagaucugcaaaugguggccuucuucguacguggagaaagacagcug

SEQ ID NO: 2938 - RNA, 67 nt, Homo sapiens
uccucugcaguauccuagccacaguaggaacucuucacaagcuuucuggcugggauauucaagggga

SEQ ID NO: 2939 - RNA, 152 nt, Homo sapiens
gcagaggccaggcuucagguuugaaaugaaugucugcaugaguugcuaauauagaccaaggagagcaugagcacuccuacugcugugguaaugaugcaggccaagagacacaccaggaaaauguucacccgugaccacagccuguucuuugc

SEQ ID NO: 2940 - RNA, 81 nt, Homo sapiens
gacuaugccuccccgcauccccuagggcauugguguaaagcuggagacccacugccccaggugcugcuggggguuguaguc

SEQ ID NO: 2941 - RNA, 169 nt, Homo sapiens
gcagcagcuccagccccacaaauagaugccaguacaguagccccucggaucacaggagguauuuuuggugcuggaagccagccacacuuuggcaggcuuucagcaucaagucuguucccuuuagaggcgggggguggcaagcuaucaguguuuagcaugggaaugcugc

SEQ ID NO: 2942 - RNA, 112 nt, Homo sapiens
guggcugcugcugggggcuguugaaucugagggccaggcuucucauuucucucaccaggcccugccuccaagccuagucccagggagacagcccucaggaacccaaggccac

SEQ ID NO: 2943 - RNA, 91 nt, Homo sapiens
uaucuggcccugggcgaggaagugggugcuuuagaggucuuagaguacagacagcuuuuagggcauucugaucuucacccugguucagaug

SEQ ID NO: 2944 - RNA, 113 nt, Homo sapiens
ggaugagcaggcugcauauauaaucuucugcuacauucugccuagaacuaaaguucugccuaaaguucuaggcaaaacauagcagaaggaucauauuugcagcccaaucaucu

SEQ ID NO: 2945 - RNA, 95 nt, Homo sapiens
agucaugcagguaagaugaggagcaaagcccugugggguagccaaucuaaagaagcauuccaugugggcuggugccucccucuugcagaaugacu

SEQ ID NO: 2946 - RNA, 108 nt, Homo sapiens
gucccagcagugucuaaugaccuggagagaccgcaugcuaaguugggcccccacuuuccagccuagggugugacauagcagagugguuuaagguuaugagcaugggau

SEQ ID NO: 2947 - RNA, 91 nt, Homo sapiens
caggaugcgguggcugaugacagaacaauguggagagaggcgucauuugucaaauccuuacuuuguucugggcauugugcuaaaaauucug

SEQ ID NO: 2948 - RNA, 128 nt, Homo sapiens
ucggcugcggcaagugcuucuacaucccugcuccaacaaggaaagacaggaggccaggcguguguguggcucacaccucuuguccuuccuuguuggggcagggguacagaagcauuuuggggggcuga

SEQ ID NO: 2949 - RNA, 76 nt, Homo sapiens
ucacaugcuugauaaaaugaugaaaucacugaccagcaggauccgucaguggagucagcauuuuaucacaauguga

SEQ ID NO: 2950 - RNA, 76 nt, Homo sapiens
guaacugcugucauguaauguaucauagcaugugccaggcacugugcuaugcaugucauaugugagcucaaguuau

SEQ ID NO: 2951 - RNA, 127 nt, Homo sapiens
uuuauugcuauugaguguuacagcauaaauaucuuaaacuuguaacuaaccaguuacuuugauuuuaggguauaucaaaguaacugcuuaguuacaaguucaagauauuuaaacacucacaaauaga

SEQ ID NO: 2952 - RNA, 127 nt, Homo sapiens
uaguggggucacucauuggggccacaaguuggaagagugauuuucagggggucgcagaugggguaauugguuugggagucccugagggaauuauuaguuaggaagucauugauggguggaauuacua

SEQ ID NO: 2953 - RNA, 75 nt, Homo sapiens
ggagagggaggcagggcagaaguggcgggggugggggacaguccuuucaaacacugcagcucuguuuuucucucu

SEQ ID NO: 2954 - RNA, 81 nt, Homo sapiens
ggguacggggauggauggucgaccaguuggaaaguaauuguuucuaauguacuucaccugguccacuagccguccguaucc

SEQ ID NO: 2955 - RNA, 84 nt, Homo sapiens
ggcuguggcuggauucaaguaauccaggauaggcuguuuccaucugugaggccuauucuugauuacuuguuucuggaggcagcu

SEQ ID NO: 2956 - RNA, 108 nt, Homo sapiens
gcuaauggugagaagaaauuguaaaaagaggcaauagaagaugcuaaguuguuucucuucagcaucuucuaguaucucuuuuuaauucauaauuugcuuaaaauuggc

SEQ ID NO: 2957 - RNA, 68 nt, Homo sapiens
uggaguggucaagucuguggcugguguguuuccccucucccugcaccaggcacaggaucugaacucca

SEQ ID NO: 2958 - RNA, 76 nt, Homo sapiens
agugcugggagggcauucuuggguagauguugaguggguuaccaaaggcauacuuugagaaaguguuuagagcauu

SEQ ID NO: 2959 - RNA, 68 nt, Homo sapiens
uguauuggaguucuucucuucuguaauacacaaauauuuggagaugaagaagagaaggcuaaaguaca

SEQ ID NO: 2960 - RNA, 66 nt, Homo sapiens
ucuuauggugaugacaguuggaugcaccuaaucaaaagucagcaacuaacuguuaauaaaguagga

SEQ ID NO: 2961 - RNA, 107 nt, Homo sapiens
cacuggggugauguuaccauaauaauuauggaauuauggcuuaaaaucaaaucacuauuguggacauuuaagucaugauucuguguuacuaggaaaccaaacuagug

SEQ ID NO: 2962 - RNA, 60 nt, Homo sapiens
gcgaggggagggcccagccccuaggcccagagggagacuggcgggguuggcccaccucgc

SEQ ID NO: 2963 - RNA, 111 nt, Homo sapiens
uccccuggaggugggagugggggcgaggggcacugggcaaagacacacugugauuauuuugaucauuuugcuaaggcuccuccugucuuccucuuccccaaacaaagggga

SEQ ID NO: 2964 - RNA, 89 nt, Homo sapiens
ugcccuggauucugggcucuuaacuguaugagcacuguaggugugagcagcaacaauuaagaagcugcagagguaaagguauaagggca

SEQ ID NO: 2965 - RNA, 85 nt, Homo sapiens
cagacaggaaaccccaccccagggccugcagugggacagguguggccgcccuccacccccacacaggccucggggagggugucug

SEQ ID NO: 2966 - RNA, 82 nt, Homo sapiens
caggcuggaaaggucagauggggaggguggguguagggacacuaugugucccuuugccucuccauccucagaugauggucug

SEQ ID NO: 2967 - RNA, 80 nt, Homo sapiens
gauaggggaauggaugguugaucagagaacguacauuuuauaaaugguguaugucaguugauccacagucccuaccuauc

SEQ ID NO: 2968 - RNA, 120 nt, Homo sapiens
aagagaggcacugggauagcgccaucacaacuguucacaaaauucuggccaguggaacagcuagucacaaggccaagguuuugugaacugugucuauggcuguaucucaguacaucucuu

SEQ ID NO: 2969 - RNA, 75 nt, Homo sapiens
ccuucugggguauuauggcagcugcagccaauauugaacagggagcugcagcuguuuacagaugcauuaggaagg

SEQ ID NO: 2970 - RNA, 123 nt, Homo sapiens
acccuugggaggcacugggacuggcucagguguauucuacagugcacgugucuccaguguggcucggaggcuggagacgcggcccuguuggaguaacaacugaagccggagucugcgaagggu

SEQ ID NO: 2971 - RNA, 80 nt, Homo sapiens
agcaggguagauggggcuggggcgguggcacuguccauugaagauagcgcugguguggcuuccccagcccgucuucugcu

SEQ ID NO: 2972 - RNA, 79 nt, Homo sapiens
ccgaggguguggaccuggaggugaauucagcagcuugacaaugugcaguugaggucauuuccaucuuccaucacuucgg

SEQ ID NO: 2973 - RNA, 86 nt, Homo sapiens
auacaugugacucuggauucaggaucucuccuuggaauuuaaguugcagcccaaggggauaucaugucucuuugagucuaauguau

SEQ ID NO: 2974 - RNA, 85 nt, Homo sapiens
cauuuuguagcaagauuguuuccccaugagcaguuugucuucauucagcagcugucuucucuggggaagccauuuuguagaggug

SEQ ID NO: 2975 - RNA, 104 nt, Homo sapiens
cguccuguauguaaacccuauuaccacggaaagagcauuuuuguggcauaucgacuaagaaaauaaccaggcugcucuuucuugugguauuggagcugaggacg

SEQ ID NO: 2976 - RNA, 110 nt, Homo sapiens
gggggugucugcugcgggucgagagggguggaggaugggugaggaccaggaacgagggccuucucucaggacuccauccuucugaaaaugugcaccugcaguaagccccc

SEQ ID NO: 2977 - RNA, 84 nt, Homo sapiens
ccuggugucaguuccacagccuuuugugaaauuugccacacgaauuggcagaauccuaagaggcugcugggaaaguuaaccagg

SEQ ID NO: 2978 - RNA, 102 nt, Homo sapiens
gggcuugucccaguuacaugaauuaauucugucuugggguucugauggcagcauaaaccaaagagcccagaaucccaugaugaaauuauaucguuaaagccc

SEQ ID NO: 2979 - RNA, 75 nt, Homo sapiens
cucacugugauggccaggccaggggauacauccugguggcccuucugugucacuggccuuugccauaaaaguggg

SEQ ID NO: 2980 - RNA, 87 nt, Homo sapiens
auuucugugcauaaacgguggccuagauucuugcccuguggaaauccauggaauuaagaacucuagguuccuggagugauaagaggu

SEQ ID NO: 2981 - RNA, 79 nt, Homo sapiens
gguuugguguguuggcuccuguuccucugucugggaccuuaagaccauagaagaggcaggaggagcuaaaaaacaaacc

SEQ ID NO: 2982 - RNA, 89 nt, Homo sapiens
ggcucaguucucuugcagggcaaaaauccucauuuauugggaacuggaaaaguacuuaaggugaggauuuuguucugcuagggugggcc

SEQ ID NO: 2983 - RNA, 83 nt, Homo sapiens
uaggguguuuagguuaauuggugugaugcauguuuauuauaaaaaguuguugcugaaugcaugccuguuaaccuuuaacccua

SEQ ID NO: 2984 - RNA, 82 nt, Homo sapiens
uaugcuguuugggugcuguuuaugggagcagggaagaaagacuugguugcuugcuucaauacacagugcccuauaaggcaua

SEQ ID NO: 2985 - RNA, 84 nt, Homo sapiens
acuaguuaguaguauaacuugcuaguuauacuacuuaccaguuacacuugcuaguauaacuaguaaguuauacuauuuacuagu

SEQ ID NO: 2986 - RNA, 68 nt, Homo sapiens
cauugauuaaugaaaucuaguauaaacgggugucaugcccuuuaaauauuagauuucauuacuuagug

SEQ ID NO: 2987 - RNA, 65 nt, Homo sapiens
ggauuuuguuuuguucuguuucccuugagcucggaaaccuuaauggaacagaguaaggcaaaucu

SEQ ID NO: 2988 - RNA, 84 nt, Homo sapiens
ggugaguggguuggugacaacugguuuggaggcuuuugugggggacuguggugucuuuuggauugugucaucagcuccuucauc

SEQ ID NO: 2989 - RNA, 57 nt, Homo sapiens
aaggauuaaagucaaagccccagcucgacaugaguuaugguuuugauuuuuauucuu

SEQ ID NO: 2990 - RNA, 74 nt, Homo sapiens
cugcacugucuuccaucuaagucaucaccaauuuuauaucuaauaagcuuugucugagauggaagacugugcag

SEQ ID NO: 2991 - RNA, 168 nt, Homo sapiens
uuuuaauauuacacauacaaucauuuuacaguguggagguuaauuccgcucacaaaagugcaugaaaggaauuaaaggaaacaauuugaacauuuuaauucuuuucauauauuucaaggggaggaauuaggcaccaaaacacaaaacaauuauauguguaauuuaaaa

SEQ ID NO: 2992 - RNA, 69 nt, Homo sapiens
ugcaugucuguuucuucucaaugaauaguaggccauagaagcaguuagcauuguaagaaacaguaugua

SEQ ID NO: 2993 - RNA, 69 nt, Homo sapiens
agagacucaaaauguggaaaggagaaagggcuaucagaaguccugugucuccuuacauuuuguguuucu

SEQ ID NO: 2994 - RNA, 65 nt, Homo sapiens
auucaauuugacaagguucuuucuuucuggaucagagagggaguaagguucuugucaguuugaau

SEQ ID NO: 2995 - RNA, 69 nt, Homo sapiens
uguuuuucuguuucuuucugucucuugguuccuuaagggcuuugaugaucagggcagaagcagaaggca

SEQ ID NO: 2996 - RNA, 59 nt, Homo sapiens
guauauucacacacgcauaggcuauagaacaaauaguguguguaugugugugcauaugc

SEQ ID NO: 2997 - RNA, 59 nt, Homo sapiens
cccugauuuaauuagcuuuuccuuacaaugauuuagggaagccuguaauuagcucaggg

SEQ ID NO: 2998 - RNA, 59 nt, Homo sapiens
ugguuuuugguuuccagagcaggcaggaguaaacacagcuucucugaagccauaaauca

SEQ ID NO: 2999 - RNA, 63 nt, Homo sapiens
ucucauuuugucuccuaagcugaucacuggagauuccaucguuagugcugaggcaguauggga

SEQ ID NO: 3000 - RNA, 122 nt, Homo sapiens
auguauugauauuaucauucuugcugacauauucuggaagcuuucagccccaccaacacugccccacccaggacuucugcagcugagaguuccugugucaguagggucugauauuuguacau

SEQ ID NO: 3001 - RNA, 122 nt, Homo sapiens
agccaguagcugcacugcagcccauagauucugaggauucuacaaagcaauguguagaaugagaugccuuugaccugaauucucgggauuuuaaaaucugcugacaguagcaguuucuggcu

SEQ ID NO: 3002 - RNA, 100 nt, Homo sapiens
uuugacugccaucaugauucaggccucagugucauggacucuagcgaccggucacuggagguuaugaccaacugaggccugauugacgauggccgucaaa

SEQ ID NO: 3003 - RNA, 101 nt, Homo sapiens
cuugcuuccugccccuucccgcacucagcagcccuucgcaggaacuuggggcacuuccccaugcccgaggggcugcugggcagcucccaggcaggggcaag

SEQ ID NO: 3004 - RNA, 75 nt, Homo sapiens
cuucccucaguuccucaggcucagauuuuucuccucaggagcaucagaucugggagcccuggagggcuggggaag

SEQ ID NO: 3005 - RNA, 107 nt, Homo sapiens
cggccaugguuucucagucaccccucaaggaguugacacuuuggggcccaugaaguuuuuuagcccuaaaacauguugacucuuuaaauggcuguggaaucuggcug

SEQ ID NO: 3006 - RNA, 85 nt, Homo sapiens
agcuguuggaggacauuaggaagggaagggaaaugauuggauuugcauuuagaaaguuaaggccuuccaagugccuucugcagcu

SEQ ID NO: 3007 - RNA, 76 nt, Homo sapiens
uauggauuauaaacugugggcauuuauuuacacuuucacuauaggauaagugagaucucacaaauuguauucuaug

SEQ ID NO: 3008 - RNA, 82 nt, Homo sapiens
gaguuaugagguagcuguggcuggcuggguuuugaugaaguacccauaauuucauaucagcugccacaggacuuucugacuu

SEQ ID NO: 3009 - RNA, 66 nt, Homo sapiens
uuuucuucaaggauaagucauaugucaaguaaaaugucugagcauaugacaacaucuugcagaaag

SEQ ID NO: 3010 - RNA, 68 nt, Homo sapiens
uccuuguccucucagaguugucugccugaaucuuguuuagugugacugaucauucuagaggcugggga

SEQ ID NO: 3011 - RNA, 80 nt, Homo sapiens
gguacuugaagagugguuaucccugcuguguucgcuuaauuuaugacgaaucauacagggacauccaguuuuucaguauc

SEQ ID NO: 3012 - RNA, 64 nt, Homo sapiens
cccaaauggccagaucugugcaagacaaucucauuugacacuuagcuugccaugguccuuuggg

SEQ ID NO: 3013 - RNA, 60 nt, Homo sapiens
gguggcucguuuuucuugaaaggcuaaguaacuaaugccuuuuauugaugaauggccacu

SEQ ID NO: 3014 - RNA, 91 nt, Homo sapiens
gucuuuuaacucuauauugcugguggcucugauuucaugaugcauugugcuuaugaaacucuagcuuucagcacuaaaaugaguuaaagau

SEQ ID NO: 3015 - RNA, 80 nt, Homo sapiens
guauccucagcuuugagaacugaauuccauggguugugucagugucagaccucugaaauucaguucuucagcugggauau

SEQ ID NO: 3016 - RNA, 65 nt, Homo sapiens
ucugauucauugaacguucugauugauggagacaagaguuucagugaauguucuaaugcauuaga

SEQ ID NO: 3017 - RNA, 71 nt, Homo sapiens
uaguguugcuuucuuaauggcaaauuauuuuuucauggacaugaaacuuugccggaagacaaguugcacug

SEQ ID NO: 3018 - RNA, 71 nt, Homo sapiens
cccgguucccagacugcacuggaacacugggcuuuaugcccccacauucagugcauuugguggguacuggg

SEQ ID NO: 3019 - RNA, 56 nt, Homo sapiens
auuuuaugggauuuccuggcuuuuaaaguaaaagccaguuaaaacucccuugaaau

SEQ ID NO: 3020 - RNA, 81 nt, Homo sapiens
ccaaaguagaaagcaagacaaacacuuuucagauuuucacuggugggaguauuuucuguuguuguuuugucuucucuuugg

SEQ ID NO: 3021 - RNA, 83 nt, Homo sapiens
ucaggcugugacccucuugagggaagcacuuucuguugucugaaagaagagaaagugcuuccuuuuagaggcuuacugucuga

SEQ ID NO: 3022 - RNA, 69 nt, Homo sapiens
uuuuuuuuucccuucucccuucaccauuaccccacuuugugguaggaaagggaggacaggaacaggaga

SEQ ID NO: 3023 - RNA, 68 nt, Homo sapiens
auauguuaucacugugugagcugaaaguaaccauuugguaugaugcagcuaacauucugguuacgugu

SEQ ID NO: 3024 - RNA, 109 nt, Homo sapiens
ugccauugacagcaggagaaaagcagaaaucugaaggcaugauuucaacagcagauuaaauagagcugaaggcaucauguuuuggaucauguuugugguguucauggua

SEQ ID NO: 3025 - RNA, 90 nt, Homo sapiens
gcacugugggugcauugaggguguuuuauuguacacagagggaagcuuucucuaaagugcagguauaacaccucuucaaaccccuagugc

SEQ ID NO: 3026 - RNA, 185 nt, Homo sapiens
uacauuuucccggauggaagcccgaaguuugagggagaaacuugugaggaaauaaaggaaguuaggcugaggggcagagagcgagacuuuucuauuuuccaaaagcucggucugaggccccucagucuugcuuccuaacccgcgcuugaguuucuccccgcuuggaugcucucaggggcagugug

SEQ ID NO: 3027 - RNA, 90 nt, Homo sapiens
ucacauuguuuucauucuuuuucuguuaguuugaguugggaacagaauuaugaagccaaaauaauagagaagaggugucuaagcaugugg

SEQ ID NO: 3028 - RNA, 117 nt, Homo sapiens
gguguguggccuccuccucuuccucgagggccucugggagggagccgcgugugccucauggguguuuggcuccuucccaguuuugcucuggggaccugcauucccuggcccugcacc

SEQ ID NO: 3029 - RNA, 85 nt, Homo sapiens
uaggggugucuuugcugccaauggcugcaagggguugacaacaucauuucagggacccucauucauuugcagcugggauuccuug

SEQ ID NO: 3030 - RNA, 67 nt, Homo sapiens
gaggggugcagaguggccaggaggugacacacuauacuguccacccccugccgccucuuguccccuc

SEQ ID NO: 3031 - RNA, 81 nt, Homo sapiens
gcugcuuggcacuaccagcauucuucucucuccuuuucucaguggaaaugaauucaaccaguguuguaguuggccagcagu

SEQ ID NO: 3032 - RNA, 116 nt, Homo sapiens
uguucuuggccaagggccuccgcugagccuggcacagccucggcuuggcccucaccagcgagugagggcuuggcuggggcccagccagggcgguggacaugauugaagcuagaaca

SEQ ID NO: 3033 - RNA, 70 nt, Homo sapiens
ccuguuuauuaucgucaucagccucaaugauuuccaaggaacggcagcaugcugugauggaaauaacagg

SEQ ID NO: 3034 - RNA, 76 nt, Homo sapiens
gguucaugcgaugguuggagggaugguaaaagcaguuagcucuugucagcugcuucccucugcuagugcuugagcu

SEQ ID NO: 3035 - RNA, 109 nt, Homo sapiens
gacuagugggagagccacauuuucuggugaucaaagacucugaggcuuucaucugcaagugccugggagaauguugaacaucuuggaauuugucauaucgccuuugguu

SEQ ID NO: 3036 - RNA, 55 nt, Homo sapiens
cagcaguggaaacaaggccugaggguccuggggcccugagccgugcuccuugcug

SEQ ID NO: 3037 - RNA, 112 nt, Homo sapiens
ucaguuucucaucuuuuuccugccgagcccauucaagcacgaagcuuccuuuugaagacagagggagcuuugugcuugaauucguuccgcagggaaacagucagagaacuga

SEQ ID NO: 3038 - RNA, 88 nt, Homo sapiens
aggaggugaccagccccgggauggaggggaaguacucuggcucuuggcacagugacauuccucuuugucccuuugcuaguuucuuccu

SEQ ID NO: 3039 - RNA, 70 nt, Homo sapiens
ggcaaguggugagggcgaggcgugggcaggugguugaagagccacgagcguccucucccagccucuugcc

SEQ ID NO: 3040 - RNA, 80 nt, Homo sapiens
ggggaaugaagaagagguaggaacguaguaagugaaaacauuugugcauuucauuugcuaguucugccugauuuuucccc

SEQ ID NO: 3041 - RNA, 81 nt, Homo sapiens
gugggaugagguaguagauuguauaguuuuagggucauaccccaucuuggagauaacuauacagucuacugucuuucccac

SEQ ID NO: 3042 - RNA, 94 nt, Homo sapiens
gucuuuuguaguggcuaaggcuuccuugggaacaacaggaccuggccccagggccucugguuuccagggcagaugccuuuagcauaccaaggac

SEQ ID NO: 3043 - RNA, 82 nt, Homo sapiens
ggggcauggguaggacccuggagggguuuucagucccuucauggacuuggagacugucagccccuccuggccuuccugccuc

SEQ ID NO: 3044 - RNA, 102 nt, Homo sapiens
uguguguguauauucuggugccuccucuagcuuguagcauucuuaucacaaucaaacagauguugggcugagaguugggggaggauaagaagcugccacaca

SEQ ID NO: 3045 - RNA, 109 nt, Homo sapiens
ugcuguuguuuugccaaauguaacugucacuuuuuauugaaacaucagaaucagacauuuaauucucacaguuuugaugcuuaaugaaaagugaaaguuaaacacagca

SEQ ID NO: 3046 - RNA, 82 nt, Homo sapiens
uccccauggcccugucucccaacccuuguaccagugcugggcucagacccugguacaggccugggggacagggaccugggga

SEQ ID NO: 3047 - RNA, 78 nt, Homo sapiens
aguuguuugaggaguuaauccuagcaaaaauaggucagcaucuuuucuccuuuucuugggauuaacuccacagcaacu

SEQ ID NO: 3048 - RNA, 68 nt, Homo sapiens
gggcgcuccagucucgacguucccgggguagagagcaacguccggggacgaacgggacgggugcgccc

SEQ ID NO: 3049 - RNA, 56 nt, Homo sapiens
ucauuguguaguagagguggcaccauuuuacuauguguccucccugcacucaguga

SEQ ID NO: 3050 - RNA, 58 nt, Homo sapiens
cagcugugaaagccauuuccaggcgacuauaaauugugaggaaauggccauccagcug

SEQ ID NO: 3051 - RNA, 69 nt, Homo sapiens
aguaucuugcagccagccgcugggaugacgcccuuuggaacagaucagucggcucaggcucaugauacu

SEQ ID NO: 3052 - RNA, 107 nt, Homo sapiens
ugugugucacugggaagcuuacugucucugaucaaaugcauguggugcugacacaagguccccacugugcaggugauaugggacaguccgccuauacauugcacgca

SEQ ID NO: 3053 - RNA, 64 nt, Homo sapiens
acuggcugacccuggggagcuagcugccuugauucauuaauagcuguuccugagucuugccagu

SEQ ID NO: 3054 - RNA, 74 nt, Homo sapiens
cugagcucuguauacagucugggcuugggucaaggccaagggcagcaacagcccagaaagaguaaagugcucgg

SEQ ID NO: 3055 - RNA, 79 nt, Homo sapiens
ugguacucggggagagguuacccgagcaacuuugcaucuggacgacgaauguugcucggugaaccccuuuucgguauca

SEQ ID NO: 3056 - RNA, 70 nt, Homo sapiens
caggggugaguccucuccagggauggaucccaaacauggagccugcuguacccuggagagguccccccug

SEQ ID NO: 3057 - RNA, 74 nt, Homo sapiens
ucuucuucuugaguaacaucagauucuucaucagugccaacugaagucccacucugauucaacuuggcaggaga

SEQ ID NO: 3058 - RNA, 73 nt, Homo sapiens
ggccuuuucucucucuuuuguuccugccuaacuucuuuugacauccugccagggccagauggaggauagggcc

SEQ ID NO: 3059 - RNA, 131 nt, Homo sapiens
ccucccuguuggcccacagcugcuaaaaaacaaggugaguggugcuuaaguucaggcuugauaaaccacaacugagcuggacuuugcaccacuucacccucuacagcagucacugaauuccugcugggagg

SEQ ID NO: 3060 - RNA, 109 nt, Homo sapiens
uagaguucauauuuacaaagugugugcaugccuauguguaucacuaauauguaguauaugcauacuaaauaugcacauggguauuucaaacucuguuggcuugacucua

SEQ ID NO: 3061 - RNA, 77 nt, Homo sapiens
ggauucugccagcauagugcuccuggaccagugauacacccggcacccuguccuggacacgcuguuggccuggaucu

SEQ ID NO: 3062 - RNA, 77 nt, Homo sapiens; identical to SEQ ID NO: 3061

SEQ ID NO: 3063 - RNA, 60 nt, Homo sapiens
uugauguuuugguuuucacugaacaguaguaacacuguuccuuguaaccaaacucauuaa

SEQ ID NO: 3064 - RNA, 72 nt, Homo sapiens
ucccucuuucccccugguuuggcacauaccuccuucagggagccugagccgaguagggaggggacugaggga

SEQ ID NO: 3065 - RNA, 92 nt, Homo sapiens
ccugggucugggagugcugagguuggggcuugggcuuccugcuugucuagaaaagggccaaaucucagcuccagucauuguuggucuccagg

SEQ ID NO: 3066 - RNA, 100 nt, Homo sapiens
guauggugcacugcagccuggucccuguccuccuggaccucugaacaggaugcaagaggagcaggagcguggaccaacgcugcccuaccugcucccaugc

SEQ ID NO: 3067 - RNA, 127 nt, Homo sapiens
acagaguggccccuucucuguaccuauggaucuuggacucccaagaccuuucccugaaugugguaagaauuuaauaagaaagguucuugggaguucacagaccagggacagagugaaccuucucugu

SEQ ID NO: 3068 - RNA, 99 nt, Homo sapiens
aggucaucuuucugaaaucccuacuuuuuguccacuucugauuaguuaauucucaggccuguuugcagaagguggguguuucagcgagucuauugauuu

SEQ ID NO: 3069 - RNA, 152 nt, Homo sapiens
gccuggugcuagucacuggggcaaagaugacuaaaacacuuuuccugcccucgaggagcucacagucuaguaugucucauccccuacuagacugaagcuccuugaggacagggauggucauacucaccucgguguugcccaaaccuccaggc

SEQ ID NO: 3070 - RNA, 70 nt, Homo sapiens
gugggguaggauguguucucguuacuaguaauuccuggaacagaaaacgagaaaacauauccgucuccac

SEQ ID NO: 3071 - RNA, 70 nt, Homo sapiens
gugggguaggauguguucucguuacuaguaauucuuggaacagaaaacgagaaaacauauccgucuccac

SEQ ID NO: 3072 - RNA, 70 nt, Homo sapiens; identical to SEQ ID NO: 3071

SEQ ID NO: 3073 - RNA, 70 nt, Homo sapiens; identical to SEQ ID NO: 3071

SEQ ID NO: 3074 - RNA, 70 nt, Homo sapiens; identical to SEQ ID NO: 3071

SEQ ID NO: 3075 - RNA, 70 nt, Homo sapiens; identical to SEQ ID NO: 3071

SEQ ID NO: 3076 - RNA, 70 nt, Homo sapiens
gugggguaggauguguucucguuacuaguaauucuuggaacagaaaacgagacaacauauccgucuccac

SEQ ID NO: 3077 - RNA, 70 nt, Homo sapiens; identical to SEQ ID NO: 3076

SEQ ID NO: 3078 - RNA, 70 nt, Homo sapiens; identical to SEQ ID NO: 3076

SEQ ID NO: 3079 - RNA, 70 nt, Homo sapiens; identical to SEQ ID NO: 3076

SEQ ID NO: 3080 - RNA, 70 nt, Homo sapiens; identical to SEQ ID NO: 3076

SEQ ID NO: 3081 - RNA, 159 nt, Homo sapiens
gcaaaguaccuagcccauguccuaguauguaacgggagcucaauaaacagcaggucuugacagguguagcacugaaggucuacagaggugcugcucuggccaggaacugcugauuauugagcuccuauuguaugccaggacaugagcuaggggcuuugc

SEQ ID NO: 3082 - RNA, 106 nt, Homo sapiens
aaguguuaucaguuuaaugaacuacuuaugaaguguuaaaugcaugcaaguguaaacugcaacaucuggguuuguguuuuauuuguagacuucaaacugggcgcuu

SEQ ID NO: 3083 - RNA, 85 nt, Homo sapiens
uuaagcuauuuaauucuacuucagaaauacuaucuccuuguuuauucaguggcugugcgucuggaguggaguuugaacugcuuaa

SEQ ID NO: 3084 - RNA, 73 nt, Homo sapiens
ucuucauauagggugauaaaaccuucugcucguguuucaggcagcggaggguuuucuucuuuccuacugaagg

SEQ ID NO: 3085 - RNA, 55 nt, Homo sapiens
augucauagucuauguugccaaggcaacaacacagccagcaacagaggcugacau

SEQ ID NO: 3086 - RNA, 69 nt, Homo sapiens
aaggguuauauggauauuuugaguuauuucauaugcauuuaggaauaacccaagauaugcauaauccuu

SEQ ID NO: 3087 - RNA, 76 nt, Homo sapiens
guguuguaggcaguggggucucucuguaccucccacccuugaggagggagguaaagaugagcucaguguccaacac

SEQ ID NO: 3088 - RNA, 68 nt, Homo sapiens
augaguuagcccguuucaauagaguccaaccccaguauaaacuucugaaugaaagagggccugcucau

SEQ ID NO: 3089 - RNA, 70 nt, Homo sapiens
gugaauuagguaguuucauguuguugggccuggguuucugaacacaacaacauuaaaccacccgauucac

SEQ ID NO: 3090 - RNA, 123 nt, Homo sapiens
ggguucuaguuuucagcagcaucuuccgccuuuggcaauggauggucaucuagugcaauguuuggcacacaguaggugccauguauaugucaaauggauaacugagugaaauagcaugaaccc

SEQ ID NO: 3091 - RNA, 86 nt, Homo sapiens
uagauuuauuugcauguguguguguggaauacaaggaauuucagaacuaaauguguugcacauauuuggcauguaaacauaaucua

SEQ ID NO: 3092 - RNA, 94 nt, Homo sapiens
auggauuacuugguauugcuguccagaaaccugacucucauaccauuuuggggggaagagagguuugggacagcaauuaaugaagcauauccau

SEQ ID NO: 3093 - RNA, 79 nt, Homo sapiens
uuaggcuaagcugggaguugguggggugggauguggggcauuggccccauuagucccaguuuaccaggcccaggucuga

SEQ ID NO: 3094 - RNA, 68 nt, Homo sapiens
ggccuuuagguuguaagcacauuugauuuuuauagacagaaaugcugagauguacuuacuuugaggcc

SEQ ID NO: 3095 - RNA, 111 nt, Homo sapiens
ccuuccuaugccagcugauccccuaggcccuaggcuuccaucauaucacugagcaaagcacagggcaguuugagugggggucagaggccuggggggucuuuggcuggaagg

SEQ ID NO: 3096 - RNA, 92 nt, Homo sapiens
ucccaguauuuagugggggcagaaucagguaguuauaaguggcuagcuagccaggaggaaagacuugguacugaucccuuccuagcuuggga

SEQ ID NO: 3097 - RNA, 168 nt, Homo sapiens
ggaggcuauaaaauccccugagaaugcaaggguaagcuucuaccuccuggccgaauucucacccacagaaguagacacugcugcuguugaaucuacuucugugagugagaauucagccaggagaauccaaagugcucuucguaugaacuuugggagacccaugccucc

SEQ ID NO: 3098 - RNA, 101 nt, Homo sapiens
ugcacguaucuacuuuuaaagugguuguaauuuguguucagaguaagaggacuaucuuuucuagacuccaaauugcagacuuuuaaguauaaauucgugca

SEQ ID NO: 3099 - RNA, 128 nt, Homo sapiens
gauaucuauuuccuugccuccuucuuuccucccucucucugggcuuuguccugagacauccggaaaggaaagggcagucagacagcagccacagggagagggugguaaguggggaggacuuugguauc

SEQ ID NO: 3100 - RNA, 76 nt, Homo sapiens
acacucuauucaacuaccucuauagcccugcuaucccuuagggaagcagcaggagccgaggggcuggucugagugu

SEQ ID NO: 3101 - RNA, 90 nt, Homo sapiens
ugcuagucauuucugcuacacaaaaauccccuggucacuuuuuguuauuugugugaccagggaauuuuuauguagcagaaauagcuagua

SEQ ID NO: 3102 - RNA, 75 nt, Homo sapiens
auggucucugagccuuccuguggccaccagcacauucugugcagccccaggaccacaugggaggcucauggccau

SEQ ID NO: 3103 - RNA, 69 nt, Homo sapiens
augggcucugggggucaggcagcugggaaggaguuuagaacccaugccuaggccuuccccaaggcucau

SEQ ID NO: 3104 - RNA, 84 nt, Homo sapiens
aacuggucggugauuuagguaguuuccuguuguugggauccaccuuucucucgacagcacgacacugccuucauuacuucaguu

SEQ ID NO: 3105 - RNA, 55 nt, Homo sapiens
ggcauuuccuucuauugacuucagagaugccuuccucaagucagaagugaaugcc

SEQ ID NO: 3106 - RNA, 60 nt, Homo sapiens
acccuuuccugugcccuuuuaagguugacccagugcuuuaagaggcuaacacagaagggu

SEQ ID NO: 3107 - RNA, 79 nt, Homo sapiens
cacuaguccguuagcuaucuggguugcagggaccuucuacacaugauucucuccuguaccccagaguagaugcuuagug

SEQ ID NO: 3108 - RNA, 83 nt, Homo sapiens
cugccauccugcucuuuuauaugugagaggcauucaggauacuuucuuucuuucuucucacauaagaggauccaguguggcag

SEQ ID NO: 3109 - RNA, 83 nt, Homo sapiens; identical to SEQ ID NO: 3108

SEQ ID NO: 3110 - RNA, 79 nt, Homo sapiens
cugccauccugcucuuuuauaugugagaggcauucuggauacuuucuuucuucucacauaagaggauccaguguggcag

SEQ ID NO: 3111 - RNA, 79 nt, Homo sapiens; identical to SEQ ID NO: 3110

SEQ ID NO: 3112 - RNA, 79 nt, Homo sapiens; identical to SEQ ID NO: 3110

SEQ ID NO: 3113 - RNA, 83 nt, Homo sapiens
ggccucucucuccguguucacagcggaccuugauuuaaauguccauacaauuaaggcacgcggugaaugccaagaauggggcu

SEQ ID NO: 3114 - RNA, 61 nt, Homo sapiens
gucuguuccccccucccgcccagucuccucccccugggaacgcgcggggugggugacagac

SEQ ID NO: 3115 - RNA, 70 nt, Homo sapiens
ucugaaucacgcuugcaaacugucucaguugccaggcccuguuuucaagacaguuugcacguuuuucaga

SEQ ID NO: 3116 - RNA, 82 nt, Homo sapiens
gccuucucagugagcuaccugugcaaguaaauuaaaucaaacauuuaauguuagcugugcagguuacuucauuuaugaaggu

SEQ ID NO: 3117 - RNA, 90 nt, Homo sapiens
ugggcuucaucuguuacugguuuuauuuuuuuccucagccuacagccaguuguggaaggaauuaaccaguaaauuccagguccuaguuca

SEQ ID NO: 3118 - RNA, 88 nt, Homo sapiens
acaucuucagguaaagagagggauuucucaaucuacuuucuguuaugucagacuauaagagaaacccuuucagcugcuuucuagaugu

SEQ ID NO: 3119 - RNA, 95 nt, Homo sapiens
gcuccuucuguuguccuaaggaugaaggcgcucccuguccuuugcagaggcucccuuagcggggggugcuuccucauuaggaugcaaaugggggu

SEQ ID NO: 3120 - RNA, 114 nt, Homo sapiens
gguagcucgcuggggaaauaaagugucugagcuggaugugcaaacugaccuggaucguuuuaguuuugcauucacguuugcacuuuguaaauauuugccuggcacccugcugcu

SEQ ID NO: 3121 - RNA, 102 nt, Homo sapiens
cccaagucagguacucgaauggagguuguccaugguguguucauuuuauuuaugaugaguauuacauggccaaucuccuuucgguacucaauucuucuuggg

SEQ ID NO: 3122 - RNA, 97 nt, Homo sapiens
gccucuuccuccuucucaguacugucaaucuuacuuggguucaacauuugaccaagauaggagagggcagugcuugguauauaaaaggaacagaggc

SEQ ID NO: 3123 - RNA, 77 nt, Homo sapiens
cugagauccgcggcuucucggacggcugguuucuuagggaucugagaugccugcucuccagacugcugcucucucag

SEQ ID NO: 3124 - RNA, 74 nt, Homo sapiens
ucucucuccuaauugguggaaaauugguugcuaacugucaggaaauugccgauuuuccauccauuacugggagg

SEQ ID NO: 3125 - RNA, 93 nt, Homo sapiens
gagagcuccacaaaaggggguaacguuggauuacuugcuuuaaaguggugugcuccuuugaagcagguauguucaauuuuuuuucuuguucuc

SEQ ID NO: 3126 - RNA, 66 nt, Homo sapiens
gagugaucuuucccuucagcguuagccuaauaacaacuuggaggguggggcugaaggaauucacuc

SEQ ID NO: 3127 - RNA, 117 nt, Homo sapiens
gaguucucugauauguccuuugagcuucccuuagacgcucuuagacuacuguauugggagaaugcaguaguggcuaagagccugggccguggaguuggacugacuagguuugaacuu

SEQ ID NO: 3128 - RNA, 96 nt, Homo sapiens
uaccucucuuuuuuggacaagagauggaggaagcugcuucuuuccuguguauaaguggagagaagccguuguucuccaucccuggucuaugaggua

SEQ ID NO: 3129 - RNA, 67 nt, Homo sapiens
gggugguggcugcucaagggaggaggcugcaauuuaaggcacccucugccuugagcagugcccaccc

SEQ ID NO: 3130 - RNA, 80 nt, Homo sapiens
gauauuugaggagagguuauccguguuauguucgcuucauucaucaugaauaauacaugguuaaccucuuuuugaauauc

SEQ ID NO: 3131 - RNA, 77 nt, Homo sapiens
gguuuaugauuuggaugcuuugggaaugggugaggccaacaguuuccacuucccugagggcagccgaguuguaaacc

SEQ ID NO: 3132 - RNA, 75 nt, Homo sapiens
guccucugcacagcuauuguucccaacacaggaggugagaacuuccuuaucaucagcagccuuuguguggagggc

SEQ ID NO: 3133 - RNA, 91 nt, Homo sapiens
ggcuucugccccacucaaucuggcucgcuaggcucugggguccaucuggccagcucuccugggcuuaguggcuaggucuggggugggagcc

SEQ ID NO: 3134 - RNA, 78 nt, Homo sapiens
ugagccugguuggggaaugaugggguggaacaguggugugcugggccauugguucuacaucuucugugacuggguuua

SEQ ID NO: 3135 - RNA, 73 nt, Homo sapiens
ccuggcuggaggggaagggagacuugggcaaguggaacaucagcuucagucgcucaucagaccucuggccagg

SEQ ID NO: 3136 - RNA, 85 nt, Homo sapiens
aaagaaugaucuugaaaacauuggcuucuaaaagucugcuugauaguaguguggacauuagagcuaaguuuuuagauuguucuuu

SEQ ID NO: 3137 - RNA, 67 nt, Homo sapiens
gcugaaugaaaagcagaaggaguugggaaauuuacaccaccuaucauccugcugccuuuuguucagu

SEQ ID NO: 3138 - RNA, 144 nt, Homo sapiens
gccgcgugcaacuguuuucgaaaaccugggaugaucauuuaaauguuuaaaauaugcacaugguaauucaaaacuaauuacccugagcacauuugaaacauuuaugccaucgucucuggauccugccuacugauugugcgcggc

SEQ ID NO: 3139 - RNA, 89 nt, Homo sapiens
ucugugugccaggcgcugugaucucuguagggacuaaggauaaacugaaaauaaucuuggcccucuagagaaggcagaugguccacaga

SEQ ID NO: 3140 - RNA, 139 nt, Homo sapiens
guucagugguauugcaaagaggacagaugguuuuagggaggccuugugaaggaggcuguuuugcagauggagacacuguugguggcugcagagguuuuccagauccuguuuggcuuacugguuuuguagauugcugagc

SEQ ID NO: 3141 - RNA, 78 nt, Homo sapiens
acagggugggcggggggugaagaggaaaggaugggaagggggcgucccuaaaacuguuuucaccccacccugcccugu

SEQ ID NO: 3142 - RNA, 87 nt, Homo sapiens
acuggguggugacuaaggguguuuguugucauaguauuccucaugcuuuucauauacuuuacaaauagcccuuugaaacugcucagu

SEQ ID NO: 3143 - RNA, 84 nt, Homo sapiens
auuuccugaggauuaaugaucaacuggaagagcuugugguccugggaccauuaacuccauguggucauuaauuuuguuggaaau

SEQ ID NO: 3144 - RNA, 88 nt, Homo sapiens
ucucuauguuaggcguuucugcagacauccuuggccggaucugaucgcuggcucugggguggcuguggaaauguguagauauuagaga

SEQ ID NO: 3145 - RNA, 67 nt, Homo sapiens
uucucaugagccaugauuagccucaggucuauggaaccuucugcagcuaugucauggugacugagga

SEQ ID NO: 3146 - RNA, 103 nt, Homo sapiens
ccuccgugacccauggcccgugauaaagguguuggaacaaucgugccaauauggccacaggaagcaugauuguucucuccuugcgcauugcaggggcuggagg

SEQ ID NO: 3147 - RNA, 67 nt, Homo sapiens
caggacugauauucagcuggaauguacugguggccuuaaccauugcuuccaguuggcuaauguucug

SEQ ID NO: 3148 - RNA, 64 nt, Homo sapiens
gugggcugggguugaugagaaggauugaacuucauuuaugaauccuuucuucagcuacgcccau

SEQ ID NO: 3149 - RNA, 81 nt, Homo sapiens
ugggguugggcucagccaguagaucgggaggauguaggauauugugccaacauagcuucaaucuauuggcuagcaacucua

SEQ ID NO: 3150 - RNA, 91 nt, Homo sapiens
ggugaguggagagggagcaguuucucuaacagcuggggaaaggggaucaucucuaaagcugaaggggaagaacugcuccguaaaccucacc

SEQ ID NO: 3151 - RNA, 99 nt, Homo sapiens
cuccccuggugguagggggcugggaaauggagauagggugcauaguuugaaaauuaaaaagccuccuauuucagauucucacagauuucuacuggggag

SEQ ID NO: 3152 - RNA, 89 nt, Homo sapiens
gagguauuaccuuuuucuccuaauuuuucucacagccuuuguuugcaucccccugugagaguguuuuagggagaggaagguuuuacuuc

SEQ ID NO: 3153 - RNA, 86 nt, Homo sapiens
uauaaguuaugaaaccuggauauuuuagggugcaguuaguuuuuaaguuuuuugaaccuaaaguauuuaccagguuucauuuugua

SEQ ID NO: 3154 - RNA, 86 nt, Homo sapiens
ggcaacuuaugggguuuagcuuuuaccccauguacuucccggcuguaauaacuggguuaucaggguugagugaaucccauguugcu

SEQ ID NO: 3155 - RNA, 94 nt, Homo sapiens
ccuuaguucugcucuaggcuaauuguaggucaagucugcuuggagugaaacugaagcagaccagaucuaaaauuaggcuagagcaggcuuaggg

SEQ ID NO: 3156 - RNA, 94 nt, Homo sapiens; identical to SEQ ID NO: 3155

SEQ ID NO: 3157 - RNA, 103 nt, Homo sapiens
aauggguuccuaggaagagguaguagguugcauaguuuuagggcagggauuuugcccacaaggagguaacuauacgaccugcugccuuucuuagggccuuauu

SEQ ID NO: 3158 - RNA, 67 nt, Homo sapiens
ucuucauuuuacaggcagaccugucuaacuacaagccagacuuggguuuucuccuguaguuugaaga

SEQ ID NO: 3159 - RNA, 66 nt, Homo sapiens
ugggaguuguagucugccuuguacugucggcuaugggccgaagacgugagaagacuacgguuccca

SEQ ID NO: 3160 - RNA, 76 nt, Homo sapiens
gcuggguucuggagucagaaugucugguuuagaaucuuagcuaagugggacuuccguuuugucuccaggucucagc

SEQ ID NO: 3161 - RNA, 62 nt, Homo sapiens
guggcuuuucauuauaaauuuugcauguaaacacuuugcauguucugauuuaaugaggccau

SEQ ID NO: 3162 - RNA, 56 nt, Homo sapiens
gagguuuucuggguuucuguuucuuuaaugaggacgaaacacaccugguuaaccuc

SEQ ID NO: 3163 - RNA, 80 nt, Homo sapiens
gaaaaguucugacagccagaguucaucaguuaaggacaugccuuagagcuuaacugauggacucuagcagucagcuuuuc

SEQ ID NO: 3164 - RNA, 80 nt, Homo sapiens
gcuacguuguguguaucugaaguuaaacauacucaaaaaaagagagguaauaaacucuucuucagauccacacucguggu

SEQ ID NO: 3165 - RNA, 73 nt, Homo sapiens
gaguccuuucccugucucccucccaaaaaaguggaggcuuuuagcccaccggacuggagggaggggagggcuc

SEQ ID NO: 3166 - RNA, 84 nt, Homo sapiens
ugggcuuuggagauguaggcagguggaggagugaaggcccaaggauggcucuucagcccuucccuguuuucaucagccagccua

SEQ ID NO: 3167 - RNA, 116 nt, Homo sapiens
guguuguuguugauuugguuguuuuaaagauuuccccccgcccccauuuucuuaaaauagaguguugugguggggaggggggcagguccaguuuguagauuaaauccacucggcac

SEQ ID NO: 3168 - RNA, 70 nt, Homo sapiens
guuuguuugcuuuucucuaguugguaauguugguuaagacacugacuggcuuuggaaaagcuauauagau

SEQ ID NO: 3169 - RNA, 76 nt, Homo sapiens
agaugauuaccauggaguuuggagugagaggguucaagucccagcucucucacuucugagcucugguuacucaucu

SEQ ID NO: 3170 - RNA, 73 nt, Homo sapiens
gcauguuuggucaugaaugucagugugacauuucagucauuuaaaucauugacgaucauguacuuuuaugugc

SEQ ID NO: 3171 - RNA, 71 nt, Homo sapiens
guuuaauuuuagugugggcugcuuugaauuuugcuuugacaaucaacaggggcucacaguaaugcuuagac

SEQ ID NO: 3172 - RNA, 157 nt, Homo sapiens
accucauucaccucuacccaacccauccccucugccuuuuccucuuguugucuuucuucuggcaguuuuguuucacucaagggcagucaggaagagaaguaaagauagaggaaaaggaaauuuauuuugggugcaguucaggagguguagcuggggu

SEQ ID NO: 3173 - RNA, 91 nt, Homo sapiens
uucucuuuccucagguggccaggugcauaucuuggugugaggaccuucacuguaucugggaaugccuacugguuaccuugguaacagagaa

SEQ ID NO: 3174 - RNA, 91 nt, Homo sapiens
uucucuuuccucagguggccaggugcauaucuuggugugaggaccuucgcuguaucugggaaugccuacugguuaccuugguaacagagaa

SEQ ID NO: 3175 - RNA, 91 nt, Homo sapiens; identical to SEQ ID NO: 3174

SEQ ID NO: 3176 - RNA, 91 nt, Homo sapiens
uucucuuuccucagguggccaggugcauaucuuggugugaggaccuuugcuguaucugggaaugccuacugguuaccuugguaacagagaa

SEQ ID NO: 3177 - RNA, 90 nt, Homo sapiens
uucucuuuccucagguggccaggugcauaucuugugugaggaccuucacuguaucugggaaugccuacugguuaccucgguaacagagaa

SEQ ID NO: 3178 - RNA, 79 nt, Homo sapiens
cuccccuucucugagaaaggcaggagaucuagccccaucccuguguuagagcuccaccucccucagggccacuggggag

SEQ ID NO: 3179 - RNA, 119 nt, Homo sapiens
ugucuauuacagcacuuagcauaggguggagugggggaaggaguguuauuuagcagaguggaccaagcacagcuugcauuccaguccccacuguguccuaagcugugugauuuuggaca

SEQ ID NO: 3180 - RNA, 83 nt, Homo sapiens
ucaguuuuauagacauguugacaauaaagucuaccaugugugucucccugccauggugauuauuuugcucaauaugugauuga

SEQ ID NO: 3181 - RNA, 77 nt, Homo sapiens
uaaacauucuuccucugaggcacuuguuuagccauguagaagccauucaggggcuaugccuagagaggaauuguuua

SEQ ID NO: 3182 - RNA, 70 nt, Homo sapiens
guuggauucggggccguagcacugucugagagguuuacauuucucacagugaaccggucucuuuuucagc

SEQ ID NO: 3183 - RNA, 122 nt, Homo sapiens
ucuucuuucacauucucaaugucagaggaggguaucaggugagguuggaggagauguuggaggcuggcaggggaaacaaaaaaugucugauacuccuggaggagaggagaaugaauagaaga

SEQ ID NO: 3184 - RNA, 122 nt, Homo sapiens; identical to SEQ ID NO: 3183

SEQ ID NO: 3185 - RNA, 66 nt, Homo sapiens
cuuaaauugcuacaguaauucaagagacagcccugucuggacacagaguuacuguggauuuuuaag

SEQ ID NO: 3186 - RNA, 161 nt, Homo sapiens
gcucccuugaagcaagaaagaaggucccagggcugcaaaacuggaagcacagccucuaggauggggagggaaagaugguacuauauccaguuccugcucucugcucauggguggcugugacaacccuggccucacuugauuucuugccacccccugggagu

SEQ ID NO: 3187 - RNA, 56 nt, Homo sapiens
guggguuuuuggucuccccaggaaacuugaguucacugggagggagaucagcccac

SEQ ID NO: 3188 - RNA, 66 nt, Homo sapiens
gaaagauuucauuugcuaugcuuucugccuuugcgucuggguagcauuguaggcagguguucuuuc

SEQ ID NO: 3189 - RNA, 86 nt, Homo sapiens
caaugcuuugcuagagcugguaaaauggaaccaaaucgccucuucaauggauuugguccccuucaaccagcuguagcuaugcauug

SEQ ID NO: 3190 - RNA, 104 nt, Homo sapiens
uggcaguuuauguuuuugaggcucacucuacacagauagaauggggacugcuggcagugccucagguuauugguggggguaagaaagggcauuucucucugcca

SEQ ID NO: 3191 - RNA, 103 nt, Homo sapiens
agccucuuucuuacacgcaaugaauuuugcccacaaugggcuaauugccaaagcaguucgccaccugugggaguaauuagucacgugucagucuucugagguu

SEQ ID NO: 3192 - RNA, 93 nt, Homo sapiens
uauugcuuuaaauguauucuguggaauuagucuuugucccacccucgauuaaauuugggacaauaugacuauuccauuuauucaugugcaaua

SEQ ID NO: 3193 - RNA, 79 nt, Homo sapiens
ccaugcuuugggugcucauggagcagauuagucagcacucagcuugguugacuugguccuugggcacuauugugcaugg

SEQ ID NO: 3194 - RNA, 91 nt, Homo sapiens
uucuucuuuuuauuggguuuucuggaaaauaggcccuuuuuuccacaggcagucuaggacuauuuuccugaaaauuagauauaaugaagga

SEQ ID NO: 3195 - RNA, 111 nt, Homo sapiens
uuuuccuuuugcuuguauuuucauuuuguugaucucaagauuuacucccaucucaagauauguugagaugggagaauuugaaguuaaaauguagaaauauaaauuggaaaa

SEQ ID NO: 3196 - RNA, 55 nt, Homo sapiens
cuccucuuuuggcaccuuccucugcaacagcgaaaaggagaggugagcugagggg

SEQ ID NO: 3197 - RNA, 83 nt, Homo sapiens
gccauugucccuuuucucuauggguaaggcaagcucuuucuacuaucaucuggguuccuugauagagagaagggauagauggc

SEQ ID NO: 3198 - RNA, 66 nt, Homo sapiens
cauuuccaaagugucuuuuaagcauuauccgguuugacucuuaucuacaggacacuuuggcaaaug

SEQ ID NO: 3199 - RNA, 75 nt, Homo sapiens
agcucccccagugccuucugcuccuggauccuacccuuuuauccaacaucccugcaaaaggcacuggggugggcu

SEQ ID NO: 3200 - RNA, 136 nt, Homo sapiens
ugaaucaaaaucugcaacuuaucaagcugcccaggcgauugcuaaugugcauaggaauucugaaucugaagaauaugauuccugugcacauuagggaucaccuggggagcuugaucaauugcagauuuuguguucg

SEQ ID NO: 3201 - RNA, 76 nt, Homo sapiens
ggguggaggaggggcagccagccacugugagcccugaagacauguggggcugagggcggugccucucuucucaccc

SEQ ID NO: 3202 - RNA, 69 nt, Homo sapiens
agaagaacagauagaggcucccauguaagucaguagggacuucguguuuguuaucuaucuguuguuucu

SEQ ID NO: 3203 - RNA, 113 nt, Homo sapiens
gcugggcguuuuuaauacaacgguggguggcugguacugacggaggggauuugggaucuccaccccuuccguuucccucacuauuccaggcccuguuuuggaaaugcuucagc

SEQ ID NO: 3204 - RNA, 56 nt, Homo sapiens
ggguugaggcggaugucggcgggaacaucggccuuguccucguccgccucgaacuc

SEQ ID NO: 3205 - RNA, 74 nt, Homo sapiens
ucaggcucuccaguacauggggcaccguggggagcagcuguuccccugcuccagggucugcuggagagaccuga

SEQ ID NO: 3206 - RNA, 66 nt, Homo sapiens
caggaggagcugggcagcugucaugcucauccuaggaaugcaugugucccucccagcuccuuccug

SEQ ID NO: 3207 - RNA, 82 nt, Homo sapiens
ugacaccuggcuaccuggcugaaauaaauggcaugcuuugugcuguuuuaaauuuuucuugcucuguguggccaggcuguca

SEQ ID NO: 3208 - RNA, 156 nt, Homo sapiens
cccuuacagagauguauuugcuccccuuaucuuccuuccgucuuucuugauuaaaagcuaugugugauauuuguaguuaucaaacaucaauauuuggcauggauuggcgaaauggauauggggggaagaaaggagucugaccauuucuguaaaggg

SEQ ID NO: 3209 - RNA, 72 nt, Homo sapiens
ugguugaugaucaguggacauggcaugugaagaaauaacuccuuagccaugucacauauggucaucgaacca

SEQ ID NO: 3210 - RNA, 75 nt, Homo sapiens
ugucugaauuacauuuuauugagaaaugucuuuuugaaauagagacauugucaguaaaaguuguaauuuaagacg

SEQ ID NO: 3211 - RNA, 85 nt, Homo sapiens
aggucacaguuuaaucaaagaacuggguguuugccuugcacugguauauaccacccaguuuugcuugauguugggcuguagaccu

SEQ ID NO: 3212 - RNA, 56 nt, Homo sapiens
aacaguuggaagggccuggaucuuuagcucugggucuuuggacuuuccaauuuguu

SEQ ID NO: 3213 - RNA, 79 nt, Homo sapiens
gggguugguggggucgggcaggagggccggggauuggaagguuggccagcucuaccuccugcccuucccaccgcacccc

SEQ ID NO: 3214 - RNA, 77 nt, Homo sapiens
uguaucuguuaaaucucuuauuugcuguaaauugaguuuuguuuuaugguauguauaagagguauuagcagaauaca

SEQ ID NO: 3215 - RNA, 167 nt, Homo sapiens
uuuguaauauuaaucuuccccagccuccacuguccuagcuucuaccuccugucuuguagguaaauacccaagggaacugguuauuuacaacaccuaaggaaauuuaccuacaagagaggagguagaugcuaggacaguagaggcugggggagaguaguguuaacaag

SEQ ID NO: 3216 - RNA, 87 nt, Homo sapiens
gcugcuggccagagcucuuuucacauugugcuacugucugcaccugucacuagcagugcaauguuaaaagggcauuggccguguagu

SEQ ID NO: 3217 - RNA, 104 nt, Homo sapiens
cuuucuuuuaaccuaaugagacacuccacaggagacuaacauuucuuucgcugaauuccaaguguagguuuccuggguuguccauuuaauuguuaaagugagag

SEQ ID NO: 3218 - RNA, 69 nt, Homo sapiens
cugcuccaaugugccugucuuuuucuaggucaauucagcaugagauugacaaggaagcauuggaagugg

SEQ ID NO: 3219 - RNA, 119 nt, Homo sapiens
guguccaggauggaaagaaagccccuagcgcucuggggacucaaggauggaucuuaaggauggcacuggggagucuaucuuauuguccuuuagaaagaggggcuuguauccugagacac

SEQ ID NO: 3220 - RNA, 70 nt, Homo sapiens
cuccggggugugcggcugagggcagagguuuccgaguccuucucuguccucggcugcugcacucgcggag

SEQ ID NO: 3221 - RNA, 56 nt, Homo sapiens
caggcagcaggagcccugcucgcaucucccauuguagcuguggccuugcuggucug

SEQ ID NO: 3222 - RNA, 78 nt, Homo sapiens
gaauauuccugaggugugggugguugguuuccuuacaagguaggguuugcaagcuccuuacauccacaggggcuguuu

SEQ ID NO: 3223 - RNA, 84 nt, Homo sapiens
ucaggagcuggaauggggcccagagcucucaagccucugcucacccgcuugggacuggcccuuggcuccaggccagcucccuga

SEQ ID NO: 3224 - RNA, 82 nt, Homo sapiens
uuuguggguucacucauugcuuuuuccccaggucuagaagagugccuggcacauaccaagaagcaaggaagagcucaacaaa

SEQ ID NO: 3225 - RNA, 64 nt, Homo sapiens
gggacgccuugcagggaugcagugacugucuggcacuguuucuuguaucccucaaggcugucuc

SEQ ID NO: 3226 - RNA, 56 nt, Homo sapiens
gaaggugggggcuggaugcuuuguuaagcaggaaaugcaggccacccccagccuuc

SEQ ID NO: 3227 - RNA, 79 nt, Homo sapiens
uugccuucucccuggcuucugcacacggacgggucucuuuuggagcugaaagugugugaaaguuauuggagaaugguag

SEQ ID NO: 3228 - RNA, 97 nt, Homo sapiens
cuaagaucuggcaggacggagggcuccugaugcucuccagaugcuacugugucacgucugagaugggcuucgggagucgucagcccuagauccuugg

SEQ ID NO: 3229 - RNA, 98 nt, Homo sapiens
gaaacugguggcacagaagguaagggcugcagguucucuguccccaggcuccuggccagguggccucacccuuccaguucugacccccacuacguuuc

SEQ ID NO: 3230 - RNA, 75 nt, Homo sapiens
cugugagcucccgguguccugcaaacguuggccccugaaucaccgggccagugugugugggauggggcugcauag

SEQ ID NO: 3231 - RNA, 69 nt, Homo sapiens
uguggcgguggagagagggaaugugggaugauaguucugcccugcguugucucuuucauaccguucacg

SEQ ID NO: 3232 - RNA, 71 nt, Homo sapiens
uaauuaccagugugggaacggcuuuaugauccucaagggcccugaaagagccccccacaucuggucaauua

SEQ ID NO: 3233 - RNA, 97 nt, Homo sapiens
uaauacuaacuucacagggcugcugugaguuaauauuuguaaugccuuuaggauggcguuuggcacacaguaagcccuaagugaauguuggcuguua

SEQ ID NO: 3234 - RNA, 98 nt, Homo sapiens
gccugucaccugcgggguccggugcagcucauacagacucaguucccacguuuugcuggcauucugggcauucgccggcgucgucauggugaccgggc

SEQ ID NO: 3235 - RNA, 81 nt, Homo sapiens
guugggugauuuuucuguuucagaaaggacaggcuaagucagaguucagguauucuggaacagagaaacugucauaccaac

SEQ ID NO: 3236 - RNA, 86 nt, Homo sapiens
gcucccccucaccccggccucccugaacuuugggguugccguggugacugccuccaagggucagggccgaagggagaggguggggc

SEQ ID NO: 3237 - RNA, 104 nt, Homo sapiens
aaggagaggaaaaggcugauguggauggcugggaagagguucgaugguuaccuuggcaacugagcuuccuuccucauccccaucccucccuaguccuuguucuu

SEQ ID NO: 3238 - RNA, 79 nt, Homo sapiens
aaugaagcuuacaugucugacagagcuagacaaauagaaucagucauauguuuggcucugaucagauagaguuaucauu

SEQ ID NO: 3239 - RNA, 72 nt, Homo sapiens
gcccccgggaaggguuguugucuuugugccauauccaaacagagggcuuuuaauagcagcuuccuguggggc

SEQ ID NO: 3240 - RNA, 77 nt, Homo sapiens
agaggauggaggaggugaagauuuugggggguucucaucauuuucccuuuccaaguuucauccuuauccaugcuucu

SEQ ID NO: 3241 - RNA, 68 nt, Homo sapiens
ugccuaggcugagcucaggguucagggcaggaccagcucaggauccuguaagggcugagccuaaggca

SEQ ID NO: 3242 - RNA, 66 nt, Homo sapiens
gcaggcuucagcagcacugaacauuggcugugucaguccagugaaucucaggcugugaaguccugu

SEQ ID NO: 3243 - RNA, 65 nt, Homo sapiens
ggcaggcaggugucccgggcaucagccaguggauggagagaggcugcugggacuccugcucugcc

SEQ ID NO: 3244 - RNA, 68 nt, Homo sapiens
ucccccugguugcuauguugggaguggucuguagggggccaaaggagaagcagagagaccagugggga

SEQ ID NO: 3245 - RNA, 74 nt, Homo sapiens
cuacacuagagauagcugcagccaccuaggggcucaccccuggucgggagcgagcagcuauuugcuaguuguag

SEQ ID NO: 3246 - RNA, 87 nt, Homo sapiens
gaggccucacaaccuucuagggcacagacggugaaaauggcucaggccagaauuugguuuagguuucagaagggugcugggugccuc

SEQ ID NO: 3247 - RNA, 78 nt, Homo sapiens
ggaaggacucugggcuuccugaaucuauugagugugcuauauacucacuagaugugagacccagggcaagucacuucc

SEQ ID NO: 3248 - RNA, 57 nt, Homo sapiens
acucgagagaguagcaaucacauaugguaaugacauaugauugaaaccucuacgagu

SEQ ID NO: 3249 - RNA, 77 nt, Homo sapiens
ccucccuggaaggucucuucucaagaguuccuccuuaugacugagaaggauuaucugggaggcgacccugguggagg

SEQ ID NO: 3250 - RNA, 58 nt, Homo sapiens
cgagccuuuagggguaugagagaaaccggagaccugguccgugcucucaaagagcucg

SEQ ID NO: 3251 - RNA, 79 nt, Homo sapiens
uuggcccacagugacuauucuaucaggaagggaaggauccaguuuuauuuucuucuggauagagagucaguggugccag

SEQ ID NO: 3252 - RNA, 82 nt, Homo sapiens
gcuugagccaucccuggcuuccuggagcucacaaccugagagagaagguggugcugcgggaacccaggguugggcugugggc

SEQ ID NO: 3253 - RNA, 71 nt, Homo sapiens
uuaauucagaucaauaucaaucaggagauaaacaaguguuugucucuugauuggcauuuaccugagauuaa

SEQ ID NO: 3254 - RNA, 85 nt, Homo sapiens
ucagagcugauugauggcuuuuuggcccuucagcuggcaaacacugacccuggcacccaagagaggccauuuucacagcuucugg

SEQ ID NO: 3255 - RNA, 106 nt, Homo sapiens
gccuuccagccccuccacagaauccagaauugcugaggugccaguuaauucuucauucugcaccuccccucaccaaucugguuuucugggagggcucuggcagggc

SEQ ID NO: 3256 - RNA, 66 nt, Homo sapiens
agugcuuugugcugccaguggaaagccgggugacccgccucggcccgcugagcagccgaacgcgcu

SEQ ID NO: 3257 - RNA, 65 nt, Homo sapiens
uguggucaguagaauguuuugcuuucuuauagucacaacagcauagaacagucuucugagccaca

SEQ ID NO: 3258 - RNA, 135 nt, Homo sapiens
gcaugguugugugcuguggcucagcuagucaggaggcagggccuggagggcugcugggaggggaagggccugcccuguccccagcagccuuugcccccauccccaggcuggagaagcuacgccaccagcucaugc

SEQ ID NO: 3259 - RNA, 86 nt, Homo sapiens
uuuggugcuuaaagaauggcuguccguaguauggucucuauauuuaugaugauuaauaucggacaaccauuguuuuaguauccaaa

SEQ ID NO: 3260 - RNA, 71 nt, Homo sapiens
gguggggaauggucuaggggaucuugcgaguuguucuuuuugcuaggaucccccaagccccuuccuucacu

SEQ ID NO: 3261 - RNA, 88 nt, Homo sapiens
ucaucuuccucacccacaccuccguauaucacuaagugagcaaggaugagagugauauauaaugaggugagggauguuggaaggauga

SEQ ID NO: 3262 - RNA, 116 nt, Homo sapiens
guguugcuauaggaagagagagucaccaugaaggauggccuguauggaaagaggcacacugcgggugcccuggugggucguccuggcugugggcuacucuuuccuggagcugacac

SEQ ID NO: 3263 - RNA, 127 nt, Homo sapiens
agguuuggaagcauucuuucaaauuaacccaucucaggccaucugcagagaagaaaggugguaccuaaauuuuucuugucagcauuugguagggguguuuuauugaccaaauauguucccacaaccu

SEQ ID NO: 3264 - RNA, 86 nt, Homo sapiens
agguggcaagacauccagaacagagcuucuauuucaguuuguaaaauaacacacuguagcagguucuguugcugcucugcucaccu

SEQ ID NO: 3265 - RNA, 80 nt, Homo sapiens
auccuccuacuuuccuuuugggaucuugauggugccuauucagggaguccauaggguuccagaggaaaggaaggaaggau

SEQ ID NO: 3266 - RNA, 69 nt, Homo sapiens
uaguuuggaauuguuccugggcuggugacugugauggugcaauccauagcccaggaaugaccacagcua

SEQ ID NO: 3267 - RNA, 71 nt, Homo sapiens
gccuccucauuggucuguguccaucgucauuacucugugguguauucucaacacagcagccagagugaggu

SEQ ID NO: 3268 - RNA, 79 nt, Homo sapiens
ccugugggcagcaucagggucugccuugcggugggaccgcuuggguuucagagcagggucccuguuguuuccugacagg

SEQ ID NO: 3269 - RNA, 61 nt, Homo sapiens
uuccccagcacuggaggaggcacugguugugugggcccuggcuccuccaugucugagggaa

SEQ ID NO: 3270 - RNA, 86 nt, Homo sapiens
uccaggaccaaggcacagcugccauccccugccucucacuaugcugguauaggaggaagggaguggggcugugcagagucucuggg

SEQ ID NO: 3271 - RNA, 74 nt, Homo sapiens
gcugguuugagcuagacuccuccuccaucauagcagggugccuggucuggaguagagucuagcugggauccagc

SEQ ID NO: 3272 - RNA, 68 nt, Homo sapiens
auggagcuguaaguacuuaggagggagacuuuuccagcagucucucucuuggguaucugagugucuau

SEQ ID NO: 3273 - RNA, 77 nt, Homo sapiens
ggauccggguuuagaggggcguccccacucccuuaucuggcggagaggaagcuggggguacccucuaaccgagauuc

SEQ ID NO: 3274 - RNA, 80 nt, Homo sapiens
uccucggcucucggggucuuuuguuuugggauuguaaauguuauagaucucccaugauggaaggccaugaggucaggggg

SEQ ID NO: 3275 - RNA, 108 nt, Homo sapiens
ggcauccuuuaaugucaaugucacuuguucugauuugugcugggcaaggaaagacacuguccuuuccaccccagcacauuugacaagcacugacacucugggcaugcu

SEQ ID NO: 3276 - RNA, 69 nt, Homo sapiens
ugcagcuguccagucauggggugcaggugaaacaaauucacgugccgcuuggugcugggcuaguuugua

SEQ ID NO: 3277 - RNA, 75 nt, Homo sapiens
ugugcaguugugaaggauuuaggcuccacugcucaugcauuuggguggggccugaaucacuuucagucuagcaca

SEQ ID NO: 3278 - RNA, 75 nt, Homo sapiens; identical to SEQ ID NO: 3277

SEQ ID NO: 3279 - RNA, 75 nt, Homo sapiens; identical to SEQ ID NO: 3277

SEQ ID NO: 3280 - RNA, 139 nt, Homo sapiens
uucuccuaguugcucggcugucccucucuuugccuuccucccuccagaggaggagggacucugauaucagcagauguguuuuuccucuggcaugggaggacagaagggaagagaaacaguauaguuaucuaagugagaa

SEQ ID NO: 3281 - RNA, 82 nt, Homo sapiens
gauggcauaaauguuucaaaugugcucaggguaauuaguuuugaauuaccaugugcauauuuuaaacauuuaaaugaucauc

SEQ ID NO: 3282 - RNA, 83 nt, Homo sapiens
gaguccacacucccucuuugccccuugcugguucucuacugcccccagcauaggguggagugggugugcaguuucugcgacuc

SEQ ID NO: 3283 - RNA, 122 nt, Homo sapiens
gccugggagccaugcagcacaaucagucuggcuucucccauccagcucugcccugaccagcagagcuguguggugggaggcgagggcugcugcuaaucaugcuuucugaacacgccacaggc

SEQ ID NO: 3284 - RNA, 70 nt, Homo sapiens
gucagugaaccuucaccaaaccccacgugcauuuuauccucagugaauuguugguggaggugcaccugac

SEQ ID NO: 3285 - RNA, 76 nt, Homo sapiens
ugcauccaugccuguuagcugcacugucuuuggcccuuguaauagacaggguguaugcucagcaggcagguaugua

SEQ ID NO: 3286 - RNA, 95 nt, Homo sapiens
aagugggagacagcaugugguuagaaauuaggagaauugacaugauguccuauucugcuauuuuuuagccauaagcaagcccugucaccucacuu

SEQ ID NO: 3287 - RNA, 90 nt, Homo sapiens
ggugcagaggcuuuuaaaggacugacauuccucggguuauggaaaacaauaauaauaaaucuuaaggaaugucaccuugccccuggcacu

SEQ ID NO: 3288 - RNA, 117 nt, Homo sapiens
ggcuggaagugaggggcggaagcacuggggagagacaggugugagcuucccacguggugaucagcucacaccugucuuguguucuugguauucacagacucucagaaugucacagcc

SEQ ID NO: 3289 - RNA, 85 nt, Homo sapiens
guacugccaguaacuauagaugcugggagaaggcccacaucaaacugaguccucccagcaugcuauauagguugcuugccaguac

SEQ ID NO: 3290 - RNA, 65 nt, Homo sapiens
uuuugugccaggaauugugcauaucugugggaauacaaugauaugcauugacccugccaucaaag

SEQ ID NO: 3291 - RNA, 59 nt, Homo sapiens
agaggagccugggcuggcggucgggaucuuuucccucccuccgcgcccgcccucccucu

SEQ ID NO: 3292 - RNA, 56 nt, Homo sapiens
cuucuucccuucucugcaggggccaacagggcacccuguggagauguagaugggag

SEQ ID NO: 3293 - RNA, 136 nt, Homo sapiens
gccuggugagggaggcagcacaaggcuacgggagucacagguuugagugcaggguguaggaggaccugggaggcuucagggcccuugacucaagugccuguguuccugcccuauucccugcuguccugacccaggu

SEQ ID NO: 3294 - RNA, 68 nt, Homo sapiens
ucugcugggcauuuuggggugggagaagauucuagauacuucuccaaacuccaaaaugaauaugcgga

SEQ ID NO: 3295 - RNA, 78 nt, Homo sapiens
cugcccagguggggcccaugcccuuaagcaguauaggugaguguauccuguugcggucaugggccauaaaugaggcag

SEQ ID NO: 3296 - RNA, 78 nt, Homo sapiens
cugcccagguggggcccauggccuuacacgacauaggugaguguauccuguuggggucaugggccaugaaugaggcag

SEQ ID NO: 3297 - RNA, 85 nt, Homo sapiens
ggcagagucuggguccuccccaggcuguccuccuggcacuggacuccugggugacagccugggggacugggcccggccugcugcc

SEQ ID NO: 3298 - RNA, 111 nt, Homo sapiens
uugaagcuggcaugcgggcaucagccuccugcaagcucugaggcuuugugacaccaggaauuguuccaucuuauagcuuaggaggcuggggcucugugccucugccuucag

SEQ ID NO: 3299 - RNA, 91 nt, Homo sapiens
aacauguuuuaacuuugggauguuuauaggcaaguuuguuuaucuaaaauaaaacacaccgcauugaauguccuaaaguuacuacaauguu

SEQ ID NO: 3300 - RNA, 68 nt, Homo sapiens
aaucauauucugauaucagcacuuuggggaaucauguuucccaaugcuguugauucagcuuauugauu

SEQ ID NO: 3301 - RNA, 130 nt, Homo sapiens
agggccauuguagacuuagugggucaccuugaagaaauuauccccaggcagagagcucagggcagagaguaagggcucucugccugggaauaauuuccucauggugacccacuaagcuuaccugaguucu

SEQ ID NO: 3302 - RNA, 67 nt, Homo sapiens
ggccagaaugauaguuguuaaaaauaaugcuaauuauagcaauaauaauagcugucauuuguuggcc

SEQ ID NO: 3303 - RNA, 55 nt, Homo sapiens
ugggggcaggagggagcuaaaccuaggaccaggauaucucccuccuguuuuccca

SEQ ID NO: 3304 - RNA, 80 nt, Homo sapiens
ggggagcccaggaagguuaucagagggagaagagugaggacaagaauuuuuuccuuuggcuuccuuccuggguaguuccc

SEQ ID NO: 3305 - RNA, 75 nt, Homo sapiens
gagaaucgucuuauuauuucagcaggagggguguggguaaaauaucugccugcugaaagaugggauggauuucuc

SEQ ID NO: 3306 - RNA, 66 nt, Homo sapiens
cagagggaauuugcagguuguuuugagaaagauuucuuaaagcaauuugagcaaguucuaucuuug

SEQ ID NO: 3307 - RNA, 90 nt, Homo sapiens
uaacuuuaauaguaauuaaaauuccaucugauuucugaaauccauaugacacagaaaucauauggaaguuuaacugcuauuaaauaguua

SEQ ID NO: 3308 - RNA, 58 nt, Homo sapiens
ugugaagugcuggguggcggcuguuguacuggccugcauggccucagcgcuugucaua

SEQ ID NO: 3309 - RNA, 88 nt, Homo sapiens
agacaagagacuaggagcuaggagcugcggaucugcaguuucccaaagguaaaggagccugcagcugagccucgaguuucucaugucu

SEQ ID NO: 3310 - RNA, 124 nt, Homo sapiens
gugauuaaacaucgaggcuuugauguuuuauacggcauucuuccccacaauuaacuucauuagugcaguuaauuaguggggaagaauaucguauaaacaucaaagccucaguguuuagugucac

SEQ ID NO: 3311 - RNA, 62 nt, Homo sapiens
gcucaguuugcugcacagauauuuggguuaaacaaucauuugcuguggggcagacugugagc

SEQ ID NO: 3312 - RNA, 73 nt, Homo sapiens
ggagccaggcguaggacagggcccaucacucagcacuaagccacccccagcucugccugccgcuugcagcucc

SEQ ID NO: 3313 - RNA, 68 nt, Homo sapiens
uugcuggccagaggugagagcugcccucaggcugcccagggcccacuuucaccaccuggccucagcag

SEQ ID NO: 3314 - RNA, 68 nt, Homo sapiens; identical to SEQ ID NO: 3313

SEQ ID NO: 3315 - RNA, 68 nt, Homo sapiens; identical to SEQ ID NO: 3313

SEQ ID NO: 3316 - RNA, 67 nt, Homo sapiens
gggaaacacaagagcaaggugcugagguaaaaaacaccugaggcagcuuuuucuguguguuuuuccc

SEQ ID NO: 3317 - RNA, 61 nt, Homo sapiens
ugcuuucaccaaggugccucuguguuuacuuaagugacuugugguagcugguggcugagca

SEQ ID NO: 3318 - RNA, 105 nt, Homo sapiens
aguauucacacuuccaaauaaacagagugacucacuacugaauuuaugaagaaacuuggguaguggugaguugcuuuguuuacuugggauaaaugugaauguacu

SEQ ID NO: 3319 - RNA, 79 nt, Homo sapiens
gcugcuguguugauuccaggggacacccucccuaucacguucuacgugaacaggguccccuggggucacacagugcagc

SEQ ID NO: 3320 - RNA, 76 nt, Homo sapiens
ggccagggauuuaugggaaacuggcaauuaugacauauguccagcuauugcuagccucagauuuaucccugugguc

SEQ ID NO: 3321 - RNA, 66 nt, Homo sapiens
uuccugggccugugccuugucucuggcugccuguggcagcuggacagggcugagagcccuugggaa

SEQ ID NO: 3322 - RNA, 72 nt, Homo sapiens
acauuucacuccccuccccacugcacccuggcaacagcucugcaggacuggggagcggaaggugagugaugu

SEQ ID NO: 3323 - RNA, 83 nt, Homo sapiens
uuccuguccauuuguccauuauuauccuugagaggcuaacauguucuagucuccaaggagaaaugggcaacagggcaaaggga

SEQ ID NO: 3324 - RNA, 67 nt, Homo sapiens
gguccggggcucauauccuggggagcucuauagucacaggcagacccaagugugauccccaaggacc

SEQ ID NO: 3325 - RNA, 95 nt, Homo sapiens
gcagggccuuggagcagguaggguggaggccugcacacuggcggggccaccucaccccccuggccucuucccuccuccugcuccgggcuuccugc

SEQ ID NO: 3326 - RNA, 73 nt, Homo sapiens
gacucggugucacccaucacugggccccacacccagcacagggagggaacaggaugggugcucacuaaggguc

SEQ ID NO: 3327 - RNA, 78 nt, Homo sapiens
gaggcagauucacguuuguccauuuggaugcuuccuuuagaauugacaagcccaaauggauaaauuuaucuuggucuu

SEQ ID NO: 3328 - RNA, 152 nt, Homo sapiens
gcuccaccuucccaagaaugucuaauugucauuggaacagccagugucuggcagcuucgcucgggcugauguggcaucugacccuugguggguugccagacauuccuuccuguuuccgccaugggaaguugacacugggaaugguauggagc

SEQ ID NO: 3329 - RNA, 70 nt, Homo sapiens
uaagcgcgaugcccucuccuagaucuacaaaccgguuuuuuccuggcuagggaggggauacgucugcuua

SEQ ID NO: 3330 - RNA, 81 nt, Homo sapiens
uuugauggacucugugacacugugguaguaauaaccacuacuaucauaguaauaccacagugacacagaccucacuucaaa

SEQ ID NO: 3331 - RNA, 95 nt, Homo sapiens
uguggugacguuccaaaauguuugaaagcuguugcccucaagaaacucuuguauauagaguaacagcuuucaagauauuuuuacauuagcccaca

SEQ ID NO: 3332 - RNA, 107 nt, Homo sapiens
cugagugauagaaauaaggcucccguccauuacuggagacucuggguuuuauacuaccagugucuccaguaguagacagaagccuuauuucucaaguucguucucag

SEQ ID NO: 3333 - RNA, 90 nt, Homo sapiens
ucaaugguuguagagcugguuguggggaaaaugagauguucugggauuccagaacugauuuuauuuuuuucacuccaagcaccuaguuga

SEQ ID NO: 3334 - RNA, 91 nt, Homo sapiens
gacugccugaccucuauuucuugggaaccguuguuuugggggagacuggagaacagagagaaugaaugaggaagagagguuggggccaguc

SEQ ID NO: 3335 - RNA, 78 nt, Homo sapiens
aggcaggaguuucauagaagcaccaccuaugauuuaaaaauaaaauacaugguuguuuuuauggagcuucucaugccu

SEQ ID NO: 3336 - RNA, 133 nt, Homo sapiens
agugguagugaccucaggagucuguguguggcccauuugaugugguuugggccuaaggaaaagcuaaaggcuaaauguauuuuaagugggcuaaaaccaagauaaacacaucccugaggucauuauuuccauu

SEQ ID NO: 3337 - RNA, 88 nt, Homo sapiens
ggaggacuugaggccggcucaguggucagcgcugcugcuuguuccccuacacagaggcguuggguggagcugccucagguaucccucc

SEQ ID NO: 3338 - RNA, 114 nt, Homo sapiens
ccucaugcccuguccaugcccgcucugaccugugcccuccaccagggaaaaccgcggguuuuucccugcacagggggcugcaggccaggccgggcuccacagggcagauugagg

SEQ ID NO: 3339 - RNA, 109 nt, Homo sapiens
gacaaucaagauugugaguugguaguuuggagccagauguaacagaugcucaauuggcccacagcgugcugguuucagauugucguguacaguugucuuggauuuuguu

SEQ ID NO: 3340 - RNA, 99 nt, Homo sapiens
ccaagaaguuaaauaacuugcuuaagaucacagagcuaaugaguggcagaacaauuauucuagcucugauuuuaagggauuuacuuaacuuuuacuugg

SEQ ID NO: 3341 - RNA, 99 nt, Homo sapiens; identical to SEQ ID NO: 3340

SEQ ID NO: 3342 - RNA, 75 nt, Homo sapiens
gggaagugcuguugugcuguacucuacaugguuauauaaauuaugcaguuuaaggcacaauuagcaugcauucuc

SEQ ID NO: 3343 - RNA, 88 nt, Homo sapiens
gcagaggaaggugggaggcagcaagaggcagcuggagccguggugggccgucugucauccuguucaccucccacucuucccacucugc

SEQ ID NO: 3344 - RNA, 102 nt, Homo sapiens
uuugugggaacauguaccuaggaaagcucugcacacuuguggacacacaguuguacauguaugugcacacaaguguguguuauccauauuuccccucacaaa

SEQ ID NO: 3345 - RNA, 90 nt, Homo sapiens
gaccugggcaguggguugauuggagugaggggauaccaugcccacccugccuugguccuccuggcuccaucaccccaugcccaugagguc

SEQ ID NO: 3346 - RNA, 137 nt, Homo sapiens
ccugaacagauuaagcauugucugcugaaugauauguuugcuuuucaugcagugaaguucuuuugugacaacagaacagcugcaugaaaacaacuuuuucauaauuuccacacgaaugcaucauaaugucaaucagg

SEQ ID NO: 3347 - RNA, 174 nt, Homo sapiens
aggguggcugugcugaugaaaggcagagauggccgcggaugucugcaugaaucacacagggcugugcagcagccaaaagucucuucaaucucugugauucaugcagaugccaauggccauucuuugucccucucuauucauuuuauucauccaauaagcauuugucaacgcccu

SEQ ID NO: 3348 - RNA, 114 nt, Homo sapiens
caguacaagcuggcaccucuucucaaagcaacauugacaaauggcaauggcuuucuauuugagcccacauuuguuaaugcugcuuuuaacaagaagugccagcaugcuauacug

SEQ ID NO: 3349 - RNA, 70 nt, Homo sapiens
gggcccugggucacagagcagaugguccugaauggagcacaggaugugugcugugugccgggacuggccc

SEQ ID NO: 3350 - RNA, 71 nt, Homo sapiens
gcugguuuuaggcaggugugauauuagcgccugaaacgggaaauaaaucacaccugccuuugaaccccagc

SEQ ID NO: 3351 - RNA, 107 nt, Homo sapiens
gaacauccaggucuggggcaugaaccuggcauacaauguagauuucuguguucguuaggcaacagcuacauugucugcuggguuucaggcuaccuggaaacauguuc

SEQ ID NO: 3352 - RNA, 62 nt, Homo sapiens
gaguccuguauuuguggaugaugugagacuucuuauaguucugugagaugcagacuugacuc

SEQ ID NO: 3353 - RNA, 116 nt, Homo sapiens
cagcaagauaaaacaaacaaauaacauacaauggaccucuaguacaucuggcagcagacuuuucagugggaaccuugcaagccaggagagagugacaugacauaucugaagugcug

SEQ ID NO: 3354 - RNA, 83 nt, Homo sapiens
cccucugcccucccaugucccuggcagugggcauuucucaaauggugauugaugacuggggaugggggugggcaagccgaggg

SEQ ID NO: 3355 - RNA, 80 nt, Homo sapiens
ggggcccagccucugugugaggugcucugggggcugugcugagccccugagagccucccaccugagacuggagucgcccc

SEQ ID NO: 3356 - RNA, 163 nt, Homo sapiens
ggcccugggaugggcaaccacaguaacuuccacggagguuucagcaguggcaucuggggcuggggucgcggccguggacagcaccggagccgggaccaaggccacggagcuugcagaggcaaggccgaggauaaggaguggaugcccaucaccaagcugggcc

SEQ ID NO: 3357 - RNA, 79 nt, Homo sapiens
augaauuucacuaaaucauaugggacuaaagacagacuuuguuuuuaucccaagauguauuuggugaaacccacuucau

SEQ ID NO: 3358 - RNA, 73 nt, Homo sapiens
ugaggguaugugccuuuggacuacaucguggaagccagcaccaugcaguccaugggcauauacacuugccuca

SEQ ID NO: 3359 - RNA, 79 nt, Homo sapiens
caggugggcaggagcugcugggggugcugggcagacguuuaccguccagcacccccauuucugcugcucugauaacuug

SEQ ID NO: 3360 - RNA, 85 nt, Homo sapiens
ggcacuugggaauggcaaggaaaccguuaccauuacugaguuuaguaaugguaaugguucucuugcuauacccagaaaacgugcc

SEQ ID NO: 3361 - RNA, 91 nt, Homo sapiens
agcugcauggaguucuguggauggagguugagagggcugcuucgaaaauaacucugcuuucucacucuccauucacccaugugccccagcu

SEQ ID NO: 3362 - RNA, 84 nt, Homo sapiens
gccuguccccuggugacccugaggaugcaccagcagggcuccugcuugcuguggcaucucagggagcuagaagaauaaacaggc

SEQ ID NO: 3363 - RNA, 78 nt, Homo sapiens
cuccaguggccucuggcugucgccucccacuccagcaugagggaucgggugcaagcacagaggccaugcagaguggag

SEQ ID NO: 3364 - RNA, 102 nt, Homo sapiens
gugcugcugcucugccugaacaauuccaccacuguggacguaucuuuguaucgagugcccacguaggauggaauugucuagauaaugcagucauacuggcac

SEQ ID NO: 3365 - RNA, 133 nt, Homo sapiens
guguauguaucuugagucacagacaagggaacagaggccugaagaagucauagcuuaagucauggccaacuccugugacuucuucaguccucuguucccucacuuguaagauuuaaguaacagucaauuacac

SEQ ID NO: 3366 - RNA, 79 nt, Homo sapiens
ugccccagguugccugucccaggugcacugggcccaggccagguuucuuucugggauagggggcuugaggaagagggua

SEQ ID NO: 3367 - RNA, 112 nt, Homo sapiens
gcauugucugcuaaucuggagaucugaauuucuguuguuuuccuccuuuccaccaguagaugaguugacagggauucagugauuccuaagaaagacagauuuaaaaaaaugc

SEQ ID NO: 3368 - RNA, 90 nt, Homo sapiens
ggggcugucacacugcaugggcuccgggacacuguggcugcccuuaugugguguccccggagggcccugcaggugucacaccgcugcucc

SEQ ID NO: 3369 - RNA, 81 nt, Homo sapiens
ugggaugugugcgggaggcugaguccagccaccacacgggucggcuuccacaggguuucccgcacgcacugugcuguccca

SEQ ID NO: 3370 - RNA, 97 nt, Homo sapiens
ggagagagugucugugcggaagacaaugugucuuuuuggucucauuuaauuuuuuauaaacauugucucugacaaggacacucaaaaauacaucucc

SEQ ID NO: 3371 - RNA, 84 nt, Homo sapiens
gaggagggauagccuggucugggggagaagaggaacuggguucugucucucucucuuaccucuaucuuuaucuuucuuauccuc

SEQ ID NO: 3372 - RNA, 98 nt, Homo sapiens
gaguaacaagaacucuuacaccuagguaaagccuugggaagggagcaaacugcucaggcugcuaagguguaagaggauguaugugaaggggagugcuc

SEQ ID NO: 3373 - RNA, 98 nt, Homo sapiens
accuuaaaugucagagaugauuuuucugauaauuuggaauaacguguaaucuaccacauuuagacaucgucagaaaaaucauuucugacauugaaggu

SEQ ID NO: 3374 - RNA, 80 nt, Homo sapiens
aucagauauaccugagugaaguucugaacuuuccacucuggaaaguggaaaaucaagaauuuuacuuaggugugauuggu

SEQ ID NO: 3375 - RNA, 75 nt, Homo sapiens
uauacaaagcagaaguauuuuuuucuaacaaaagcugucaaagguaaagcuugagaaauacuuuuguuuaguaug

SEQ ID NO: 3376 - RNA, 111 nt, Homo sapiens
ucccaaagugaaugaauggcucaggagaucccagaaucaaaucagguggacacuauuagaaagcacccgauuugaucccgggaucuccccagccauucauucacucuggga

SEQ ID NO: 3377 - RNA, 105 nt, Homo sapiens
gcucaaagaggugagguaacucucccaggguuccacgccuggcugugugcaugaccugcuacaaccagcaugaaaccuugagcagguuacuucacuucucugagc

SEQ ID NO: 3378 - RNA, 91 nt, Homo sapiens
gauuuauguguguguguguaauauguuuaauauaugaaacagugaaagauauaaacauguauuugcaugugugcacacacacacacaaauc

SEQ ID NO: 3379 - RNA, 72 nt, Homo sapiens
ugucuacugaagcaugcuuauaugucuugugucuucugcugcacuugagcauuagguguguuucagaggaua

SEQ ID NO: 3380 - RNA, 75 nt, Homo sapiens
ggugaaggaggggaggggagguggaagaaggaggagguuagcucaggguucuaccuuaccuucuccucuaucauc

SEQ ID NO: 3381 - RNA, 71 nt, Homo sapiens
gguuaaagaaauucacuccugggcugagaaauuauaugucaagcuauagccuaaagugaauuuuuauggcu

SEQ ID NO: 3382 - RNA, 67 nt, Homo sapiens
cuuugaggucuuggaagaaguugcaccaguauaaggauaggggguaaguuuccuccaggauccagag

SEQ ID NO: 3383 - RNA, 73 nt, Homo sapiens
ggaggagguuuuuguauuauuuuuggcuugggcauucauauccugccagugagugacagcagagacugccucc

SEQ ID NO: 3384 - RNA, 73 nt, Homo sapiens
aagucaggcaugcagacagguuuggcaagaaccaggauggugggagcggggcuagacacugugugcuggauuu

SEQ ID NO: 3385 - RNA, 67 nt, Homo sapiens
uuuugaggucuuggaagaaguugcaccaguaugagaauagugggucaguuuucuccaggauccagaa

SEQ ID NO: 3386 - RNA, 92 nt, Homo sapiens
uaauaauaacacucaagcaacccuaucacuuaggcacuauuaucuacauuuacauauuagugccuaggugacaggguugaguguuacuauua

SEQ ID NO: 3387 - RNA, 60 nt, Homo sapiens
agcagauuuucccaguaaguaaagggcccuugggagccaaggcacuuuggggaagcugcu

SEQ ID NO: 3388 - RNA, 81 nt, Homo sapiens
uuuuuauuuuccucuuucucugcucuuaacccucagucacagaaucauguugcagggagggcagguaggggaaaaagaaaa

SEQ ID NO: 3389 - RNA, 56 nt, Homo sapiens
ccuccauggcuccaagaaaaacuauuugaaaugucccuucuuauggggccaggggg

SEQ ID NO: 3390 - RNA, 175 nt, Homo sapiens
gcaggaugagggguagggagggacgaagugcaagccuuggcggagcgcaaggugcggccaagcagggagucagagccccuagccccgagagggcucccgugcccuccccagcucacuccccgcuccgugccuagcucugcgcucccgcggcgcccccagaccgccccuuaccugu

SEQ ID NO: 3391 - RNA, 76 nt, Homo sapiens
gggucaggucuuuccccugggacguuuucuccucuuuauugcaguggcggaagcguccccgugagaggcccgaccc

SEQ ID NO: 3392 - RNA, 69 nt, Homo sapiens
gugggagggggaaccgugggcccugcugccaaugagugccagacuuggggccucaguuuccccaccugc

SEQ ID NO: 3393 - RNA, 68 nt, Homo sapiens
agggaagacuucguuagagaguaaucaccuuugagucacagaaggcagcuccuuuaugaagucucccu

SEQ ID NO: 3394 - RNA, 59 nt, Homo sapiens
aguguacuguauauuuuaggcagaauguuuuuucuuggcugguuuguauacagcacacu

SEQ ID NO: 3395 - RNA, 74 nt, Homo sapiens
guuugauuuucugguucacuagacugacacaccacaaagggaaagguggaagguuagugguccagaaaacagac

SEQ ID NO: 3396 - RNA, 87 nt, Homo sapiens
uuugaaagccuucagaguuuuaucauacguggauaaaacucauaaugcaaauuauccauguaugauacaacucagaaggcucucaga

SEQ ID NO: 3397 - RNA, 66 nt, Homo sapiens
uuuccauggacacgagagccccugcugggucccgugcuccuggcaggcugcugguguccaggggaa

SEQ ID NO: 3398 - RNA, 61 nt, Homo sapiens
aucauacuggauaucuuuccacagauuaaaaaaaaaaacuuggggaaguguccagagugau

SEQ ID NO: 3399 - RNA, 116 nt, Homo sapiens
gugaaaagagauuuggcucaagugguuauggugccucuuuaaaugucagagucccugcugacuggcguuuugggggcaucaucagaccccugcccccaagccugaucuuuauuugc

SEQ ID NO: 3400 - RNA, 110 nt, Homo sapiens
gaauaagauucacugaugagcugcugagaguggcuuggcugcacuacagggcuagccaguugccauguggccuguggucaagucagagggagcagcugugaauccuauuu

SEQ ID NO: 3401 - RNA, 94 nt, Homo sapiens
ggggcauggggcaggcaggguuuuguguuugcuggugcaguuuacagcuuuucaaugaucaggcagacacaggacucacgccagcuccgguccc

SEQ ID NO: 3402 - RNA, 78 nt, Homo sapiens
guuauaaaucacuacuuaaucuaauuaguuuagaagcuauuuuaaagagcuuaauuagauuaagcugugauugauaac

SEQ ID NO: 3403 - RNA, 72 nt, Homo sapiens
aaugaagaaggcucugcacagcccccagaaggaaacuuaauagucuaggggcucccuuggguccuucucauu

SEQ ID NO: 3404 - RNA, 72 nt, Homo sapiens
gguacauuggugagucacaauauauuaugaguuguaccacaaguaauuugugacucaugaagcuaaaguacc

SEQ ID NO: 3405 - RNA, 69 nt, Homo sapiens
ugggaaagagaaagaacaaguaaaaggaauuuucauuuuccagccccuaauuguucugucuuucuccca

SEQ ID NO: 3406 - RNA, 94 nt, Homo sapiens
gcugaauuucacacagaauagcacaauuuacaaaacccggcaacacagggcaauuggguaauguguaaauuggcuacuucuguuuggaaucagu

SEQ ID NO: 3407 - RNA, 70 nt, Homo sapiens
cugggaaggcccgaucgcaggcacucccuagucuggcuggagggagguggcuggauuuuggccuacccag

SEQ ID NO: 3408 - RNA, 77 nt, Homo sapiens
aggcaaggggacuuccuggugccacagcucaagucugugacaagagacaagagccaggcgugaggauuccccugccu

SEQ ID NO: 3409 - RNA, 61 nt, Homo sapiens
gcccaagagagcgaagguuggcaugcaguuccaacugccuuuccacuuugcuucucugggu

SEQ ID NO: 3410 - RNA, 98 nt, Homo sapiens
aggugaaugauggaugaauaaaaugagguugcaggggaagggcugugggaaagcuggccuccccccugcaaaacguugcugucuacacucauccaccu

SEQ ID NO: 3411 - RNA, 74 nt, Homo sapiens
cuauuacauauggcuaauaaccuauuguuuaggaaagacuagacaauggguaauaaaagccauuuaugagauag

SEQ ID NO: 3412 - RNA, 63 nt, Homo sapiens
caggcaaaacuugguugucaguaaagauguuuguuuugauuggcaaucagcauguuuagucug

SEQ ID NO: 3413 - RNA, 93 nt, Homo sapiens
guguaauaaguugaauaguaucccaguuugcagccaagggauuauauucagccaaggcugcaaacugggacacuauucaaaaccuuaguauau

SEQ ID NO: 3414 - RNA, 77 nt, Homo sapiens
uaggcacuccaucuugggauuccugaugucaucuauuuugucacgcaggauaugggggguccugggaggagagucug

SEQ ID NO: 3415 - RNA, 76 nt, Homo sapiens
gugggaugggaggacagagggaggaaguaaggaaaggauccaggcguccacuuccccuucuuucugccccacccac

SEQ ID NO: 3416 - RNA, 84 nt, Homo sapiens
caugcauuuuaaaaauagauggcuuugaaugugugaguuaauuuuuagccucauuugccaaggccuccuaacuccagaagcaug

SEQ ID NO: 3417 - RNA, 65 nt, Homo sapiens
ucaguagauaagucaaggucugaagcagcaguuaagaaggucucagaccuuaaaauaucaacuga

SEQ ID NO: 3418 - RNA, 65 nt, Homo sapiens; identical to SEQ ID NO: 3417

SEQ ID NO: 3419 - RNA, 65 nt, Homo sapiens; identical to SEQ ID NO: 3417

SEQ ID NO: 3420 - RNA, 77 nt, Homo sapiens
gagagaggggcgggaggagagcggcgccugccgaugacgcaagucaccuagcaaccgcucucuucccccucccucuu

SEQ ID NO: 3421 - RNA, 109 nt, Homo sapiens
acaauauuugcaauuuaccuuaaucucagagaaaggauagaagggcaccaagaacaggaagauguacaucuaucuuuucucugagagcaagguaaaguacaagcauugu

SEQ ID NO: 3422 - RNA, 68 nt, Homo sapiens
auguaacggugucuagaggaagggaugcuguguuccaccuacuugucuuuugcucugaggcuguacau

SEQ ID NO: 3423 - RNA, 67 nt, Homo sapiens
ccaggaccuuggacagaccugccaagugaggaaacacuucucacuuggcagguguugggaggccugg

SEQ ID NO: 3424 - RNA, 105 nt, Homo sapiens
ugggcacccuguuugaggaggcuggucuaucauuuggguggggaaacauuuagggaacugagggggucccaaucugaggagacuggucuacuauugaggggccca

SEQ ID NO: 3425 - RNA, 114 nt, Homo sapiens
ggcacauaguugaugcucagagaauauuuguugaguaaaugaaucaaauaaccaaugccuugcuucauuaauucauucauucaucaaauauucauugugcaccuacuacgugcc

SEQ ID NO: 3426 - RNA, 62 nt, Homo sapiens
ucuccaaacgugcuguuuccacauaaccagucuuuucuuugagggacagcacuguugggaga

SEQ ID NO: 3427 - RNA, 106 nt, Homo sapiens
guuuuaagcaauccuuuauacacaauuauagauagaugccauuguaccagcuggcucuggguacaaugccaucuaucuuuaaguguucaaaauuuuagcucaagac

SEQ ID NO: 3428 - RNA, 72 nt, Homo sapiens
cggguacauaaauuccuggcauuucugcuugaaaaguccugacagcugaaacugcaggaauucaugaaccug

SEQ ID NO: 3429 - RNA, 92 nt, Homo sapiens
gagggagccacagugugggaggaaggagccugggaaaaucgccucuggaugcagaucuggggcuucuauuccccugcgcacugaggccucuc

SEQ ID NO: 3430 - RNA, 66 nt, Homo sapiens
cagcaaagaaauaucauggcaucagggaaaaacauugaacuuggaugucaggauaucucugugcug

SEQ ID NO: 3431 - RNA, 77 nt, Homo sapiens
uccccaaggagucccuuuaacucacagccccuuuccuggccagggggcugggaguugggggauauucaucucgggga

SEQ ID NO: 3432 - RNA, 81 nt, Homo sapiens
augccacucaccuucuuuuaggaaaagauuuguauuuaauaggaagccugggcaguguuuuucuacaagaagagagggugu

SEQ ID NO: 3433 - RNA, 72 nt, Homo sapiens
ggcagaggccaggacuggacucagacuuuugccucacaaagcugugaggacucugaagguccugccccugcc

SEQ ID NO: 3434 - RNA, 72 nt, Homo sapiens; identical to SEQ ID NO: 3433

SEQ ID NO: 3435 - RNA, 99 nt, Homo sapiens
ggugaacaucaagaucuauugaccugagagguaaauauugaccgaggugaagucaaggucaauauuugccucaaagaauaggaaaucuuaaugcucacc

SEQ ID NO: 3436 - RNA, 93 nt, Homo sapiens
ggggcagggcggaggcugcgugggggugagcucugaggacuguccaccucccagcuccucagagagcaccacccugucccuccccucagcccu

SEQ ID NO: 3437 - RNA, 70 nt, Homo sapiens
cuucaaccccauccuccaccccugcccccgccacggccaagccagauuugcagggguggggagggugagg

SEQ ID NO: 3438 - RNA, 149 nt, Homo sapiens
gugucaucuccgcuuggcagacaggaaaguagaggcucagagaggcucagggauuuggccaaagucagacugccacuaccuugaugucugacuuuggcaaguucuucaaacucucugccucugcauccuugcuuauaaaauggagacac

SEQ ID NO: 3439 - RNA, 103 nt, Homo sapiens
uucuuaaggcucauaacaucauucauuuucucugagggacagagugguuuuuauuaauggagcaacaucuguucuuucagaaguaaaugaguucccugaagga

SEQ ID NO: 3440 - RNA, 82 nt, Homo sapiens
ucuaaagcagaggauggcaguuccacaugcucaggugauaaaucaucuacauaaauuaugugggauugauguaaugcuuaga

SEQ ID NO: 3441 - RNA, 126 nt, Homo sapiens
cugggaagguugcuuggucugccuagagccccggcuggcaggcagugcccugggcaagcucuucagccugcaccugccccugggcgcucacuucagcuggagugugguggacagaguccugcccag

SEQ ID NO: 3442 - RNA, 79 nt, Homo sapiens
cacauaaccaugacugaguuugugaagggcugguuauuuucuuucuugucuuucugcauuaucagucaugugugaugug

SEQ ID NO: 3443 - RNA, 86 nt, Homo sapiens
ugcugacucugagccccaggcuucaguugagaugguccuuucagaaauguggagcuuaguccaagccuggauuucaguggguagca

SEQ ID NO: 3444 - RNA, 92 nt, Homo sapiens
gcaucacugguuagaggaauaauugauuaggggucaccgauggggguuauuaguuggagagucacuaguuagugcuaauagccaagagaugu

SEQ ID NO: 3445 - RNA, 104 nt, Homo sapiens
gggagagcggggcagagugggggugagcaugcacgauggggcucgaguuccagccaccuagggcaagagccucggcguccucgccucuuggccccuggccuccc

SEQ ID NO: 3446 - RNA, 56 nt, Homo sapiens
gaguuauaaccuaguuuaacuggauuuagaaaacugguuaaacuaggcuacaacuc

SEQ ID NO: 3447 - RNA, 73 nt, Homo sapiens
ucccaaccaucuccaucacccggcuccccuccuggucccugcugggaaugggguggugcauggagagguggga

SEQ ID NO: 3448 - RNA, 76 nt, Homo sapiens
gggugagaagagaggcaccgcccucagccccacaugucuucagggcucacaguggcuggcugccccuccuccaccc

SEQ ID NO: 3449 - RNA, 96 nt, Homo sapiens
uuggaacuaagugagcacccugcccacccccagccuuguccccuaaacugggugguuuaggucugagggguggggagaaggcugcccagaguccaa

SEQ ID NO: 3450 - RNA, 91 nt, Homo sapiens
uccuuaggaagccguagcugccccaucccuuaggcuguggagacugugcaguguuucaguagugagagaaggggcauuguagggccaagga

SEQ ID NO: 3451 - RNA, 88 nt, Homo sapiens
auuccaucccuuuccccuauuccuaaaugugcuccagggacaauggggaagcuggagcacauauaagaauaggggaaagagagggaau

SEQ ID NO: 3452 - RNA, 110 nt, Homo sapiens
guucuauacguggugaucggguucccagaccugucuauaaaagugaauacacugugggcuggauucacuuuuauagauaggucugggaacccaaucaccauuuacagaau

SEQ ID NO: 3453 - RNA, 96 nt, Homo sapiens
ccaagacucauggccuugaccuccccuagaccuggcugagcaccugcccccuggucagcagcagcuugagucugggaggucagaggcuaagcuugg

SEQ ID NO: 3454 - RNA, 91 nt, Homo sapiens
gcgcgagggcuucugggguuugugguucuucugcgcccuuuugccgcugcgugcucggaucuaggacuauacaucccagaaggcugcgcgc

SEQ ID NO: 3455 - RNA, 92 nt, Homo sapiens
aggagaaguaacguuuccacuguucaguccuuuucaagugguuacucuagggauccguugccaaggacuggccaguggggauccucucuccu

SEQ ID NO: 3456 - RNA, 60 nt, Homo sapiens
aaacgauuugcagcuagagcaaaggugacaaguugaccuuuacuggcugcaaagacguuu

SEQ ID NO: 3457 - RNA, 62 nt, Homo sapiens
cuccaauguguuaaugagcaaugaccuaaauuuuaggucccugguaauugacacacaugggg

SEQ ID NO: 3458 - RNA, 72 nt, Homo sapiens
aucacacauaagagauauguuaaacuacuuaugcuuuggcaccaguggcaagcaauuuucuuaugcaguggu

SEQ ID NO: 3459 - RNA, 56 nt, Homo sapiens
aggggagggggucuuuggggagcugguuaaagauccagaaucggccccucgccccu

SEQ ID NO: 3460 - RNA, 74 nt, Homo sapiens
uccagauauaucuaaguuaggauaacugucucuugaaagauagagaucaguuagauagcuugaugugaccugga

SEQ ID NO: 3461 - RNA, 58 nt, Homo sapiens
ggcugacucugugcugucacagggagacaugcacaccuguugcagcuggagcacaguc

SEQ ID NO: 3462 - RNA, 74 nt, Homo sapiens
ggggaaagggguggcgagggagggguuguggggcuggggccucacuuccccuccuucccuuuccccuggucccc

SEQ ID NO: 3463 - RNA, 83 nt, Homo sapiens
cccagagcuggugcggcagguuuuucaugcaagaucaagcagauuauagaaugaaaagugucugcugcauuucagcaacuggg

SEQ ID NO: 3464 - RNA, 79 nt, Homo sapiens
gagcaagcagaagagauggagaaucccagugugacuaugguacaacugggaaacaaucucuccauuuccugugaugcuc

SEQ ID NO: 3465 - RNA, 82 nt, Homo sapiens
aggcuauuacaaaugguuuccuuggugucaaaaauuacuaaauaguucuuuuuucgacauuaggaaaaugagugacaggccu

SEQ ID NO: 3466 - RNA, 136 nt, Homo sapiens
ugauaagagccaaggaguuuagauuuuuaagacugacaccccccuuuuuaacucauguuguuuuauuuauuuuccccaauugcaugaauuaaagaugggguguuaucucagcuuugaauuccuuagcuugauguca

SEQ ID NO: 3467 - RNA, 86 nt, Homo sapiens
cagagaccuggcaccugccgccuuuucuguucuaauaaaaggcagaugccuuggggguggauggggguaguguguggggggcucug

SEQ ID NO: 3468 - RNA, 81 nt, Homo sapiens
ccaggacacaaggcgccgggccagcuucacugaugcuuccacaaguuaggggugggcuggcccggccuuugcugccccugg

SEQ ID NO: 3469 - RNA, 102 nt, Homo sapiens
guucaacacgugaauucuugggaccccuuccaggggguuaaauccgggaaucucaauuuaauuuccuggagggagucccgagaaucugcauguggaaugaac

SEQ ID NO: 3470 - RNA, 102 nt, Homo sapiens; identical to SEQ ID NO: 3469

SEQ ID NO: 3471 - RNA, 89 nt, Homo sapiens
cugagauuguaacuuuuauucucgauuaucugauaaacauaaaucaaauguuuaucaugugauugugauuaaaauauauaaacccucag

SEQ ID NO: 3472 - RNA, 72 nt, Homo sapiens
uugagaggcccauuagauccuggccauggauacagauguauaaucguggccaggaucuaggguuuugcucaa

SEQ ID NO: 3473 - RNA, 72 nt, Homo sapiens
uugagaggcccauuggauccuggccauggguacagauguaugaucauggccaggaucuaggguuuugcucaa

SEQ ID NO: 3474 - RNA, 68 nt, Homo sapiens
aggcaacuuuuguagucuucagcaaggaaaccccccauuaaacaaauaagacuaaaaaagcuaugccu

SEQ ID NO: 3475 - RNA, 118 nt, Homo sapiens
guucuaauuuaugcugccuuucauagcagaaaauugggaggcuggagccuguggauaaagaacccaggucuugccuuugauuguugauugugaugguaaauguauggaugaugagaac

SEQ ID NO: 3476 - RNA, 65 nt, Homo sapiens
cugcuaaugacgucugugguaaaccgguguguuaaugagguuaaucacaggcucaugauaagcag

SEQ ID NO: 3477 - RNA, 95 nt, Homo sapiens
ccucaagccucuaaucucaucugugaaaaagaacuguacuuuacuguccacaaaacagucuauuuucaaagugagaggagaauggcccugugagg

SEQ ID NO: 3478 - RNA, 127 nt, Homo sapiens
cagagacagaaggcccagggguugaagagagagugagccuggggugggggcagagagauggacgcugggugcguguuucugcagagcuggccugggcguggccccgugaaggccuaugguaccucug

SEQ ID NO: 3479 - RNA, 67 nt, Homo sapiens
aucccaccgucucugcacagaccuccucaaagccaagggcaggggucugcagaggugggugagggau

SEQ ID NO: 3480 - RNA, 82 nt, Homo sapiens
ggcugagucaguguggggggcccaaggcugcgucagugaggggagagcugacguagccccccccagaccggcgggaccagcc

SEQ ID NO: 3481 - RNA, 81 nt, Homo sapiens
ccuccagugcucaccacugugcuauagcuccaaguagagcagcuggggaguaacugcugauggugagcacauagcgggagg

SEQ ID NO: 3482 - RNA, 66 nt, Homo sapiens
guagaaagaggguaugaguaauagguggcuuaagccaaauuuaguuuagucauauccuugcucugc

SEQ ID NO: 3483 - RNA, 91 nt, Homo sapiens
uuugaaagauuuauucaggcugugucagcagccacccaaaugguaguguaaaaaaaaaucugcugauacaccccaaaauaaauugcuuaaa

SEQ ID NO: 3484 - RNA, 83 nt, Homo sapiens
ggcugaacagccucggcucccugauggggcacaguucccgggaugagaagugccuccugcaggcggggcggggcuggcuggcc

SEQ ID NO: 3485 - RNA, 66 nt, Homo sapiens
gaaagaaugcugggagccaucuugaauaaauggaaaguuagacaaaauggcauucagcaaccuuuc

SEQ ID NO: 3486 - RNA, 77 nt, Homo sapiens
gugacaaucugggcuuguugacugggcuggauaguagcuguacugguuuggccuaguuggagcccccgggaggucac

SEQ ID NO: 3487 - RNA, 74 nt, Homo sapiens
gggggaaaggggugggggggagggguugugcggcuggggccucacuuccccuccuuccccuucuccuggucccc

SEQ ID NO: 3488 - RNA, 87 nt, Homo sapiens
acuugaacccgugcucuauccacuacaccccgcugccucucauggagaagaggcaggguaguguaauggagagagugcgggccgagu

SEQ ID NO: 3489 - RNA, 138 nt, Homo sapiens
cauucaaaguguccuuucagcuugcucugcuggagcaagagcaggagcaggaguccucauggaggcaaacaguggggcucacugguuuucucuuauuuagcagaagcacuuggagcuucugaaggacuacugggaaug

SEQ ID NO: 3490 - RNA, 85 nt, Homo sapiens
ggaagaaagaacaucuacagaaacagcggcagguucuaucugaaaggcaagccugcugcaugcucugugugaugagucuccuucc

SEQ ID NO: 3491 - RNA, 97 nt, Homo sapiens
ggacaaauguauaaucaggagaagagaguguaaaccauccauuugguaucugccugccaucuauaucacacauucuccuuuccugagaacaaugucu

SEQ ID NO: 3492 - RNA, 146 nt, Homo sapiens
cggggaauugccagcgauggaaagcagucugaggcuccauuuggcuccgcggcuccgagggugcccggggcccuccaaggcccccgccccaggggcugcagggaagccgggccuggggcccccucccaccgcaggcugagcccccg

SEQ ID NO: 3493 - RNA, 92 nt, Homo sapiens
uaucuaaguggguaguauuauuucgguuagggcuuucuuaguuuuuaacacuauauaaagucuuaaagaaauggcugccagcaaccaggaug

SEQ ID NO: 3494 - RNA, 72 nt, Homo sapiens
gggguaaccucaagcuauggaaaaaauuaggguuagacaugaaguauuuuuucauagccugaggaaggcccc

SEQ ID NO: 3495 - RNA, 80 nt, Homo sapiens
cuccaaacagcacugaacgcagcauucuugcagaaaucuccaacgcaacugggugcugcguuucugugccugguguggag

SEQ ID NO: 3496 - RNA, 62 nt, Homo sapiens
uggggaagggcaagcagucuuuuccucuggagccaggggagggggcugccccccgcccccca

SEQ ID NO: 3497 - RNA, 83 nt, Homo sapiens
uggguaauucucucugucauucuaggcaagaaaaguccauuuggguguuaaauuucuuggcugggguagagauaacagaccca

SEQ ID NO: 3498 - RNA, 88 nt, Homo sapiens
gcugcaaaaggaaguuugcaaaggcagggaagacagcaggugaucucacucagacccuucccaaucuuagagaacuuccugaaguagc

SEQ ID NO: 3499 - RNA, 86 nt, Homo sapiens
uggggaaaucagucucucugcuggucuuuuccccuugcaaaacuugaugugagaggaagagaccagauuggaaggucugggucuca

SEQ ID NO: 3500 - RNA, 96 nt, Homo sapiens
gugccaaagagucauccauuagugacaagaaugacuggaaaacuguuuccaacgccuuuucugucauugauuuuacugaagcugaccucgagguac

SEQ ID NO: 3501 - RNA, 84 nt, Homo sapiens
aauugaaacagaaagcaagccauucacugucaccuauaacucuugguuaacagggaauggcuuugcuuuauuggaaagacaguu

SEQ ID NO: 3502 - RNA, 103 nt, Homo sapiens
cccugaaaaucuuucuuugcuggggaggcagucugggcccugcccacguugcccugcacauggauagagcugggucugucugcccugccaaggaagagcaggg

SEQ ID NO: 3503 - RNA, 70 nt, Homo sapiens
gcaucaaaaaaaaugaugcaggcauuuuuauuccccuaaaggggaauggugcuuccauuguuuuaggugc

SEQ ID NO: 3504 - RNA, 70 nt, Homo sapiens
auccuaaaauguuuccuaccauuuuucuuuuccaguggcuagaaaguuugaaaugguggggagaggggau

SEQ ID NO: 3505 - RNA, 80 nt, Homo sapiens
ggggaaaacaagaguaagaagggaaaggaaugucucagaaagucagccuccugauucccagucaugcucucucucucccc

SEQ ID NO: 3506 - RNA, 79 nt, Homo sapiens
auggaaaauuuuuuaacaucucuguaaaauuauuggguugaacaguauauuaaucaagaauaaagcauaggugguucau

SEQ ID NO: 3507 - RNA, 56 nt, Homo sapiens
uuugaaacuugacagaugugugccucaaaguuucuacacaucugucaaauguuaaa

SEQ ID NO: 3508 - RNA, 79 nt, Homo sapiens
aggagaacaucugugcucuuuauccucaucuggauuuagcaaccauaccaggugggggugagaaaacagacacacuccu

SEQ ID NO: 3509 - RNA, 77 nt, Homo sapiens
cagagaacaaaacaugucaucucuccacccaagcuggguccacccaggacacuggcuuggcaggaggaagaccucug

SEQ ID NO: 3510 - RNA, 117 nt, Homo sapiens
agucaaacuguuaauuggaauagaauccaucucaauuuauuccuagaaacaguucugcuuuucugaggcauuaggaauaaauugagguggauccuguuccaauuagaauuuaugauu

SEQ ID NO: 3511 - RNA, 79 nt, Homo sapiens
gcuggaaguggcuuucugguuuauggagcaagacggaacuguaaagucagucguucucaugggccagagucaagucagc

SEQ ID NO: 3512 - RNA, 95 nt, Homo sapiens
ccagaaagcuuugccccuaggguggcccauaggaugugcccucaggcuuuuucuaaaugcuuccugaucugggcugcccggggugggggcucugg

SEQ ID NO: 3513 - RNA, 91 nt, Homo sapiens
gucagaaguauuuucccaacugcagaugugaaauaggcugguuauacacaucuauuuguuucucuucuguagugcugaaaauuauauugau

SEQ ID NO: 3514 - RNA, 117 nt, Homo sapiens
gcuggaauguuucuuugggguccgaggugacaugaucucuugggugguauccaggccccagggacuugaaagcacuccacucaagauuucugucugccgaggagaggagaccccagc

SEQ ID NO: 3515 - RNA, 125 nt, Homo sapiens
ccuagaauagccuagaauaguuccuggcacagagcaggugugcaguaaauauuuguugaugaauaaaguuccacaaaugucuauugagcacccacucuaugccagccccugugcugggcacuagg

SEQ ID NO: 3516 - RNA, 149 nt, Homo sapiens
gucugacucacuucuaaauugaagugcauauauaaaaaaaauugaaucacuccaaugauuuuaaaucacucuucaaugugcagagcaauuuaaaauuacuggagugcuuccaauuuuuauuaguccuugaauuuggaagugaucuaggc

SEQ ID NO: 3517 - RNA, 79 nt, Homo sapiens
ccucaacgagacauucuuaggaacaauguugucaaggaaacauacugaaacuguuacauaaaagaaugucucugugagg

SEQ ID NO: 3518 - RNA, 82 nt, Homo sapiens
cuccuacucagugccuucccccaggaauugcucucaaacaaaugaaauguggguaauuacugggcuaggggcuggacaggag

SEQ ID NO: 3519 - RNA, 84 nt, Homo sapiens
gaugcacccagugggggagccaggaaguauugauguuucugccaguuuagcgucaacacuugcugguuuccucucuggagcauc

SEQ ID NO: 3520 - RNA, 68 nt, Homo sapiens
gggagacagcaggugcuugggaaaggccgagcucugggcuuuccuuucccaagccuugcuucccuccc

SEQ ID NO: 3521 - RNA, 111 nt, Homo sapiens
ucuaaaccacaucagugaguuagugaaaggguugagaauagacuucacaguuugugacaucuggucuaguucuuagacuucuugucuacugucucacuguguguucuugga

SEQ ID NO: 3522 - RNA, 76 nt, Homo sapiens
uaugaacauaaauuauuuacagugugcucgaagagcucagaagggcuuuguaagguaaauaauuuauaaacucaua

SEQ ID NO: 3523 - RNA, 139 nt, Homo sapiens
aauguacaguuucuagaaugagaacucuuacccuggcuucggaacuucuaggaggcauggaaacagguauguauagggucuccauuucuccuggaaggcuugaggccagcaaaacuccuuacucuagaaaccggacauu

SEQ ID NO: 3524 - RNA, 122 nt, Homo sapiens
ucuucacaccuccaguagcccagaggaugcagagguuuugguaaccauugcacaagguccagguccuuguggaaguuauggugaccucuguagaaccaccuugcuauauaagaggaggagga

SEQ ID NO: 3525 - RNA, 113 nt, Homo sapiens
cuccuacaggcugcagugccuucugucugcuuuaggguguggcaucugccauuggggaggaaaaacuggcaugugucgccuuuuauagcagacugauuucauugugcuggggg

SEQ ID NO: 3526 - RNA, 146 nt, Homo sapiens
ggacuacgcugaccuuugcaauauuauguauucugauugguuguucaugucaccucuuucccacaaguuaauaaggcuguaaaaaggagagaacugaaauggccagccagucaaauuauagaauauugaaaaggucagagcagucc

SEQ ID NO: 3527 - RNA, 117 nt, Homo sapiens
gcuggacgcgccgcccccagcagccuccccucccagccccaccccacccaugcccuccccaaccagcagcugaaacuggagcuggggcuggaggggggccagggggcggcccccagc

SEQ ID NO: 3528 - RNA, 77 nt, Homo sapiens
gagguacuugauaugcgguguguuucuucucugugaaucaauucagcugagaagcaaagaacugcacuucagacuuc

SEQ ID NO: 3529 - RNA, 105 nt, Homo sapiens
ggccgacuacaugaguuaauauuugaaaggugcuuagaacauugccuggucaacaguaaggcuauguaagcacuuguuuaauuuauuaauuuucuuucccuggcc

SEQ ID NO: 3530 - RNA, 66 nt, Homo sapiens
aguuuaggaggagggaggggcgacaucggggcaauccucugagucucucuuuccuccucaggaacu

SEQ ID NO: 3531 - RNA, 66 nt, Homo sapiens; identical to SEQ ID NO: 3530

SEQ ID NO: 3532 - RNA, 99 nt, Homo sapiens
aaaagaguguaauuccaucuuggggcuucuggugaguugagcuugugguucugugguuuaugaugucaccagaaccccuggauggaauuacagccuuuu

SEQ ID NO: 3533 - RNA, 69 nt, Homo sapiens
ggaagagguaugaaggugcaucagccuuuuucucauugaggauuugggugagcacuuucaugcacuucu

SEQ ID NO: 3534 - RNA, 82 nt, Homo sapiens
gcuccaggcccaaugcucaggccuuguggcugcugccugggcauccaggcaagagaagcaaggcucugaauugggugggggc

SEQ ID NO: 3535 - RNA, 151 nt, Homo sapiens
ugggcagcacccacugcgugcccagcucugugcccagguccugagggcugcuguugguuguaacguuucauggaaagaacagggcuugcugcuguacagcagcucagaugacgcugggccaaagaccccacguuugugugggugaggucca

SEQ ID NO: 3536 - RNA, 66 nt, Homo sapiens
aguuuaggaggagagaagggcgacaucggggcaauccucugagucucucuuuccuccucaggaacu

SEQ ID NO: 3537 - RNA, 79 nt, Homo sapiens
cucccagcuucccuccccuucccucagcugucccagccccgaggcucugcagagggaggaauggagugggggaggggag

SEQ ID NO: 3538 - RNA, 69 nt, Homo sapiens
ccuggagaccaguuggagugguggacuccagguuauccucagaaucuacccccuuuucuggugaccagg

SEQ ID NO: 3539 - RNA, 69 nt, Homo sapiens
ccgucagggucaggccucucggugacuuuuccuuuuucucuggcagaaacugaggggugagaccgaugg

SEQ ID NO: 3540 - RNA, 93 nt, Homo sapiens
uuuggaguacaggugugcuauuguguuuuugauggaguguugccauuccagaaagcuccauucaaaaacacaaugccacacauguaacccaaa

SEQ ID NO: 3541 - RNA, 75 nt, Homo sapiens
gguccaggguccaggguccacauguugacccugaaagucaaugaugaaaaaacauguggacuuugcaucagggcc

SEQ ID NO: 3542 - RNA, 119 nt, Homo sapiens
gucccagcuauuaaaucaggcaguuggaaaguacauaaauucuuucaaacccuaagugguucccugguagucugaaaggauuuauauacuucccuacaugccuagcuuacuagagggac

SEQ ID NO: 3543 - RNA, 72 nt, Homo sapiens
acuccagguccacucccaucuguuuucuguuaagaguucauuuucagagugcaggcugguggaauucggagu

SEQ ID NO: 3544 - RNA, 106 nt, Homo sapiens
ccugcagcuuucuccucaacuuucuuccucccccacuagauaacugcuauugaaccugcuuguguaaaagugggaggagguaggaaagcuaaggagauagggcagg

SEQ ID NO: 3545 - RNA, 86 nt, Homo sapiens
cccuuaggcugccuccacaggugagugcugcuggggguagggcugggcccacccugaagggguucucccugugggcugcaggaggg

SEQ ID NO: 3546 - RNA, 76 nt, Homo sapiens
gggcaaggguuuugucuguauuguuugcugcuguaucuccaggucuaaaacagugccaggcagaugccaggugccc

SEQ ID NO: 3547 - RNA, 77 nt, Homo sapiens
caugaagcaguagagucagcagucaaacugaguacacauucuuaaccagugugcugcagauucuacugaaagucaug

SEQ ID NO: 3548 - RNA, 89 nt, Homo sapiens
agaggagagagaggcgaggaaguggagaagauucaguugaagucaagcucacuguucucuuuucccuuuuacaguacuuucaacccucu

SEQ ID NO: 3549 - RNA, 75 nt, Homo sapiens
ucucaagacaggucccuggagguauugucagauuuaucucaaaauaaacauugcuuccagggauccugcguggga

SEQ ID NO: 3550 - RNA, 109 nt, Homo sapiens
gagucagagaaauucuguuuccccaguaggccauugguaauaaugguguauucuaauucaguugauauuauuaauaccaauagcccacuagggaaacagaggagggcuc

SEQ ID NO: 3551 - RNA, 77 nt, Homo sapiens
ggggaaggguggguaggugagugaggguggggugccccugguuggccccccaucuucccugccugucccacaucccc

SEQ ID NO: 3552 - RNA, 66 nt, Homo sapiens
uguccaggcagcauaauaaauaaccugccccuuuuggcagggaguuuauuagagacugaugggaca

SEQ ID NO: 3553 - RNA, 68 nt, Homo sapiens
cagccaguuccaagguccacagguaccuuccucuuugggggucaaggccugugggcuugggugggcug

SEQ ID NO: 3554 - RNA, 104 nt, Homo sapiens
ccuccaguuuggaguuggcacaguccaagacugaaaucaaggucaagcccuagggacuggaccuugauuucacacuugggcuauguaugugcccaguggggagg

SEQ ID NO: 3555 - RNA, 123 nt, Homo sapiens
caaaaaucuucuccuuuugguuuguuugccaacagacuuuggcuucuugggcaaaacccucaucaguaacuuugcucaagaagcugaagucuguuggcaaauaaaccaaaaggaggaguuuug

SEQ ID NO: 3556 - RNA, 77 nt, Homo sapiens
cuggaaugucaggcucugucaccuuguuuuagcugacgaguucagggcugaugaggugaaugggccugauugucuag

SEQ ID NO: 3557 - RNA, 68 nt, Homo sapiens
gggacauugcuugaugauucauaguaagguccuuuagacauuaaugugaguuaucuaaguacaguccu

SEQ ID NO: 3558 - RNA, 75 nt, Homo sapiens
ucaaaaugaacauucauuccaagguuagguacagacauauaaaugucugccugguuugggaaugguuccauuuga

SEQ ID NO: 3559 - RNA, 148 nt, Homo sapiens
ggcugaucagugacaaggaggcugcaggucacgggggggaugcuagguggccuggagcuuugugguuaacugccauugugggaggcugccauggccuugggccgccuggagccccccucgcuguggcgucuccucaguggcugcagcu

SEQ ID NO: 3560 - RNA, 84 nt, Homo sapiens
gggccauucuccucucacuuugaaaauagacuguuuuguggacaguaaaguacaguucuuuuucacagaugagauuagaggcuu

SEQ ID NO: 3561 - RNA, 89 nt, Homo sapiens
agggcaugagcuuggagggagcccacauugggaggcccagcuggcaaucccaauggucucccaaugaggccccgaagcucucagguccu

SEQ ID NO: 3562 - RNA, 148 nt, Homo sapiens
ucucaauugcacagcuggguucuguuggucacaugucagcuucagagcacaucuguucauuccucaaggauccucuaggccccaugaacacaaugugcucuguguagaguaguuuauaccacaaaaaccagcagcugcaugggugaga

SEQ ID NO: 3563 - RNA, 62 nt, Homo sapiens
guuacauauguuuggcagaguucaggccaacaccuggguccugcacuugccagauaaguagc

SEQ ID NO: 3564 - RNA, 99 nt, Homo sapiens
ugaugauauuaugccaugacauugugucaauaugcgaugauguguugugauggcacagcgucaucacguggugacgcaacaucaugacguaagacguca

SEQ ID NO: 3565 - RNA, 81 nt, Homo sapiens
uuccaauacccugcccuuuucacaagauuuccgagagagcaguucacagcgcucauuuuguggggagagagggggguggaa

SEQ ID NO: 3566 - RNA, 84 nt, Homo sapiens
gcaggauaagugagccgaugcugcuccuuaaucagggacaucgaaucggaggcccugggaggagcagccggcuggcugcccugc

SEQ ID NO: 3567 - RNA, 120 nt, Homo sapiens
uugcaauagaaauucuuucugguuaggaaaaauaaaaggcagugauaggccacugaacauucugggaacagucaugccucugccuuuugucccugacagagaagauaaagucacguguag

SEQ ID NO: 3568 - RNA, 100 nt, Homo sapiens
gaugcauaacuguggguuagugaauuugaggcgugggggugguguggggaaccgauaucuccagacaucccagcuucuauuuauuggggucagaagcauc

SEQ ID NO: 3569 - RNA, 83 nt, Homo sapiens
ccuucauauuccuuugccauccuuaccuacagcccuggcaccuauaaaccgaggguuggaggucaguggcaaagucuggaagg

SEQ ID NO: 3570 - RNA, 82 nt, Homo sapiens
ucuccauccugagucacccaggugauaacauaagaggaauuguuaccuggguguuuuucuccuguaugacucagaaaggaga

SEQ ID NO: 3571 - RNA, 74 nt, Homo sapiens
cucagaucuuggaagaucuuggcucuuuuguuggauuucuucaaggagagaacuaggaucaaccaacaguugag

SEQ ID NO: 3572 - RNA, 104 nt, Homo sapiens
gccuaauccggugcacauuguaggccucauuaaauguuuguugaaugaaaaaaugaaucaucaacagacauuaauugggcgccugcucugugaucuccaugggc

SEQ ID NO: 3573 - RNA, 81 nt, Homo sapiens
gagguaugcuuggcugugaggguuuauaggauaaaagggggaagaaaguccuaacugaauacucacaguuaagaagaccuc

SEQ ID NO: 3574 - RNA, 78 nt, Homo sapiens
cuucuaugcuuuggcugaaugaacugcccccugaauguauuuucucaccucaguguguuuguucaugccagagggaag

SEQ ID NO: 3575 - RNA, 83 nt, Homo sapiens
uucgcaugcccucggcacaucuuaauuguuacugcuccuaauuggcccggcacugucgauuaugaugagucagggauggcggg

SEQ ID NO: 3576 - RNA, 79 nt, Homo sapiens
cauaaauuugguuaugcugaccagcaaaaugcgacagagcgagacccagcauggugcuguucagcauaaccacauugug

SEQ ID NO: 3577 - RNA, 171 nt, Homo sapiens
aggaucacuuuaauaucauccagaugcaaauaacuuauuucauuagccacauccuccugaacaaacugugcaauaagucuagacuuuuguauaaagcauugcagaguuuguucgggagaauaugguuacugaaagaaguuauaugcaucuggaugauguuaaaguuauccu

SEQ ID NO: 3578 - RNA, 83 nt, Homo sapiens
guuaucaagagauaaucauauucuaguggugcuacuuauuguacccaaugaaagucccaaggaugugauuaucucuuaauaac

SEQ ID NO: 3579 - RNA, 106 nt, Homo sapiens
ggggucucagcccuuagaucacaugauuuauaaggcaggagggaguccccuggaugauggaacccccucccuuguauaaaucauuugauuuaagggcugaaacccc

SEQ ID NO: 3580 - RNA, 108 nt, Homo sapiens
uaauucuuuuucuauuggcuguuuuuauggaagguguggggagcauuggucaauucugcucccuacagccuccauaaaaacaaacugauagccaauagaaaaaaauua

SEQ ID NO: 3581 - RNA, 136 nt, Homo sapiens
gaaagcccuuaugauucuggggaucccaugaucaguauuuuuagcaacuagcuuuucuguuugggacugaaaaaaauagaaaagcuacuggcuaaaaaugcugaccgugggaucccucggaauuauaaggacuuuc

SEQ ID NO: 3582 - RNA, 139 nt, Homo sapiens
aauguccgguuucuagaguaaggaguuuugcuggccucaagccuuccaggagaaauggagacccuauacauaccuguuuccaugccuccuagaaguuccgaagccaggguaagaguucucauucuagaaacuguacauu

SEQ ID NO: 3583 - RNA, 55 nt, Homo sapiens
gggcucuuccuucccugucauauguccuuaaaauaacaacaggggaggaaagccc

SEQ ID NO: 3584 - RNA, 73 nt, Homo sapiens
auucucguuuuuccucaaguccauuauacaauuuggauugcauaauacugguggaauugaggaagggcagaau

SEQ ID NO: 3585 - RNA, 98 nt, Homo sapiens
gcaaacauuaggagaguaucuucucuguuuuggccauguguguacucacagccccucacacauggccgaaacagagaaguuacuuuccuaauauuugc

SEQ ID NO: 3586 - RNA, 55 nt, Homo sapiens
ggagacaggggcggggcgggggcgggucaggccccugaagccccgccccuucucc

SEQ ID NO: 3587 - RNA, 69 nt, Homo sapiens
agagacacaaaauguggaaagaagaaagggcuaucagaagucccgugucuccuuacauuuuguauuucu

SEQ ID NO: 3588 - RNA, 71 nt, Homo sapiens
uaaugcgguuuccuaugugggccaauuaaaagcugccuguuaagguucacugcucuauaggaaacccauug

SEQ ID NO: 3589 - RNA, 103 nt, Homo sapiens
auaagcaauagguguuacaagcaguaaaggcuuugaaguuuugcaccaaccuaacauauagagaaccucaaagcccuuacugcuuccaacaccuauuucuugu

SEQ ID NO: 3590 - RNA, 59 nt, Homo sapiens
gggcucuggggaggagcagggaggcauccuuuuggcauauccccuccucucugcagccc

SEQ ID NO: 3591 - RNA, 86 nt, Homo sapiens
ugggccuggcauauggggagggcucagucaggcuccuucacucauucauguaauaucuauugagcccuuuccaugugccaagccca

SEQ ID NO: 3592 - RNA, 79 nt, Homo sapiens
ccacucuuaauuucaacuauuaccucuauuaguauaacucccaaauccuaauagagguaguagcugaaauuaaaagugg

SEQ ID NO: 3593 - RNA, 74 nt, Homo sapiens
gaggacggaagaggaacuuaggagcuaaaugcugacccucucuauuuugcuccagaauguucuuuuccuuucuc

SEQ ID NO: 3594 - RNA, 65 nt, Homo sapiens
gggagccgguggcacagucugcucucuggcccugcccugagggucugagggugccacugacuccc

SEQ ID NO: 3595 - RNA, 64 nt, Homo sapiens
cucaccugauuuccacccaccuguaucacuuuuaguaaauggugcagggauggaaauuaguggg

SEQ ID NO: 3596 - RNA, 80 nt, Homo sapiens
uuggccagggaguaggcaguagcuugaguuauaaggaauuucucuuugaggucucggaacugcugauugcucucugccag

SEQ ID NO: 3597 - RNA, 67 nt, Homo sapiens
gcaaccagaucagcuuuugagacaaaugugaaucaaccacaacacucagcucagcugauuuuguugc

SEQ ID NO: 3598 - RNA, 113 nt, Homo sapiens
gccaacagaguguaacacugagggccuuuugggguaagggucuaggguuuuaaugagguucuacugacccuagacccucaccccaaaggcccucagugcuacacucuauuggc

SEQ ID NO: 3599 - RNA, 71 nt, Homo sapiens
uuucucagguuuauaacuugaacaagaggaaacaguguauauccucuugcuuaagccauaaauuuuggaaa

SEQ ID NO: 3600 - RNA, 69 nt, Homo sapiens
uuacucagguaaaccaccaaaucucaggaccuggaagcagucaugagauuugguaguuuaccuaaguaa

SEQ ID NO: 3601 - RNA, 69 nt, Homo sapiens; identical to SEQ ID NO: 3600

SEQ ID NO: 3602 - RNA, 69 nt, Homo sapiens
uuacucagguaaaccgccaaaucucaggaccuggaagcagucaugagauuuggcaguuuaccuaaguaa

SEQ ID NO: 3603 - RNA, 145 nt, Homo sapiens
uuuugcaugguaccuuguuaacugaaaaccaggcauauuggaaccauguccuugcuuugauuuaauuuuaguuacacagaaccaugcaaaaugagaacauaguucugauacauaugaguuucaguuaacaugguacuauacaaaa

SEQ ID NO: 3604 - RNA, 75 nt, Homo sapiens
ugcuacuucuaaguauucagauaguugugagucaaacugagucaguaaugcugucuggauaucuuggaauuagua

SEQ ID NO: 3605 - RNA, 69 nt, Homo sapiens
cgaggcagacaaaaguuggaaggccgguuaauuuuccccuccuucuccugcuucagcuuugucuccucg

SEQ ID NO: 3606 - RNA, 77 nt, Homo sapiens
uugaacaguucagagggcaaggaagcaaagagaagugcucugagugugucuuugcuugccagcuccugaauuuuuaa

SEQ ID NO: 3607 - RNA, 96 nt, Homo sapiens
acacacccaucucaauaaauagcuguugaguugcuggagcaguguggcugcugcuuugauggccagugaugaacaguguuugagggauggaugugu

SEQ ID NO: 3608 - RNA, 58 nt, Homo sapiens
ucagccugccguccacacucuccaccgccugacaggguuugagugcgauggcagcuga

SEQ ID NO: 3609 - RNA, 76 nt, Homo sapiens
gccugccucuucuguguucugcguuuaaugcauauuaacuguaucugcauuacaccagcagcgagaggagacaggc

SEQ ID NO: 3610 - RNA, 69 nt, Homo sapiens
gucuacccaguguuuagacuaucuguucaggacucccaaauuguacaguagucugcacauugguuaggc

SEQ ID NO: 3611 - RNA, 67 nt, Homo sapiens
gugacccucuagauggaagcacugucuguugucuaagaaaagaucgugcaucccuuuagaguguuac

SEQ ID NO: 3612 - RNA, 80 nt, Homo sapiens
gggggcgagggauuggagagaaaggcaguuccugaugguccccuccccaggggcuggcuuuccucugguccuucccuccc

SEQ ID NO: 3613 - RNA, 106 nt, Homo sapiens
ugggccgggagguugaacauccugcauagugcugccaggaaaucccuauuucauauaagagggggcuggcugguugcauauguaggaugucccaucucccagccca

SEQ ID NO: 3614 - RNA, 88 nt, Homo sapiens
aagcccgcagauuaugacauacugugccuuuuugauauggcauauaaagagccuaaaauaucacagaauguccuguauuugcuggcuu

SEQ ID NO: 3615 - RNA, 108 nt, Homo sapiens
uggggcugggggaggggaaagccuugcccaaggccccugggcuagcaacucaauagagcugggccuaacccaggggucugcaggaugucuccuuccacccccacccca

SEQ ID NO: 3616 - RNA, 78 nt, Homo sapiens
gcaaucauuuuuccccuucucugcuuuguugucuucgcuuugccaggauauaaggccugggagggcagggauuguugu

SEQ ID NO: 3617 - RNA, 115 nt, Homo sapiens
gagucccuuucucacagaagccucugacuccccacacuaguccgggucccacagcaugggacaguaggacccagacaaguauggggaaucggaggcuucuacaaggaagaggcuc

SEQ ID NO: 3618 - RNA, 82 nt, Homo sapiens
ucccucgcaugucccuuccgcguagcuauguauguccuucucagacacagacauacauagguagugagucauaugucaggga

SEQ ID NO: 3619 - RNA, 80 nt, Homo sapiens
gguaccugagaagagguugucugugaugaguucgcuuuuauuaaugacgaauauaacacagauggccuguuuucaguacc

SEQ ID NO: 3620 - RNA, 67 nt, Homo sapiens
cccgucgaggcugggcagucagggggccuuuacagacaauggguccuuugagcugggucuucauggg

SEQ ID NO: 3621 - RNA, 67 nt, Homo sapiens; identical to SEQ ID NO: 3620

SEQ ID NO: 3622 - RNA, 71 nt, Homo sapiens
agauacuaguuaucauagcuucacuuaauacuucugacuuguaguaagugaaguuauguuaacuaauauuu

SEQ ID NO: 3623 - RNA, 69 nt, Homo sapiens
cucugcucuccaucuccgugacaacuccuauguucaggaucuggaggagcacggggcuuggggacaggg

SEQ ID NO: 3624 - RNA, 75 nt, Homo sapiens
gcagacugcgcaugcggggcgcggacgcucggaaggggaaccagccgggaccccgcgcgcgcgcgcgcacucugu

SEQ ID NO: 3625 - RNA, 59 nt, Homo sapiens
gcaggcggcuuagcagaggaggaggagccucaggccccuuucccagccaggcccccugc

SEQ ID NO: 3626 - RNA, 86 nt, Homo sapiens
cuccacaccugaacaaugagaacagcaccgcuuggcucggaccccacugagccagguggugguguucccauuuuccagguauggag

SEQ ID NO: 3627 - RNA, 59 nt, Homo sapiens
gcccccucccccaccugcaggcugcuggguuucccgggcccuucaggaggggaaggggc

SEQ ID NO: 3628 - RNA, 66 nt, Homo sapiens
aagaacaguaggcccucugaaggguuuccagcaguugugcuuugcccuuaaggggcugcuuuucuu

SEQ ID NO: 3629 - RNA, 98 nt, Homo sapiens
ugagacccaguugcggggagaggaagaaggucuggccuuucuacucaguaaggcucuguuuagguuaacccuucuuuuccucuugcugcuggcucuca

SEQ ID NO: 3630 - RNA, 69 nt, Homo sapiens
cuacacguccuuacaagcagugcucuguggcccacaugaaaucaggccauugcaugcuaggaccuguag

SEQ ID NO: 3631 - RNA, 105 nt, Homo sapiens
ucacccuggauuccuguaaauguaugccaucuguagguguuauguggaaacuauguauugcuauauuucaccuauagauguaugcaacuaauuauguccagguga

SEQ ID NO: 3632 - RNA, 65 nt, Homo sapiens
gaaggcgguuccgguucgcggcgguucccggguuuugcguuccgcgcccggccggaaaccccuuc

SEQ ID NO: 3633 - RNA, 77 nt, Homo sapiens
gaacccucaugaagaguucuaacccuugguuuucaauaaagugucuacaagugguuggagauucaucugugagguuc

SEQ ID NO: 3634 - RNA, 91 nt, Homo sapiens
guugccucuaccacucagaugaugucaggcccaguuccucagugcccugcacaaggaacagggcucaucuucugagaaggauggacgcagc

SEQ ID NO: 3635 - RNA, 91 nt, Homo sapiens
uucuccuccugcugucauuucucauuacugcccuugacuucuuucuagaagaguggguacaguggggagugaccagcccccaggaagagga

SEQ ID NO: 3636 - RNA, 91 nt, Homo sapiens
gcuucccugcaacagagugugccucugccgcugccccagggauucuggauuuaggggcagcucuggccagaggcagggacagcagagaggc

SEQ ID NO: 3637 - RNA, 84 nt, Homo sapiens
ucuuacugcccucggcuucuuuacagugcugccuuguugcauauggaucaagcagcauuguacagggcuaugaaggcauugaga

SEQ ID NO: 3638 - RNA, 66 nt, Homo sapiens
ucccacuucccuacuuccuuccagcagaucccugaagaaaggaggcagaaggaacuaggaauggga

SEQ ID NO: 3639 - RNA, 70 nt, Homo sapiens
gucuccuuccgugaggucuuuggcaguucccacaauaauagaggagcuggaagaugaagaggagagagac

SEQ ID NO: 3640 - RNA, 101 nt, Homo sapiens
aaagacaaagucauaucugaaucuauuuaauucaaccucuauauauaaccagaucuaacuagagguugaauuagauagauucagguauguucuuuuucuuu

SEQ ID NO: 3641 - RNA, 84 nt, Homo sapiens
gcugacccuuuuauuuuguguucuucuaguguaugcgugcacacaugcaugcauguguuugaauggaagcacuuaaggaucagc

SEQ ID NO: 3642 - RNA, 78 nt, Homo sapiens
cauggcagugggauggaugauugaugcugcgugggcuuuagcuuccacucuggccuuaaucuuuuccugacuuccaug

SEQ ID NO: 3643 - RNA, 150 nt, Homo sapiens
gccugcggggugcaccggcgcuuucgggcggaaggcggggccucccggccagugaccccgccccgaggcgccucccgggcggggaagggcggggcucgcgcugggaaacuccccuuccaaggccgaggcgccgcugcgcguccuccaggc

SEQ ID NO: 3644 - RNA, 93 nt, Homo sapiens
ugaaccccuaccagggaaaauaccugcuacaagauuuccuuaaucucuaaucugguagcagauauuuccccuggucacgaaccuaggaguuua

SEQ ID NO: 3645 - RNA, 76 nt, Homo sapiens
gcuaccuauauauacaccugcuauguguguggauauguauuuacacauacacauaucagguguauacauacguagc

SEQ ID NO: 3646 - RNA, 146 nt, Homo sapiens
cugugcugcagucuacaccgaaccacggcagcuccauucgcugcuguaacaaguugaaaaaaaacuaauuaauucaaacuuuaguuuuuuuuaaauuuguuacagcgcugagcagagcugccgaccccaugcaggacagcacacag

SEQ ID NO: 3647 - RNA, 83 nt, Homo sapiens
ggccccgccaacccaguguucagacuaccuguucaggaggcucucaauguguacaguagucugcacauugguuaggcugggcu

SEQ ID NO: 3648 - RNA, 72 nt, Homo sapiens
uacaucggccauuauaauacaaccugauaaguguuauagcacuuaucagauuguauuguaauugucugugua

SEQ ID NO: 3649 - RNA, 72 nt, Homo sapiens
ggcgcccgccugggccugccggcacacggggaggaauguuccuuccucugcccggcccgcccagcgcgugcc

SEQ ID NO: 3650 - RNA, 102 nt, Homo sapiens
aagcucuggcuuucuaacagccaggggacacuccugcuugggcugagacuugugcagcucuaguaggaaugucccucugugcuuagaaaacacccaaagcuu

SEQ ID NO: 3651 - RNA, 80 nt, Homo sapiens
cuucgcuccccuccgccuucucuucccgguucuucccggagucgggaaaagcuggguugagagggcgaaaaaggaugagg

SEQ ID NO: 3652 - RNA, 66 nt, Homo sapiens
uggggcagagcccggugccugugagggauaggaagcuccaguucaaagcaggcuugggucucccca

SEQ ID NO: 3653 - RNA, 89 nt, Homo sapiens
ggucccuccgggaagcaggcucuggugagacuguccagccccagggucucggggcacaguuccaggugcccuguccuccaggaaggauc

SEQ ID NO: 3654 - RNA, 64 nt, Homo sapiens
gcgcgcggugguggugggcuuugacccgcacuucagcuacaugaagcucaccaaggcccugcgc

SEQ ID NO: 3655 - RNA, 123 nt, Homo sapiens
caaaacuccuccuuuugguuuauuugccaacagacuucagcuucuugagcaaaguuacugaugaggguuuugcccaagaagccaaagucuguuggcaaacaaaccaaaaggagaagauuuuug

SEQ ID NO: 3656 - RNA, 79 nt, Homo sapiens
ggcuccugaggagucccaaugugcucacugccccuauuagaggggggcccuaacaggugaugcuugggaccccagagcu

SEQ ID NO: 3657 - RNA, 108 nt, Homo sapiens
gaaugccaaagauguguugugucccugcaagugugcugaacuguacugaacugaccaaagcacugcaguucagugggcuugcugaggacccaaagcucaaugucauuc

SEQ ID NO: 3658 - RNA, 105 nt, Homo sapiens
agccucugaaucuaggccgaggaucaggguuccuacugacaagggcaggcaguaagugcacagccccuguggcagagcccugaucaacaccuaacaccacaggcu

SEQ ID NO: 3659 - RNA, 67 nt, Homo sapiens
cugcccagcucucauuaugacauuuagccugugauugauauugugugugucauugagaccuuggcag

SEQ ID NO: 3660 - RNA, 77 nt, Homo sapiens
ggggacagccagagcaggugccagaggaggcucuucccaucuuugcuuggccccucgucaaccugccugucuuccuu

SEQ ID NO: 3661 - RNA, 76 nt, Homo sapiens
uuuugcagguaagccuaucuauccaaauaugaucaucugcuuuaucauauuuagauagauaggcuuaacuacaaaa

SEQ ID NO: 3662 - RNA, 78 nt, Homo sapiens
gucucccggugggucagauguuuuaggucugaucuuccccagaggcaggcucuggaugcaaaggacccagugagagau

SEQ ID NO: 3663 - RNA, 87 nt, Homo sapiens
gaaagcgcuuuggaaugacacgaucacucccguugagugggcacccgagaagccaucgggaaugucguguccgcccagugcucuuuc

SEQ ID NO: 3664 - RNA, 106 nt, Homo sapiens
uaauucuauaaguccacaugguaauuaccuaauuacaagcugucagcauaugauugcugacacuuguaauauuuuguaauuacauaauuuggcaugauuacaauua

SEQ ID NO: 3665 - RNA, 155 nt, Homo sapiens
uugcccagucuccugcggagccacuccucuuggggucccccucuugaaaagaccccugcccaaagcuccagcccugggaugcugauagcagccgugcugagauugaggcugggguagaggggccaucuagagcagucgcucccacuaccuggcaa

SEQ ID NO: 3666 - RNA, 76 nt, Homo sapiens
cacuuccuuuccuccuaccgguuuuauaagcucagcucccugcuuggccacccucacacuaaggaggggagaagug

SEQ ID NO: 3667 - RNA, 173 nt, Homo sapiens
cugaacauacaaugggcugugacacuggauaaaucauuuguuuccacuuguuauugaugacauuucauaacucauuuggggcucugcuuugccccgucacucgugaguuaugagguuaucaaucaugacugggaauaaaugauuuauguaaguugcccuauuguauauuuuag

SEQ ID NO: 3668 - RNA, 71 nt, Homo sapiens
caggccugccuagauauuuuaggggugagucuuuuggaaauugccccacugugauuucuagguacagccug

SEQ ID NO: 3669 - RNA, 105 nt, Homo sapiens
accaacagcuuguucuaauuuaggaaaggcagggugggaggggaguaagggguccccacagggaccuuauuuucuucuaucuugauuucccucaagcuacuuggu

SEQ ID NO: 3670 - RNA, 75 nt, Homo sapiens
ggcuuccuguuuccagggugacguagauuuuuuuccuucgccagucucaccguuacccggggcaacagcugagcc

SEQ ID NO: 3671 - RNA, 135 nt, Homo sapiens
ggggcccggggaggugcuggggcugggggagggggaugacucggaucugcccucuuuguccuggagcaccggaguauauaaauagugcagucuccagccagacucucucccagucuugcacgcccccgcaguccc

SEQ ID NO: 3672 - RNA, 82 nt, Homo sapiens
gcaggcccucuggguaucgguuggugcaaaaguaagaaccacaaugacuucugcaccagccuucuaucugugaggcaucugc

SEQ ID NO: 3673 - RNA, 117 nt, Homo sapiens
gagcacugcuguguuccccaucuugaguuauacuucaucccuuccagucucuguggggccccucacugauccacagugacuggaggucaaugaaguuuugagauaaagcauuugcuc

SEQ ID NO: 3674 - RNA, 70 nt, Homo sapiens
agacacuguagcaggccagagaaugagguguucuaaaauccccucucucugguccugcugcaacuuguuu

SEQ ID NO: 3675 - RNA, 65 nt, Homo sapiens
ugucuccagaggaugccaagcauaaaguccuugaguauauucaucuuggauccucugauuggaca

SEQ ID NO: 3676 - RNA, 112 nt, Homo sapiens
uucaucagucuucucccugucauucauucccuauggaaucccuucuaccugagacaaauaggacugauuacuuuagggaaauugagugaacaggagggaaaacucaaaugag

SEQ ID NO: 3677 - RNA, 87 nt, Homo sapiens
cgagccuguccugccccagcacugugcucaugcuuggaaugcaaacugcagcuaucagagacagcgccgggguuuaauaacugcuug

SEQ ID NO: 3678 - RNA, 55 nt, Homo sapiens
ucuaucuuggaggauguuugugugugagacaauguauauucuucaacauuguaga

SEQ ID NO: 3679 - RNA, 74 nt, Homo sapiens
ggccccucacacugcaagguggugcccuccaggucagaguggaggacauuggcugcgaugugugaagcugggcc

SEQ ID NO: 3680 - RNA, 126 nt, Homo sapiens
ggggacggggcagccagucugcugcauggcagguugcagggcccagguguccggguccugccuacaguggcccggugacacucagggcccggccaccccagccccaggcaggaccccucccucccc

SEQ ID NO: 3681 - RNA, 81 nt, Homo sapiens
cugggcagacagguguccccugguccccuuuccucaccccaauccaggaaaagggaccagggaacaucugcuaauucucag

SEQ ID NO: 3682 - RNA, 75 nt, Homo sapiens
gggcacagcuuucugugucagucucucugguggagaucuaaacuucaucagggcugugcacagaaggugaugccu

SEQ ID NO: 3683 - RNA, 69 nt, Homo sapiens
gugggcacucaauaaaugucuguugaauugaaaugcguuacauucaacggguauuuauugagcacccac

SEQ ID NO: 3684 - RNA, 64 nt, Homo sapiens
uucuccauguccuauguguuacuguaaccacugaaguggcauauaguauauaggacacagagag

SEQ ID NO: 3685 - RNA, 71 nt, Homo sapiens
uuccucaucgagcccagggcugaaauucuggcaagugcucagccaguguaggccucuggcuugaaagggaa

SEQ ID NO: 3686 - RNA, 94 nt, Homo sapiens
ccugacaacugagaaaggcugggcuccuccguuugugcuccagggaaggcggcccuggagcggggauggcgagcagcuggacuuagugcucagg

SEQ ID NO: 3687 - RNA, 74 nt, Homo sapiens
uccuucagggcccucaacacgaucuucucuggacacgagucuggggauagccggguguugugggcuccaaaggg

SEQ ID NO: 3688 - RNA, 83 nt, Homo sapiens
uccagcaucuccaguuagcaguacugauuuuuuuuccccccaacaaaggaacacuacaucaacacuguuggcggggaccugga

SEQ ID NO: 3689 - RNA, 85 nt, Homo sapiens
agauucaggcucaggacccagugagagaaggagacagguccuaaauugcuaucacuuccuauuuugcuggggagagcucuaaucu

SEQ ID NO: 3690 - RNA, 101 nt, Homo sapiens
gagcacaaaccugagccaggcacugcaggcauccugagcaggaguuggguccccaaggcggcugugcgggggcucugugaugccuggggaagguucugcuu

SEQ ID NO: 3691 - RNA, 70 nt, Homo sapiens
agccccaggacaugguucagccaggggcucagaaguggaucagcugugccucuggacuagucucugggcu

SEQ ID NO: 3692 - RNA, 68 nt, Homo sapiens
ggagccaugagcagaacagacuggagcagcacggauguagcaggguuccagcuguucaccucagcucu

SEQ ID NO: 3693 - RNA, 104 nt, Homo sapiens
aaacucagcuuauuggugugcagguggcaccuagcugcuauuuguugggagaagugagcagcaaacagcaggugccaccuggcauaucuguacuuggcagguuu

SEQ ID NO: 3694 - RNA, 89 nt, Homo sapiens
gaaugcagcucaaugggcagugaaaaucaaugagagcaaauuggcccauuuuugccucacugacuuguacuguccauuaagcccuauuu

SEQ ID NO: 3695 - RNA, 129 nt, Homo sapiens
cuuuucauguggaaagaucaauacacaauaauaaagugauugaaaggacguuuagaguauacacaagccccaauuagacauccucucaauugcuuuuacuauuguauauaaaucuuuugacacuaaaag

SEQ ID NO: 3696 - RNA, 93 nt, Homo sapiens
uggcccagugccgccggauuauuuuguauauucaugaagcugcucaucagccgucaggagaaugugcaguaauccuuggaugaaauaaggcca

SEQ ID NO: 3697 - RNA, 90 nt, Homo sapiens
uccugcaggaaggagacggugaugauggggagacaggcuucuugccuccacauccucccaucacaggcaccugucuccuuccccucagga

SEQ ID NO: 3698 - RNA, 99 nt, Homo sapiens
ggggccaggccaggcaaagggcagggggccuggcugggaaaggggccugaggcuccuccuccucugcuaagccgccugcauagccguggccaccgccuc

SEQ ID NO: 3699 - RNA, 92 nt, Homo sapiens
aguuccaucuauaugacaccaaaucauugggaugaaauauggaaaauugagucuaucauccacauguuugaugucaugcaaagacuugaacu

SEQ ID NO: 3700 - RNA, 123 nt, Homo sapiens
uccuucacagcuacacaaggacaggcauucagucucugagauaauaaggaauucacagcaaccaggcuuuccuccuucauggacugaaaugacuguuuuaugugcauuuggcugaaauaagga

SEQ ID NO: 3701 - RNA, 71 nt, Homo sapiens
gcucucauuacagacuuucauucuugggacgaagacgguaauaagaguggaaugucguguaaaaacagagc

SEQ ID NO: 3702 - RNA, 104 nt, Homo sapiens
agagccagcauauuaucuucccauuauuacucuguuuuaauaucuaacugacagaugcaugucacuaaaacaaggcaaucaugggcagaaaaugccccugcucu

SEQ ID NO: 3703 - RNA, 93 nt, Homo sapiens
ggcagcaagccuaccugucaagugcuucugggauuaggagugcgcauugccaacuccccacucuggaagaacuugaugggugggcauccugcc

SEQ ID NO: 3704 - RNA, 83 nt, Homo sapiens
cagggcaaccagcccuggcauugccccuacgggucacucacucuggacugaggcccccagggagugcccagggcaggacccug

SEQ ID NO: 3705 - RNA, 94 nt, Homo sapiens
acccacaaaggcaaggguuggacucuguggccagcagugcccccuucauccccaguaggcaucagagccacagcugucuuccuuugcucugggu

SEQ ID NO: 3706 - RNA, 70 nt, Homo sapiens
ugagccaaagcugaagggcaggaugugguuucagcaugcggugaccaccaucccucccuccaguagcuca

SEQ ID NO: 3707 - RNA, 80 nt, Homo sapiens
ugugacaacugagugggagguuugugugaugauuaucuguccaagcagaauuacacuaaaaccccccaacucauuucaca

SEQ ID NO: 3708 - RNA, 91 nt, Homo sapiens
uuuuccaagccccugacccccaacccugcugccagagcucaccuccaggacaggggcuguggagggguugggggugcaggggagcugagga

SEQ ID NO: 3709 - RNA, 91 nt, Homo sapiens
gaggucaagccaagggcagggacugcagagggugacgcuuggguacccugggcauggacuaacccuuguagaccugccccacagacaccuu

SEQ ID NO: 3710 - RNA, 111 nt, Homo sapiens
gcccacaaugugaggacacgagagaagcacuggacuuagggucagaaggccugagucucucugcugcagaugggcucucugucccugagccaagcuuuguccucccugggc

SEQ ID NO: 3711 - RNA, 64 nt, Homo sapiens
guugacacaggcaggcucuggguaugugcaucgagagauauuucccagagucuguuuuuuugac

SEQ ID NO: 3712 - RNA, 77 nt, Homo sapiens
ucugacacucugaggaugugguuucucacacugugucucucgcacaguaauacacggccguguccucagaucucagg

SEQ ID NO: 3713 - RNA, 77 nt, Homo sapiens
ucugacacucucaggauguggguuuucgcacugugucucucacacaggaauacacgaccaugucuucagaucucagg

SEQ ID NO: 3714 - RNA, 77 nt, Homo sapiens
ucugacacucucaggauguggguuuuugcacugugucucucacacaguaauacacgaccaugucuucagaucucagg

SEQ ID NO: 3715 - RNA, 77 nt, Homo sapiens
ucugacacucucaggauguggguuuuugcacugugucucucacacaguaauacaugaccaugucuucagaucucagg

SEQ ID NO: 3716 - RNA, 88 nt, Homo sapiens
cuccacacggcccuacagcaucugaucuuggcagugucccugucaccaaggucacugcacaaguucugguguccugggaccucuggag

SEQ ID NO: 3717 - RNA, 87 nt, Homo sapiens
cugaucacaggcagauaaguaggcugguugauuaggaugaaucccacagguaaucccuaaucuacuagucuguuuguuaacuaucag

SEQ ID NO: 3718 - RNA, 75 nt, Homo sapiens
gugaucacagcugcuuugcaguagaguaauagccaaauuagcaauuuuuucucugcuacaaaggagcagcaucac

SEQ ID NO: 3719 - RNA, 75 nt, Homo sapiens
uggcccacaugggucugucucaggccagucuuccggcuuuggucacaagucuggcucagggcaguccucugguua

SEQ ID NO: 3720 - RNA, 82 nt, Homo sapiens
gaguucacuggccgcaaguucauucauugauucaguaaauauuuauugaaucaaugaaugcaauguugugcuuucauagcuc

SEQ ID NO: 3721 - RNA, 71 nt, Homo sapiens
ucaaccagacuauuucuguuuaguuaauuuggauaagaaauuuuucagaggauagcaggaauaguaguuga

SEQ ID NO: 3722 - RNA, 83 nt, Homo sapiens
agagccaguggcccuggauucacaucccuuacuggucccauuuuacaguuaaggauacugagggugagucuggggccagcucu

SEQ ID NO: 3723 - RNA, 104 nt, Homo sapiens
ugugacaggagucuugaucaugucgggcaagaguagcaaaacaguuguggaaaauccucgacuuuagaagacugcucuugauuauucaaggucugauuaucaca

SEQ ID NO: 3724 - RNA, 90 nt, Homo sapiens
ccagucauggcaugcgauggaggacaggggaggccauugaggggaugagggucucaaugagcuugucugugccccgagcugcccagcugg

SEQ ID NO: 3725 - RNA, 82 nt, Homo sapiens
uuccccaucugccuuuggugacaggcaugugugggcauuccuuaccucccccaccagccugaucaucaaagcaacaagggaa

SEQ ID NO: 3726 - RNA, 74 nt, Homo sapiens
guauacauugcucaaaggagccccagugcuacugguuucuuaucugucccauuggggcuguuuuaugcuuauac

SEQ ID NO: 3727 - RNA, 83 nt, Homo sapiens
ccugucauucucuaggcagagaggccauaagaauuacacuaccugcgauuuuuaugguccuuuccugccuuaauacuuauagg

SEQ ID NO: 3728 - RNA, 74 nt, Homo sapiens
aagaucauuucaguucuggugguuccgguuuuugcaggcuuagagaaaacuguccaucaggauugugcugucuu

SEQ ID NO: 3729 - RNA, 88 nt, Homo sapiens
gugacccuugggcagggagaguugcuuuccuuuacacaccauuagcagguggcaaagaggggggccugcaucucugcccagcuguugc

SEQ ID NO: 3730 - RNA, 55 nt, Homo sapiens
uccuccccgccgucgcgcccuauuggcugccagggcuucagcgauggugcgaggg

SEQ ID NO: 3731 - RNA, 135 nt, Homo sapiens
gcaagccuugcagaaggaccuccaaggugcagagaggugggcucggggcuccgaguggcccucaaacaaguaccuuuggaccauucaagcucugacccacuuacuguuuccagaguucugucccugcaaacuugu

SEQ ID NO: 3732 - RNA, 84 nt, Homo sapiens
gucaucccuggauuggucaccucugcugcuaucagucaugaagacuauccugcugaugaaggugaccagaucuccaguaaugac

SEQ ID NO: 3733 - RNA, 65 nt, Homo sapiens
gaaauccgcaaucaggcuuucauauuuugcuuuuugcugagugugaauuccucauuguuaauuuc

SEQ ID NO: 3734 - RNA, 100 nt, Homo sapiens
ggagcccagcugcugcugagcugcuccuucccuucccagugagcuccaggcagauguggggcacacgggaugggcagggagacggcaggcaagcugcucc

SEQ ID NO: 3735 - RNA, 65 nt, Homo sapiens
guggaccggagggaggcgguggggcuaacguccacacugccccugccgccuucuguccauuccau

SEQ ID NO: 3736 - RNA, 65 nt, Homo sapiens; identical to SEQ ID NO: 3735

SEQ ID NO: 3737 - RNA, 75 nt, Homo sapiens
gcagccccugagaaccacgucugcucugagcuggguacugccuguucagaacaaaugccgguucccagacgcugc

SEQ ID NO: 3738 - RNA, 112 nt, Homo sapiens
gcuguccucauuauuuuuuuuucugccagauggcuugcuaauuuaaagucccugaagugauagguguuuuauuauagacaauccacuuggcugggaaaaguaagacugcagc

SEQ ID NO: 3739 - RNA, 87 nt, Homo sapiens
cccucccuuuggaucucuccagcuuuaacauggggcccuuaacaacugaggugucagugugaaggcuggggugaccaaguuagaggg

SEQ ID NO: 3740 - RNA, 77 nt, Homo sapiens
acccaccugcaggcugagugacccugggcaaccuuuucccccucucucugcucaguuuccucagcugcaaaaugggu

SEQ ID NO: 3741 - RNA, 68 nt, Homo sapiens
ccagcccccugcugcccagugugucugggccuggcaccucucccagacuaugggcacagguuagcugg

SEQ ID NO: 3742 - RNA, 156 nt, Homo sapiens
cccugccaccuccccccuuuccuuucgucuggccgugcuggcggggcuggcucugggccucagacacucuggaaucgccaaggucugagcucagggccuggcccccuucccaggcuaacagccgggaggacgggggcgcuguccgagggcccaggg

SEQ ID NO: 3743 - RNA, 93 nt, Homo sapiens
aagcuccaauaccuggaaagagguuguaccuaaaguguucucuguauuggcggaaaauguuucccgggcaaccucuuuucauugugaaggcuu

SEQ ID NO: 3744 - RNA, 103 nt, Homo sapiens
agucaccaauaccagauugcuguuuucauagguuuuuucccccauuuagugguuuauuugacggaugggggaaggagagccugugugggaauuugaacugacu

SEQ ID NO: 3745 - RNA, 75 nt, Homo sapiens
cccauccacaaggcacauguguccugaucuuuuauugcuuucuucuggucccagauacugugucuuaacuguggg

SEQ ID NO: 3746 - RNA, 82 nt, Homo sapiens
caaggccacacagacaaugcccuuucucauuguuaugacaaagaaacaaccaaacggugagaagggguguugucugcccuug

SEQ ID NO: 3747 - RNA, 129 nt, Homo sapiens
uccucccaucccaauacgaggcacugaguuaaguguucuacacagauaaucuguuauuaaugagagaauagaauagacaaucuguguagagugcuuaaccuggugcccaguguuuucauuccuagagga

SEQ ID NO: 3748 - RNA, 111 nt, Homo sapiens
ccagccccagccugauuucccagggucuguccuugcccgaugucccucccucaaaguccaugugggaugggagcggggugggggcagcccuaaucaagggauggcugcugg

SEQ ID NO: 3749 - RNA, 82 nt, Homo sapiens
gcacccccucgcugcuccccaugacaggcugucccagugcuggagucagugugagcaugaggagcagugaacaucauggugc

SEQ ID NO: 3750 - RNA, 82 nt, Homo sapiens; identical to SEQ ID NO: 3749

SEQ ID NO: 3751 - RNA, 148 nt, Homo sapiens
ucucacccaugcagcugcugguuuuugugguauaaacuacucuacacagagcacauuguguucauggggccuagaggauccuugaggaaugaacagaugugcucugaagcugacaugugaccaacagaacccagcugugcaauugaga

SEQ ID NO: 3752 - RNA, 117 nt, Homo sapiens
cagagcccuggccagggccaguacacugcccaacuccagaggacccuguccccuccuugugaacggcauucccuggaguugggcaaucuugugggccugcuccuucccuacccucug

SEQ ID NO: 3753 - RNA, 83 nt, Homo sapiens
cccugcccuuuccagaagccugccucagaugcacucacccuucuuggcaggcaucagggguagguguuuaggauuacacaggg

SEQ ID NO: 3754 - RNA, 77 nt, Homo sapiens
cuuuuccucucucuuuuucguuccccucuccucuccuuaccggccuaggggaggggggaaacaaggggagcuagaag

SEQ ID NO: 3755 - RNA, 77 nt, Homo sapiens
ucaauccuugguaaucuggcugcugcugccaucucuuauagggaccuccucguucccagccagagaaccauuguuga

SEQ ID NO: 3756 - RNA, 85 nt, Homo sapiens
gggggccuguguguguuuugccccagggucuucaggcugccuggcugccucuaucugcccccuggguguccagcaccaccccccc

SEQ ID NO: 3757 - RNA, 77 nt, Homo sapiens
uggcuccuggccucaagcaaaucuucuaccuuacuucccaaaguauugggauuacuggugugcuggccugaugguua

SEQ ID NO: 3758 - RNA, 77 nt, Homo sapiens
ccugucgguaggaagauuguuucaaaucuguuugugccugaagcacuuuugauugugacagucuucucauucauggg

SEQ ID NO: 3759 - RNA, 93 nt, Homo sapiens
gguaucguugcugcagcugguguugugaaucaggccgacgagcagcgcauccucuuacccggcuauuucacgacaccaggguugcaucauacc

SEQ ID NO: 3760 - RNA, 81 nt, Homo sapiens
auggccguuucuggcuuaggguaggaugguuguaggugcuggcaacacagucaccugccacuuccugccucagucugccau

SEQ ID NO: 3761 - RNA, 109 nt, Homo sapiens
aacaccuuguuuccuccuuuucucccaucauuucuccuucuacuucauccccacgauaacgcagaggaacagugagagaaguggggugagaagaggaggaagcaguguu

SEQ ID NO: 3762 - RNA, 156 nt, Homo sapiens
auuuacugacaauucaugcuauuuuauaguccaugucuuuuggaauggaugggaguuuguuauucagugguuuauaaaaucuuccagacugaaugaugagcucacaucuguuacaauugguauggaaaguaaaacuggcgugaguuguccauaaau

SEQ ID NO: 3763 - RNA, 72 nt, Homo sapiens
cugcacuaauugagaaugcaaucuacuauggcaccuauuugcugauuuuuggagcauuuuuaauuuauguag

SEQ ID NO: 3764 - RNA, 67 nt, Homo sapiens
ugguacuucauguuaguugaggccucugcucaaugcacucuguccuccuaacuaacaugauuugcua

SEQ ID NO: 3765 - RNA, 80 nt, Homo sapiens
gguaccugaagagagguuuucuggguuucuguuucuuuaaugaggacgaaacacaccugguuaaccucuuuuccaguauc

SEQ ID NO: 3766 - RNA, 72 nt, Homo sapiens
gugggcugggcagggcuccaggacaugugacugggccuuagaggccuguccugggcccccugccccacccac

SEQ ID NO: 3767 - RNA, 75 nt, Homo sapiens
ccuaacuugaaagaggugcuaaauuggauauaggggcaaaaauaaccacgcuccuaggcacucuuucaucuuggg

SEQ ID NO: 3768 - RNA, 81 nt, Homo sapiens
gccgccucgggggaaccggcccgggccucggccgccucuaguccucacacagccgaggcccucucggucccccgccgcggc

SEQ ID NO: 3769 - RNA, 135 nt, Homo sapiens
uucuucuuugcaugcugcucacuucuuauacccagacauuuaugacuaugucauucauaaauuuguccaaaccuuuugugaauuccuucugucauauccuucugguuuaagagaugugagucaugcaagaaagaa

SEQ ID NO: 3770 - RNA, 90 nt, Homo sapiens
ugagccucagguuucccauuuguaccuuggagguaaugcuuucaccuaacgccccaccucacaggguauguagggaacaucuguugcuua

SEQ ID NO: 3771 - RNA, 101 nt, Homo sapiens
ccucacuugacagaggaaacugaaguccagaaaggggacgggauuagaauguccaacagaaguaccuuucaggccucaguuuccuccuuugucacaugagg

SEQ ID NO: 3772 - RNA, 70 nt, Homo sapiens
ccuuccugcgugacguaggcuggcgugggcucuucccccagccccuugccggugcugccacgugagaagg

SEQ ID NO: 3773 - RNA, 70 nt, Homo sapiens; identical to SEQ ID NO: 3772

SEQ ID NO: 3774 - RNA, 87 nt, Homo sapiens
gcacacuuugacuuucuuccucccucgggccugauugggcagcugacagcccacagcucccugaggaaaggaggggauuugaugugc

SEQ ID NO: 3775 - RNA, 87 nt, Homo sapiens
ccaugcuguaguguguguaaacauccuacacucucagcugugagcucaagguggcugggagaggguuguuuacuccuucugccaugg

SEQ ID NO: 3776 - RNA, 110 nt, Homo sapiens
cucugcuccuaccauauguuuaugguuacuuccugggcaucuacacaagggccagucacuguguggggcuggggauaugacaacaaugagaacaacauccagguccagag

SEQ ID NO: 3777 - RNA, 117 nt, Homo sapiens
gcugccuggccucccugggcucugccucccgugccuacugagcugaaacacaguugguuuguguacacuggcucaguucagcaggaacaggggucaagcccccuuggagccugcagc

SEQ ID NO: 3778 - RNA, 160 nt, Homo sapiens
ggggucuguagagguuggcaaagucauuguguugauuugcuaagacuguccuuaaguuuaauuuaaagaaaacuuacuuuaagcauacugguuucuuuaaacuagacuuaaggucaaccuuagcaaaucagcaaaaugacuucgccaaccuguacacccc

SEQ ID NO: 3779 - RNA, 93 nt, Homo sapiens
uccagcuugacuuucuaggguucuaaggaauaagaagggggucauguagauccugguuccuugauuucuccuuagagcuuggaaagcacugga

SEQ ID NO: 3780 - RNA, 63 nt, Homo sapiens
ccuggcugagggagggagcggugauggugggugaccccaacugcuucccuuccuuuccccagg

SEQ ID NO: 3781 - RNA, 81 nt, Homo sapiens
cauugcugagccuccugagcacaguccugggguuggaucauugcaaguucugggaucuguauuugggggguuccucuagug

SEQ ID NO: 3782 - RNA, 87 nt, Homo sapiens
uagggcugaagacagagagggccauggcaggagggaggagggccuugguuuucuuucucuuguguguuccacuuucuucucuuucug

SEQ ID NO: 3783 - RNA, 82 nt, Homo sapiens
agucccuucacuucuuggaggcucagucuccucauguacagcauagaccugggaggugagcucuccgagagugguaaggacu

SEQ ID NO: 3784 - RNA, 75 nt, Homo sapiens
cgccgcuugguuucucauuccucuggucauuuuuguaucaguugaggugggcaggggugggggaucacgacggcg

SEQ ID NO: 3785 - RNA, 75 nt, Homo sapiens
ccuuccuccuagcucacaccuaccuagagauaccugaaaauguuuucucuagguaugucugggcagguucgaagg

SEQ ID NO: 3786 - RNA, 101 nt, Homo sapiens
cuacucuacuuuuucuccaaacuccucuccacucuuguuuagauggucuuuuuucuauucuggauagggguggaguagaaggaaaaaaauguucccaguag

SEQ ID NO: 3787 - RNA, 79 nt, Homo sapiens
caugacuacccacacggcuugccuuccucuccagaugugaacucuggcuggggugggcagcugugucuguccuuucaug

SEQ ID NO: 3788 - RNA, 116 nt, Homo sapiens
uggagcuaagcuucuccauggcagcagcaccuccauuguuuuuaguccauuccaggagcaagcccaugauguagaugcugaaacauggaggcguguuguacgaggagcuguuucca

SEQ ID NO: 3789 - RNA, 71 nt, Homo sapiens
aaggucuaacuaaaacacuccccuacgaggugaauaaaauaccucacaacaccggaguuuuuuggugccuu

SEQ ID NO: 3790 - RNA, 126 nt, Homo sapiens
cucuucuaaagguaaggaaauaugggggugugagggaggagcaggcagaggcagugacaggccaaacaggaagcuggcucugaagcuucuuccuuaucaacuggccccuaauguuaaugccaagag

SEQ ID NO: 3791 - RNA, 81 nt, Homo sapiens
ggagacuccacauucagugggcagugaacacuccuuuaccagagggaauggaggaauccuugcuuauuggauguguucuuc

SEQ ID NO: 3792 - RNA, 89 nt, Homo sapiens
cuggccuccagggcuuuguacaugguaggcuuucauucauucguuugcacauucggugaaggucuacugugugccaggcccugugccag

SEQ ID NO: 3793 - RNA, 129 nt, Homo sapiens
ggcuccucgguagcugccugaaagucuggacucugggggcugggcugggcuggguggggagauugcuguuggucccacugugccuguuguaauccccagguucaugaaagaggugccugccuuagagcc

SEQ ID NO: 3794 - RNA, 88 nt, Homo sapiens
cccagcucccagccccagugcuccuugguuauccuuucugcuucugucaaauaauaaugaaggagcucacugggcauugguaacuggg

SEQ ID NO: 3795 - RNA, 97 nt, Homo sapiens
cugcacucacucuuucugaucacuggaguaccauuuagcaaauugcugcugcaguaggcucaaugauaccccaguguucugaggaaguuaauugcag

SEQ ID NO: 3796 - RNA, 77 nt, Homo sapiens
gcccucucaccuugaggucgcacagcagcauuguuauuuacuuccuuucauuguugcuguggaccuugaguaagggc

SEQ ID NO: 3797 - RNA, 88 nt, Homo sapiens
uugcacucaucuuauguuagugauuuucauauuacauuagcaaauuuaaucucugcucaugugauaggaaguuacuaacacaaugcga

SEQ ID NO: 3798 - RNA, 93 nt, Homo sapiens
ccacccucgcccgcgccgccggccccucccccacuuccggcgucuccuagcgacggcggggguaggggccgggaugcgcgcgggaguuggugg

SEQ ID NO: 3799 - RNA, 71 nt, Homo sapiens
ccuggcucuagcagcacagaaauauuggcacagggaagcgagucugccaauauuggcugugcugcuccagg

SEQ ID NO: 3800 - RNA, 72 nt, Homo sapiens
cugcccugugugacugauugcuucuuguguucaaguucugacugaaccagacagcaaaucaguuguaggcag

SEQ ID NO: 3801 - RNA, 68 nt, Homo sapiens
uggggcuguguuggggaccugagcagagugcaacccagcaugucuggggccuccccaaccugacccca

SEQ ID NO: 3802 - RNA, 90 nt, Homo sapiens
gcuuccugugguaauaagacuguguuacaccaaaggggaauguaugaagcaacagaucuucuugggugugaccagucugagccuugaagc

SEQ ID NO: 3803 - RNA, 78 nt, Homo sapiens
cuccucuuccccgcgccgccggccccucuuauuugagcuuugggaagcugagggcagccaggcagcugggguaaggag

SEQ ID NO: 3804 - RNA, 77 nt, Homo sapiens
aauggcuucacugguggcccauucaaaugugcuaaugucagaaaaaaagguugaauggggcaccaauguacaccauu

SEQ ID NO: 3805 - RNA, 137 nt, Homo sapiens
gccgccuucaggccgcuacgagaggcuugcaacgcuucacgacagcgcgcuuucugccucgcugguuuccaaugugaccucacggcaaccagccaagaaaguggcugucggggugcagcugcgaggccgccagcggc

SEQ ID NO: 3806 - RNA, 66 nt, Homo sapiens
gucuccuugaggaugaggauggggcgggcgauguggucggcgcugcacuccaccucguccugagac

SEQ ID NO: 3807 - RNA, 94 nt, Homo sapiens
ucaaccuuggccuuugcuuggaucucuggacuucugucugaucauuucugcucugcugacagcaguccaggugugauccuggcagaggaguuga

SEQ ID NO: 3808 - RNA, 86 nt, Homo sapiens
uugagcuuugauggcgggcuugcuagcuuucuugacucuuuuuaaacucgcugucugauacuggcaaucuugccaucccuucucaa

SEQ ID NO: 3809 - RNA, 85 nt, Homo sapiens
auguggagcgagagagagggauuuaauguuaauuuuaaauauuaaauccucuauuaauauuaaauuccucucucucguuacacau

SEQ ID NO: 3810 - RNA, 123 nt, Homo sapiens
ccggagucccagagugaaugaauggcuggggagaucccgggaucaaaucgggugcuuucuaauaguguccaccugauuugauucugggaucuccugagccauucauucacuuugggaauuugg

SEQ ID NO: 3811 - RNA, 65 nt, Homo sapiens
gacaggaguuugggucacacgugagcuucauggaguugagcucaugugugacccaaacugcuguc

SEQ ID NO: 3812 - RNA, 75 nt, Homo sapiens
gcacaggguuauaucgccaguaagugucagagcuaugauuuaaauccagauaauccuggcgauauaaccaugugc

SEQ ID NO: 3813 - RNA, 67 nt, Homo sapiens
cugcagagucccaggggagcuguggccugcuguccccucauagggucuuucuccuggggcugugcag

SEQ ID NO: 3814 - RNA, 108 nt, Homo sapiens
augauguucuggaucacauuccuguauguucugguucaguauauuaaagauaacucaaagauagauguacugaaccagaauauaugaaaacgugauccagaaaauuau

SEQ ID NO: 3815 - RNA, 66 nt, Homo sapiens
gcucagggcagaggccacagaggacugcauuugcaccugacuucuagacuggcuucugcugugagu

SEQ ID NO: 3816 - RNA, 65 nt, Homo sapiens
ggagggggaguuagagaggagggaauccugcugcugccggaagaucuauuucugauuccacuucu

SEQ ID NO: 3817 - RNA, 69 nt, Homo sapiens
cacuugugugggugugaaggcggggcuucacagagcccccaggugagcugagccacacccacaagagug

SEQ ID NO: 3818 - RNA, 67 nt, Homo sapiens
caucagcugccucugcuaugacccggaaaugaagaugcuucugucuggcauccugggggcaguggug

SEQ ID NO: 3819 - RNA, 71 nt, Homo sapiens
gggagggaggcagagccagguccucccuggcuggguugcccagccauguccugagcgucugucuugcucuc

SEQ ID NO: 3820 - RNA, 98 nt, Homo sapiens
uugacggccaucgucaaucaggccucaguuggucauaaccuccagugaccggucgcuagaguccaugacacugaggccugaaucaugauggcagucaa

SEQ ID NO: 3821 - RNA, 75 nt, Homo sapiens
uucaugagucaauuuuucuguggcuuauguagguaugacacaaccucaggccaucccagauaauugacugauggg

SEQ ID NO: 3822 - RNA, 66 nt, Homo sapiens
gcugagugauaauagggucgugaccuccuuggaaagggagaccauguuccuugcauugucaucagc

SEQ ID NO: 3823 - RNA, 91 nt, Homo sapiens
ggugugcauuaacccgguucucccaagcccagcucuaagcggaguauaggcggagagcuggguuugggauuuggugauuguugaugacacc

SEQ ID NO: 3824 - RNA, 70 nt, Homo sapiens
gccaugcuggcacagugcccccagcaaggggagcucugcuuccugcuggugggcauaggugccagguggu

SEQ ID NO: 3825 - RNA, 69 nt, Homo sapiens
uuggggagcagggaccaggcgcugugagagauauauguaaaaucuccagcuccuagcccuguugcccag

SEQ ID NO: 3826 - RNA, 76 nt, Homo sapiens
cccuggcaaauaccaucugagaugaaacccacagcagcauaauguugguuuguuguuucagauguauuugauaggg

SEQ ID NO: 3827 - RNA, 80 nt, Homo sapiens
acagugugggguccauaccugcagcaagggucgaucacccacccccacuucugccuugcuguagggugacuccaagcugu

SEQ ID NO: 3828 - RNA, 80 nt, Homo sapiens
uaaaugagcucuuguaaggugccauauaccaauucaugcgcucgaagggagaugaauggugccuugaaagagcugauuua

SEQ ID NO: 3829 - RNA, 72 nt, Homo sapiens
ccagggucagggaugcaggguguugguuuccaucaauucaaggccaggcugcacccugcuuuccugaccugg

SEQ ID NO: 3830 - RNA, 99 nt, Homo sapiens
caggggcuggcacacaguaggugccuacuaaacaguagcucgccuuuaugcauccaguaagcagguguuuagugagcaccugcugcaugccaggcccug

SEQ ID NO: 3831 - RNA, 56 nt, Homo sapiens
cccaggucugggguuggcucaggccacagggcccugcaggcugagcuuaggcuggg

SEQ ID NO: 3832 - RNA, 70 nt, Homo sapiens
ggcuugaccugugagggguugacagccauggcgacugccucugguggccugugccccagcaggugaagcc

SEQ ID NO: 3833 - RNA, 68 nt, Homo sapiens
uucauggguauauaguggcuuuccauugagguuuucacucuuugaaggaggucauuuauaccaaugag

SEQ ID NO: 3834 - RNA, 66 nt, Homo sapiens
ccugggauuuucugccugagggugcucucugcucagaaggcacuccggcaggcuggaggugccagg

SEQ ID NO: 3835 - RNA, 66 nt, Homo sapiens
cuguugucuugguaccucuuugaagugcaaaaacauuacaacuucaaaagcgguccaggaagaugg

SEQ ID NO: 3836 - RNA, 88 nt, Homo sapiens
cugaggcugagauacuauuggggagcaugaggggaggggcugauaaaggucugcagagacaguguccccagaagggucucaggcucag

SEQ ID NO: 3837 - RNA, 74 nt, Homo sapiens
gcccugcgccugcccagcccuccugcucuggugacugaggaccgccaggcaggggcuggugcugggcggggggc

SEQ ID NO: 3838 - RNA, 93 nt, Homo sapiens
cauuuggagcaaugccuggcacauauuaggcacuagcuauuauaacccaaugcuucuugaaucccugguaugugccaggcacuguuugaggug

SEQ ID NO: 3839 - RNA, 132 nt, Homo sapiens
ccgccgcgcgcgcuuggccgcgggccaggaggccgccugcaguuggcgcuucccggggccgcagugccagccgcaaugccggccuccugaaggcaggcgacagccugcggccgggagcacagcgcggggcgg

SEQ ID NO: 3840 - RNA, 76 nt, Homo sapiens
uuucagcuggcugcaaagggaacuggugagguuugcaugcauguucauauucaguuccccuuuguggcuagugaaa

SEQ ID NO: 3841 - RNA, 74 nt, Homo sapiens
ggagggcagagccuaggccuuggagucuggucucaucucauuauuucacagggccuuggccuccucugaccucc

SEQ ID NO: 3842 - RNA, 90 nt, Homo sapiens
ucgaugguguaagaaucucaggugacaaugucaggagcuccugagcaccugagcaccugacauugucaucugagauucugacacgauuga

SEQ ID NO: 3843 - RNA, 66 nt, Homo sapiens
cuugugcuguauuuugaaaaauuagguaauuauauugacaagccuaauuggcaaaagcaggacaag

SEQ ID NO: 3844 - RNA, 113 nt, Homo sapiens
uuuuagggauacagucagucugugaggccaccaggguacuauucacugcuuugcagcagcaauuuaccaaaugguacccuggugacuuagagagugaaugcacaucuguaaag

SEQ ID NO: 3845 - RNA, 75 nt, Homo sapiens
gagccguuuuaaugaggucucucgcuggccagcccguggcuuucagaggccuugagagacccggagagaggguuc

SEQ ID NO: 3846 - RNA, 90 nt, Homo sapiens
ucgauggugugagaaucucaggugacaaugucaggagcuccugagcaccugagcaccugacauugucaucugagauucugacacgauuga

SEQ ID NO: 3847 - RNA, 75 nt, Homo sapiens
cugcagcccaguggugagguggguuggcaugaaacccucaauguaaaagaggcacccucucuccgugggaugcag

SEQ ID NO: 3848 - RNA, 83 nt, Homo sapiens
cuguugcuuauuacauccauaggcucugcuucuacuaacguccuugaaccuuggagcagagccuauggagguauuaaggacag

SEQ ID NO: 3849 - RNA, 55 nt, Homo sapiens
auagugcuucuggcauuucagagagugugcaauguuuugaagccugaaggacugu

SEQ ID NO: 3850 - RNA, 70 nt, Homo sapiens
ccagggagguuaaguagcuugcucaagauuccugcugcuaaguggcaguagcgagccaccaccugccugg

SEQ ID NO: 3851 - RNA, 92 nt, Homo sapiens
gaugugaguuucaccugaugagggaucaggaucuucuuucauauaauuugggaaagcagauguuggucccuuuagaucuguuaacugacauu

SEQ ID NO: 3852 - RNA, 70 nt, Homo sapiens
uaucagucuuuuguaaugacccuaacagaaaagcauccccucuauuuaggagucauuauuggagauggua

SEQ ID NO: 3853 - RNA, 117 nt, Homo sapiens
agugugagaauuuggacucuacucaccaaggaggcuguuguggagagggccagaagagcaaaauggcccagagucacgugguuuuuugaaggguggggagagucucucuuuggcauu

SEQ ID NO: 3854 - RNA, 55 nt, Homo sapiens
ggcaagaugcuggcauagcuguugaacugggaaccugcuaugccaacauauugcc

SEQ ID NO: 3855 - RNA, 102 nt, Homo sapiens
ggcuaggcucgcuguugcuaccucuccucgcagaugcaacgagguaaggcuuguuugcggugccagcugaagguggggaggggggagcgaagcaguguggcc

SEQ ID NO: 3856 - RNA, 70 nt, Homo sapiens
uugaugauugaaguuuugcuagcagggagugucacaaaaggcaacugggcaguggaauuugagugauuag

SEQ ID NO: 3857 - RNA, 97 nt, Homo sapiens
cuccugguugcagagaaggguuuguuuucgccuucugcaagaugggcagguuugugggcuggagggcaggaggcgaagacacagccuggaugagggg

SEQ ID NO: 3858 - RNA, 58 nt, Homo sapiens
gccuugccuggcccugggcagaaugcuggucuaccaccagcagccuggggaggagggc

SEQ ID NO: 3859 - RNA, 89 nt, Homo sapiens
ggcuuguguguagguguucucaggaauccucccagggaaccugcucuuguggguuccuugggaaugauuucaggugagcagcaggagcc

SEQ ID NO: 3860 - RNA, 103 nt, Homo sapiens
aaagggaaguuaaaacaagagucuuuucaaacuagcaacaccucaguuuuuuucuaagggaggugcugcuaguuugaaagggcucuuguuuuaccuuaccuuu

SEQ ID NO: 3861 - RNA, 71 nt, Homo sapiens
uucuugccuucccugcugagagcugcucuacccuuuuuugcaggugcuuuggcucuagcagacaggaagaa

SEQ ID NO: 3862 - RNA, 105 nt, Homo sapiens
agccugugguguuagguguugaucagggcucugccacaggggcugugcacuuacugccugcccuugucaguaggaacccugauccucggccuagauucagaggcu

SEQ ID NO: 3863 - RNA, 56 nt, Homo sapiens
caucuguggaagugggagagaaaaauaauacuuucucugccuacuucacagagaug

SEQ ID NO: 3864 - RNA, 102 nt, Homo sapiens
gccuggggagccgggcguucuggccacccgcggugcagcaggcaccaggcccuggcagaagcaggcugggcuggggguggcaggcagcccuggcccacaggc

SEQ ID NO: 3865 - RNA, 99 nt, Homo sapiens
uuagagucaaugggugguaguggaggaagcauggaauuuggagucugaaaggccuggguucgaaucccugcuucuucacugcuagcccaaggaguuugg

SEQ ID NO: 3866 - RNA, 70 nt, Homo sapiens
gucaggugcaccuccaccaacaauucacugaggauaaaaugcacgugggguuuggugaagguucacugac

SEQ ID NO: 3867 - RNA, 86 nt, Homo sapiens
gugaggaggcccaagggggauggugguggugaggaagccgagaggacuuggccauucaccagcuccucagggaaagcacugcucac

SEQ ID NO: 3868 - RNA, 112 nt, Homo sapiens
ggcuggugggguuucugguugcagggcuaggugguuccccacgggggcagggggugaguuucuguuucccugggucuggagugcccgguucugccucucuguuucagcggcc

SEQ ID NO: 3869 - RNA, 96 nt, Homo sapiens
ggccagugggaacaggcugcuguaagccuugcaauuaggacuuuuuucuaugggcagugggggguauugaaggcugaagcagccuguggcaugguc

SEQ ID NO: 3870 - RNA, 96 nt, Homo sapiens
ggccagugggaacaggcugcuguaagccuugcaauuaggacuuuuuucuaugggcagugggggguauugaaggcugaagcagcguguggcaugguc

SEQ ID NO: 3871 - RNA, 67 nt, Homo sapiens
ggguggaguggggucaggggagggcucagggaucuguauccugccucuucuugggccuccugcaccc

SEQ ID NO: 3872 - RNA, 87 nt, Homo sapiens
ucucaggcugugacccuccaaagggaagaacuuucuguugucuaaaagaaaagaacgcacuucccuuuagaguguuaccgugugaga

SEQ ID NO: 3873 - RNA, 87 nt, Homo sapiens
ucucgggcugugacucuccaaagggaagaauuuucucuugucuaaaagaaaagaacgcacuucccuuuagaguguuaccgugugaga

SEQ ID NO: 3874 - RNA, 67 nt, Homo sapiens
ccaccgcacccgcauguccugguccuuucagggcgcccugaggcggccaggacagagguggaggugg

SEQ ID NO: 3875 - RNA, 67 nt, Homo sapiens; identical to SEQ ID NO: 3874

SEQ ID NO: 3876 - RNA, 83 nt, Homo sapiens
acccugucaguguuccacccugucccaggcccugugauauuuauuguggcuaaaggcaaugagauuggguggaagagaagggu

SEQ ID NO: 3877 - RNA, 124 nt, Homo sapiens
uuugagaaccacuguccuuaaggaauacguagauuuguugccuuuccuggaggcaacaaaucucaugcuccuggagagaaggaaacaaaucuauguacucguuaaggacagugguuacauuaga

SEQ ID NO: 3878 - RNA, 55 nt, Homo sapiens
cuuauggcaacuguggcaaagucucgaagaguuccuuugccaaaugcgagaugag

SEQ ID NO: 3879 - RNA, 119 nt, Homo sapiens
gagaagggcuaucugaggagcugggagagagaaugcaguccccgcucuugccucacaaucccuauuguaagggcuccuuccccacucucucuccugcuucaucaguuuuccauuuucuc

SEQ ID NO: 3880 - RNA, 69 nt, Homo sapiens
ugccugagguugaguguguacauuuaagugacacaauucacuggguguauucauucaccugcuagggca

SEQ ID NO: 3881 - RNA, 141 nt, Homo sapiens
gcuaugauagagacaggucuuaagagagcagagaguggaugcaaucgaggaagacuuccuggucuucauagccccaccucuaggaagucuuccuugguugcacccacucugugcuccguuaagaccugucucuggaguagc

SEQ ID NO: 3882 - RNA, 75 nt, Homo sapiens
cauuagaaauaugccuauaggaaucaaagagagaaccguacaguuuucuagaugcuuauaggcauauuaguaaug

SEQ ID NO: 3883 - RNA, 75 nt, Homo sapiens
acucugagucugugucuguuggucuuacuugcacccugcaaggaaggcagggagaccaaccuugcagauaagggu

SEQ ID NO: 3884 - RNA, 94 nt, Homo sapiens
uggcugacuugccucucucuguuggcuucugugcuguucuguguugcucucugccuccuccacuagcacgggagcaccaagagggcaggagcca

SEQ ID NO: 3885 - RNA, 117 nt, Homo sapiens
agaaugacuuggggcguuggcgggggaagguggagaugagaggcuucuguagcugaugcugucaaggagugccuuuucccuacugccucccacccgccugcuaugaacugagauucu

SEQ ID NO: 3886 - RNA, 79 nt, Homo sapiens
gccaggaauguggacaagugugguugugagaucucucuccugggaucauuaacaaucuaugcuuccugacaucucuggc

SEQ ID NO: 3887 - RNA, 71 nt, Homo sapiens
gcuuugaggucuuggaagauguugcaccaguaugagaauagggggucaguuuccuccaggauccagaaagc

SEQ ID NO: 3888 - RNA, 112 nt, Homo sapiens
guacugauuaauuauuaaaaacacauuuugugugguuugacagcuaugccagagcagucugucucauagugauuaaaccuccauaaaugugguuccaauaaugagcugguac

SEQ ID NO: 3889 - RNA, 68 nt, Homo sapiens
gaagagaugauaaaaaguuuuguauguuuggauccugaggauuugcaaagcuuugagucagcaucuuu

SEQ ID NO: 3890 - RNA, 82 nt, Homo sapiens
aaucugaaggucccagggucugagagucccaaggaucuaugaguugguucuagggaucugagacuugggggucugauggguu

SEQ ID NO: 3891 - RNA, 60 nt, Homo sapiens
cucuugacagcuucauuuucaggccagugagcuaggaugaaaauugagcugcccaaagag

SEQ ID NO: 3892 - RNA, 110 nt, Homo sapiens
ugcaggauccagaggagcuuguguuccaugcugugcaucuugaugacccaagccugaaggucacaaggguggcacagugggggagggcuuaagcaccuggaaaaacugua

SEQ ID NO: 3893 - RNA, 107 nt, Homo sapiens
gcugugacccaugaggcuucucuucugccucugaccuggagggguucuggccacggaaguacccugaaggaggggcaggaggugagaagaugggaaaaaagaacagu

SEQ ID NO: 3894 - RNA, 113 nt, Homo sapiens
ugggagaaaggaaaggagagaggagugaggggcagaaugugaucagggucuucugaguacccugacccugguuuguacucccccaccugcucuugaugcuuuaucucauccca

SEQ ID NO: 3895 - RNA, 150 nt, Homo sapiens
uggccgaagaacaugggugagaaguccugggcugucucagagccuggagugggggggcaggaggggcucagggagaaagugcauacagccccuggcccucucugcccuuccguccccugcucuuggccaugcugugcccaguccaggcca

SEQ ID NO: 3896 - RNA, 118 nt, Homo sapiens
uuccugaagcuagggggugggaguguuauucacggaaaauugaaggcuuguugagucaauaaucuucuuucacacaguaacaauuuuccgcuaaaauuucuugacccaaacaaaggaa

SEQ ID NO: 3897 - RNA, 100 nt, Homo sapiens
gugcugaauuuuugcugcacgugcuuaaaaacacagagaguaaugcugaacuuaaggguagauucucuggucauugagcauauccaagugaacaaagcac

SEQ ID NO: 3898 - RNA, 68 nt, Homo sapiens
uccccgacaucuccugcccacuucuuaccacugcccgacagaugaggcagguggggaggagaagggga

SEQ ID NO: 3899 - RNA, 84 nt, Homo sapiens
ggaaggagggcccuuucccucagagcuugaaggcuucucuguauccuaugccaacaagucuggggagaaaaggcuaacacuuuc

SEQ ID NO: 3900 - RNA, 88 nt, Homo sapiens
cuggggagcuccuggaggcuggggagcgagccugcacagagaaagaaaaacgggucgcucccuccagcugcaggagaggaaggcccag

SEQ ID NO: 3901 - RNA, 121 nt, Homo sapiens
ccagcgagggcaugggcugcugggguggcccaccuuccccgguguacauacugugucuguguaacauuuuguauauuccagaggguagggcugccccuguaucauaccuagcagagguugg

SEQ ID NO: 3902 - RNA, 83 nt, Homo sapiens
ccuuggaguaaaguagcagcacauaaugguuuguggauuuugaaaaggugcaggccauauugugcugccucaaaaauacaagg

SEQ ID NO: 3903 - RNA, 59 nt, Homo sapiens
gugaagauguagugaugggaauucugauuuuaaucagaucuccuucaucucugcuuuac

SEQ ID NO: 3904 - RNA, 77 nt, Homo sapiens
aguuugauaccagguaguggucuguggcuacaggaaucuuguucuacugucugcuuccacugccugcuuaaaaaacu

SEQ ID NO: 3905 - RNA, 90 nt, Homo sapiens
ggguugaucaggugggaggaggccugcaccuuaagugggugcuggagccagccccaagugagucuguggguuccccuaugcagcaggccc

SEQ ID NO: 3906 - RNA, 102 nt, Homo sapiens
aauaggauuuaauuaaccuggaaauugcuguugugccgcagucagggcuacccuagagauugagugcacagauagcaauaagcugguuaacucuacacuguu

SEQ ID NO: 3907 - RNA, 84 nt, Homo sapiens
aaugagcaucagcugugugugugugugcaaugggugucuguguauauaaacacccacacgcauuuauauacaguugauaucauu

SEQ ID NO: 3908 - RNA, 76 nt, Homo sapiens
auccagcuucuucauagugccacuuccuucaguagaaguacuagaagaaagagaaguggacgaugaggaaauggau

SEQ ID NO: 3909 - RNA, 85 nt, Homo sapiens
agccugcgguuccaacaggcgucugucuacguggcuucaaccaaguucaaagucacgcggagagauggcuuuggaaccaggggcu

SEQ ID NO: 3910 - RNA, 64 nt, Homo sapiens
gcccugcucccuccauuccccgcaagaucgcccaggcagggcuggaagggggagaggggagggc

SEQ ID NO: 3911 - RNA, 82 nt, Homo sapiens
uuacugccucaggaagcaugaaagcuuaggcaacauuuuaauuaaauguugccccaggucuuuauucuugcugagaaaguaa

SEQ ID NO: 3912 - RNA, 119 nt, Homo sapiens
gcucugcugccuguucuguugugugcacuggaauauugauuuuucagugugugugcgccggcucuguaaaaaucaauauuucaguagcucgagcacagcgcagggcaguguaauggagc

SEQ ID NO: 3913 - RNA, 82 nt, Homo sapiens
uggaugccugcuggaugaugaagacaucacacaccccacuuucacuccgcacuguggggugucuucacaucuacagaguuca

SEQ ID NO: 3914 - RNA, 79 nt, Homo sapiens
cuggggccaagguuagcucuuggaguugcugaaauaaguggggacaguucugcaauuccacaagcugacugugacucag

SEQ ID NO: 3915 - RNA, 79 nt, Homo sapiens
gaggugcggaagagagacugggugguugagggaacccugugaacuuccucuccucguccuguuucuuuucuuaaaccuc

SEQ ID NO: 3916 - RNA, 73 nt, Homo sapiens
ucagagcagaugaaaggaaggcaugauuggugcaaaugaacagucgugccucuccuuuucauuuacaaucuga

SEQ ID NO: 3917 - RNA, 78 nt, Homo sapiens
gggcugcagggggcggggagcacaugcggcgugcagaccuuuccuuagguuugugcugggugcucugcucucaggccc

SEQ ID NO: 3918 - RNA, 71 nt, Homo sapiens
ccagagcagugaagggauuuccucacugggcucugcucugaggcagaucugaggagcucuguucacucugg

SEQ ID NO: 3919 - RNA, 80 nt, Homo sapiens
gugaggcacacgauguaagugcugaaguucugugcaaauuuauuagcacgaacugaagguacugucauuguuuaacucau

SEQ ID NO: 3920 - RNA, 85 nt, Homo sapiens
aucuggcuugguuuucagcuucacuggauuuuaaucaaaaaccguguugagaauuguuugugacccuggggaccauaugacaggu

SEQ ID NO: 3921 - RNA, 75 nt, Homo sapiens
aucaugcuauggacauaacuggggcgcuggauguuuauucuuucucuccagugagccccaguaugucuuaaugau

SEQ ID NO: 3922 - RNA, 110 nt, Homo sapiens
uggcugcugcaguguggggaagggagggaaaucagaucagugccguccuccuccuggaccagcugcaacucaucuguuuccuucucucuuuaucuucauauuuugggcca

SEQ ID NO: 3923 - RNA, 90 nt, Homo sapiens
ucucagguugugaccuucucgaggaaagaagcacuuucuguugucugaaagaaaagaaagugcuuccuuucagaggguuacgguuugaga

SEQ ID NO: 3924 - RNA, 93 nt, Homo sapiens
gauaaggagagagaagguagagaauagggaagagcuguggagaaaaagcaagucauuccagcuucuauuauuuuucuucuucuuuuuauuauu

SEQ ID NO: 3925 - RNA, 120 nt, Homo sapiens
ccauugguuuucuuuguguuucuguuuuguauuauaguguacgauggcucccuggccucucugggucucucagggaaccaagcguccacugugcccaagaaggaaaaaggaaaaaagugg

SEQ ID NO: 3926 - RNA, 120 nt, Homo sapiens; identical to SEQ ID NO: 3925

SEQ ID NO: 3927 - RNA, 58 nt, Homo sapiens
uuacagggcugguuugucaaacacgguuacaucugcugacaagaaaccaguuauguaa

SEQ ID NO: 3928 - RNA, 85 nt, Homo sapiens
gcgguggccagugucauuuuugugauguugcagcuaguaauaugagcccaguugcauagucacaaaagugaucauuggaaacugu

SEQ ID NO: 3929 - RNA, 77 nt, Homo sapiens
cucuaggaugugcucauugcaugggcuguguauaguauuauucaauacccagagcaugcagugugaacauaauagag

SEQ ID NO: 3930 - RNA, 92 nt, Homo sapiens
cuuuugguguuuucuucuuggcugacacauuaguuuauuauucugcuucaaaugaauaaauuucugugccagccaagauuuuaauaaagaag

SEQ ID NO: 3931 - RNA, 74 nt, Homo sapiens
ccuuuggcuucucccuguuucuuccugcuacuuacaggccugguggcagaggguaggacggggaaagaaggagg

SEQ ID NO: 3932 - RNA, 101 nt, Homo sapiens
uccaugggucagcuauguggacucuagcugccaaaggcgcuucuccuucugaacagagcgcuuugcucagccaguguagacauggccugauaaacaaugga

SEQ ID NO: 3933 - RNA, 89 nt, Homo sapiens
gcuguggauucuuuaucugagcuaugcagaugcuuugaugcaugaagaaaguuuuaagacaucugcacuagcuugaauaagauaacagu

SEQ ID NO: 3934 - RNA, 123 nt, Homo sapiens
caccuggcuggauucuucaguuuuuaaaugcauauuuauguuauucugauaaugacagaucuccuaaacuaucauucugagaauaacauaaaugcacauuugaaaacuggagaauucugggug

SEQ ID NO: 3935 - RNA, 75 nt, Homo sapiens
ccugggucucggguucacuccuuuccugcuccucacagguguaagaauacaggaagggggugccugagugccagg

SEQ ID NO: 3936 - RNA, 75 nt, Homo sapiens
cuuaagucucauggcuucugucuuggaaacuuuaccuuuaaaagauuauuuaagacaggaaccaggagguuuggg

SEQ ID NO: 3937 - RNA, 87 nt, Homo sapiens
ggggugucaaugaagcggagcaaagguauaaggaauuuggggcagggcaccacccuuucaccuuugcccagcuguugugcaaauucc

SEQ ID NO: 3938 - RNA, 159 nt, Homo sapiens
cucccgugcgccucccucccuuccccgccccgggccgcggcuccugauuguccaaacgcaauucucgagucuauggcuccggccgagaguugagucuggacgucccgagccgccgcccccaaaccucgagcgggagagcgggucggagggucuagggag

SEQ ID NO: 3939 - RNA, 88 nt, Homo sapiens
gcagagugggaagagugggaggugaacaggaugacagacggcccaccacggcuccagcugccucuugcugccucccaccuuccucugc

SEQ ID NO: 3940 - RNA, 82 nt, Homo sapiens
cagcuguggggcuuuugggagcuggccguaggcaagggagugccaagugucugcagucagaggccaggagccugggaggcug

SEQ ID NO: 3941 - RNA, 80 nt, Homo sapiens
auuauguuuuguuuucugucagcugccugacagcuaaaaucauauuugcugucagaggugacaggggccacaauagugau

SEQ ID NO: 3942 - RNA, 109 nt, Homo sapiens
gagacguuuuccuuugucaucucuagcucccauaucucguuuccaccaaggcauaugcaucucgguggaaacaaaauauuggagcuagagauacuggcacuuugguuuc

SEQ ID NO: 3943 - RNA, 83 nt, Homo sapiens
uaauuuucuaguaguagcuuguauuaaagagacacaaagugauggagcauggcucuuuaauacgagcuacuauuggauaauua

SEQ ID NO: 3944 - RNA, 83 nt, Homo sapiens
cggggugagguaguagguugugugguuucagggcagugauguugccccucggaagauaacuauacaaccuacugccuucccug

SEQ ID NO: 3945 - RNA, 73 nt, Homo sapiens
agagcugcauuuuaaauggcgagaacaguacauuaaacauguauaagauguaaucucauuuggaaugcgcucu

SEQ ID NO: 3946 - RNA, 66 nt, Homo sapiens
ggaguugaggguguucuugcagguacacacucugcccucuuuuccucugagaacaucuuccgcuuc

SEQ ID NO: 3947 - RNA, 64 nt, Homo sapiens
guuaauguaccuuauuauuccauuucucucugaugaauucuuuggaaucaauaagguacuuaac

SEQ ID NO: 3948 - RNA, 68 nt, Homo sapiens
uggacuucccuuugucauccuaugccugagaauauaugaaggaggcugggaaggcaaagggacguuca

SEQ ID NO: 3949 - RNA, 67 nt, Homo sapiens
cccauuauuguuccuuagaaccaugccugacacguaauuguggaaggaaggaaggaacagucauggg

SEQ ID NO: 3950 - RNA, 85 nt, Homo sapiens
gcucuuguacauggcacuaacuccaaaaguguggaguuaaacuccugaaguccacacuuuaggaguuaaugccauguacuggagc

SEQ ID NO: 3951 - RNA, 82 nt, Homo sapiens
ucuccuuucugagucauacaggagaaaaacacccagguaacaauuccucuuauguuaucaccugggugacucaggauggaga

SEQ ID NO: 3952 - RNA, 72 nt, Homo sapiens
ccuccucuagcauccucaugcccgacauugagcaacugugugcuucaggcauggugcugggugcuggggagg

SEQ ID NO: 3953 - RNA, 67 nt, Homo sapiens
uucuuuagcauaauuaagucuuauguugcagagaaaauugcaacuaauaugcgauuauguuuaggaa

SEQ ID NO: 3954 - RNA, 74 nt, Homo sapiens
gaggauggaagaggaacuuaggagcuaaaugcugacccucucuauuuugcuccagaauguucuuuuccuuucuc

SEQ ID NO: 3955 - RNA, 79 nt, Homo sapiens
gacaaugccuugauuguuuacagcuaagucucuuuaaguaggugaaggcugcugguuauguagaaaauuaaggcuuguu

SEQ ID NO: 3956 - RNA, 73 nt, Homo sapiens
uuaauuuuccacucuguuuaucugacaguguggaugugcaauccaaacagauaaugagagagugggauauuga

SEQ ID NO: 3957 - RNA, 68 nt, Homo sapiens
cuggcuggucugugcuucuagguacaaugguaugugucaccuuguauacagaagccauggauugucag

SEQ ID NO: 3958 - RNA, 76 nt, Homo sapiens
cucuuucgccuucugacuguucugucuguagcaaaccauagagaguuuuucuggacaguccaggaagguguaagag

SEQ ID NO: 3959 - RNA, 88 nt, Homo sapiens
guuuguucuccuauuucuugacugcuuaggaaugcagcaacucauacuggugcauucugagcaauuaagaaguuaugggagacuaggc

SEQ ID NO: 3960 - RNA, 79 nt, Homo sapiens
ucauaucagcuuaaauuucuguuuuuuuuacaaugccaugugggguaacagagggaagaggagagauugagcugugugg

SEQ ID NO: 3961 - RNA, 86 nt, Homo sapiens
cguugucuauauauacccuguagaaccgaauuugugugguauccguauagucacagauucgauucuaggggaauauauggucgaug

SEQ ID NO: 3962 - RNA, 89 nt, Homo sapiens
cucccugaaaugaaaggagaggggauuuuguuaccuagagggcuugacugcaauuagguaauauauuuccuccucuucauuucugggag

SEQ ID NO: 3963 - RNA, 67 nt, Homo sapiens
gggugugugggguuauguguguguguagccuagugacaccagcacccccacaccggccccaccaccc

SEQ ID NO: 3964 - RNA, 87 nt, Homo sapiens
ucucaugcugugacccuacaaagggaagcacuuucucuuguccaaaggaaaagaaggcgcuucccuuuggaguguuacgguuugaga

SEQ ID NO: 3965 - RNA, 69 nt, Homo sapiens
uagagugguuuuugacauugauauacauugccaugauguauguauguuauaugucaagaagcuucucug

SEQ ID NO: 3966 - RNA, 75 nt, Homo sapiens
ggggcugggcuucguggggaucaagcuucguggcuuuuuaugaagaaucccgaacccugccuaggagcccgcccc

SEQ ID NO: 3967 - RNA, 65 nt, Homo sapiens
auugauucucuuuauuuucugcauccugugaaugcacaagggcccagaguggagagagacuuggu

SEQ ID NO: 3968 - RNA, 82 nt, Homo sapiens
gauucuuuuaggccaccaggguuccauuuagagaauuacaauugccaugugcuaacugguacucugguagccugaaugaguu

SEQ ID NO: 3969 - RNA, 108 nt, Homo sapiens
ugauuuaaggcucuuuuagaaagagagacugagggcuaccccggggcaaacacugcaugacucuggcaguagauccagucucucugcuucagacaugggccuuaauca

SEQ ID NO: 3970 - RNA, 81 nt, Homo sapiens
gauacuaaacuguuuuugcgauguguuccuaauaugcacuauaaauauauugggaacauuuugcauguauaguuuuguauc

SEQ ID NO: 3971 - RNA, 68 nt, Homo sapiens
uuuauucuccagauggcgagacugugccgcccugccgcgagggaccaccucuuccacuggaguguaaa

SEQ ID NO: 3972 - RNA, 73 nt, Homo sapiens
ggggauggagagaugcagucaagggagaaucugaagguggaucaaccuuucuugaccucaccucuuccucucc

SEQ ID NO: 3973 - RNA, 89 nt, Homo sapiens
guaccuggugugauuauaaagcaaugagacugauugucauaugucguuugugggauccgucucaguuacuuuauagccauaccugguau

SEQ ID NO: 3974 - RNA, 74 nt, Homo sapiens
cuucuucuucuuccucauccucauccagcuccagcuccagcacugaugagagugaggaugagaaggaagagaag

SEQ ID NO: 3975 - RNA, 97 nt, Homo sapiens
aagggucucaggccugucagucugaaagcucagaaaagaucuccuugaaaagcucuuccaaucuggcuacuucaggcuggcaguuccugggucucuu

SEQ ID NO: 3976 - RNA, 75 nt, Homo sapiens
auuagugguccucauagaauugauagcuuuuugaaccgugacaaugagauuaucgauuccugaaagggcccuaau

SEQ ID NO: 3977 - RNA, 75 nt, Homo sapiens
gucccugcgugcgcacacgggccugcauuuguacccugcguggcuggguauaugcaugugugagugcgcuggggc

SEQ ID NO: 3978 - RNA, 56 nt, Homo sapiens
ucucuucccuuagauguaaaaugcagaggcuacugcauuuuacauaaggguagagg

SEQ ID NO: 3979 - RNA, 66 nt, Homo sapiens
acauaugguuuggauuugagugauuucuucccaagcuggagggauuucucucaagcaaaucuaugu

SEQ ID NO: 3980 - RNA, 67 nt, Homo sapiens
ggcccuggggaggagggugaagacagaggcacccuaggccuuaaacuucaucuagacucccugggcu

SEQ ID NO: 3981 - RNA, 68 nt, Homo sapiens
uuguuuuauugcuacuguucauugauuuaucgaagugauuuauugacgauggacaugcaguacaacaa

SEQ ID NO: 3982 - RNA, 98 nt, Homo sapiens
cacagugaagcuuuggaggaaaucuuucuuccuuuucucuucuuuucccaucacggguugagaaauuggagggaggggcauugcuggggcuuccugug

SEQ ID NO: 3983 - RNA, 149 nt, Homo sapiens
auaugucgugccaagagagcaagcccuucccugcucccucucucacaucccuugcaugguggagggugagcuuucugaaaaccccucccacaugcaggguuugcaggauggcgagccucagcuuuccuugcucucuugugcauguguau

SEQ ID NO: 3984 - RNA, 66 nt, Homo sapiens
cgcucuugggggagggauggaccaugcuugagggccacacccuccaucucuuucucuccacgagcg

SEQ ID NO: 3985 - RNA, 83 nt, Homo sapiens
ucucaugcagucauucuccaaaagaaagcacuuucuguugucugaaagcagagugccuucuuuuggagcguuacuguuugaga

SEQ ID NO: 3986 - RNA, 83 nt, Homo sapiens; identical to SEQ ID NO: 3985

SEQ ID NO: 3987 - RNA, 84 nt, Homo sapiens
ucucaugcagucauucuccaaaagggagcacuuucuguuugaaagaaaacaaagugccuccuuuuagaguguuacuguuugaga

SEQ ID NO: 3988 - RNA, 59 nt, Homo sapiens
gagaauggggccucuuagacucugccucuuacagugguccugggauuugcccuuuucuc

SEQ ID NO: 3989 - RNA, 81 nt, Homo sapiens
ggaguuccuggcauccaagcagaaucacgugagagcaacaccuguuauuuucauguggucauugcuggcccucaggauucc

SEQ ID NO: 3990 - RNA, 72 nt, Homo sapiens
cgggcuggaaaccauagcugucuccugguuuuccagaaauccugcagcugggagagaguuccuuucugccug

SEQ ID NO: 3991 - RNA, 83 nt, Homo sapiens
uguuauuugcagucaguaacaaagauucauccuuguguccaucaugcaacaaggagaaucuuugucacuuaguguaauuaaua

SEQ ID NO: 3992 - RNA, 70 nt, Homo sapiens
auugcuuuuucuagugguugcaugauuaucaugccucugaugauaaaucugcacccacugaaaaugcagu

SEQ ID NO: 3993 - RNA, 62 nt, Homo sapiens
accauuguuucuauuaaaggucuuuaaugauauugcauuuuagaccuguaaugaaacauggu

SEQ ID NO: 3994 - RNA, 83 nt, Homo sapiens
guucauuucuguaaauaacaaaaggaccuuguucuaacaccuucacuuauaacaagguccuugaguauaaaguagaguugagc

SEQ ID NO: 3995 - RNA, 74 nt, Homo sapiens
ugggauggggguugagaaggagaaaaauagaacgcuuucaucgcuucucugauuuuccuucucccucucuucua

SEQ ID NO: 3996 - RNA, 75 nt, Homo sapiens
ccccguggcuucgagccuuugcccugaugugauauugauggcuggggugggaggcaggggcuggagggcccgggg

SEQ ID NO: 3997 - RNA, 118 nt, Homo sapiens
agacuuagccaccuguccuuucuucuauccuccuguacucaucagauugagcaccauguggguccagucccugagaugagugcuugauagauagaggugaacgaugggggcuuggucu

SEQ ID NO: 3998 - RNA, 162 nt, Homo sapiens
cagugugugcagacagcacgggguggcgcugcucucaggugcucuggcugcuuggguuccuggcaugcugauuugugacuuaagauuaaaaucacauugccagggauuaccacgcaaccacgaccuuggcugcuccuccagaaaccguggucgcgcucacug

SEQ ID NO: 3999 - RNA, 101 nt, Homo sapiens
cuaacucccaagaggacaugcuuauggccugcacugacuagggcagauuuucaaaccaguccuagcucuagcaaggcuggccugggguucugugggguugg

SEQ ID NO: 4000 - RNA, 97 nt, Homo sapiens
ggggcugaggaggcuggugucaggccuugguaaauccucuccaguaaggguaaggcaccgaggggaggccaaggccugggugccaguccucugcccc

SEQ ID NO: 4001 - RNA, 80 nt, Homo sapiens
ccugcucuuccuucccuauauucuuggccagacacaaaaaucugaugcucuggcaaaugcagaaauggggagaaggcagg

SEQ ID NO: 4002 - RNA, 73 nt, Homo sapiens
ggugguggcugcggacaacauggacccaagcaggggcaucccugaggggagucugugcugcugagcccccacc

SEQ ID NO: 4003 - RNA, 66 nt, Homo sapiens
ccuccuccuggugcaguguuccgaaaucaccugugguggguuucauuagcaugggcacaggggagg

SEQ ID NO: 4004 - RNA, 89 nt, Homo sapiens
gggcuucucugaguguggugacucuuauuuccagguauauucuuuguguggucacuggaaaguauggaguuguuacaagagaguggcuc

SEQ ID NO: 4005 - RNA, 130 nt, Homo sapiens
gugucucuguguuugcagguguccagugugaggugcagcugguggagucugggggaggcuugguacagccugggggaucccugagacucuccugugcagccucuggauucaccuucaguaacagugacau

SEQ ID NO: 4006 - RNA, 70 nt, Homo sapiens
gauggugacaugcugggguggggagaaaccacugcuaugccuucuuccugaccgaccaguuguuuucauu

SEQ ID NO: 4007 - RNA, 115 nt, Homo sapiens
gcaauuucaguggaugugguuaucaugggauaaucacacuccugggguacagccuugugccuguaaucucucaggaguguaauuauuucaugauaaccacacccccugguguugc

SEQ ID NO: 4008 - RNA, 91 nt, Homo sapiens
ggcgcugaguucccuggcgguaguccagcuggggcggcagcccagcggggacagaaccccagcucggaccccugccacgcugcuuugcgcc

SEQ ID NO: 4009 - RNA, 65 nt, Homo sapiens
ucaguugauauuuuaaggucugagaccuucuuaacugcugcuucagaccuugacuuaucuacuga

SEQ ID NO: 4010 - RNA, 65 nt, Homo sapiens; identical to SEQ ID NO: 4009

SEQ ID NO: 4011 - RNA, 65 nt, Homo sapiens; identical to SEQ ID NO: 4009

SEQ ID NO: 4012 - RNA, 77 nt, Homo sapiens
uggccucugugcccuggugaaggccagggucuucauggcgagccucucccugaccacugccaggguaccgguggcca

SEQ ID NO: 4013 - RNA, 105 nt, Homo sapiens
acagauagaagcugaccuucaccucugucuuaccugguacuguuuaggacguagcugaacuaggucccugguagguauggaaaaggagguugagcucucuuuugu

SEQ ID NO: 4014 - RNA, 124 nt, Homo sapiens
ccuucugggacaggaacacauccacaucagcuucuuucauacccccaaauacuuagggcaaugccuguucuguuuguggguuaaugaaugagucaguggacaagauuuucugacugccugaggg

SEQ ID NO: 4015 - RNA, 141 nt, Homo sapiens
uccuuugcgaauacagcuucaguuccuaaccaaaaacacaucccugcuauugucuugucuggauccagaugcaaacaugauuaauuaaguuucuggugaggagugggacgagggcagugggaacugauggcuugcugagga

SEQ ID NO: 4016 - RNA, 70 nt, Homo sapiens
cuccgugccacuugauagcucugucuauuccuauggaaaccaaguuaguggauggagccaaggcuuggag

SEQ ID NO: 4017 - RNA, 68 nt, Homo sapiens
agauuuugucaccauggcaacuggucauuggaccaaugaaauaaucaguugucaugguaacaugaucu

SEQ ID NO: 4018 - RNA, 75 nt, Homo sapiens
gggagugaacugguuguguuagaagcugcucuacuuaaaaccaugugggggcuucugguacauucauucuuuccc

SEQ ID NO: 4019 - RNA, 61 nt, Homo sapiens
cuccgucucccgcuugcaguaggaauaccugugauuccugugcugcgaguacgagccggag

SEQ ID NO: 4020 - RNA, 132 nt, Homo sapiens
accuguccccugacuugcucuuuccacuucacagucuuaaucaugaggcaagacagugugcucagaaggcacugugcaguucugcugccugaugauuccaaacuuagagugaaaagugaagaugggccaggu

SEQ ID NO: 4021 - RNA, 67 nt, Homo sapiens
ucucuugguguaauuaaagugauuucugguuuugugaagggcagaaauuacgaaguuaggccagagg

SEQ ID NO: 4022 - RNA, 80 nt, Homo sapiens
ugggaugagguaguagguuguauaguuuuagggucacacccaccacugggagauaacuauacaaucuacugucuuuccua

SEQ ID NO: 4023 - RNA, 163 nt, Homo sapiens
cuucauggcucauucucacuuagauaacuauacuguuucucuucccuucuguccucccaugccagaggaaaaacacaucugcugauaucagagucccuccuccucuggagggaggaaggcaaagagagggacagccgagcaacuaggagaaauggcuuuggag

SEQ ID NO: 4024 - RNA, 72 nt, Homo sapiens
ucaggugccucagcuguguucuugguaucacuguguaggaacagugugcagaggggacagugggaguccugg

SEQ ID NO: 4025 - RNA, 82 nt, Homo sapiens
cauuaucuuuguauucuucuccaagaaggaugcuccuagugagugagcugccuuucuuugagagagagugggaaaguuaaug

SEQ ID NO: 4026 - RNA, 88 nt, Homo sapiens
ugaggugacauccucuaauuuuccuaagcacaguggggccuccuggaaacaucugcuggauuugaggaguaaggggaugcuucccuca

SEQ ID NO: 4027 - RNA, 125 nt, Homo sapiens
gugauucuugcuccauuuguacuaaauuggcccuucugaagaguugagcauccuggauguccagauguuugucuauauagaagugguuguugaguauauaaugaagcaccacaaaaaaguaucac

SEQ ID NO: 4028 - RNA, 79 nt, Homo sapiens
ccgggugcacagggccuguuuucccgguggcuggcgaagcaauguccuucccccggguaaagcagcccaugcguuccgg

SEQ ID NO: 4029 - RNA, 79 nt, Homo sapiens; identical to SEQ ID NO: 4028

SEQ ID NO: 4030 - RNA, 79 nt, Homo sapiens; identical to SEQ ID NO: 4028

SEQ ID NO: 4031 - RNA, 79 nt, Homo sapiens; identical to SEQ ID NO: 4028

SEQ ID NO: 4032 - RNA, 79 nt, Homo sapiens; identical to SEQ ID NO: 4028

SEQ ID NO: 4033 - RNA, 79 nt, Homo sapiens; identical to SEQ ID NO: 4028

SEQ ID NO: 4034 - RNA, 79 nt, Homo sapiens; identical to SEQ ID NO: 4028

SEQ ID NO: 4035 - RNA, 79 nt, Homo sapiens; identical to SEQ ID NO: 4028

SEQ ID NO: 4036 - RNA, 81 nt, Homo sapiens
ccagguagagguggagcgaaguggggcucuggaagcugucuacuuaaaccccuuucccacuuccugcuccucccucccugg

SEQ ID NO: 4037 - RNA, 114 nt, Homo sapiens
guggauagaaaucccuauucucuguuaggaaaugcuaaguuauuuauagaacuuuuaagaaaguugcuacaaauagcuuagcaucucaacagaggaagagggacaacucuccau

SEQ ID NO: 4038 - RNA, 99 nt, Homo sapiens
ggcugugcagggacugauaagcccccauuugugaaggugcuucaguaggaagcaaggccuuugagguacucacaaauggggcuguuuauucagccagcc

SEQ ID NO: 4039 - RNA, 114 nt, Homo sapiens
acuucuggauauagagcuuuccuuggauacugugucucuugggauaauccagcuucuacccagaggcuuuuauguuaucccccagagaaucacaguagaaacucucccugaagu

SEQ ID NO: 4040 - RNA, 79 nt, Homo sapiens
gugagucacuggcacaugugagggauauuaucuuuaaauuaguugggggaaauuaauauugcucacuugcuaugcucac

SEQ ID NO: 4041 - RNA, 81 nt, Homo sapiens
uuuuauuccagacacuguaggugagagcuggcacaugccacuaucacugggccagcuuucacacagugcucuaggcuaaaa

SEQ ID NO: 4042 - RNA, 105 nt, Homo sapiens
caguguggcauuguagggcuccacaccguaucugacacuuugggcgagggcaccaugcugaagguguucaugaugcggucugggaacuccucacggaucuuacug

SEQ ID NO: 4043 - RNA, 110 nt, Homo sapiens
cugcuucuccugcugugaaacaacugccauauuuuuuaaaguguugucuguguuuucuuagaggcauuccugcucgaaaagaugugguaauuucauuccauaaguagcag

SEQ ID NO: 4044 - RNA, 72 nt, Homo sapiens
cagcuuggcuaaagugauaggccuaagcucuaaagagacaaucuuuaaauucaggccuuucauuuccaguug

SEQ ID NO: 4045 - RNA, 79 nt, Homo sapiens
gguacuuggagagaggugguccguggcgcguucgcuuuauuuauggcgcacauuacacggucgaccucuuugcaguauc

SEQ ID NO: 4046 - RNA, 87 nt, Homo sapiens
uuacaucugcacucuuaucuuggaacuugguaugggaagacgaauaguaguuccugcuaagccucuaaggugagaagugagcuguga

SEQ ID NO: 4047 - RNA, 74 nt, Homo sapiens
gagaauaggauggaaagggguguuugcugaugguaccuucuaagggaacagcugcccuuuucacauguuuucuc

SEQ ID NO: 4048 - RNA, 72 nt, Homo sapiens
uguggucagugagucuggggguguguguguggguuuccguacuacauauccccggauuuucuaguguccaca

SEQ ID NO: 4049 - RNA, 87 nt, Homo sapiens
aguguucagaaggucucuauggggacugauguccugaggugacuagacgcuuccagacaucagugcccguggcacccagaugacacu

SEQ ID NO: 4050 - RNA, 70 nt, Homo sapiens
gaagguccgguuaaccaccuuggagaccacugaaacaucaucccuccaacgguguguuauuagguuuuuc

SEQ ID NO: 4051 - RNA, 87 nt, Homo sapiens
gcucauacugggauacucaaaaugggggcgcuuuccuuuuugucuguacugggaagugcuucgauuuuggggugucccuguuugagu

SEQ ID NO: 4052 - RNA, 90 nt, Homo sapiens
ucccaugcugugacccucuagaggaagcacuuucuguuuguugucugagaaaaaacaaagugcuucccuuuagaguguuaccguuuggga

SEQ ID NO: 4053 - RNA, 88 nt, Homo sapiens
ucccaugcugugacccuccaaagggaagcgcuuucuguuuguuuucucuuaaacaaagugccucccuuuagaguguuaccguuuggga

SEQ ID NO: 4054 - RNA, 88 nt, Homo sapiens
ucccaugcugugacccucuagaggaagcacuuucuguuuguugucugagaaaaaacaaagugcuucccuuuagaguuacuguuuggga

SEQ ID NO: 4055 - RNA, 68 nt, Homo sapiens
ggcggugguggcuuuggcgcugguggcaggggaagccuuaacggccccggagcugaagccucucuguu

SEQ ID NO: 4056 - RNA, 69 nt, Homo sapiens
gguggugaucaggucugaacagggagguccaugcacauaugaaauuucuuccucucaggcuuucccacu

SEQ ID NO: 4057 - RNA, 56 nt, Homo sapiens
uaauuuuuucacacuggcacccuaauuaaauguuaggguguuaguccuaacaauua

SEQ ID NO: 4058 - RNA, 98 nt, Homo sapiens
ugaucuuguccacaguuuucaaguacauguugcucaacagccacauguucucaucuaugagguugacagcagcaugaacuacgaacucguucagauca

SEQ ID NO: 4059 - RNA, 84 nt, Homo sapiens
uuccuugaguuuaggugaauucuagggucaauauuacaaguuuugacuuugucaugcucuagaauaaaccuaaauuuuuaggga

SEQ ID NO: 4060 - RNA, 84 nt, Homo sapiens
uuccuugaguuuaggugaauucuagggucaauauuacaaguuuugacucuaucaugcucuagaauaaaccuaaauuuuuaggga

SEQ ID NO: 4061 - RNA, 105 nt, Homo sapiens
uguaauuauuuucuccaaucaggauguaguuucaaggguggccaacacugucaaucacccucugcccuucuuugaaacucgcugauuaugggaaagugcuuugca

SEQ ID NO: 4062 - RNA, 96 nt, Homo sapiens
uguccuuguugacauuguuguugcucugcugacuuguuuuucuccuggagcggagccugccugcagcacagcacagcggugacucagcacuggaua

SEQ ID NO: 4063 - RNA, 68 nt, Homo sapiens
caaguuagagcaauguguaggagaggcccaaauauguuuggccugcuuaaacacaugcuuucugcuug

SEQ ID NO: 4064 - RNA, 67 nt, Homo sapiens
aggaguggagggugugaauugaagauuaaaucugcucucagucuuuuccucacuccuuccuucucuu

SEQ ID NO: 4065 - RNA, 147 nt, Homo sapiens
ggaguuugaagcaacauuggaagcugugugcauccggguugagguaguagguuguaugguuuagaguuacacccugggaguuaacuguacaaccuucuagcuuuccuuggagcacacuugagccgucgaggaauucuucaucacuuu

SEQ ID NO: 4066 - RNA, 77 nt, Homo sapiens
ccagcugugcugaggggcagagaucagacuauaaugagauuuguccacugguaucucuuccucuggguaucugcugg

SEQ ID NO: 4067 - RNA, 73 nt, Homo sapiens
gggcuuucccugagggaagguagcaucuugccauuuucuuccugcacagcuuugccuucccagggaucggccc

SEQ ID NO: 4068 - RNA, 83 nt, Homo sapiens
ggccuuggcccucugucucuccuugcuuuucucuuggguucugacccagggagaggaaggacggacacaggaagccuuggguc

SEQ ID NO: 4069 - RNA, 119 nt, Homo sapiens
gucccucuaguaagcuaggcauguagggaaguauauaaauccuuucagacuaccagggaaccacuuaggguuugaaagaauuuauguacuuuccaacugccugauuuaauagcugggac

SEQ ID NO: 4070 - RNA, 57 nt, Homo sapiens
agcauuuucugccugggugcuacaguaauaucugugaaaucaagguugaauugugcu

SEQ ID NO: 4071 - RNA, 86 nt, Homo sapiens
uaggguuggagggagagcccucagugugacccccgguguggaguagggaggguuucagcacugaggaguuuucucagcauucccug

SEQ ID NO: 4072 - RNA, 85 nt, Homo sapiens
ucucaugaugugaccaucuggagguaagaagcacuuuguguuuugugaaagaaagugcuuccuuucagaggguuacucuuugaga

SEQ ID NO: 4073 - RNA, 89 nt, Homo sapiens
uaggcuguaugcuguuaaugcuaaucgugauagggguuuuugccuccaacugacuccuacauauuagcauuaacaguguaugaugccug

SEQ ID NO: 4074 - RNA, 98 nt, Homo sapiens
uggguuuucuuuagcucccagcuuaguauuauuuuuaucacuccaaauguuagucaaaauagaaauaaugcugaauggugagcuaaaggacaugccca

SEQ ID NO: 4075 - RNA, 75 nt, Homo sapiens
ggcaguggaagcugucugaggcuucagggcccccuccucacuaggggcuauaauucaugcaguuucuuaucugcc

SEQ ID NO: 4076 - RNA, 71 nt, Homo sapiens
ggagguauauauccugcagcucaugcuguaccuuagacaugccaguaugggucgggauauauuuagucucu

SEQ ID NO: 4077 - RNA, 82 nt, Homo sapiens
caaacuuaaauugcauccauguuaaagaggaaaaaggcuuuagcacauuccuuuggggaauggaaacaauuuauuuuguuug

SEQ ID NO: 4078 - RNA, 56 nt, Homo sapiens
uuuaaugggauuggcagauugccauuuuugugcuucugccaacucucuucuuugag

SEQ ID NO: 4079 - RNA, 103 nt, Homo sapiens
ccacuuggcaauguugacauacucuuagagacugggguccaggaaauggccuggcuggcccagcucuuucagggagugucagcagggcccauagaacuagugg

SEQ ID NO: 4080 - RNA, 90 nt, Homo sapiens
ugggcuaggucaggccccugggcgcucagcaguucugucggcaagugagcacaagaggagcggggcagccugagggucuggcccugucua

SEQ ID NO: 4081 - RNA, 90 nt, Homo sapiens; identical to SEQ ID NO: 4080

SEQ ID NO: 4082 - RNA, 90 nt, Homo sapiens; identical to SEQ ID NO: 4080

SEQ ID NO: 4083 - RNA, 90 nt, Homo sapiens; identical to SEQ ID NO: 4080

SEQ ID NO: 4084 - RNA, 90 nt, Homo sapiens; identical to SEQ ID NO: 4080

SEQ ID NO: 4085 - RNA, 58 nt, Homo sapiens
ggagguacgaggaggcaucuggccaacccauuccugguccuuguuuccuugaucuuuc

SEQ ID NO: 4086 - RNA, 55 nt, Homo sapiens
ccacuuagcuauucaguuccauggagacagaaaguggaagagagcagcagggugg

SEQ ID NO: 4087 - RNA, 86 nt, Homo sapiens
uggcuuaacaugucucuuuuuggcuuuuugcuuccuugagucuuccaggcaggaucaaauaagcuguauaagagagauuguggccg

SEQ ID NO: 4088 - RNA, 67 nt, Homo sapiens
gguuuuaggcaggugugauauucgacagcaccugagaccggaaauaaaucacaccugcccuugaacc

SEQ ID NO: 4089 - RNA, 108 nt, Homo sapiens
aguuguagaauaugguuuggaauucaaaauguggucaaguauuguuccugaacaugccuuaacaacacuugaccacauccugagucccaaaccauaggucgauuagcu

SEQ ID NO: 4090 - RNA, 76 nt, Homo sapiens
ugucguauucuguaaguuacaagagaguugcuuucaugcaugugaaaugcaauucucuucuugcaaaaacuugaca

SEQ ID NO: 4091 - RNA, 65 nt, Homo sapiens
gcuuguaagugcuagagcgaggaaugccuccuucuaagcuccguuccucccucuggugccugagc

SEQ ID NO: 4092 - RNA, 73 nt, Homo sapiens
acuucuaagcugauuccacuuuuuccccagagcugcugcagugcgguguggguggagggagggaucaggaggu

SEQ ID NO: 4093 - RNA, 72 nt, Homo sapiens
accucuaagcugauuccacuuuuuccacagagcugcuccagggcgguguggguggaggggggaucaggaggu

SEQ ID NO: 4094 - RNA, 74 nt, Homo sapiens
gacaguaagagaagagucuugucaaauuagccuugacaauuaagcaagccuuaauuugacaaggcuuuccuguc

SEQ ID NO: 4095 - RNA, 95 nt, Homo sapiens
ucaucuaaucaggaagggaaucugagugcagcuggggaaacuuaacucuuugacaaccaguucccguuuccaucagcugcucaaguuccugguga

SEQ ID NO: 4096 - RNA, 97 nt, Homo sapiens
agcaguacaggaucucagauacacuccugacuccuaauggugcucuguucuucccaccugccccuucucucaggaugccucuggauccccaccugcu

SEQ ID NO: 4097 - RNA, 88 nt, Homo sapiens
aucauuacuauuuaagcccuucaugcccagaucugaagaggcauaaguggggcacaguuucuggguaugcaggguuuagguuuaugau

SEQ ID NO: 4098 - RNA, 68 nt, Homo sapiens
guucauagcuaggccuucuuaagugucugguuaauauuuuaagcuguacauuuaagagguucuugaac

SEQ ID NO: 4099 - RNA, 172 nt, Homo sapiens
uugcuuagugaauuucugccaucuaacuaaaaaaaauucuguuuaucaccagauccuagaacccuaucaauauugucucugcuguguaaauaguucugaguagugcaauauugcuuauaggguuuugguguuuggaaagaacaaugggcaggcugcagaaaguauguagcag

SEQ ID NO: 4100 - RNA, 120 nt, Homo sapiens
ggaaauauuguucauuagcuguaaucugcggaauugcuugagugaacuuccuuuggaggcugcuuuaaacgguucacucaaguaaagcaguuuguaugguaauuaagggagcauuuuucu

SEQ ID NO: 4101 - RNA, 117 nt, Homo sapiens
aaagcuauucuauagcuguuccuuuuuuauaacugccccaucuuaucccuccuggagaugccgacccagcagggggugagguaauggccaguuauggagaucagaauggauugcuuu

SEQ ID NO: 4102 - RNA, 92 nt, Homo sapiens
gcccuuaugccuaggaucuugcauauuauaugugccuuauuaaugcuugcaauuguaagugcacuguaagugcaggaugagggcuacagggc

SEQ ID NO: 4103 - RNA, 94 nt, Homo sapiens
ggguguauuaggugggggauggucuaggggauccugugugcuguucuuuuugcuaggauccccuaagacccuuccuucacugucuuuuucauuc

SEQ ID NO: 4104 - RNA, 94 nt, Homo sapiens
ccagguauucugcauguccaaacuugguggugacagcaguagcaaacaacccugagugucccucuguuccugccaauuugaugcuacacccugg

SEQ ID NO: 4105 - RNA, 84 nt, Homo sapiens
gcucuucuccuuucagcuguuaaccgaccaaguacaucuuuaauuuccaagaccgauggugugguagcaguugagaggaagagc

SEQ ID NO: 4106 - RNA, 70 nt, Homo sapiens
uuagaucuuuuuauuuacccuguuaaagugcucauauggcuucgaacaacggguaaaugaaaaacucuga

SEQ ID NO: 4107 - RNA, 63 nt, Homo sapiens
gccaaucagagagcagcuuuuaugaaacugggcucucucauuggcuagcugcuuucucuuggc

SEQ ID NO: 4108 - RNA, 79 nt, Homo sapiens
cucuuucuccauauucaagaugcgggagucuuuggauuuuucagaacaaagacuccucuaucuagaauauggacaagag

SEQ ID NO: 4109 - RNA, 81 nt, Homo sapiens
guuucucaguuucauacauuaucugcaucaccagcuaaauuucuagaugugcuuugcagaugauauuugaagcuaggagac

SEQ ID NO: 4110 - RNA, 106 nt, Homo sapiens
caguguccuggguaggccuugaagggugaucuucacguaagccuguggccagagcaagaaagcugcacacgggcagcggaggaaccagcaggagcccaguccacug

SEQ ID NO: 4111 - RNA, 124 nt, Homo sapiens
ggauuucacaggccacgugauuagucgcacaaguuggauggaguugggggauuuuaugcacacagguucccaaccauaaaaucucccaacucuggccgggugcaguggcucacgccuguaaucc

SEQ ID NO: 4112 - RNA, 85 nt, Homo sapiens
gaggguccagucccaggcgugcauggguagaggcuggguacauuccuaucagccuuccucgggcaccccuccuggcugcccccuc

SEQ ID NO: 4113 - RNA, 99 nt, Homo sapiens
gaugaucuugggcuuccaggcauacuccuggguggaccagauaguucccacuuugcugucugaguccacuaggauuuggcacuggagacuuaacucauc

SEQ ID NO: 4114 - RNA, 74 nt, Homo sapiens
gagggucaacuaugcaggcagacugaguuucaaguaaagaaauuugucauucuuguuugcuuugguuagcucuu

SEQ ID NO: 4115 - RNA, 176 nt, Homo sapiens
gcacuuccuccguuuugcugguuguagaaugagugcucucauuuuacuuaaaaugaguuaauuuuuuaaugaugugugcuucuucuaucuuuggggaauguacaucaugauaaauuaaguaguuuaaaauaaauuugugaguacucaucccacgaccgcuaguuugggguuggugu

SEQ ID NO: 4116 - RNA, 87 nt, Homo sapiens
cuuguuccacucuagcagcacguaaauauuggcguagugaaauauauauuaaacaccaauauuacugugcugcuuuagugugacagg

SEQ ID NO: 4117 - RNA, 57 nt, Homo sapiens
uuccuucccuaagauucccaacacacagcagaagcugguuggggaugaggucaggaa

SEQ ID NO: 4118 - RNA, 102 nt, Homo sapiens
gcucaucuuugggcaggcucacggcugugauggaaggaauuagucaauugguucacucccucauuccuccauuuagccguguggccugucagugaccugggc

SEQ ID NO: 4119 - RNA, 91 nt, Homo sapiens
gguugucgugacaaccugggcagugucugcuccugauaaccacauaaugagguugucaggaacagaagugcccccauccccacacccaacc

SEQ ID NO: 4120 - RNA, 135 nt, Homo sapiens
gggacucaagacaggccuaacagcguccuuucuguucaugggaggcacugcuggagcuugcugacauuggacaauuugcuccugguagugugcccauggggagcagagcucagacauguauggugugucuguccc

SEQ ID NO: 4121 - RNA, 56 nt, Homo sapiens
uguuuucauuucuucauccuugagccuaaagcuaagggaagaggaaagaaugaaca

SEQ ID NO: 4122 - RNA, 83 nt, Homo sapiens
accucucacaaauuggcaaucgucuccauuuuuacacccuauauggaaugcaaaaauagaggggauugucaguucuaugaggu

SEQ ID NO: 4123 - RNA, 66 nt, Homo sapiens
cagacuccucauccagugcuccuuucacacugccaagcuaagcagaggacauuggguggcugucug

SEQ ID NO: 4124 - RNA, 101 nt, Homo sapiens
gcacuucccgcccgcgcaccugguggucuacggcuggucuguuggcggcuucacggccaccugggccaccaugaccuacccggagcugggugcacuggugc

SEQ ID NO: 4125 - RNA, 92 nt, Homo sapiens
uccacucccgcccaggcucugcgccgcgacuucuauggcucuaccuuucaugagccucauagucuggugagagacuggauguguaaugugga

SEQ ID NO: 4126 - RNA, 82 nt, Homo sapiens
ggccauccucacugcuucugcaucucaucagcuuuccgaaucccauuggaagcugcugggcuggaagcugugcucucuggcc

SEQ ID NO: 4127 - RNA, 57 nt, Homo sapiens
cccucucugcuacauuucuuggacaguuuuaaagagcccaugaauguaguuuggggg

SEQ ID NO: 4128 - RNA, 129 nt, Homo sapiens
gauugucuucauuaaggacauuaauauucauagggaguagaaaaucugacacaagagaggacucacuaaccuuuucucguauuagauuuuuacuucuuaacacaauuacaguccggcaaugacuuaauu

SEQ ID NO: 4129 - RNA, 84 nt, Homo sapiens
gccagucucuaggucccugagacccuuuaaccugugaggacauccagggucacaggugagguucuugggagccuggcgucuggc

SEQ ID NO: 4130 - RNA, 87 nt, Homo sapiens
uaaacucugaagugccacacaaauguaaggcauuauuauuuaaaauuaugauguaugcuugccauuuaaaauggugcuuuuuguuua

SEQ ID NO: 4131 - RNA, 79 nt, Homo sapiens
ugcucucuaaguucagggaguuuacaagucuacugugcauucagccagagacaguaaccuuucuggucuuuucugagca

SEQ ID NO: 4132 - RNA, 87 nt, Homo sapiens
uucacucuagugcuuuauggcuuuuuauuccuaugugauaguaauaaagucucauguagggauggaagccaugaaauacauugugaa

SEQ ID NO: 4133 - RNA, 81 nt, Homo sapiens
uggcuucucuuuggaaacaguucacugguuuucucaagggaccaaugggcuaugaagaccagggacuguccaagcuggcca

SEQ ID NO: 4134 - RNA, 85 nt, Homo sapiens
gaaacucugccaaacacuucacaggauaaugcuucggaacuggugucauaggagcauuauccuguaaagugcuggacucuguuuc

SEQ ID NO: 4135 - RNA, 76 nt, Homo sapiens
guccaucugucagaucuuaagcaacuugaggucagggacaguauguccucaaguugcuucagacaauguuuuggac

SEQ ID NO: 4136 - RNA, 107 nt, Homo sapiens
gcaggucuugagucuggcagccagggagggagcacagccgccucucaugaaacaauggcacccugcugugcuucuucaagcuggucugucacucacucccucccugc

SEQ ID NO: 4137 - RNA, 94 nt, Homo sapiens
ucuucuguugccuugugcagcagaucuccaugaaacucaguuggggcaaacugagaugagugcauggagaucugcuacacaaggcaguggaaga

SEQ ID NO: 4138 - RNA, 69 nt, Homo sapiens
ggggauggggggcagaagccuaaggcuaccaccccuuuauuugccuucaugcugcugucccuuuucccc

SEQ ID NO: 4139 - RNA, 67 nt, Homo sapiens
auccuugcaacgaaccugagccacugauucaguaaaauacucaguggcacauguuuguugugagggu

SEQ ID NO: 4140 - RNA, 66 nt, Homo sapiens
ggacuugggcgucaguauucuggucaagaggccucccaaauuuaugagagucugauguuugagucu

SEQ ID NO: 4141 - RNA, 88 nt, Homo sapiens
acucuugcucucucucaggacuuccauuuccucauccgaccugugaggcaauuggauugggaggucucugaggucagagggugggagu

SEQ ID NO: 4142 - RNA, 80 nt, Homo sapiens
ugauuuggucuugacagaaauguuuuaaauacagcuucuagcuguuuaagguauuuagucauuuugacaagacuggguua

SEQ ID NO: 4143 - RNA, 110 nt, Homo sapiens
ugugcugggcauucuucuaggggguggagauauagcagugaggacaaugucuuacgaagcuuuauuuauucauuguugaauccucaguucccagaauagugccuggcaca

SEQ ID NO: 4144 - RNA, 92 nt, Homo sapiens
uucuuugguuguucaugucacggcccuucagucugcgcaguuuuacaaaugugcuggcgagaugaaaggcgccgggaacagcgacuggagaa

SEQ ID NO: 4145 - RNA, 70 nt, Homo sapiens
ggcccuggcaggugaggggugggggguggugcugggaagccccaagcccagccucaagcuugcuggggcu

SEQ ID NO: 4146 - RNA, 77 nt, Homo sapiens
cagggugggggcuggggcugaggucuguccaaggggcuguguccagcuugcugggcaaccuggccaagucuccccug

SEQ ID NO: 4147 - RNA, 85 nt, Homo sapiens
gugugugagguucugacucagggagcagcucugugucugccucauccccaacauagcuguuucuugagauuugggccuuccacau

SEQ ID NO: 4148 - RNA, 84 nt, Homo sapiens
cuugcuggugggguaggauguguucucguuacuaguaauucuuggaacagaaaacgagaaaacauauccgucuccacguguggg

SEQ ID NO: 4149 - RNA, 84 nt, Homo sapiens; identical to SEQ ID NO: 4148

SEQ ID NO: 4150 - RNA, 84 nt, Homo sapiens; identical to SEQ ID NO: 4148

SEQ ID NO: 4151 - RNA, 80 nt, Homo sapiens
uugagugaggcacuucccuucuccagcuuauuucaccaucugucgaaugaagauggggagaagggggaugccuaccuuga

SEQ ID NO: 4152 - RNA, 73 nt, Homo sapiens
gguucuggggaguuuguggggccucagguaucaccugggucagaccccauccccacacacccuucuuggaacu

SEQ ID NO: 4153 - RNA, 168 nt, Homo sapiens
ggcccugagggcuggcuuuggcugagacaggugcagggaaggugagaagcaggcugaggagcacagagagggagucugugucuugauuuccuuucuuguuuacuucuuuuguguccuuucccacccucgucacccuggccucagucuucauugagucuucccugggcc

SEQ ID NO: 4154 - RNA, 65 nt, Homo sapiens
gucucugaaauuggcugguucccauaacaguuaaacuuuauggcagcacaguauauuuuggagau

SEQ ID NO: 4155 - RNA, 136 nt, Homo sapiens
gcagcugaugagucaucaaaugggagaaaucugagagccauguguuccacaggccucugguccuuguucaggcagcagggcacugugacauguggcuccuuggccccuuccagccaccaccuugauugcaugcugc

SEQ ID NO: 4156 - RNA, 115 nt, Homo sapiens
aggugugggccaaggcgggcagccugggguguguccuggucucagggcaucucaccagggaaaagggccccgagcugggcaggccugggcugccuccuugacucugccugugccu

SEQ ID NO: 4157 - RNA, 64 nt, Homo sapiens
uuaggugcuggaugaucucugaguuggacaucuucuugaacaucucagggcucacagugccuaa

SEQ ID NO: 4158 - RNA, 101 nt, Homo sapiens
ggggcugggaugcaaacacaggugucuuucugacuccaaagugauguuauuagcuuuuuaacauauaauuagaaagauauuuggucuuugcuccugguucc

SEQ ID NO: 4159 - RNA, 78 nt, Homo sapiens
cucgcugcccccucccccuuccgcuguggccaccggcuuuguuuuccggaaacgcacggaucagggagggagggugag

SEQ ID NO: 4160 - RNA, 110 nt, Homo sapiens
ggcagugugugaugugaguaaggaggaacauugugugauucagucaguguugccucaccuggcugaacacauuucugucacuacuggcaugcaucagaauucauccugcu

SEQ ID NO: 4161 - RNA, 103 nt, Homo sapiens
caccauggcccuggcugagguaguaguuugugcuguuggucggguugugacauugcccgcuguggagauaacugcgcaagcuacugccuugcuagugcuggug

SEQ ID NO: 4162 - RNA, 115 nt, Homo sapiens
gccaguguugucuuuccugcagcucgaagcuaacaagacccugaacugcugcuucucuaggaccucagagcuuaguguuuugucagcuucaagcuguuuuggagaaaguguuggc

SEQ ID NO: 4163 - RNA, 56 nt, Homo sapiens
ggugguggggcccuggcgucaggcaauauucagaccagccagggcccauugucacc

SEQ ID NO: 4164 - RNA, 74 nt, Homo sapiens
ccggaugggggcggggcggguaggccggaggcgcagagucuccgccgggaccgcgaccccgccccgcuuuccgg

SEQ ID NO: 4165 - RNA, 89 nt, Homo sapiens
acagcugucagucccacccaccugcccgugguaguaagcucugggagcauggccucugcugggggugggggguagacuggaggugcugu

SEQ ID NO: 4166 - RNA, 97 nt, Homo sapiens
gggccugagugagcucauuucuaggggcuccaggcaggggaccaggaaugucauggugacugccuggauguggccccuagugaggcucuccuggccc

SEQ ID NO: 4167 - RNA, 78 nt, Homo sapiens
uuccuugcaucuguacacauuugaaagguugauauguauuauuugcaugugaaugcacggauguguaugaaauaggaa

SEQ ID NO: 4168 - RNA, 87 nt, Homo sapiens
ucucaugcugugacccucuagagggaagcgcuuucuguugucugaaagaaaagaacgcgcuucccuauagaggguuacccuuugaga

SEQ ID NO: 4169 - RNA, 87 nt, Homo sapiens
ucucaugcugugacccucuagagggaagcacuuucucuugucuaaaagaaaagaaagcgcuucucuuuagaggauuacucuuugaga

SEQ ID NO: 4170 - RNA, 73 nt, Homo sapiens
gccauuggagcuuggaguccagcugggcaguuucuuuuauauuuguuuagccuuaccuucagguugcuguggc

SEQ ID NO: 4171 - RNA, 56 nt, Homo sapiens
uuuuauguguagcuuuaaaagguacuaaugggguaacuuuuaaagcuacuuuaaaa

SEQ ID NO: 4172 - RNA, 101 nt, Homo sapiens
uaggcuguaacauaugcaguaugaacucaugcguuugaguugaguuaauuauaugaguuaacacaaguguaugagcucauacuauacauguaaaaugcuua

SEQ ID NO: 4173 - RNA, 79 nt, Homo sapiens
gcugguguuuuccgggaucugcaugugccucuucccauguaacuuugguaggccuugugcaggucuuggaguuuccagu

SEQ ID NO: 4174 - RNA, 70 nt, Homo sapiens
ucaucuguuguugcugugcguccugcacugagcuacggccagacccuggauguucaguaaaaguugguga

SEQ ID NO: 4175 - RNA, 101 nt, Homo sapiens
gccccuguuuuguccccuucccaucucccugggaaugaugaccuugccuuugucaggagggaggcgucacucccaguugcuugggcugggguaucuggggc

SEQ ID NO: 4176 - RNA, 78 nt, Homo sapiens
agcauuugugaaugaguuuugguuucuuggaguuauaaaauguguguaaacuaguaaaccaugucucauucaugugcu

SEQ ID NO: 4177 - RNA, 111 nt, Homo sapiens
gaugauugggcugcaaauaugauccuucugcuauguuuugccuagaacuuuaggcagaacuuuaguucuaggcagaauguagcagaagauuauauaugcagccugcucauc

SEQ ID NO: 4178 - RNA, 60 nt, Homo sapiens
ccaaauuggugcagcaaagugguuaauaggaucauuagccuacucgcuguauuuuuuugg

SEQ ID NO: 4179 - RNA, 101 nt, Homo sapiens
gcuguuuggagcucugcgguggguggaacauguuucaugcuggggugacggggcauuuucagcaaagcgugucuccccacuuuguguugaguuccuacggc

SEQ ID NO: 4180 - RNA, 86 nt, Homo sapiens
ccaaguuucaguucauguaaacauccuacacucagcuguaauacauggauuggcugggagguggauguuuacuucagcugacuugg

SEQ ID NO: 4181 - RNA, 66 nt, Homo sapiens
gugauuucuuccacuugggcaugucucuucagggguccuuggaaguuaugucuauggaagugucac

SEQ ID NO: 4182 - RNA, 72 nt, Homo sapiens
ugcauuuugauagucuccuagccugugacccaggacagauuccuugcaugcauaggaguuugucaccaugca

SEQ ID NO: 4183 - RNA, 98 nt, Homo sapiens
ugugcuuccagagacaguucacacuaccaagcucuauggcaccacaacuuuuaaggugagagggcccuacaguacuguggaacugcuucugguguaca

SEQ ID NO: 4184 - RNA, 82 nt, Homo sapiens
cucccuugcauuguguucuugguuuuggagauacaucaaacuacgaaugauguauucuuucaaacuugagaaagugugggag

SEQ ID NO: 4185 - RNA, 89 nt, Homo sapiens
gaggguucauugugguggcacuuuacuuccucaggagagucuucccuggcacucucuuguggggugaggugccucuucaauguucccuc

SEQ ID NO: 4186 - RNA, 76 nt, Homo sapiens
ggugguuuccuuuugucuccuuuauuacaugggacucugacaugugcccauagcuaggguggcaguaggaucuacc

SEQ ID NO: 4187 - RNA, 131 nt, Homo sapiens
ccucuuuguauucacguuucccaucuguaaaauugggcacugccuguggcacccauaccacugucgggagaauucaagcacugggaccccgggaagugcucaguauccauggaggacggauguaccagagg

SEQ ID NO: 4188 - RNA, 56 nt, Homo sapiens
accuuuucaagcuccaagaguuucacauuuggagacuuuuacagcauugggagggu

SEQ ID NO: 4189 - RNA, 107 nt, Homo sapiens
accuuuuggcuuugcuguccuuauuucucuucuucugaucccucaucugcuccuuccuuugcugaucauuagaacaggaagagggauaaggggcagcugccuaaggu

SEQ ID NO: 4190 - RNA, 65 nt, Homo sapiens
uuuucuucuggucuaaggucuucuguuucccuguggaaucaggaagugccauagaugagugaaaa

SEQ ID NO: 4191 - RNA, 78 nt, Homo sapiens
cgccuuuguuucagugauuccgauuccaaacgacacauccaaguuacuguuugaaucggcaucgagcuuacuggggcg

SEQ ID NO: 4192 - RNA, 83 nt, Homo sapiens
ugguguuaucaaguguaacagcaacuccauguggacuguguaccaauuuccaguggagaugcuguuacuuuugaugguuacca

SEQ ID NO: 4193 - RNA, 69 nt, Homo sapiens
cagacuucuucuugugccuuguccacaguuucugggggaugcuggggacaccgcaggaaguacugucug

SEQ ID NO: 4194 - RNA, 114 nt, Homo sapiens
ggcccuugccuuucugagugccugguuugaccucuugaucccuccaggggagaacgucacagucaaaggaggggugcaagaggccaguggcacacagagaggucugugugggcc

SEQ ID NO: 4195 - RNA, 66 nt, Homo sapiens
uccccuuaccaggcuccuccuuguucucagcagcagaaucgaugggggaggggucuggagugggga

SEQ ID NO: 4196 - RNA, 124 nt, Homo sapiens
guuccuuaaaggauucugauuuuucucacaucccucacguccuuccugauaggcaggguuucuuucugugucuguuugggaaggguguucagggggccuucucuccaagucuccauccuggaac

SEQ ID NO: 4197 - RNA, 55 nt, Homo sapiens
gccaguucccauuguagaaugcugauaaacaacuuaccauuuugcaguggcuggu

SEQ ID NO: 4198 - RNA, 103 nt, Homo sapiens
cgaccuucuauuccucuggguauaacucugauccgcugugaggaauauuauuauauuauuucuggcagugggccacagugguacaccauuugggaugugguug

SEQ ID NO: 4199 - RNA, 81 nt, Homo sapiens
ggcuguucuguagagucagcaggugguaaucaaggauuugguuuuaaagauuagccaccugcuguuuucuucaccuuagcc

SEQ ID NO: 4200 - RNA, 75 nt, Homo sapiens
gaguuuucauggcacagguagaauuucugggauaaauaaaaguuugugggauuuuaccuuggccaucuuuaacuu

SEQ ID NO: 4201 - RNA, 83 nt, Homo sapiens
cccaguucauccgggaucuuuuuuuccuucuccaaaccucucucugcaugguugggcaggugggaggauccuggagcucuggg

SEQ ID NO: 4202 - RNA, 84 nt, Homo sapiens
cacuuuucaucuuguagcuucucaagcaagguuacucaagaaagaguugcugggugugcuagaggcuacaaagaauuacaagug

SEQ ID NO: 4203 - RNA, 115 nt, Homo sapiens
ccaccuucagcugaguguagugcccuacuccagagggcgucacucauguaaacuaaaacaugauuguagccuuuuggaguagaguaauacacaucacguaacgcauauuuggugg

SEQ ID NO: 4204 - RNA, 101 nt, Homo sapiens
gcauuuucaaggaaaacaggaggccagcacaaaggcagugcuaauuaccucuaauuacccagaagaggaaagcacuguuuuuugugauguacuccuaaugu

SEQ ID NO: 4205 - RNA, 120 nt, Homo sapiens
ggaguuucaaugucuuccucccaaaaaccucuaagcugauuccacucuuuccacagaccugcuguagugcgguguggguggagggagggaucagaagguacagaaaaaaaagacugcucc

SEQ ID NO: 4206 - RNA, 102 nt, Homo sapiens
guucauuccacaugcagauucucgggacucccuccaggaaauuaaauugagauucccggauuuaacccccuggaaggggucccaagaauucacguguugaac

SEQ ID NO: 4207 - RNA, 102 nt, Homo sapiens; identical to SEQ ID NO: 4206

SEQ ID NO: 4208 - RNA, 100 nt, Homo sapiens
ggcaguucucgggagugcuucugcgugugugauaugccucugcacacaugucuugugcaugugggagugucacaugcugcacgaggcucaccugucugcc

SEQ ID NO: 4209 - RNA, 125 nt, Homo sapiens
caggcuucucuugcauguguagcugcuucugccaccugguuucauuuccagcacauuauuccuguuuaugugggugcugggaagugggaaaaggggccucacugcuggacaaaacacucugcuug

SEQ ID NO: 4210 - RNA, 70 nt, Homo sapiens
aagguuugucugcuauucauaaacugcuuaagauguuuucuuguaguuugugacauaagcagaacgcuuu

SEQ ID NO: 4211 - RNA, 82 nt, Homo sapiens
gugacuugugggcuucccuuugucauccuucgccuagggcucugagcagggcagggacagcaaaggggugcucaguugucac

SEQ ID NO: 4212 - RNA, 114 nt, Homo sapiens
ugccuuugauacucauucauggauuagaagggauuauaauuugauaauaauaauggcauuuuacauguuauauguuauggucccuucuaauccagaaacaaugaauacuaggca

SEQ ID NO: 4213 - RNA, 82 nt, Homo sapiens
gccuguugccacaaacccguagauccgaacuugugguauuaguccgcacaagcuuguaucuauagguaugugucuguuaggc

SEQ ID NO: 4214 - RNA, 132 nt, Homo sapiens
cucccuugguaaaaaugagcuugcagcuauaauaccucugguggucaagagugucaagugugcaacgguacugucagacauuuugcgcagaugcacucugaccacuccuggcauggugggacuucaugggag

SEQ ID NO: 4215 - RNA, 68 nt, Homo sapiens
caucuuuguggcuccugguugcuaggagcaggugcuucuguuacuaagcaacaggagccuguuggaug

SEQ ID NO: 4216 - RNA, 87 nt, Homo sapiens
cgggcuugucacuugugugcugcgcagaugugccugcaagggagaauucuugcuguaggucuggccguagccacauagguaugcccg

SEQ ID NO: 4217 - RNA, 58 nt, Homo sapiens
uugucuuuguucccgggacucaggggcuguguugcugcuggcuuccuggggauggcaa

SEQ ID NO: 4218 - RNA, 71 nt, Homo sapiens
aaauguuuagaggaaaucuguugcugggauccaaaguuuaaugucagcaauuuuauuuccucuucucauuu

SEQ ID NO: 4219 - RNA, 105 nt, Homo sapiens
ggggcuuuggguugagccccagaugacauggcugccgcaggcagguggccucgaggccccuggagccuccggguguggccauguugggggcaccggcccugcccc

SEQ ID NO: 4220 - RNA, 80 nt, Homo sapiens
uucucuuucucugcuuuguuuccaaaagccugaagugugagaggcucccgcuggaggccugggggcagaggggaggggaa

SEQ ID NO: 4221 - RNA, 78 nt, Homo sapiens
aaugcuuuggguugggaauaguugaggguuuagaauuuguauccugcuugaaucccuaacuuuucccauccuugcauu

SEQ ID NO: 4222 - RNA, 83 nt, Homo sapiens
agagcuuugccuuagaucaguaguugguaagggucauaggauguaaucccaggccaacuggcugaucucaaagccugugcucu

SEQ ID NO: 4223 - RNA, 90 nt, Homo sapiens
uugccuuuuacuucuugauguuugugacucuuuuggccucaacuuugagaccagagcggguagaggaucuuuagggguauguagugguaa

SEQ ID NO: 4224 - RNA, 78 nt, Homo sapiens
ugcuguuuaaccucucuggaccucuuugcaagaauuaaaugggaaaaggugcaugaaggggucuaggaggugucagca

SEQ ID NO: 4225 - RNA, 74 nt, Homo sapiens
acacguuucuacauucuuuucccuggguacagaaacuccacaucugaccacagggaagccaaaauguaccgugu

SEQ ID NO: 4226 - RNA, 113 nt, Homo sapiens
ugcaguuugaccugaucuggcuugcggaugcgguauaaagacagugccacaacaugggcacaauaaaauauguccuuguuuccacagcugcaggucacugagguaaucuugca

SEQ ID NO: 4227 - RNA, 79 nt, Homo sapiens
cucuauuuguuaauaggguagauuuaagucgauguucucuaacacaguaaacauaagcuuaaauguucccuaauuagag

SEQ ID NO: 4228 - RNA, 101 nt, Homo sapiens
caaguuuuuggucuaauuccagcugaggauuuaaugggacucauucugacaagauauaggauauugucccaauagaugcucauuuggaaaugggccacuug

SEQ ID NO: 4229 - RNA, 75 nt, Homo sapiens
aacuauuuuuucucucuggacuuauucuuuacauuuuuagaaaaguggggaaugggcagaugagaauuuuuaguu

SEQ ID NO: 4230 - RNA, 75 nt, Homo sapiens
auaauuuuuugcaucuugggcauugcuaauccuacaagacguucagaagagcagugcccagagagcaucuguuau

SEQ ID NO: 4231 - RNA, 120 nt, Homo sapiens
gcuucuuuuaucuaaucucuacguuaacaaauggacgcugcagccagugucuauccuguggcugaggcauggacgcuggcuguagcaaccauuuguuagguguagacgguucucugaagc

SEQ ID NO: 4232 - RNA, 80 nt, Homo sapiens
ucagcuuuuuaaauauaggaaaccagauguaaauaugcugcuucgguuauuuacaucugacauucuugcaugcuugcuga

SEQ ID NO: 4233 - RNA, 79 nt, Homo sapiens
aaggaggcagagaugaguaagacaggagguggcuaguuauaaauuccucggcugugucuuauucaucucugcuugccuu

SEQ ID NO: 4234 - RNA, 134 nt, Homo sapiens
uuacugcuuaggaucauggaacuggcucuuucuuugguucuguuccaccucaaauaagcuggggagagguguguggcugucauuggguguggcaaagccaaagaaggagcuaauucaugauucuaagcauguga

SEQ ID NO: 4235 - RNA, 76 nt, Homo sapiens
cucagacuguacucuuauagccaucugaaauacguuuucuagguagagauagauuguguaaggguacaguugugag

SEQ ID NO: 4236 - RNA, 76 nt, Homo sapiens; identical to SEQ ID NO: 4235

SEQ ID NO: 4237 - RNA, 76 nt, Homo sapiens; identical to SEQ ID NO: 4235

SEQ ID NO: 4238 - RNA, 76 nt, Homo sapiens; identical to SEQ ID NO: 4235

SEQ ID NO: 4239 - RNA, 76 nt, Homo sapiens; identical to SEQ ID NO: 4235

SEQ ID NO: 4240 - RNA, 76 nt, Homo sapiens; identical to SEQ ID NO: 4235

SEQ ID NO: 4241 - RNA, 76 nt, Homo sapiens; identical to SEQ ID NO: 4235

SEQ ID NO: 4242 - RNA, 66 nt, Homo sapiens
aaggugaucucaauuauuuucauagcaucucuugaugaugagguacaaaugguugggauuauucuu

SEQ ID NO: 4243 - RNA, 63 nt, Homo sapiens
ggauucccagcugucugcaugaggagggggagucagcugcccuggcaggcagcugggguaucc

SEQ ID NO: 4244 - RNA, 55 nt, Homo sapiens
gggcagaggggacuggcagccagcuaugcuugcggcuucuggucccuucuaguuc

SEQ ID NO: 4245 - RNA, 77 nt, Homo sapiens
cugcacucugucuuuucauuaauagaaguuaacccaauaaguuaaugacuucuguuaacuaaaagacagagugguag

SEQ ID NO: 4246 - RNA, 76 nt, Homo sapiens
cucagacuguacucuucuagccaucugaaauacguuuucuagguagagauagauuguguaaggguacaguugugag

SEQ ID NO: 4247 - RNA, 76 nt, Homo sapiens; identical to SEQ ID NO: 4246

SEQ ID NO: 4248 - RNA, 58 nt, Homo sapiens
acaggcuauuuuuggaguuguguuguuuggagagcaaccaagccagaaauagugcugu

SEQ ID NO: 4249 - RNA, 78 nt, Homo sapiens
gagucacaguggacuuggagucaggaggccugagguccuugaagaccucccugaccugcucugguccacugugugcuc

SEQ ID NO: 4250 - RNA, 159 nt, Homo sapiens
cagugaaauuccuaaggauccaaaagaaucagaaggauggcucaggccugccuacauguuacaguggugaguucuuuagaaacuugccccacugugauuucuagguacaacccgccuguguuccugggguugcucucuccauaguggggauuucugcug

SEQ ID NO: 4251 - RNA, 78 nt, Homo sapiens
ugcaagagucugaguuggaaaguaagguugucucuauaacuuaucaccagcccuccuuucugucucaggcucugugca

SEQ ID NO: 4252 - RNA, 67 nt, Homo sapiens
ggaucuguguauguuuguguauugcuuguacuguccuacuugguuuccauaugcauacauagugucc

SEQ ID NO: 4253 - RNA, 90 nt, Homo sapiens
ucuucuucuggaagcugguuucacaugguggcuuagauuuuuccaucuuuguaucuagcaccauuugaaaucaguguuuuaggaguaaga

SEQ ID NO: 4254 - RNA, 133 nt, Homo sapiens
aucaguucauuuucugccuuuagucaaagccuaaucaaaugaggcugggagaggcaauacuuuacauuucucuacugccucuucuagccucguuugauuagguuuugccuaauggcagaaaaaugaacuugau

SEQ ID NO: 4255 - RNA, 72 nt, Homo sapiens
gaggggcggggguaucgcugugggggaggagucucggggcucccccuccccaacgcacacccccgccgccuc

SEQ ID NO: 4256 - RNA, 137 nt, Homo sapiens
gguagaggagggcccagggagguugugaaaugaaggagaaaggaaggaacagggguccgggaagaguaacugucuuguucucaucuuucuucuuuuccuugcagcaaacaguuuguggauuugaccuucuucgugcc

SEQ ID NO: 4257 - RNA, 135 nt, Homo sapiens
ggggggggcuggcguaguuugccugugugggccaguucagugagccaucugugcucaguccagagaccauugggagaggggcacuaugggcucucuggacauugcaucugggaagcuuagaaccagccccauccc

SEQ ID NO: 4258 - RNA, 80 nt, Homo sapiens
cuguacccagagcugcuuggagagccuuccacauggaucagucaaugaccaaggaggaguucuaagccuuuggguggcag

SEQ ID NO: 4259 - RNA, 71 nt, Homo sapiens
ucuggucuuuuuuaucugcucauucugugauucagaaauugaggaacauaacucagauaaaaggacucaga

SEQ ID NO: 4260 - RNA, 75 nt, Homo sapiens
gcaggucaggacaguaggcucaccugacuggagaaagcagggcaaggucagggagccacgugauccugacacugc

SEQ ID NO: 4261 - RNA, 169 nt, Homo sapiens
gagccagggcaggccuugaguugaaaauguuuccugccucuccccgguggcucuguaccugguagaaggagggaagaggcugcagguuccccauucccuguuuucuccuuuccugcccucuggcagcugccaaacucggggugggcggggaggccuuugcccugcgcuc

SEQ ID NO: 4262 - RNA, 59 nt, Homo sapiens
uuucaggaguacauuuucacuuagcuguucucuaaguagaaaugcauuacuccuagaaa

SEQ ID NO: 4263 - RNA, 85 nt, Homo sapiens
caggaacauagggcgacacccaccuucagucuguuggaaggaaaucugaccugaagaaauacaggguguuggacuauguuacuug

SEQ ID NO: 4264 - RNA, 66 nt, Homo sapiens
gcuuuugacugggugucuaaggccaguagggauuccaggcaggcagcagacaaucaguuagaaagc

SEQ ID NO: 4265 - RNA, 66 nt, Homo sapiens
aaggcaauaauguuugugcagugcuauuccuuuaacugaauaguacuguuuguaauuguugaccuu

SEQ ID NO: 4266 - RNA, 92 nt, Homo sapiens
ccagggcaggguguguggaggagagugagggaaugaucaugauugcaccuccugcucacuuuuacacucuuguucucacuuccugccucugg

SEQ ID NO: 4267 - RNA, 56 nt, Homo sapiens
ggccccagauguuugaaagacuuuugcagacaagguaaucaauccauuugguggcc

SEQ ID NO: 4268 - RNA, 96 nt, Homo sapiens
cacuuacuucuuuguuaucccagaccacaguccuuugaaaagcugacauggcuuuuugcuaagggugaugauggggcugggauuagaaguauagug

SEQ ID NO: 4269 - RNA, 70 nt, Homo sapiens
ugucaaagacacuuuggggaccaccguggaagaucauuuguggggaggucaucaggguggucuuuggaca

SEQ ID NO: 4270 - RNA, 74 nt, Homo sapiens
cacacaccagaaagccugggacaaagccugggcuagagcccucaggauucauucucaggcuuccuggugcugug

SEQ ID NO: 4271 - RNA, 74 nt, Homo sapiens; identical to SEQ ID NO: 4270

SEQ ID NO: 4272 - RNA, 88 nt, Homo sapiens
gcccacccuuaugcauguauucagucuuccagaucgccagagaugaguggguggucucgaugacugugcauaugcacaaggguagggu

SEQ ID NO: 4273 - RNA, 77 nt, Homo sapiens
uggacuuucaaguacccagagguuucagcucacaagagacaaaugucaguagugagccuggaguacugagagaucua

SEQ ID NO: 4274 - RNA, 77 nt, Homo sapiens
uggacuuucaaguacccagagguuucagcucacaggagacaaauaucaguagugagccuggaguacugaaagaucua

SEQ ID NO: 4275 - RNA, 69 nt, Homo sapiens
cuggcugcugaccugcccagggugugucugaccugaggggacccacuccuaggcuggccagcagcccag

SEQ ID NO: 4276 - RNA, 67 nt, Homo sapiens
gucuagguccaagauuccaggucuugauaagugugacuuuugggauuuagaucuaaggacuuaagac

SEQ ID NO: 4277 - RNA, 130 nt, Homo sapiens
ggggagcgggaucccgggccccgggcgggcgggagggacgggacgcggugcaguguuguuuuuucccccgccaauauugcacucgucccggccuccggcccccccggccccccggccuccccgcuacccc

SEQ ID NO: 4278 - RNA, 70 nt, Homo sapiens
ggcucagcugccuggagugggugagcagaccagaagcaugacccugccccacccccagccagcugcagcc

SEQ ID NO: 4279 - RNA, 56 nt, Homo sapiens
gcccgaccgcgccggcccgcaccucccggcccggagcugcgggcugcggucagggc

SEQ ID NO: 4280 - RNA, 73 nt, Homo sapiens
ucacaucuaaggaugaagacuaaugacagauacuuccugcuuuaagaguggaagucuucagauuagauaguga

SEQ ID NO: 4281 - RNA, 95 nt, Homo sapiens
ugcaugcuaagguuuggggccaagauuuaucucauucucugauggcauuuuaucguuauuagagagccauaaauuucagcuccguuagcacugca

SEQ ID NO: 4282 - RNA, 71 nt, Homo sapiens
cucuugcgugccccggccacccccgggcggcuuguagccggugcgcgggguggcuggggcuacgugcagag

SEQ ID NO: 4283 - RNA, 89 nt, Homo sapiens
gcuccucuuccagcuguucucacucuuucugcuguuucuacaccacugagcugcagaaugaugagaauacagcugaggcaagagagagc

SEQ ID NO: 4284 - RNA, 66 nt, Homo sapiens
aggggccagguacccucaguucaccaugacugccacuagauggcacugauggcacucuggcacccu

SEQ ID NO: 4285 - RNA, 59 nt, Homo sapiens
gguuucuguaaaugugggucagucaugugauuaagugacccagauuuccgcagacaacc

SEQ ID NO: 4286 - RNA, 128 nt, Homo sapiens
guccuucacggugggguucugggggcacagguggguuggugggcaagggcacagcagcuccuucuccagcugcugcccagcccccaacccagagccagaugaacacugacccgcugaggugagcggau

SEQ ID NO: 4287 - RNA, 104 nt, Homo sapiens
aguuacagcaauggggccuuguagagacaggaccugaggaagcuggcgcugccuccuuagaccuguuucucugccagaaaugccuccauuuccagcugucaacu

SEQ ID NO: 4288 - RNA, 77 nt, Homo sapiens
aagagagguaagagaauuaauguuugggugcuaggcagucaguugggcaguucacauaaauucucucauuucaucuu

SEQ ID NO: 4289 - RNA, 88 nt, Homo sapiens
uguauugugagggaguaagugggugggcaugggaacucaagugugggccugagcccugugacucccauccgcucuccccacagcuaca

SEQ ID NO: 4290 - RNA, 70 nt, Homo sapiens
cucugccucaagggaaaugaggagaaaaaaaaaauacaguucuuuccacauuucccccuagaggugagag

SEQ ID NO: 4291 - RNA, 71 nt, Homo sapiens
guggcuguaagggucuguguggaugcaccuccugccaaccugggagcguccacccagacugugcagcccac

SEQ ID NO: 4292 - RNA, 62 nt, Homo sapiens
ucugcaggucagugugcagcuguuucagcaucaccuccagcugguacaccuugccugucaga

SEQ ID NO: 4293 - RNA, 78 nt, Homo sapiens
ccccggggagcugugugagcaguggugugcagaaaugauucaaucaccaugcacaucugcagcuuagguccccugggg

SEQ ID NO: 4294 - RNA, 86 nt, Homo sapiens
uuccgucccuucugcagucaacacagcccuggcucugcauucggcccucucuucacagggcugugucugggcagauggggcuggaa

SEQ ID NO: 4295 - RNA, 86 nt, Homo sapiens
uuccgucccuucugcagucaacacagcccuggcucugcauucggcccucucuucacggggcugugucugggcagauggggcuggaa

SEQ ID NO: 4296 - RNA, 77 nt, Homo sapiens
gccuuaggggaccaucccagccucucagugucccucuuccucccuugcacucagaugcugaugguccuucuaugggc

SEQ ID NO: 4297 - RNA, 70 nt, Homo sapiens
agaguggccuugaagcuccccccaacaacccuggcugccggggcuggggguggccucaggagccaucucu

SEQ ID NO: 4298 - RNA, 65 nt, Homo sapiens
aggugcacuccuugcagcauucuggagagaagcccuuuagaugcgagguaaggaaugugcuaccu

SEQ ID NO: 4299 - RNA, 73 nt, Homo sapiens
aaccagucauucuucucacccuccaaucucaaaaggggaaaagacggagggagagauggaguuagauuagguu

SEQ ID NO: 4300 - RNA, 101 nt, Homo sapiens
accaggacccaagaaaacuauucucuuuaguaucucugugucuucuauaauugauggccauguauuauagagaauaggaguucuacaaggcuguccauggu

SEQ ID NO: 4301 - RNA, 136 nt, Homo sapiens
gucccuccucuuucucucugucuggauuccuugggacugacaucauagacauggaggagucucugacuuuuuaaaguuuuugacagucuugaauguugugguuuuccagugaguuaugggaagaguuggagaggac

SEQ ID NO: 4302 - RNA, 78 nt, Homo sapiens
ggguggguaauggaggcggugacugagaaaacauuguuucucuauaugcagccaagucgccccuauagaacucaaccc

SEQ ID NO: 4303 - RNA, 96 nt, Homo sapiens
acaucugaaacauuguuuucuauccucagcaucaugaaacccuaaacauacagguuucugucuugcugcuggggugggaaauuuggaucaguaugu

SEQ ID NO: 4304 - RNA, 96 nt, Homo sapiens
accucucuaacaaggugcagagcuuagcugauuggugaacagugauugguuuccgcuuuguucacaguggcuaaguucugcaccugaagagaaggu

SEQ ID NO: 4305 - RNA, 104 nt, Homo sapiens
cuuccucaacucuccuuaucauagggcuguccuuaguaaaggggccaaucuuagcaaauauccaggcuccccagagauagcccagggauaaggggugaguggag

SEQ ID NO: 4306 - RNA, 55 nt, Homo sapiens
ggaacccucgggguuuuccucucauugcugaggggaaggaggcuccagggcuuuc

SEQ ID NO: 4307 - RNA, 102 nt, Homo sapiens
gugagguccucagaaggacaguguguuuguugggugaguagaggcaggacuggagacaaaguugccuaccacaaaugcgucuguccuggcugagaccaucau

SEQ ID NO: 4308 - RNA, 97 nt, Homo sapiens
agcagggccaguccccgggcaggacuggacacggagacacagggacaaaccagggugcuuccugcuccauccugaccuggaggggccuguccaugcu

SEQ ID NO: 4309 - RNA, 110 nt, Homo sapiens
uacuacuucacccuccucauaguaugauuaaaagcugcuuugaauccacuauugccucaagggauuugaggcuagaauuuaacaaacugcugagaaggcuuaagucagua

SEQ ID NO: 4310 - RNA, 81 nt, Homo sapiens
aggagagagcucaacggucuaucuucugaauauuacaauguaucauaaugugcagaagguagaauguugagguuucuuccu

SEQ ID NO: 4311 - RNA, 87 nt, Homo sapiens
ucucuggagagcgccuggcuauuugggucucaucugucuccaagauuugaugggugauucacucaaguaccagugcuguucacgaga

SEQ ID NO: 4312 - RNA, 72 nt, Homo sapiens
uggauggugaagaggggaaagaagaaggaauaauuugugucuaaaaucuccuuucuccucugaaccacucua

SEQ ID NO: 4313 - RNA, 109 nt, Homo sapiens
ucccagcaguggaaacccaggaaaguuccugagguuuucugugccucagcuuccuccuaggugaacacagagaauaacaggacuuaccucaaagggcuguugcuaggga

SEQ ID NO: 4314 - RNA, 94 nt, Homo sapiens
aggugcugucuaggaaacuaacuuuucaguuugcaagcagaggcugaccgcucuaaguuugcagacugaucagagauggugcuggcaguaaccu

SEQ ID NO: 4315 - RNA, 68 nt, Homo sapiens
gcuggcuguccucugugaagauaagaaaucuggugacaaguuauauguggucuuugaggcagcucagu

SEQ ID NO: 4316 - RNA, 153 nt, Homo sapiens
ugcugaagguggagccugccccugacaauaccccaagccuacaucucucugguuuuguggucguuuuuguggagggugauuuucuuauacaucuuccuaauggaugccuacaaaggcaggcugaaccugggagcagugcccauuauucuagca

SEQ ID NO: 4317 - RNA, 69 nt, Homo sapiens
caggcaggagaaagcgcuauggucauugcuggaagauuccuucugaccauuagcuaucucucugaccug

SEQ ID NO: 4318 - RNA, 69 nt, Homo sapiens; identical to SEQ ID NO: 4317

SEQ ID NO: 4319 - RNA, 88 nt, Homo sapiens
ggcgcacggcuucccggcggucggcgacuucugcucuggcaacuuacgccaggguugugugcuggccgcugggagcccaggugacgcc

SEQ ID NO: 4320 - RNA, 84 nt, Homo sapiens
gaggcugaggagcuggcccaaggcuuugggggcuggauuugugccucacccagcuccugccuuguggcugucuccacaguccuc

SEQ ID NO: 4321 - RNA, 97 nt, Homo sapiens
gcacuccacuagcccucaccgcuacuccuuucauuucuccagccugggaaagguaguguuccgagagguaaagauggggagggcuaggaggaggugc

SEQ ID NO: 4322 - RNA, 67 nt, Homo sapiens
gccuuggccaccacaccuaccccuugugaaugucgggcaaugggugaugggugugguguccacaggc

SEQ ID NO: 4323 - RNA, 73 nt, Homo sapiens
ggccacccagggagguccugggggcagggauggccccaccucccggcccccagcacccgccccuuggugggcc

SEQ ID NO: 4324 - RNA, 77 nt, Homo sapiens
ccccccacccauccucacagucucagucucugguuuaggauauugugggacugagauuguagacuuggcuggagggg

SEQ ID NO: 4325 - RNA, 100 nt, Homo sapiens
ggccugacauggguccuuccugaggcaagucccugccuggccuguuagcccacccacagccaggcacgauuuccacauggcuggucccagcuuuauggcc

SEQ ID NO: 4326 - RNA, 89 nt, Homo sapiens
ggagcagcuuuguauaagguaucugccaccccuguaccacaugcugaggcccuuagggguggcacugugccuuguucaccccugccucc

SEQ ID NO: 4327 - RNA, 55 nt, Homo sapiens
gccccucugcaguaguuaugccagagcgcccuguguagagcggcugcgagcgggc

SEQ ID NO: 4328 - RNA, 73 nt, Homo sapiens
gacagucuccugcucuucagguucucccaguuggguucuagauugguauggagccugggggcagggauauguc

SEQ ID NO: 4329 - RNA, 91 nt, Homo sapiens
caggagaugagaugagcacuggccugggagucaggggcuguauuccaggcucugucacugacccgggcaagucacucacuucuucucccug

SEQ ID NO: 4330 - RNA, 97 nt, Homo sapiens
aggccuguaggacuccaugcagggacaacuccauucguagagccagaacucccagugagaguucuagaaugggggcuccuuccgagucccagagccu

SEQ ID NO: 4331 - RNA, 87 nt, Homo sapiens
gguugcuucagugaacauucaacgcugucggugaguuuggaauuaaaaucaaaaccaucgaccguugauuguacccuauggcuaacc

SEQ ID NO: 4332 - RNA, 83 nt, Homo sapiens
gugucuggcauacaguaggugcucaguaaauauuuguuagucaaaugaaugaauugugagcucugacugugugccugguacac

SEQ ID NO: 4333 - RNA, 85 nt, Homo sapiens
gccucuuccugagacuuccgccagccccaggacccacagggcaggugacagagggguggguggaggugucuccaggagagcaggc

SEQ ID NO: 4334 - RNA, 89 nt, Homo sapiens
gaggcagcuccucagagccccugagcugcaugugggccugagcaccuguugcaggccagcuggggagggguucuggcgggcgugaccuu

SEQ ID NO: 4335 - RNA, 90 nt, Homo sapiens
gguggcggggcugcggcugggcggagguggggucagugagagccgcuuucaaccgcgcccccgcucagccuccgcggcccucagcgcauc

SEQ ID NO: 4336 - RNA, 65 nt, Homo sapiens
gaaacgagguuaugauuggcaugacauucuccauugagguuugccauaguuauagccaugauuuc

SEQ ID NO: 4337 - RNA, 80 nt, Homo sapiens
guuaggaaaaagaggauugcuauuuugggauuugggguucuacccagcaacacccaagauaccaccuuuuuuaccauggc

SEQ ID NO: 4338 - RNA, 72 nt, Homo sapiens
gcuuucacuggaggucaguggagcacugggguugcaaugauaggacagugcccugggccuuccaggacaagc

SEQ ID NO: 4339 - RNA, 80 nt, Homo sapiens
cagggcaauugaggcuuagucaaucagacucaaugagccgcacuucauugauuuuuggaucugagcugcaauggcgccug

SEQ ID NO: 4340 - RNA, 105 nt, Homo sapiens
caugccagcugcuguggguguguggggccuucggguccugugggauggcgagugugugugcugagcaggaccuguagggccugcaucccaggugagugggccaug

SEQ ID NO: 4341 - RNA, 124 nt, Homo sapiens
acuguuaaggagguuaaucucuguucuccuugcuuacccucccugcaguaagguuggugcccccucuccuuacuucaggggagguuugugagagggcugacagcagaagccuucuggagccagu

SEQ ID NO: 4342 - RNA, 65 nt, Homo sapiens
ggugcucucaggaaggaguauaguaaaugccucauuuaauaacauacuccuuuuugaaaguugcc

SEQ ID NO: 4343 - RNA, 86 nt, Homo sapiens
gcacagcucuguuacuacgcaccacccuuuagaccgcagucuucuuucagcucuuugggugguuguggaggugacagaacuagugc

SEQ ID NO: 4344 - RNA, 90 nt, Homo sapiens
ugcugucugugagaguuggcagccucagaaagaauggagacuuaacccccuuaggcuuucugggcugugaaacgcucucauaaacaagua

SEQ ID NO: 4345 - RNA, 146 nt, Homo sapiens
gcaggacuuuggcacuuuucuaguuaacuugcuaaauauacguggccaaaccagaucauucaggccaguggugauuuuugaaccuaaauauucugguuuggcuguuuucauuuguaaaauuaaccugauacuugccaaaucacugc

SEQ ID NO: 4346 - RNA, 72 nt, Homo sapiens
gcugagcuucuccaacuguccuccccacaugugcccaauaugcagcgggaaggcagugggaggaacugcagc

SEQ ID NO: 4347 - RNA, 105 nt, Homo sapiens
gugaaacugggcucaaggugaggggugcuaucugugauugagggacaugguuaauggaauugucucacacagaaaucgcacccgucaccuuggccuacuuaucac

SEQ ID NO: 4348 - RNA, 99 nt, Homo sapiens
ggagaagagaugguaauuuauguugcauguuuagugacacaauccagacacaggugggauuguaucacuaaacaugugacauaaucacccuauuacucc

SEQ ID NO: 4349 - RNA, 97 nt, Homo sapiens
cucucuggaaauauuaucuuucugugggcggguacaaacacauguuuaugagaacaucaucuguagcugucuguggaggggggagugugagguagag

SEQ ID NO: 4350 - RNA, 77 nt, Homo sapiens
ggcucaugaaagggaacagaggaggggccgacucuccaaguuuuaguuggucuuuccuucucccuacuucugaagcc

SEQ ID NO: 4351 - RNA, 73 nt, Homo sapiens
ggcuuguuggggaucaugguuauauuccuacuagauaauaaaaggaaaaaugacucugguccuuuucacaguc

SEQ ID NO: 4352 - RNA, 57 nt, Homo sapiens
aagcggcccuuguguguugguguuugcggagcugccacacgcgcaggggccaggcuu

SEQ ID NO: 4353 - RNA, 128 nt, Homo sapiens
uccugccggccggcccccuccucaggccccuccuucucagccccagcucccgcucaccccugccacgucaaaggaggcagaaggggaguugggagcagagaggggaccacgggcuggcuggucugggg

SEQ ID NO: 4354 - RNA, 93 nt, Homo sapiens
uccugacuuucaguuccuauuuaaaaugucugaauugggagcaucgacaagcucccaaauuagcuuuuuaaauagaagcugagaguuaaagga

SEQ ID NO: 4355 - RNA, 74 nt, Homo sapiens
uguccucuuccagagccuguggucucccugcugcacacacagucuugggagccagcucucugggggagcugaua

SEQ ID NO: 4356 - RNA, 77 nt, Homo sapiens
cagcacaggaagugggccuucacaaugucaggauacaggaagcuaucggacuauugaaggccacuuccugugagcug

SEQ ID NO: 4357 - RNA, 72 nt, Homo sapiens
ggucuuguccuuuuuuggcuucucuguacucuggugcacagcucacacuuggcugggagaggacagauggcc

SEQ ID NO: 4358 - RNA, 66 nt, Homo sapiens
ugagguuauuuaggguuaccaccuggcuacuagauuugccagauggcaagccugaguaacugcuca

SEQ ID NO: 4359 - RNA, 63 nt, Homo sapiens
caguccccuccccagccccgacgggcgggcggacugcccugaagaggcggggagggggugcug

SEQ ID NO: 4360 - RNA, 70 nt, Homo sapiens
gugaaggaggcuucuggaucuuuccaggcauguagaugucuuuaaagaugcaaucaggccuccucgucac

SEQ ID NO: 4361 - RNA, 70 nt, Homo sapiens
gugaaggaggcuucuggaucuuuccaggcauguagaugucuuuaaggaugcaaucaggccuccucgucac

SEQ ID NO: 4362 - RNA, 92 nt, Homo sapiens
cuguguguccugugacucugugaggcagggcugucuucugaugagggggacccagagaccagucgugucucagacguccagggcgcuggcag

SEQ ID NO: 4363 - RNA, 69 nt, Homo sapiens
ggguagggguggggcaaaggggcaugcuucuguuuaaaucaagucuccucuguccucaccccuuugcuc

SEQ ID NO: 4364 - RNA, 72 nt, Homo sapiens
ggucucugagcaggcgggaggccuggcacucacucagcaucacccacagccucaugcccgcucagaaaggcc

SEQ ID NO: 4365 - RNA, 87 nt, Homo sapiens
ugcccccugcucuggcuggucaaacggaaccaaguccgucuuccugagagguuugguccccuucaaccagcuacagcagggcuggca

SEQ ID NO: 4366 - RNA, 92 nt, Homo sapiens
gguggcucuuugcccugucucacuauguuaagugaccaccaauuacugucugcacuuaacacaggaggcaagguaaccuggagagcaccacc

SEQ ID NO: 4367 - RNA, 69 nt, Homo sapiens
ucagaaauggucugguugcugaguggaaauauaacucuguuuuuuuagcagccaagucuauuuuacuga

SEQ ID NO: 4368 - RNA, 105 nt, Homo sapiens
ugcacaauacaaccuucaggguauauguuuguuggcuaauaaaauaucaaaggcaugcauguauuggcagacaagcccauacccuggaguguguuauugcuugca

SEQ ID NO: 4369 - RNA, 66 nt, Homo sapiens
gccugcagaagucccaggacuggcaagguucauacugagaugccagccuggggacucugccaaggc

SEQ ID NO: 4370 - RNA, 94 nt, Homo sapiens
gccaaaugcuuugcuagagcugguaaaauggaaccaaaucgacuguccaauggauuugguccccuucaaccagcuguagcugugcauugauggc

SEQ ID NO: 4371 - RNA, 67 nt, Homo sapiens
ucaguuugaggaucuaagacagauaugccaauggaaagauuauugucuuaggucuuacaaaaccuga

SEQ ID NO: 4372 - RNA, 87 nt, Homo sapiens
acucagagccugucugagggcaagugccuggggcugccgaacucaggauuagucucaggcagcucugccucccaggccucuucgggu

SEQ ID NO: 4373 - RNA, 106 nt, Homo sapiens
gcgggugcccggugcucgguuuguaggcagugucauuagcugauuguacuguggugguuacaaucacuaacuccacugccaucaaaacaaggcacagcaucaccgc

SEQ ID NO: 4374 - RNA, 66 nt, Homo sapiens
gcuuggcagggcuugugaugcgccgcccucaguggagcggaucagucgcuugcccucgccccaagu

SEQ ID NO: 4375 - RNA, 68 nt, Homo sapiens
aagcgcgaugcccucuccuagaucuacaaaccgguuuuuuccuggcuagggaggggauacgucugcuu

SEQ ID NO: 4376 - RNA, 65 nt, Homo sapiens
acauagacuucugcagaggcuagcuuuaucagacagaaguugagucucuguaggacucucagugu

SEQ ID NO: 4377 - RNA, 93 nt, Homo sapiens
cugcacgucugcgcggauggggaacuccacgucuugggaaaugcagagguuccguuccagcgugugcagcuccuccuccgucagcgucugcag

SEQ ID NO: 4378 - RNA, 66 nt, Homo sapiens
aggggugcgugucaggguccugggguaugggggagaccccagccagguccuggugcggacagcccu

SEQ ID NO: 4379 - RNA, 77 nt, Homo sapiens
gugaagggggugggggacuggugaaggagaauucgagaggaacuucugcucucacugguuacucaucuacucaucgc

SEQ ID NO: 4380 - RNA, 107 nt, Homo sapiens
cuuuucuuuucuuucccugucccuuuucucuuacauuuuuugccacuugagacuuagugaaaggaggaaugaagaagugaagggguggugagagagaagaguaaaag

SEQ ID NO: 4381 - RNA, 103 nt, Homo sapiens
ucaguccugaggcagaauuucccguggcaucugauacacagccuggauuuggagcacucacuaggauuagaugccaugggaauauuguguuuaggaacucuga

SEQ ID NO: 4382 - RNA, 68 nt, Homo sapiens
accuuauucccuccacauuggucagcucaaggaauucccuuuugaacagggugggggaauggaaaggu

SEQ ID NO: 4383 - RNA, 61 nt, Homo sapiens
gugcaggaacacaaugagucucaaagugaaaaaaacuuuggauuccugguuccuacagcac

SEQ ID NO: 4384 - RNA, 127 nt, Homo sapiens
ggcucagagaggggacacagcccgcccugcccuuggggucuggaguggugggggucagagagagagugggggacaccgccaggccaggcccugagggcagaggugaugucugaguuucugcguggcc

SEQ ID NO: 4385 - RNA, 95 nt, Homo sapiens
cacaaagggauuaaaagaaaagaggaaagaaagcacugaguaguuagucuuugugcuugcaagucuuuuguuuccuuguaaucuccuuaaaugug

SEQ ID NO: 4386 - RNA, 92 nt, Homo sapiens
cccugagaagagcagauggaaagcuugaggucaaccugggcccacagcuggccagguagacugaaguucugucaugcccugccuugaaaggg

SEQ ID NO: 4387 - RNA, 179 nt, Homo sapiens
ggcuaucccuggagcauaggaguaggauuuuaucccccagcuucggccuccccaggcagcacuuccuuucugugcuuugacuccaauuuggauggugcucaggcgggaaguaggcuggggugggaggaguuuaggggaauauuugucuucucuccuguuuugcccuagagauucuggcc

SEQ ID NO: 4388 - RNA, 79 nt, Homo sapiens
gugagcaugaguccaugucuaggugaagagcacgccuauagauugcagcuuugccauagcauggacuccugcugaucac

SEQ ID NO: 4389 - RNA, 70 nt, Homo sapiens
ggacccugggucugggcuuuaggccaaagcaaaguguuucuuuggucuuuagcagggccugggcuugucc

SEQ ID NO: 4390 - RNA, 91 nt, Homo sapiens
gcgcgccgcgcaggcgcaguggugcgaggaugagcugggcgaaauugugaggcgcucgcucgcgcacucugcggcugcgcggccagggcgc

SEQ ID NO: 4391 - RNA, 77 nt, Homo sapiens
gcagucucaaaagugacuccagcaucugaauuugggauucauauguaacuggggucacuguuuuugagaaaaucugc

SEQ ID NO: 4392 - RNA, 100 nt, Homo sapiens
ggcucugccuuggaggaugcuccggaaggaccacauaagcagugcccucguuuggauugguccugccugagcauuguccccaagcagggcaguuucagcc

SEQ ID NO: 4393 - RNA, 80 nt, Homo sapiens
gugccagcuucccucacuuuccaccucuccacagaagaaccuggccgcagguggcaggugggucugaggcugccaagcac

SEQ ID NO: 4394 - RNA, 92 nt, Homo sapiens
ggguggcaaggagguagacucuggucucuagagcucuauccaggcccuauaauggccuagagacagggagucuggcuccgugcccuguaccc

SEQ ID NO: 4395 - RNA, 71 nt, Homo sapiens
ccgcuggcccuggggcaggaggguacagggaguuggcccugagccccucugaccucagagccgaggcgcgg

SEQ ID NO: 4396 - RNA, 79 nt, Homo sapiens
gggugggcaccagccucuggggaggggaggugccaggccagcgguagcuccagcccaggggcaggugaccccagcaccc

SEQ ID NO: 4397 - RNA, 79 nt, Homo sapiens
gggugggcaccagccucuggggaggggaggugccaggccagcgguagcuccagcccgggggcaggugaccccagcaccc

SEQ ID NO: 4398 - RNA, 100 nt, Homo sapiens
ggacaggugcgccagagaggugggggcgaugggguuaacacugccacaaaaggaaaagcuccagcucacuccccucucuuccagcucauccuaacagucc

SEQ ID NO: 4399 - RNA, 79 nt, Homo sapiens
guggccagaccaggggcccgggacaugagcgcaacuuuccaagcuucucuuccaggccccugugguuggggagcuccac

SEQ ID NO: 4400 - RNA, 77 nt, Homo sapiens
uugccuucuguggauauguucucucuucuuguaugguguuuaugagaagagaaauauuuccauggaaguuucagcaa

SEQ ID NO: 4401 - RNA, 162 nt, Homo sapiens
cagcauguucccucucaagagaaggaagagauguccgcaugucuccauccaugcucuacugucaaaucagucacuuuuccccgaggcuagagugaggcaguggaggguggcugggaguguuauguuaaugggucuucacuuggaagggaacgucaagaguug

SEQ ID NO: 4402 - RNA, 106 nt, Homo sapiens
ggagacauucugggagggguuggaggaggcucuggggcugccggagggggccuggcugggagccuccaguauccuccucuggccucucacgggaugugccagcucc

SEQ ID NO: 4403 - RNA, 89 nt, Homo sapiens
ggcgggcuugguggguggguccccccuggagcugccuauguugggacuggcaggcuucuugggugggcucucccggagccgcaugugcc

SEQ ID NO: 4404 - RNA, 104 nt, Homo sapiens
gucggccggcccuggguccaucuuccaguacaguguuggauggucuaauugugaagcuccuaacacugucugguaaagauggcucccggguggguucucucggc

SEQ ID NO: 4405 - RNA, 77 nt, Homo sapiens
cugcccauguccucugcagugggacggggggcagcugauccugcugguugucccauugcagagccuggucucugcag

SEQ ID NO: 4406 - RNA, 73 nt, Homo sapiens
cccaggagagaccuugucauacuguaauuacacaugauucagauugcaagagaagguuucucuguucauuggg

SEQ ID NO: 4407 - RNA, 76 nt, Homo sapiens
ggccguuccccaggacagucugggguagaggaggucaggauuuaacuaccugaggguccggggaacagauguggcc

SEQ ID NO: 4408 - RNA, 76 nt, Homo sapiens
ggccguuccccaggacagucugggguagaggaggucaggauuuaacuacuugaggguccggggaacagauguggcc

SEQ ID NO: 4409 - RNA, 82 nt, Homo sapiens
gcagucugguugcauugauuugugucucacaaguagacauuuccuuuguuggucacaaaucaaugcuacagaacaaaccugc

SEQ ID NO: 4410 - RNA, 63 nt, Homo sapiens
ggcggcggcggcggcggcgacucugcaggcggaguuucgcggcggcggcaccaggguuacgcc

SEQ ID NO: 4411 - RNA, 165 nt, Homo sapiens
aaugagaaaucagauaaauuuauuuaagagcauggaaaguagaaguaaauaggcuuugaauaauuaucugaaauaaacauaagaauaagcuguuucagguauuuauucaaagucuauuuacuuccacuuuccaugcccuuaaauaaguuuaucugauuucccauu

SEQ ID NO: 4412 - RNA, 158 nt, Homo sapiens
uauaacauguaagcacggaauaauaccuuuacaauuuagaagcacaagacugaaaucaagaugcaagaguugcuuuuuauucggacuugcucuugcauuuugauuuuggucuucugcuucuacacuguaaacguauuauucugugcuuacaugauaua

SEQ ID NO: 4413 - RNA, 111 nt, Homo sapiens
ucauauuugauugccgucauccaccaggucuugguugaucauggacucuagcgacugucacuggaguuuaugaccaacugaggccaguuggaugaugguagucaaaaauga

SEQ ID NO: 4414 - RNA, 70 nt, Homo sapiens
uaugacauuucucugauuuguggccaauuacggagguuauaaaauggcuguuaaucagggaaaugccaua

SEQ ID NO: 4415 - RNA, 71 nt, Homo sapiens
uagaaauacaaaauguaaggagacacgggacuucugauagcccuuucuucuuuccacauuuugugucucug

SEQ ID NO: 4416 - RNA, 69 nt, Homo sapiens
cuucauaggugguuuagaguauguggaaaaggucucugcuuuccuacuagacuguaaaucgcuuggagg

SEQ ID NO: 4417 - RNA, 89 nt, Homo sapiens
auauaaagauuuauugucccuggagguaauuauugaccucaacaucuuaucagucaauauuuaccucuuaggccaauaaaucuugauau

SEQ ID NO: 4418 - RNA, 127 nt, Homo sapiens
guccauuccccacuccaggccucaguuuccccaucagggaucaagaacuucagggacccuugcucuaacauccuagggcucccuggacuucucagauuccuaugagcccauguggguggggaaggac

SEQ ID NO: 4419 - RNA, 59 nt, Homo sapiens
cccuaggugugcuccgguggggggguccccaagaucuuccuuccaggagcacaccaggg

SEQ ID NO: 4420 - RNA, 85 nt, Homo sapiens
ucugaagacaucugucauuucaaugauacuacuaaguccuagaggaagauuuggugguaucauugaaauaacagauguuuccaga

SEQ ID NO: 4421 - RNA, 119 nt, Homo sapiens
acugaucuacuccuucauuaauaucccaaauuuagguaacagucuguagagugugccaguuaguacagccuguuaccuauauuugggauaugaauauauuauccaaggaguagaacagu

SEQ ID NO: 4422 - RNA, 88 nt, Homo sapiens
gcagauggggucagguuucuauuccugugggcuuucuguggcgccgcaaaacaggaggcccacaggccuggccccuggccccgacugu

SEQ ID NO: 4423 - RNA, 102 nt, Homo sapiens
gaagauagaaagcaagugugcuuacuuuacgggaucauagacuucaagauagaaaaaggaaucagugauccuauaaagugagcacaccugcuuucuaccuuc

SEQ ID NO: 4424 - RNA, 69 nt, Homo sapiens
augcauuuauaugcauguauuacuaauauauauuagaguaaguuacaaguaauauagcauguaaagcau

SEQ ID NO: 4425 - RNA, 76 nt, Homo sapiens
uuugagaugcaaggaagcucucucugccacagaaauuggaugaccauguggguugacagcucccuuguguuauaaa

SEQ ID NO: 4426 - RNA, 121 nt, Homo sapiens
ggcgacugagagagggccaggggaaaggaggccugauuggggggccccuggagaguuguccaugagagagccaugccccccggucagguucagccagcuucugcguacucucucagccgcc

SEQ ID NO: 4427 - RNA, 133 nt, Homo sapiens
aucaaguucauuuuucugccauuaggcaaaaccuaaucaaacgaggcuagaagaggcaguagagaaauguaaaguauugccucucccagccucauuugauuaggcuuugacuaaaggcagaaaaugaacugau

SEQ ID NO: 4428 - RNA, 67 nt, Homo sapiens
gccaauguguuuucucgcuauuuaucaaaucuuuuauacucugaugacuaauggaaaauacaauggc

SEQ ID NO: 4429 - RNA, 66 nt, Homo sapiens
gggcaaccguggcuuucgauuguuacugugggaacuggagguaacagucuacagccauggucgccc

SEQ ID NO: 4430 - RNA, 90 nt, Homo sapiens
gaacauaucaugaagcugagucaguauggaaaauuuucaaauaaacagggugcugaaguuccaucugucucaucugcuuaugauaaguuc

SEQ ID NO: 4431 - RNA, 67 nt, Homo sapiens
guauaacauuauacagagaggacagugguaaacucaggacugcugcccuuucuauaugauguaauau

SEQ ID NO: 4432 - RNA, 84 nt, Homo sapiens
uugcauacuucaccaguugugguugggguuggacaccuguggggaccaccauugccaguuuuaggcaaagcugugaaguagcag

SEQ ID NO: 4433 - RNA, 77 nt, Homo sapiens
cucuaucucuaagcccuuggucaauaugaaauaguuugaaaagcccagacuaacugacuauguucuuagggaaggag

SEQ ID NO: 4434 - RNA, 127 nt, Homo sapiens
gcucacccauuuugcauuuggcuucagaaucuguuguggagacuucuaggaaaucagcaaugagugauucuaauugcuuguucuuggaaauuuccuaaaauaacuuggccaaaugaggguggggagc

SEQ ID NO: 4435 - RNA, 83 nt, Homo sapiens
gucuagugcuguguggaagacuagugauuuuguuguucugauguacuacgacaacaagucacagccggccucauagcgcagac

SEQ ID NO: 4436 - RNA, 75 nt, Homo sapiens
agauaaguccaggugauacauucaguggcugcaaaugcuuagauuaguuacugaauguauugcuuggacucaucu

SEQ ID NO: 4437 - RNA, 121 nt, Homo sapiens
cauuauaagcaaauauauggaagcauauucuuaaacuacaaaacucuuucgaguggcauuuugugagaauuauucagagauuugaguuuaagaaauauguuccuauauguuguuuacaaug

SEQ ID NO: 4438 - RNA, 67 nt, Homo sapiens
acaaaguugcagauaguaaguaaguuaucuaaauucuuagaaaaucaauucacugcugcagccuugu

SEQ ID NO: 4439 - RNA, 169 nt, Homo sapiens
ggauaacuuuaacaucauccagaugcauauaacuucuuucaguaaccauauucucccgaacaaacucugcaaugcuuuauacaaaagucuagacuuauugcacaguuuguucaggaggauguggcuaaugaaauaaguuauuugcaucuggaugauauuaaagugaucc

SEQ ID NO: 4440 - RNA, 65 nt, Homo sapiens
gcugauauucaggagauucuaccuaagaagucagagcacuauaggaagagucucuggauaguagc

SEQ ID NO: 4441 - RNA, 69 nt, Homo sapiens
ggccaucuauaaguuuuaagucaggcagugaugugacccaauguguguuucuuaaagauuauagaggcc

SEQ ID NO: 4442 - RNA, 68 nt, Homo sapiens
ggggacaggagggcgccggaucuaugcgccccuuagcagcagaucgggauccuuuugccuccugcccc

SEQ ID NO: 4443 - RNA, 71 nt, Homo sapiens
cccaaggcccuucuggaaccuucugcaagccuacuguaggagugaggaggaggugcgggaaagggccuggg

SEQ ID NO: 4444 - RNA, 134 nt, Homo sapiens
guuuauuuuguucaugugacuaacucuucaauccauuugacaaagugugccugucauuuucagauuccugaaguaaggacaggugacauguucuucaaaggaaauuuagggaaaacaaaggaaaacaaaaagac

SEQ ID NO: 4445 - RNA, 60 nt, Homo sapiens
acuuauccuccaaaauaggccaguaguuugccgacaaaugguuuuacugggaggagaagu

SEQ ID NO: 4446 - RNA, 66 nt, Homo sapiens
aucuaguucccaagugaauaaacuauaaggccaaagggcaaauaguuuaacaaaagggaaucagau

SEQ ID NO: 4447 - RNA, 71 nt, Homo sapiens
agguaugccugaagguuuagucuaagagggcauauggaacaucccacuuaugacuaaaaguaggcaaaccu

SEQ ID NO: 4448 - RNA, 121 nt, Homo sapiens
gaacacagugaaugugggagcuguguggagccgggaagggggaggguuggagcccccagaaacuggcucuuccagcugucucaguguccugcccaccgcagaacccccaccucacugguuc

SEQ ID NO: 4449 - RNA, 83 nt, Homo sapiens
ggucaugguuucccgacagugccuccucuccucuaccucagacagaaagcaggaggagaggaggcauuuaggaaagcuggacu

SEQ ID NO: 4450 - RNA, 110 nt, Homo sapiens
ucccaggaggacacauuucuuacuacagggcaacccuuuccuguccaaugaucuuaggaucuauuaucuucgaaggguagaccaugugguaguaacauauuuuccaggga

SEQ ID NO: 4451 - RNA, 83 nt, Homo sapiens
gagaaucaucucucccagauaauggcacucucaaacaaguuuccaaauuguuugaaaggcuauuucuuggucagaugacucuc

SEQ ID NO: 4452 - RNA, 74 nt, Homo sapiens
cagaagguacucugugggagggaggagauaauagccaaugauuauauuccuccuucauacuugcaguaccucug

SEQ ID NO: 4453 - RNA, 68 nt, Homo sapiens
gaugaucaugugugguuguguguuugugcaguugugugcaugugcagggcauuguuagacaugacauu

SEQ ID NO: 4454 - RNA, 55 nt, Homo sapiens
gcuuagcucaugaacuguaggcccuucucuggcccugguaguaaaugaguagagc

SEQ ID NO: 4455 - RNA, 107 nt, Homo sapiens
ggagagaaccuuauguacagucacauauucaaucacuaaguaaauuuaccagguaaauacuguaguauuuacuaagugguaaauaugugugguauuagguucccuuc

SEQ ID NO: 4456 - RNA, 67 nt, Homo sapiens
caacauagaggugacagguuaggauacagaugaggcccuaucuucuaugaucuguugucucugguug

SEQ ID NO: 4457 - RNA, 72 nt, Homo sapiens
ugcuagcagggcaggcuggcaccccaccacuguccaugcaggcucugggggucccaccugcuccugcaggca

SEQ ID NO: 4458 - RNA, 70 nt, Homo sapiens
ggggacugaaucauuagaacauuucugagcuuccauguagcucuaaaaguucuggaaugauuucagccuc

SEQ ID NO: 4459 - RNA, 69 nt, Homo sapiens
gagaaagaucaccuaggaagugggucuagacagaacagaaaagagggccauauucuagggauuuaucuu

SEQ ID NO: 4460 - RNA, 90 nt, Homo sapiens
uuggaagucgagccgucuucaugaagcuccuaaggaugggaaggugcgcaccacauuagggagcuucaugagagagcaagcggcugccgg

SEQ ID NO: 4461 - RNA, 80 nt, Homo sapiens
ccacacugauaggcauugcuggcugaucccaccauccuuucagcacaggacacacagccaguaccugcucaucagggugg

SEQ ID NO: 4462 - RNA, 113 nt, Homo sapiens
ccaaaacugcauuccauuguuuaauuucaggccuuuucuaacacggaagcugcauuuaagagccuuagggaugaagugcccuuuuguggaggaggcucacugagcaguguugg

SEQ ID NO: 4463 - RNA, 124 nt, Homo sapiens
ccccaucugccgggcaggugagucccuucccuccccaggccucgcuuccccagccuucugaaagaaggagguuuaggggaucgagggcuggcggggagaagcagacacccucccagcagagggg

SEQ ID NO: 4464 - RNA, 81 nt, Homo sapiens
gauuaucccacuuuauggcaauuugcaucguuacgggccugcggcaaaugaaacaaauugccauaaaauguugggaaaauc

SEQ ID NO: 4465 - RNA, 60 nt, Homo sapiens
gguuaugucccucccuccaguccauauaguguaacuggggcuuggagggcuggacaagcc

SEQ ID NO: 4466 - RNA, 111 nt, Homo sapiens
cggcaccggcgguggcaaagcugggggccgcccgggagggggcgugggcugcgcuuacccgcccgaagcccccggcccggcggcggcucccaggucgcggagccggagccg

SEQ ID NO: 4467 - RNA, 66 nt, Homo sapiens
ugucacugugucugguccacaguaggaauuuaacacauacuugcuggagaggccaguuacggggca

SEQ ID NO: 4468 - RNA, 116 nt, Homo sapiens
aaccaguuauuggacuuguccacacuuuucaaguacauguuguucaaaagccacauguucucgucuaugaggucaagagcagcaugagcuaugaacuggugcagacagugacgguu

SEQ ID NO: 4469 - RNA, 62 nt, Homo sapiens
cauuaaugcucauuuggcucugcaaaucuuaccguuugcuuaggccaaauggcgcaucaaug

SEQ ID NO: 4470 - RNA, 85 nt, Homo sapiens
ucagaguggcuggguuuggacggcaaagcaccaggcaaaauguuucccaucccugccagagcuguccaauucuagauuacacuga

SEQ ID NO: 4471 - RNA, 67 nt, Homo sapiens
gucaaucacgccaggaggaaaaauaguggcaugauuuguuaucuguuauuccccuugcuguggugac

SEQ ID NO: 4472 - RNA, 77 nt, Homo sapiens
uuugaacacuuaaagauagauggcauuguacccagagccagcugguacaauggcaucuaucuauaauuguguauaaa

SEQ ID NO: 4473 - RNA, 87 nt, Homo sapiens
ugcaacugugcucugucuguauccccacuggggcccagaagucugggucaggagagcggggauguaggcaaggcgguggcaggugca

SEQ ID NO: 4474 - RNA, 75 nt, Homo sapiens
ccagaagagacuguccuuccuggaggugugcaggaugaaucucucaugccuucugggaagagaggccucugcugg

SEQ ID NO: 4475 - RNA, 59 nt, Homo sapiens
cagaagccgacugccccucugguugcuuguaacuuuaaaagagggcaggccuggcucug

SEQ ID NO: 4476 - RNA, 100 nt, Homo sapiens
gcugagaaaaaaagaguugcaauaagaguugagguugaacugggucagagcaaggacacugccugguucauauccaucuuugugcuaggucuuuuccagc

SEQ ID NO: 4477 - RNA, 55 nt, Homo sapiens
ggaaagagcacuggacugggaaucaagagaccugagaucuaguccuggcucuucc

SEQ ID NO: 4478 - RNA, 70 nt, Homo sapiens
caguagauaagccaaggucugaagucugaagcagcaguuaggaaggucucagaccuuaaaaugucaacug

SEQ ID NO: 4479 - RNA, 69 nt, Homo sapiens
gaggacaggcuggcagggggaggaaaaagugaaaaagaauuuuuuuccucccuuuccgucucugcccuc

SEQ ID NO: 4480 - RNA, 98 nt, Homo sapiens
agaaauuaugccacuuuuaauuucagcuacuaccucuauuaggauuugggaguuauacuaauagagguaauaguugaaauuaagaguggaugaguucu

SEQ ID NO: 4481 - RNA, 77 nt, Homo sapiens
guccaaggagaccaucccuagccuuaacccuucaguugcuagaucauugagagguugggguggagguauccugggau

SEQ ID NO: 4482 - RNA, 100 nt, Homo sapiens
agcuaucaggucucauggguacauaggauuuugcacuuaguccagggggacagauaagcucugguuuuagugcagaaucucugggcccauuauugaagcu

SEQ ID NO: 4483 - RNA, 62 nt, Homo sapiens
ucgcaguuuuguugugccaccagagcaaguccgaaaaagccugcagcacaaccaaacaguga

SEQ ID NO: 4484 - RNA, 66 nt, Homo sapiens
ugugaccucuggccucucccaauaaugaaguccaucuagcaguccuucagggaaggcugaggcaca

SEQ ID NO: 4485 - RNA, 92 nt, Homo sapiens
caggaggcauaaaauccuauugcagauguguugcuaauuguaauucucggauacaguuaggcuuaugucuguaguuuuuaguuuugcccuug

SEQ ID NO: 4486 - RNA, 100 nt, Homo sapiens
cccuaccccaaccacacauggauaugcacauguacacaugcauguaggcucacacacccauguaugcaugugcacgugcaugugggcacaugcgggaggg

SEQ ID NO: 4487 - RNA, 81 nt, Homo sapiens
agugagcgacuguaaacauccucgacuggaagcugugaagccacagaugggcuuucagucggauguuugcagcugccuacu

SEQ ID NO: 4488 - RNA, 74 nt, Homo sapiens
cugaagagaugguagacuauggaacguaggcguuaugauuucugaccuauguaacaugguccacuaacucucag

SEQ ID NO: 4489 - RNA, 87 nt, Homo sapiens
caauagacacccaucgugucuuuugcucugcagucaguaaauauuuuuuugugaauguguagcaaaagacagaauggugguccauug

SEQ ID NO: 4490 - RNA, 87 nt, Homo sapiens; identical to SEQ ID NO: 4489

SEQ ID NO: 4491 - RNA, 96 nt, Homo sapiens
uucuauugauuuuagggcagcauuuauuugaggcaggaaguuggaccagaugaccuauucaugccucucugucaauguuguucuauuuacaaagag

SEQ ID NO: 4492 - RNA, 69 nt, Homo sapiens
gccaaagacggaaaugaggcuugccugccaugaccggcucagccagacaaaccucauuuccuuucuggc

SEQ ID NO: 4493 - RNA, 125 nt, Homo sapiens
gggcacuucuggaagcugcguuaacucuuucaggccaccggggugcuguuugaugcacagagccaaucauuuacuaaaugguaccauggggaccccaaagaguuaaggcagcuuccaaaaggccc

SEQ ID NO: 4494 - RNA, 66 nt, Homo sapiens
ggucaucgccagccaaccacgacgcgcccgacaggacacaucaggcgcugauuggcugccgagacc

SEQ ID NO: 4495 - RNA, 78 nt, Homo sapiens
gagaaaaacagcugcugacucugauugccauuuggaaauaaucgaaacaggcaguuggagguuguagcuuuuuaucuc

SEQ ID NO: 4496 - RNA, 66 nt, Homo sapiens
gguaagugcgccucgggugagcaugcacuuaauguggguguaugucacucggcucggcccacuacc

SEQ ID NO: 4497 - RNA, 66 nt, Homo sapiens
ucccagaccgaguggggugagggcaggugguucuucccgaagcagcucucgccucuucgucaggga

SEQ ID NO: 4498 - RNA, 111 nt, Homo sapiens
ggagaggacaaaucagguccugggccugugacuaggauggacuguaccaaguguucucacacucaaacugcugaccaccccccuacacccaacaccugccuacuccacucc

SEQ ID NO: 4499 - RNA, 102 nt, Homo sapiens
ugguacuuccgcccucaggugauuuuaucuaauaaaucugauaaguacaguagacucugauacucggauauuagaugaauagcucaugcuguggggagacca

SEQ ID NO: 4500 - RNA, 119 nt, Homo sapiens
aggcacuggcccaccucucuagggaccccugcagcucccacucacucugggcugggaccgcggucuggaugccagggaguggaaaggagcugaaggaacucucgcaggcgggcaggccu

SEQ ID NO: 4501 - RNA, 93 nt, Homo sapiens
gggaaccgggagggaaugaggccguggcccugcaaaaaaaaauccagaauuggauucagaggucucggccuucauucacauucucaggcuccc

SEQ ID NO: 4502 - RNA, 78 nt, Homo sapiens
ggauagcagcccucucccaagccaccuacccauccccauuucccaggaaggguagggguuggggguggcuggcaauuc

SEQ ID NO: 4503 - RNA, 114 nt, Homo sapiens
gcggaugacucucgcccaacucacccucgcuggauuccgacaaagggaaauguauuuugguuuuuccuuuauuuggaccuggugcggggagacauuggguucugugacagcugc

SEQ ID NO: 4504 - RNA, 97 nt, Homo sapiens
aggaaauacuuguaaguggugcuuuucugggaggaccagaaagugguucuucuuccuucugguccucccaaaaagaagccacuuacaagaaucuccu

SEQ ID NO: 4505 - RNA, 81 nt, Homo sapiens
gaggacuaaaggagauggggagagccccugaugcuggguccagccaccguggggggcuccuuccacauuuucuucagcuuc

SEQ ID NO: 4506 - RNA, 57 nt, Homo sapiens
gugcagcaggcugccggagccgccauuugguggcggaucucgguaguucaguagcac

SEQ ID NO: 4507 - RNA, 70 nt, Homo sapiens
caggaagacagguggguucuucagagcuggguaaguuacuuagacucuccgaaccucacuuuccuaccug

SEQ ID NO: 4508 - RNA, 133 nt, Homo sapiens
ggaaaacagaacuaucuggugggucaaaggcgcauaccagggggccgugggugccugucaaaccggaaugguuaucuggucuggcagagcccagcaucuuggguggccaaacaaaccucagauacaguguucc

SEQ ID NO: 4509 - RNA, 66 nt, Homo sapiens
caccaccaucaccuucccuccuuaucaggcaucuaagcuugcuaaagggggagaggugggggggug

SEQ ID NO: 4510 - RNA, 111 nt, Homo sapiens
uguaaagcauaaaguggaagaagagaucagagcuugggaagauaacuaugcccccaccuggaccuaguuaucaucucuggcucugaucucuuguucuacuuuauacuuaca

SEQ ID NO: 4511 - RNA, 74 nt, Homo sapiens
guguacgcgggaagcgggcagccuccgccugcacccgcggggccgggacccggaggcacccgcuuccccgacac

SEQ ID NO: 4512 - RNA, 112 nt, Homo sapiens
ucauauucgauugccaucguccaccaggucuuaguggaucauggacccuagcgaccagucacuggaguuuaugaccaacugaguccugcuggaugacaguagucaaaaauga

SEQ ID NO: 4513 - RNA, 75 nt, Homo sapiens
ccacauacccaaggucaaaugggcuggucaauuggacuucccuccucccagcucaucuuggcucuugguuagugg

SEQ ID NO: 4514 - RNA, 94 nt, Homo sapiens
gggaacacuuagcuccuugcugccuuaaacuaaccaggaagagcacgaccccuugcuacagguuagugaagggcagcagggacuuaauuguccu

SEQ ID NO: 4515 - RNA, 95 nt, Homo sapiens
gaggagacauuguaucuuucaggauaucugggagcuacuuaguggguaauucacugaaugcuaccccagugucuuugaaagaguuaauucaccuc

SEQ ID NO: 4516 - RNA, 70 nt, Homo sapiens
ccccaccccagccauuuugaggagccauccgaucuggacacgugaguuccuagaggugccugaggcgggg

SEQ ID NO: 4517 - RNA, 75 nt, Homo sapiens
uccuaggcaggccugucuugcucgcccuugcaucugggaagcagugggcagggugggcuagacucuuccccagga

SEQ ID NO: 4518 - RNA, 83 nt, Homo sapiens
ugugaggcccugguuggacacauguccuccuccugucccuucagauggugagucuggaggaagacuuguguuggacccccaca

SEQ ID NO: 4519 - RNA, 65 nt, Homo sapiens
gggcagagccagggucugagcgggacagucuggcuccaagcugugcccugggcccugggucgucc

SEQ ID NO: 4520 - RNA, 56 nt, Homo sapiens
gaggacugggcuggugaugagugaggugaugugugugacguugccagccaagcuuc

SEQ ID NO: 4521 - RNA, 67 nt, Homo sapiens
ccccaucgucaccacgccccaagaccacugcccucaccggccugguuugcaggcgugggggaagggg

SEQ ID NO: 4522 - RNA, 70 nt, Homo sapiens
uuguagggaaugauacauaaaccaucauuuuguguaauucucacaauggcuuuauguaucaucuccacag

SEQ ID NO: 4523 - RNA, 82 nt, Homo sapiens
ccgaaaugucuggcaggggcuccgucuuggcuucacugucuccccucagaaaagccagccugagcuccuccucaagucuugg

SEQ ID NO: 4524 - RNA, 83 nt, Homo sapiens
agcaagguagagguuuucugccaggagggaacacuagacggaggcuguuuguuuuuucuccaaacagaaaucucuuccaugcu

SEQ ID NO: 4525 - RNA, 80 nt, Homo sapiens
gccuagauagauggaagcucaaaucccaauucugcagcuuccuggcugagagguugggguauguuuccggacuuucaggc

SEQ ID NO: 4526 - RNA, 126 nt, Homo sapiens
gguaaguugaauaaauaaguaaaugaaugaaugaauugcuguucacuugaaugaggacaaccuauuuggaccucagucaaguggacagaaauacauuuuuuuauuugcucaaucacugucacuacc

SEQ ID NO: 4527 - RNA, 67 nt, Homo sapiens
ccugagguuggaguuuccacaguggugaggucucagcugccagcccugugggaagcucccucccagg

SEQ ID NO: 4528 - RNA, 80 nt, Homo sapiens
gcauaggggaggugggagagggucucagagccugguaaugcaccucuccuaucugcaaccccuuccaucuccuugcaugc

SEQ ID NO: 4529 - RNA, 96 nt, Homo sapiens
agaaagauucagugauacuaauaugucuaaugauugcuaagcacaaccacagacacuagcagucauuaggcacauuagcaucacuggauugauucu

SEQ ID NO: 4530 - RNA, 78 nt, Homo sapiens
uccaaguguggacagagcucaucagguguggggaagggcaccuccaccuguggucaagagcucucuccacacccugga

SEQ ID NO: 4531 - RNA, 104 nt, Homo sapiens
agcuauaaaagccacuguuucugggagauaaugaauuguuggaucaaggcagaagugauuucagcaauuuguuccauucccagaagucagagcuuuuaaaagcu

SEQ ID NO: 4532 - RNA, 100 nt, Homo sapiens
ugccaccucagauggucuaugccugguuauuccucaggcuaagagggagaaagcuguugcacugaggaaguacugaaggcugacuaggaagagggaggca

SEQ ID NO: 4533 - RNA, 70 nt, Homo sapiens
gcagagagggugccagagguuggggccaagaaacaaaguucuuggugcucccucuggucgucuuggcugc

SEQ ID NO: 4534 - RNA, 111 nt, Homo sapiens
ggcuaccaguaagcacagucccuccuagagaggccggugggagaugccuuggucaugcccgucagcaucuccuucccacuucuuaggagcugaguggcuuccugggcggcc

SEQ ID NO: 4535 - RNA, 106 nt, Homo sapiens
uggaaauuucucuaguagucuacuccuucuguccugugguagaaguacaucaugagagaguugccacaagacagaacaagcugaauugcuggagguaaaugcucca

SEQ ID NO: 4536 - RNA, 127 nt, Homo sapiens
uuggaggccaggcccagccugcuccuggcuguggguuccuuaucuguucacaaucccgagacgaaagacaauauuaggagcagauaauggacccacaaccaggagcaggcugagugaugccgcccaa

SEQ ID NO: 4537 - RNA, 66 nt, Homo sapiens
acucauuugcauacacaaucaggcauuuauggaagcacaugcccaauugugcauguaaagacgggu

SEQ ID NO: 4538 - RNA, 107 nt, Homo sapiens
uucgaguuuggguuacauguguggcauuguguuuuugaauggagcuuucuggaauggcaacacuccaucaaaaacacaauagcacaccuguacuccaaauggcugaa

SEQ ID NO: 4539 - RNA, 148 nt, Homo sapiens
ggagacgcgggcggcgacggacugggcagcagccugucgcuggccgugcccccaggcccccucagcuuugaggcgcugcucgcccaggugggggcgcugggcggcggccagcagcugcagcucggccucugcugccugccggugcucu

SEQ ID NO: 4540 - RNA, 92 nt, Homo sapiens
gggaaagcggguaccuggccaggccccuugcagggcagaaccucagguggaugggccucucggggucuggccggguccccccucuguguccc

SEQ ID NO: 4541 - RNA, 106 nt, Homo sapiens
ccucaccuggcugagccgcaguaguucuucaguggcaagcuuuauguccugacccagcuaaagcugccaguugaagaacuguugcccucugccccuggcuucgagg

SEQ ID NO: 4542 - RNA, 73 nt, Homo sapiens
ggagauuugaagaagggagagagaucugggaugauccagacaccagucucucaccuucucagaaaauuauucc

SEQ ID NO: 4543 - RNA, 94 nt, Homo sapiens
gcucagggcugggcuucccaccacugcaaagaauggcagggaauagacuuuccacaguguuuguggugaauggcuuccggccccauaaaagagc

SEQ ID NO: 4544 - RNA, 72 nt, Homo sapiens
ggguaauuccaguuuggugcaauaaauuauaugguucugcuugauuuguuuugcucugggcugggagaacuc

SEQ ID NO: 4545 - RNA, 134 nt, Homo sapiens
ucugaauuugucacuuauauucucugugccccaguuuucccauuagcaaaaugaggacaauauuacuucuuauaagugugaugggaaugaauuggcauuggcaaaguguuuugaaguucuucgauaaaagcaga

SEQ ID NO: 4546 - RNA, 67 nt, Homo sapiens
gagaaaaugggcccacacauuggagcucugaaaugauuuuggucuuugaucugugugcccaucucuc

SEQ ID NO: 4547 - RNA, 64 nt, Homo sapiens
gggaaagggaaugacccaguuagaagguggcagaaggcuuuuuuuugguuggguguuuucuccc

SEQ ID NO: 4548 - RNA, 69 nt, Homo sapiens
guggaaagaaccugggccgauaguuagucuuauuugagauuaaucauaucuuggcuugguucuaaccau

SEQ ID NO: 4549 - RNA, 66 nt, Homo sapiens
uacaaaucucucacccauggccugaauauguuugcaaacuaagcagaucaugggaaggagaaugug

SEQ ID NO: 4550 - RNA, 82 nt, Homo sapiens
ccugaagaaaaggagacucacagaaggcccaagaugaaagacucuuuaauccuguggcuuuuugaguuuuguuuuuagcagg

SEQ ID NO: 4551 - RNA, 135 nt, Homo sapiens
ggcaaagacaauccauacuguuugugcuuugugucuuguggucaguagagugcuccucaaauuucagaaagcugcuggggaguuccuuguugaccagaagccuagcaguuguaaacccuauggacccugucugcc

SEQ ID NO: 4552 - RNA, 88 nt, Homo sapiens
gcagaagagaagcuggagggcuuggagaaugauggauccccuguggauaggugggcuaucucuccacugccccccaccccucaacugu

SEQ ID NO: 4553 - RNA, 80 nt, Homo sapiens
aaggaaggaagggccacuuacuccugcuguccagggaauucccggcagggagagccaggggugguggcugaucuggccuu

SEQ ID NO: 4554 - RNA, 59 nt, Homo sapiens
gggaaaggaagucugugaggaaaaucugcuguggcuucuuccucagagaacucccuccc

SEQ ID NO: 4555 - RNA, 72 nt, Homo sapiens
gacgaacuggagagaugccugcguggacagauggccagggcccacauguucacgguuucuucucaggguguc

SEQ ID NO: 4556 - RNA, 123 nt, Homo sapiens
acccaagaggaacuguuuccugcuuucuguuagaacagucugcaaugaccuauaguaacacugcugaggcagagguuacuaucgggcauuagaugcugcuaucaggaagucagucacucgggu

SEQ ID NO: 4557 - RNA, 96 nt, Homo sapiens
ugcaaaagaccuaaugugucugggaagcuauuucugggucuauaugccgaaacuuuccuagaggccaggaaaguuacuuagaacauugggcuugca

SEQ ID NO: 4558 - RNA, 82 nt, Homo sapiens
uuagaaguaguugcaggcugaugaguuugguuuuuguuaacaaagaacaagagcuagacuuugucaggaggcagccaccuaa

SEQ ID NO: 4559 - RNA, 135 nt, Homo sapiens
ugacaaaggccaggucucugaucucagcaucauuccuccaaucaggccuccuccuccccuuauucuggaaauaggacugcacaaaacaaggggugaggugggugugucuuaugagaguaccuccuggacuaguca

SEQ ID NO: 4560 - RNA, 76 nt, Homo sapiens
gagaaaaaaaaaauacaagcugccauauuccugugaucacaccaaaauagcagcuuguauuuauauuuucagucuc

SEQ ID NO: 4561 - RNA, 77 nt, Homo sapiens
uugcaaugccaucuuucaauuccuccagcccuggauggggcucaggggcuggagggauuggaaggaggcagugguaa

SEQ ID NO: 4562 - RNA, 79 nt, Homo sapiens
aguuaaggaaugauggugccuaagucauuuagcuaaaugauguauuuaagaaagauggcugcaccauuuuccaugaacu

SEQ ID NO: 4563 - RNA, 108 nt, Homo sapiens
uugcaaaccuucagggucccagaauggggagagugcagugcuuucucacuugucaaaguuccuuccuuguacuuuuccuaguuucaggaugaccuuggggugcggcaa

SEQ ID NO: 4564 - RNA, 134 nt, Homo sapiens
gaggaagccggcggaguucugguaucguugcugcagcugguguugugaaucaggccgacgagcagcgcauccucuuacccggcuauuucacgacaccaggguugcaucauacccauccucuccaggcgagccuc

SEQ ID NO: 4565 - RNA, 90 nt, Homo sapiens
cccaaauguuggagcuucagaugaguuguucucaugcuaggcuucugcugaguuacggcucauaaaccuggagcuucaaaacacaauggg

SEQ ID NO: 4566 - RNA, 132 nt, Homo sapiens
ucugaacuuagagcugagacagaggagagggccucaaugacucagucccaccuccgccaccagccagggagcuggucaugaaggcucucugccuucuguuuccacaucugaaaaaggcucuaaggccacaga

SEQ ID NO: 4567 - RNA, 70 nt, Homo sapiens
gggaaaacuguggcuacauugugaaaauuuaaugagauaaaacagcacaguguggcuuaugggaaguccc

SEQ ID NO: 4568 - RNA, 70 nt, Homo sapiens; identical to SEQ ID NO: 4567

SEQ ID NO: 4569 - RNA, 85 nt, Homo sapiens
guagaaacgcaaaaaggaaaacagaugggcaauauccaguaagaaaauuuugcucgguauugcccaucugcuucucucugccugc

SEQ ID NO: 4570 - RNA, 82 nt, Homo sapiens
gaugaaacaaugugauggggcugcaugguuagcggcugucccucugcaucgguguccauggcauccccauuucacaugcauc

SEQ ID NO: 4571 - RNA, 80 nt, Homo sapiens
uucuaaccacugguugccuuuugcugaguuacuaugauuuucugcaaaggggacucaguuaacaggaaucagugagagaa

SEQ ID NO: 4572 - RNA, 83 nt, Homo sapiens
ugguaaccaucaaaaguaacagcaucuccacuggaaauugguacacaguccacauggaguugcuguuacacuugauaacacca

SEQ ID NO: 4573 - RNA, 81 nt, Homo sapiens
gcuaaaccucuuucuugcucuaagaagguugaccugcugaugaaagaacagaagguuggaauucuuuugagcaggaauagc

SEQ ID NO: 4574 - RNA, 75 nt, Homo sapiens
ccugaaggggagguggcuuugggaugugccagugcgccucuuacucggcaucuccugccagcugucucccacagg

SEQ ID NO: 4575 - RNA, 149 nt, Homo sapiens
gugcaaggucaagggcauggcugucagagcacucauuuaaaacuaaguaccuugaagggaucuccauucccaaugcuucucucuucaaggcaauuuguuuuaaauggccacuuuagcgcuacaaucaagucauguccugcugacaguac

SEQ ID NO: 4576 - RNA, 95 nt, Homo sapiens
gggaaagggagaacuauggggggcacuuuuggcaucccuccauagugugaucagagaggggagaugcuaaagguaaccccuauaguuugccuccc

SEQ ID NO: 4577 - RNA, 80 nt, Homo sapiens
uucaaagcacuuugccuguaucucauuuauccucaaaauaccccucugaggguaagugucuacaggcaaaaugaagugga

SEQ ID NO: 4578 - RNA, 66 nt, Homo sapiens
gcccaagauguuggcaggcugggagcagcccuuccugggacugugcucucagcugcuggcacgggc

SEQ ID NO: 4579 - RNA, 74 nt, Homo sapiens
uuggaagagggagguagagccaggauucagauccaggcagccuggcgucagaguccaggcucuccugcugccga

SEQ ID NO: 4580 - RNA, 69 nt, Homo sapiens
agugaagaugagggaggugggucugaaugcauuucagaaguaugggcucuccucucucagacagacacu

SEQ ID NO: 4581 - RNA, 86 nt, Homo sapiens
guuaaaucaggaauuuuaaacaauuccuagacaauauguauaauguucauaagucauuccuagaaauuguucauaaugccuguaac

SEQ ID NO: 4582 - RNA, 68 nt, Homo sapiens
gccaaauguuucugaauauccacauuucaguauaggcccuaauacugaggauguuuagaaccuauggu

SEQ ID NO: 4583 - RNA, 98 nt, Homo sapiens
uuagaaugagauucaugugucaguggggccagggccauguuccaggcuaacuggaauuugugugugugcugguuucacuuuuauuguuucccagcuaa

SEQ ID NO: 4584 - RNA, 128 nt, Homo sapiens
uggaaauauaacauuuuguaugaaugggaaggauaagccugguugcaugcuaaugagggagacaaaguagccucacucuuauuugcaacuggcucagaccuuuccauuagcaaauuaaaaucuguuca

SEQ ID NO: 4585 - RNA, 105 nt, Homo sapiens
ucuuaauugcuuuuggacauucaaauucugaagugggaaaaccucaagcgauuuaguguuggcuuaguuuucucauuucuacaaugaaugucuugggcuagaaga

SEQ ID NO: 4586 - RNA, 106 nt, Homo sapiens
gugcaauuaagaugguuggguuuggauuguuguacuuuuuuuuuuguucguugcauuuuuaggaacaaaaaaaaaagcccaacccuucacaccacuucauccgcau

SEQ ID NO: 4587 - RNA, 106 nt, Homo sapiens
uggcaauucucagauucaucccauggcauggaucggccugcaucucaauaguguguguacacauucaaggugggaagggcuaauuuauaguuggggucuugagcca

SEQ ID NO: 4588 - RNA, 91 nt, Homo sapiens
ucccacuucuuaagucacauggcuucugucuuggaaauuuuaccuuuaaaagauuauuuaagacaggaaccaggaggcuugggaacaggga

SEQ ID NO: 4589 - RNA, 91 nt, Homo sapiens
ucccacuucuuaaaucacauggcuucugucuuggaaauuuuaccuuuaaaagauuauuuaagacaggaaccaggaggcuugggaauaggga

SEQ ID NO: 4590 - RNA, 86 nt, Homo sapiens
gcucaccucuuccuuguacagacucugcuucuuccuuugaucagggaggcuugguuuggcuaagucugugcccagaagagaagagu

SEQ ID NO: 4591 - RNA, 68 nt, Homo sapiens
gcucacgucugacuucuccugggaucaauagacuauccugcggucccacagaaaagacaggcaagagc

SEQ ID NO: 4592 - RNA, 89 nt, Homo sapiens
gauaaccaucauagcuugacuggauacagguguuugcguuuacagacgaaccacaaacgccuggaucuuugacaggcguugaugcuauc

SEQ ID NO: 4593 - RNA, 68 nt, Homo sapiens
caggacuccccagcugcagucagcaggcccucuguaugcuuuggcgucugcagcuggaaggaagccug

SEQ ID NO: 4594 - RNA, 83 nt, Homo sapiens
ugcaacucagagucugcaucagguuagaagauacauuaaagcuaaugaaauaucuaauuugaaagcagauuuuggaaucugca

SEQ ID NO: 4595 - RNA, 67 nt, Homo sapiens
gaggacacucugguuuggggauggcaugaaugaaccacacauguccauaaauaaacccggagcccuc

SEQ ID NO: 4596 - RNA, 175 nt, Homo sapiens
ccucacacccucccccuugcucgcucugcuucagccacaccaacucaucucuguuucucaaauacaccaggcauggccuagcuauuaaaugcacgguccagccuggugcauuugaagaacacggaugaauugguguggcuggaacagagugagugagggggagagcgggaggagg

SEQ ID NO: 4597 - RNA, 76 nt, Homo sapiens
cuggacaaugagggagcugaccuuucugugcucaauaaaccaauugccacuagagaguagguucccuggugaccag

SEQ ID NO: 4598 - RNA, 125 nt, Homo sapiens
ugguacaagacaacaugaauuaaucuauauaucugaguugaguucugaacuuuccauuuuggauauauggaaaguuguuaacuuuacuuaggugugugugguaauuuaauguacauccaaggcca

SEQ ID NO: 4599 - RNA, 98 nt, Homo sapiens
guggaccggcuggccccaucuggaagacuagugauuuuguuguugucuuacugcgcucaacaacaaaucccagucuaccuaauggugccagccaucgc

SEQ ID NO: 4600 - RNA, 88 nt, Homo sapiens
gcucaccaagcuagggggguuauuuuuaauugggguucauagcacauugaacacucucuuagaugaaaacccuggauggcucuggggc

SEQ ID NO: 4601 - RNA, 122 nt, Homo sapiens
gaaaacuugcauauaucccuuacccccauacauucugggagcacaggcugaacucaucgccaccagcuuaguuuagucuuugcucccagaauuuauggugguaauggauauaugcguguuuc

SEQ ID NO: 4602 - RNA, 81 nt, Homo sapiens
caccacugccugucuuccacgcccucugccauuuuguauccauggauauugaagagguguaggaagaaagguuucaaggug

SEQ ID NO: 4603 - RNA, 114 nt, Homo sapiens
ccccacuggcuugguucacauaguccaaauaguugaaauguuuugcuugcucuuuuuaauauuugaaggaugucagcaugcauuuuggcauaguuggaaauggccugcaagggg

SEQ ID NO: 4604 - RNA, 77 nt, Homo sapiens
guucacuuugcuugugggaucuccccguugcuccugcccguggacugaguggcaggccauccuacaagcacccggac

SEQ ID NO: 4605 - RNA, 75 nt, Homo sapiens
gggcagggagugcgggucgguucugcgugcgcugccggacgaggcucccgccgccgauugacccgcgcuccgccc

SEQ ID NO: 4606 - RNA, 69 nt, Homo sapiens
uagaagguauugcacuauaaguuguaauggcccggaggcagccauuauagucuaaaggucaaugcucug

SEQ ID NO: 4607 - RNA, 55 nt, Homo sapiens
gggcaggcucgcuggcggcgucccucucgcucucccgccucucucgaguucgccu

SEQ ID NO: 4608 - RNA, 141 nt, Homo sapiens
gggcaggggguuauggggggcauuggggcauggucugccugggaaggggaagguccucuccagcccccaggccucaguggaguagucggcucccuccuuucugcagccaugccucagauucuagugucccuugccccgccc

SEQ ID NO: 4609 - RNA, 83 nt, Homo sapiens
ccauagacucugccuuccuggcuacugggacuggggaaauuaccccaaccccagaguguguaggaagguacaugagugaaugg

SEQ ID NO: 4610 - RNA, 69 nt, Homo sapiens
gcugagcaguggggccagcucccgcccacccccaggagacuggugaggagagcuguccggcugagcagc

SEQ ID NO: 4611 - RNA, 78 nt, Homo sapiens
agccagcagggggcgcugcugcccaugggauccucauggccaagggucccaggaggugguggaggccaucugagggcu

SEQ ID NO: 4612 - RNA, 76 nt, Homo sapiens
gccuaguucucucuguuccauuuuucuugccuguaccucacuaagcaagaacagaguugaauagaaggaagagggc

SEQ ID NO: 4613 - RNA, 90 nt, Homo sapiens
ggggagcuggggguuccuguggagcagggguaugggucccacccuggccaccccgucugcccaggcuccacaugugcccccugguccccc

SEQ ID NO: 4614 - RNA, 65 nt, Homo sapiens
ggcaaggcuggacacugggggcucgugguggccaauucuaugcucccucagggucccgcucuguc

SEQ ID NO: 4615 - RNA, 81 nt, Homo sapiens
ggggaggcucuguggaaauuaugaggguaggaggaggguuguaaagcucccuaaugcccuuaugguuacuacuguagcccc

SEQ ID NO: 4616 - RNA, 140 nt, Homo sapiens
ucucaggcuuccccacacacaccagcagcagagacuaggaagcccgggugcugaggucaaggggacucauggagauguuggcgugcgaggccuccugggagcucaugcugggugcaggugcugugggggagcagaggaga

SEQ ID NO: 4617 - RNA, 81 nt, Homo sapiens
gugcagccucuucccaaguucaugucacugggucaccagagauggaaucuaagugagaugagagggacugagggaaggcac

SEQ ID NO: 4618 - RNA, 55 nt, Homo sapiens
guggagaacaugacgcugggcuccuuugacggcggagcccagcuauguggcccac

SEQ ID NO: 4619 - RNA, 68 nt, Homo sapiens
acugagagccuggggaggugaggggaacuuugaguaaaugagcucccuauaccugccccugggccagu

SEQ ID NO: 4620 - RNA, 114 nt, Homo sapiens
uugaagagguuaucucaaguccuguuuugucacugucaacaucauccagcucuggguggacugcuguuggaauggaaaaugacaaaaaggaaaaugaagguucagccaagucaa

SEQ ID NO: 4621 - RNA, 89 nt, Homo sapiens
gacaagagucaggcaggaugggaggcaggacccuggccccaggcccugagggucaggaguuggggccugacuguccuagccagaauguc

SEQ ID NO: 4622 - RNA, 104 nt, Homo sapiens
agaaagcuuuaauacuaucucaaacuaaaggauauagaagguuuucccuuucucuugcccugaaaccuucuguauccuuuauuuugagauaguauuagaauucu

SEQ ID NO: 4623 - RNA, 104 nt, Homo sapiens; identical to SEQ ID NO: 4622

SEQ ID NO: 4624 - RNA, 68 nt, Homo sapiens
gaagagcagccaguuugauuguguugagaucagucauucgcaacaugguuaacuucuggcuccccuuc

SEQ ID NO: 4625 - RNA, 83 nt, Homo sapiens
ugccaggcugcagaucggucuuggcgcuguauacucccagguccagggcacugggauggugcugggugcuggccugcagggca

SEQ ID NO: 4626 - RNA, 122 nt, Homo sapiens
ggcgaggcacgcagcgccccuaagccuggcucuauccugaaagggcaccuaagcgugaacagagccggugccugcaaaaccuccaggaagagcugggugcgagugggcguuugauacacgcu

SEQ ID NO: 4627 - RNA, 80 nt, Homo sapiens
caggaggugacggaugcuggaagaggcaggcaauguuggaacccugacuauugcauagcuugucuccuaguaacggccug

SEQ ID NO: 4628 - RNA, 82 nt, Homo sapiens
gaggaguucugaggccaacucugucugucuggugcugaguuucaguagacacuggacgaugggguugaggccucagggccuc

SEQ ID NO: 4629 - RNA, 72 nt, Homo sapiens
agccagucggucccucgggccagggcaggaagcgagagucucucuuacccuggugcguggggccgcagggcu

SEQ ID NO: 4630 - RNA, 64 nt, Homo sapiens
guuaauaugagccuccggauuagacuagagccaguguuacaggucaagacugaggcucauugac

SEQ ID NO: 4631 - RNA, 65 nt, Homo sapiens
uagcauuguuucugaauuugagaaaagaauuuggaaguuccucuucuuaaguucuggaacagcug

SEQ ID NO: 4632 - RNA, 89 nt, Homo sapiens
guucauggccaauauuucccaagugucuuggaccaggggcuugcuuuuggcacuccugguccaaaauauuugggaaauacaggccgagc

SEQ ID NO: 4633 - RNA, 128 nt, Homo sapiens
ccaaaucuaacucuuucucuuccuuuguaacuccucugugucuuccuucccugaggcaauguacugucguaagcagacucaaugagggaaggacagaggagcauagggaaauauggaggugggcuugg

SEQ ID NO: 4634 - RNA, 72 nt, Homo sapiens
ucugauucaguuugguuucccuuaucuaaauguccacucgugaacuagaaugaggugaccagaugguccaga

SEQ ID NO: 4635 - RNA, 90 nt, Homo sapiens
ggagaugggcagggaugggugggagagcuuuccuggaaaaaucuucucucacccucuucaggagccuuuuuccacccauccuccuccucc

SEQ ID NO: 4636 - RNA, 62 nt, Homo sapiens
guguauuucuuucuugcuugcucucugcaagcuguggagagggagggggaagagcaagacac

SEQ ID NO: 4637 - RNA, 84 nt, Homo sapiens
ggggauauugguggagaggggagugggggaguagaagcccgauuuucucugccuuccucuucacucccuccuacugaggacccc

SEQ ID NO: 4638 - RNA, 76 nt, Homo sapiens
ccuuauaccaggggaagaaacugacaauaagacagucaaaaccuguccugugcugucgguaucuccuuggcagggg

SEQ ID NO: 4639 - RNA, 112 nt, Homo sapiens
ggguauagccaagcuauuauagcaacacucacugggaccagccaagguguucacugccaucaucaucugggcugucucagguguucaaagcuguccucacagggccaagccc

SEQ ID NO: 4640 - RNA, 89 nt, Homo sapiens
ggguauauucacuacaugcuguuagggggagaaggaaccuaauauuuaugauauucuguuccuuucccuuuugcaugucagaaacaccc

SEQ ID NO: 4641 - RNA, 86 nt, Homo sapiens
agcuauaaaauagcugcuggguggcagauuacacaggcucuagaauaaaaaggugagaauuugccacccagcuucuaccaugagcu

SEQ ID NO: 4642 - RNA, 89 nt, Homo sapiens
guacauacuuucgccuaagacaguucuguauauucuucuguuaacgggguagcaaaagcauauagaaagguuuuggggggaugcagugc

SEQ ID NO: 4643 - RNA, 72 nt, Homo sapiens
cuuaauauagguaccucagggcaguguuccaggugaggccugaaaacaagguccuuuggguacuucaguaag

SEQ ID NO: 4644 - RNA, 84 nt, Homo sapiens
ugccaucugcucugaagccucccaagcugggccuccccucccacuucuggagcccaggaacagaugugggaggcugagcaggca

SEQ ID NO: 4645 - RNA, 110 nt, Homo sapiens
uugcaucagcuugguaaagacgagguagaguuuguaguguuggggucucugagggugagucagguccccgucacacaaacuguaaagucaacgacaaaccagcuuagcag

SEQ ID NO: 4646 - RNA, 95 nt, Homo sapiens
gcucaucaccuccaaagcucugacucugcuuuaggggaagaagacugucaaucuauucuuccccuaaacaguagguggggguggggagaaggagc

SEQ ID NO: 4647 - RNA, 102 nt, Homo sapiens
uggaaugcuuacuuacuccugucaauuuccauccacaacugcuugacucugaaggugaguggugagcccucuugggaauguuggcaggagaagaugacucca

SEQ ID NO: 4648 - RNA, 97 nt, Homo sapiens
agguaugugggauugagaacugaguuuaugugaagagaggguuucuauaugagauauuuuccuucagaaaguucaaguccucaauuccuuuuaaccu

SEQ ID NO: 4649 - RNA, 98 nt, Homo sapiens
gggcauuaugguggugauaaguggaugaggaaagcuucccaauaaccagaaaauuugggaagauguuccagucucuuugcccacucccaguucagccu

SEQ ID NO: 4650 - RNA, 91 nt, Homo sapiens
caugauuaagcaggggagugaggguagaggcaggagugcaaaauuguaaaguuuuagcuuuuugagcuauucucagucccugugugguaug

SEQ ID NO: 4651 - RNA, 86 nt, Homo sapiens
uguaauuucaauguauucaguuuugacuuugcccguauucuacuucgauauagacuggcacagcaacugaauauauugcucauaca

SEQ ID NO: 4652 - RNA, 86 nt, Homo sapiens
cuagcuauuucugcuacauaaaaauucccuggucacacaaauaacaaaaagugaccaggggauuuuuguguagcagaaaugacuag

SEQ ID NO: 4653 - RNA, 84 nt, Homo sapiens
gcuucccgaggccacaugcuucuuuauauccccauauggauuacuuugcuauggaauguaaggaagugugugguuucggcaagu

SEQ ID NO: 4654 - RNA, 69 nt, Homo sapiens
cugaccaguauaaaucuggauacuucauccaugguuaaugaaugaaguguccagauuuauacuguucag

SEQ ID NO: 4655 - RNA, 81 nt, Homo sapiens
guugcuucauuauuuauugaaagcaccuuggggagcaauguguuguuucccaugguguuauucaauagauaaugaauuaau

SEQ ID NO: 4656 - RNA, 174 nt, Homo sapiens
gccccgcagccaaucagcagcggccggggcggugcaaugaccucaccgguucuacucucuuaccccucccccacgugguuguugcugccgguagacggaguagggaaguuuggauugggggaggggaggagaaccagugaugucaccuuuccccuuguugauuggcugccgggu

SEQ ID NO: 4657 - RNA, 91 nt, Homo sapiens
uguucuguuuugcaccaggcugcucuauucauguaggcagaauugcugguguaauauauaugaauggagugaccuggugcaaaacaaaaca

SEQ ID NO: 4658 - RNA, 66 nt, Homo sapiens
aaaacguggauuuuccucuaugauuaaccaucaaacacguaaccauagaaggaaaaucuaccuuuu

SEQ ID NO: 4659 - RNA, 172 nt, Homo sapiens
ccucccgcucucccccucacucacucuguuccagccacaccaauucauccguguucuucaaaugcaccaggcuggaccgugcauuuaauagcuaggccaugccugguguauuugagaaacagagaugaguugguguggcugaagcagagcgagcaagggggagggugugagg

SEQ ID NO: 4660 - RNA, 74 nt, Homo sapiens
gaggcugaugucaucuaucuucccaaagaaaaggccacuuuuuccuuuguggaaauccugggugacaucaccuc

SEQ ID NO: 4661 - RNA, 70 nt, Homo sapiens
guaucuugagggaagcauuucucccuaagugcagaguuauuuucaucagagagagcuucucuuaacauac

SEQ ID NO: 4662 - RNA, 62 nt, Homo sapiens
cucucuccauuacacuacccugccucuucuccaugagaggcagcgggguguaguggauagag

SEQ ID NO: 4663 - RNA, 100 nt, Homo sapiens
aauacugggccagauuagcucgccaugugucucccugugugcacagaacuuucacugacuucaacggguggaauguggugggagaaucuggcucauuauu

SEQ ID NO: 4664 - RNA, 76 nt, Homo sapiens
aguucauuugaagccucucucucuuuaauucggagagccgggcucugaauuaauagagauaggcuucgaguaaacu

SEQ ID NO: 4665 - RNA, 88 nt, Homo sapiens
gggacagcuggggcccgagagaugguggccccuccucugugucuugacugugggcaaguuacuucaccucucugggccucaguuuccu

SEQ ID NO: 4666 - RNA, 89 nt, Homo sapiens
auaucaagauuuauuggccuaagagguaaauauugacugauaagauguugaggucaauaauuaccuccagggacaauaaaucuuuauau

SEQ ID NO: 4667 - RNA, 93 nt, Homo sapiens
cauucugagagccuucugaguuguaucauacauggauaauuugcauuaugaguuuuauccacguaugauaaaacucugaaggcuuucaaaaug

SEQ ID NO: 4668 - RNA, 78 nt, Homo sapiens
gugucagaaucucagaugacaaugucaggugcucaggugcucaggagcuccugacauugucaccugagauucucacac

SEQ ID NO: 4669 - RNA, 78 nt, Homo sapiens
gugucagaaucucagaugacaaugucaggugcucaggugcucaggagcuccugacauugucaccugagauucuuacac

SEQ ID NO: 4670 - RNA, 74 nt, Homo sapiens
gcugcuuuaugaggcaauaacuugguuuucucauuuauccacucaggaacuggauuauuaccucauaaaacagu

SEQ ID NO: 4671 - RNA, 133 nt, Homo sapiens
gacacuauguuaauggaaacucaugcauaucugagcuauguucuugauuuucagguuuucuugcagcgaucagggaacuaugaaacacaaagaccgaguucuaauauguacaaguuucaguuaauauaauguu

SEQ ID NO: 4672 - RNA, 79 nt, Homo sapiens
uuggcggugcggcagggggaucauuugcaagcguacccucuccucgcgcggcaagugagucccgagugccgcgccccag

SEQ ID NO: 4673 - RNA, 93 nt, Homo sapiens
aaucccucugugucuccguuuucuuauuuguaaaauagggauacuauuaugauuccuauuucacagaugaggagacuucggcacagagagguu

SEQ ID NO: 4674 - RNA, 80 nt, Homo sapiens
gaagcagagugguacuguggggggccuggucagagcuccucccugucuccuguccccccagcagcgggccacucuccuuu

SEQ ID NO: 4675 - RNA, 76 nt, Homo sapiens
gaagcauuggggagaagcaauuuuaucuaggagcaaguaggaacucucagauaagauagcgucugccccagucuuc

SEQ ID NO: 4676 - RNA, 147 nt, Homo sapiens
uucaccauggcuaguuaagaaggacagucugucuuuacugccuguugaugugcaugucugccuacccugagccuacggacaagcaacauuagcaguagugguaacugaaagaaaagagacugaagcuuugccauaggccaugaugaa

SEQ ID NO: 4677 - RNA, 94 nt, Homo sapiens
gugucucagaaguauaugcaagagaaaauucugaugaguaauuaaccccauucugacaugucagaauuuccucuugcauauccuucugaaacac

SEQ ID NO: 4678 - RNA, 106 nt, Homo sapiens
ugcacaggucaguugcaaauaaucugaugcuguuuuugggaaacugcaggcuaaaaauagccaugguuuuccuggaugaggcauuaguuugauguuggccuuugua

SEQ ID NO: 4679 - RNA, 114 nt, Homo sapiens
uaggcuuguuguuuuacaguguuagugauccauucccuuugacgaucccuagguggagauggggcaugaggauccuccaggggaaaagcucacuaccacugggcaacaacccua

SEQ ID NO: 4680 - RNA, 86 nt, Homo sapiens
cacaccugccaaugaucacuuuugugacuaugcaacuggagugagaauacuagcugcagaucacaaaaaugacacuggcagcugug

SEQ ID NO: 4681 - RNA, 68 nt, Homo sapiens
ugcacuccccuacugaguccugagaccugagugcaccccauagaguaggacucagaugaggggaugca

SEQ ID NO: 4682 - RNA, 114 nt, Homo sapiens
agagcacuccuauguauaaagcacauuguuaaggaccuggaaaaaaaagcuaaauaagacugagauauuuuauuccaggugcuuagcaauguguuuuguguccaggaguauucu

SEQ ID NO: 4683 - RNA, 121 nt, Homo sapiens
ugcacuuuggucuuaacugcauucacccucuccagcaccuucuccuggauugcuaccccaaaucauuugcauccucagucuuggggaucaggugcuggauccaugugaucaccagaaugca

SEQ ID NO: 4684 - RNA, 68 nt, Homo sapiens
ggcgcaggcucggggugcuguucuagcuucaauaggagggagacuguugcagccucagagccuccgcc

SEQ ID NO: 4685 - RNA, 69 nt, Homo sapiens
ucuccuaccacuaguugugucccucccauagccuucugcuuucuagguuuugccagcuguggugagaga

SEQ ID NO: 4686 - RNA, 99 nt, Homo sapiens
agauccuuuguucagcucuagaaucugugcaaaaaucccucugugugguacucacagggauuuuugcacaaagagauucuagagcuagacaaagaaucu

SEQ ID NO: 4687 - RNA, 87 nt, Homo sapiens
ccuccccccguuuuuggcaaugguagaacucacacuggugagguaacaggauccggugguucuagacuugccaacuauggggcgagg

SEQ ID NO: 4688 - RNA, 65 nt, Homo sapiens
ucaccagauucuucucauuguccuccaccggguuucccacaaaggcaaugaugcggaucuuguga

SEQ ID NO: 4689 - RNA, 92 nt, Homo sapiens
gccucgucuucacucuucugcugcuagagcuguccuaaacacucaucagcuucaaacccaaccuagacagcagagagagugcagggcugggc

SEQ ID NO: 4690 - RNA, 65 nt, Homo sapiens
cagccaggggccggagugggaggcagggccagaugucccgcuccuuccacccugguccccugcug

SEQ ID NO: 4691 - RNA, 89 nt, Homo sapiens
uuuccccuugagcauacugacuuugcaauaaagaagcugucauuuacagucuucuuuauugcaagguggguaauagcuacagggagaaa

SEQ ID NO: 4692 - RNA, 74 nt, Homo sapiens
ucaucuccagaauuugcaccuguuucuagcugaggacuuucucuagcagaacgggagcuuguuacugggcauga

SEQ ID NO: 4693 - RNA, 75 nt, Homo sapiens
gggccugcccucguugcccucagcaaugugaauggauccaguacuuggagcugaggggcaaggaugggcaugccc

SEQ ID NO: 4694 - RNA, 77 nt, Homo sapiens
ugagcgggucucugggccucaguugccuuaucuguaaaugagaagguugaacuacaugagcuuugaagacccuuuca

SEQ ID NO: 4695 - RNA, 69 nt, Homo sapiens
gagccggaagaccaggguugaaucuuggcuucuucccuuacuggccauguaaccuugggcuucuugcuu

SEQ ID NO: 4696 - RNA, 79 nt, Homo sapiens
guggcaguugauuggaagaggaaggagacucuuggggaucacaguuuaacucccuucuuucccuuccagcagcucccac

SEQ ID NO: 4697 - RNA, 65 nt, Homo sapiens
gacgcuugggaggaggaguugauaggugacuuaauguuaaaucuggguucccucccccaauuguc

SEQ ID NO: 4698 - RNA, 126 nt, Homo sapiens
gguucccgcuaauaggcaaacaccaggaacgugcagccccuccccuccgccucgcgcucuuucugggaggagccugggggggggaggguccugcccacgggccccgcccugcacuaggcggaagcc

SEQ ID NO: 4699 - RNA, 70 nt, Homo sapiens
gccucugaaaccaaguaugggucgccuucccguucugcaccaggucucacccacgcuugauuucaugggc

SEQ ID NO: 4700 - RNA, 70 nt, Homo sapiens
gguucgaugaccauaugugacauggcuaaggaguuauuucuucacaugccauguccacugaucaucaacc

SEQ ID NO: 4701 - RNA, 85 nt, Homo sapiens
gaagcgaguuguuaucuuugguuaucuagcuguaugaguguauuggucuucauaaagcuagauaaccgaaaguaaaaacuccuuc

SEQ ID NO: 4702 - RNA, 67 nt, Homo sapiens
ggugcuccuugaggguugaugcuggguucacuuuaccucugugaauccagcacaccaugaggaugcc

SEQ ID NO: 4703 - RNA, 84 nt, Homo sapiens
ggcgcggcccggugggcuuugugccccgggugccccaccgcccgcgccccuccgggcaucuggcccacaaagcccgggccugcc

SEQ ID NO: 4704 - RNA, 57 nt, Homo sapiens
ucaccuuucuuuaucucuuuuuccacauguuuggaacugaggggauauggaaaguga

SEQ ID NO: 4705 - RNA, 69 nt, Homo sapiens
ucccccuuucucaggcugaugugugccuugaauguacuagaaucaaggccauguacuuggaaagcggga

SEQ ID NO: 4706 - RNA, 122 nt, Homo sapiens
ugaccuggcaugucuugggcacucagggcaugacuauuuguagucuuuucucccuuucaccaaggggaucacuccugcugcuccugguaccauguccugucccgugaagauccugccaguca

SEQ ID NO: 4707 - RNA, 74 nt, Homo sapiens
cccacgcugggcgagcugcccccucuccagggcagggcuccaaaccgcucugggggaagcuggccucagcuggg

SEQ ID NO: 4708 - RNA, 67 nt, Homo sapiens
uucacagagaccagucuccagugguuaccaaucuugaucuuccaguguagacugaguucucuuugaa

SEQ ID NO: 4709 - RNA, 108 nt, Homo sapiens
caugcaguaauagcuugguuuuucccguguucagcuccuccccgaguacuuaguguuaaaucacagggggaggaagugugagcagagaaaaaacagcacuauuacaug

SEQ ID NO: 4710 - RNA, 68 nt, Homo sapiens
ugcacuccccuacugaguccugagaccugagugcaccccauagaguaggacucagaugagggaaugca

SEQ ID NO: 4711 - RNA, 152 nt, Homo sapiens
augucucugcaaagucucuauaugggguggccuauugaagaaagaccccauuuaacuugaaaccgagcuuguuauuuggcuuucaaguuaaguggggccugcuuaaaugggcuaucacauauagagaacaacaucucaucacucagacacau

SEQ ID NO: 4712 - RNA, 81 nt, Homo sapiens
ggggcaggauaggggcacagauaaugguauagggguucuuuucuggcaccuugugucauauuauuugcccuuuuccucucc

SEQ ID NO: 4713 - RNA, 87 nt, Homo sapiens
ugaccucuuucugcuucacacauguccuuuccuucugcugguuaauagcaacaguagucuuuuggauguauggaagcaaagauguca

SEQ ID NO: 4714 - RNA, 86 nt, Homo sapiens
gagcccagcuggaaauguucuagccaaaaaaguuugccaagaaccauugugucuuuuuuuuugcuggaacauuucugguugugcuu

SEQ ID NO: 4715 - RNA, 166 nt, Homo sapiens
guccccuuguguguguccgucccccucccgucugucugugauucucccuuuguuuucccuccgccucuggccgcgcuuucugccuccccccagcgugugcuucuggcucagggccucaguuuccccaucgggacaacgcagaagguaacgggccguccaggaggac

SEQ ID NO: 4716 - RNA, 132 nt, Homo sapiens
gaugcucuguucuccuggcaacgcuccuuacuggcuugcaggugcccgugagcagggcuuggcuggccauccugccaagcuugcucauggagacagcaagaucucauggaggagcauuucagaucagacauc

SEQ ID NO: 4717 - RNA, 67 nt, Homo sapiens
gcagccagcuuguaaguccuggauaacacuuguugaaugggcuuccgaggacuuuugugcugccugu

SEQ ID NO: 4718 - RNA, 87 nt, Homo sapiens
acuuccuggaagcagaagcccugauguuaaggccuugcucaugguuuuaucuccagagcuuagcacagggucugcuucauaguaagu

SEQ ID NO: 4719 - RNA, 106 nt, Homo sapiens
guggcggcgccgggagacggcgggaagugggaccgggggccagggagggugaagguuggagucuccucggccgagcccgguccucaaaccgucccggcagccccgc

SEQ ID NO: 4720 - RNA, 65 nt, Homo sapiens
agggccgggugauggaauaugagacaaaagcauuuggauuuuauuauuccauuuacucugacccu

SEQ ID NO: 4721 - RNA, 94 nt, Homo sapiens
caugcugugugugguacccuacugcagacaguggcaaucauguauaauuaaaaaugauugguacgucuguggguagaguacugcaugacacaug

SEQ ID NO: 4722 - RNA, 98 nt, Homo sapiens
guggcucuacguucccuuucuccuccaguguggaaaaaaaaucccugcgugacacacauuuuuuuccauauuggaagagaaagggaaugcagacccau

SEQ ID NO: 4723 - RNA, 80 nt, Homo sapiens
ggggccccaggggagggguggucggugcuccuuuuucuuuaaagcucuuuuggccagcugccccucugccccgggacccc

SEQ ID NO: 4724 - RNA, 148 nt, Homo sapiens
gucacaugauuccuuuuaaagucaggcucuggcuggugcugcuuuuccuacccacugcccaucugccagcucaaaagacaaccugagugcuggguggggugggggaaccgccacagugagugcucaaguaagaacagaaauauuugac

SEQ ID NO: 4725 - RNA, 94 nt, Homo sapiens
aggacaauaggaacaacaguccguuuauugagcacuuacugugugccaggcacaguucaaagcgcuuucaugaauuacuguauuuaauuuuccu

SEQ ID NO: 4726 - RNA, 78 nt, Homo sapiens
gcugccugccaucugcccuggccaugcccguuccgcuaaugaaggauaaacacaaggccaggccagaugacagucagc

SEQ ID NO: 4727 - RNA, 76 nt, Homo sapiens
agggcaggcagagggagggagggagaaagagcacaacuggugccuucgucuccccuucccucccaucucucucccu

SEQ ID NO: 4728 - RNA, 124 nt, Homo sapiens
cuaacagccgagcagacaggaggggggauagccgcgguucuagacuugggcagacuaccaacagcugcaaaguuaauuauggcucucucccucguucuccuucucuucaaaaucucagcuuuag

SEQ ID NO: 4729 - RNA, 79 nt, Homo sapiens
auugcuuucauuguugugcuuacaacagcuguuucuuauuauuaagaaaagcagcuuugcgugcagaacauaaaacaau

SEQ ID NO: 4730 - RNA, 110 nt, Homo sapiens
ggcacacaguggccauucagugaauaucuguggauggaugaauucuugucaucauaguuuguaguucuguuuauuuguuuaccugauuauugcuggggucagugucugcc

SEQ ID NO: 4731 - RNA, 87 nt, Homo sapiens
augccagagaguuuggagugaucuggaccaggauuaaacaucgcauuagcagagugauccuggaccagguacuuaaucugucugcau

SEQ ID NO: 4732 - RNA, 113 nt, Homo sapiens
aguucuuagacuuuugcucauuacacugcugcauuugcaguccuuuaacccacaggauugagggugaaaagauugggaaugcagcaguauaaugaacaaaaguaaugaaaacu

SEQ ID NO: 4733 - RNA, 79 nt, Homo sapiens
gcuccgucgccccaguguucagacuaccuguucaggacaaugccguuguacaguagucugcacauugguuagacugggc

SEQ ID NO: 4734 - RNA, 79 nt, Homo sapiens
ugcccugcugccuggauggaaagcagcauucucuuuagcggcaaucugcuguaaucauuuuuuauucagguggcaggca

SEQ ID NO: 4735 - RNA, 76 nt, Homo sapiens
cuuccuggugccaauuugccccuuugcugaagcacacucuucggugcaucuaaggggcaagcuuggugccguggag

SEQ ID NO: 4736 - RNA, 75 nt, Homo sapiens
gaucccucuucucuuuccuucugggcuccaaccauuccuccuauguugggucuggaggaaggagaggcagugguc

SEQ ID NO: 4737 - RNA, 78 nt, Homo sapiens
ugagcucccauaucuuacccucaacacauccagccaaggugaaacuggcuggaacuuaagggagauguggugauuuca

SEQ ID NO: 4738 - RNA, 67 nt, Homo sapiens
gcaucuggccuccugccugauucaaaucgaaccuaaccugaugucuuucaggugggggcacauaugu

SEQ ID NO: 4739 - RNA, 104 nt, Homo sapiens
acagcggagauccuuagcgggcuucacuuaucucauccuuccuucauacuggaguuaaggcaugggaagagaagucuauugaccacuccaggaucuagcccugu

SEQ ID NO: 4740 - RNA, 76 nt, Homo sapiens
gggccucaguguuggagaccuucagggagagggagaaaggcagccauagcccugaaguguuaccagcauggagccu

SEQ ID NO: 4741 - RNA, 66 nt, Homo sapiens
ugcccucacagaugacucuggaaaggaagaguaaaucucuacucuccaggaguucccuggaaggca

SEQ ID NO: 4742 - RNA, 98 nt, Homo sapiens
gggccacaauagggaagacagaagaaugauguugggcugcccagaaucaaguggacaaggguggcaccaaaauuuucugguuuucucuggaguugccc

SEQ ID NO: 4743 - RNA, 92 nt, Homo sapiens
uguucagccugggggaggaggucagugaggccuuccccucgagggguuuagccucugauuuuucacuugccucauucugcccauucucagca

SEQ ID NO: 4744 - RNA, 65 nt, Homo sapiens
ugcucguguacuuuuauauccuggcugugggaucccgccagccugggaggaggguggagccagca

SEQ ID NO: 4745 - RNA, 84 nt, Homo sapiens
gccccacguccugucccugucccugccccucuggggcccauccagaccacacuggggccaggggccaggggagggggagugggc

SEQ ID NO: 4746 - RNA, 65 nt, Homo sapiens
ggugcugugacugaagagccugggaugacugcccauaugaaugguccaggcucugcuccaucgcc

SEQ ID NO: 4747 - RNA, 85 nt, Homo sapiens
ugaacuuuauguucuaccuaaauagcucugaaauuuacucuaugauaauggagcauagaguuguuuggguuggggaucaauuuca

SEQ ID NO: 4748 - RNA, 87 nt, Homo sapiens
agaacagcucauauccuguggacagaugauagauaugucauaucacugaaaaauuguuugucuuccacagguguaugggcuucuucu

SEQ ID NO: 4749 - RNA, 80 nt, Homo sapiens
uguccuagaaagagcuguguaggacaaccagagagaacauacauuauccagcuguccaacauagaaacuuucuauagaua

SEQ ID NO: 4750 - RNA, 75 nt, Homo sapiens
agaacgcagauugccaggcccacccucuuagguguaaugauugaguggggaugaggccuggggguuugcauuucu

SEQ ID NO: 4751 - RNA, 120 nt, Homo sapiens
agcucagaggaaggaagggcuuguauuccgaggauuuggggggcuggagagggguccuagugggcucugcuguagccugcaagguccuacaagcccagguccuuccugcccucucuggcu

SEQ ID NO: 4752 - RNA, 91 nt, Homo sapiens
gcugcugugaaaugaguugggggguuuuaguguaauucugcuuggacagauaaucaucacacaaaccucccacucaguugucacaauuagc

SEQ ID NO: 4753 - RNA, 111 nt, Homo sapiens
gaugcccuuagcaguggggcuccugggcucagggcaggggaaauguacccugaagggggaaguuucccuucuaagagcugacggagccacuuaaccacggcaaggaacauc

SEQ ID NO: 4754 - RNA, 74 nt, Homo sapiens
gguacagccauucuccugauacccucugccuuucaaucagagcacuuagguuaucaggagaggaggcuccugcu

SEQ ID NO: 4755 - RNA, 101 nt, Homo sapiens
ucuuccucagucuggcauuuucuagauucuaggauaguugcuugauaucugaaguugggcaauuuguuuuagacacaguagaauuccagaaagagaugaga

SEQ ID NO: 4756 - RNA, 70 nt, Homo sapiens
ggcuccauucagaggaagcuggggggauggagaacaguuugucucauccccuccuucccuggugucagcc

SEQ ID NO: 4757 - RNA, 120 nt, Homo sapiens
aagccuguuaccuauauccucuguuucuuuuuguugagcagcugcaugaaaguagcccauaacuuugaggcuggugcagaugcuaaauuaaagagaaacugaucuggguaaugugugcuu

SEQ ID NO: 4758 - RNA, 66 nt, Homo sapiens
cccucuccuuccccucugccuccgggcugcuggauguggguggagcagaggaggaagggcacaggg

SEQ ID NO: 4759 - RNA, 65 nt, Homo sapiens
cucaccugucuucucugugggauccaugauguagucccaugaucccaggacagggcagaccugag

SEQ ID NO: 4760 - RNA, 142 nt, Homo sapiens
cugucucccccaacccuuaguagcccccauagccugcagcccaguggcgagguggguuggcacagaauccucaauggaaaggaggcacccucucucccuggggugcagaagguggaggcggcgggggucgggggguaugcag

SEQ ID NO: 4761 - RNA, 84 nt, Homo sapiens
gucuccucuguguguguccugcacuaaaugcccaaaucccagcaugggacauaacgcagugagugacacaggcagaguccaggc

SEQ ID NO: 4762 - RNA, 112 nt, Homo sapiens
ugcacuguugugacaagcccuaguagauggugucaaucauauugcuuuauguuacauuaagugacauauuguaaugcgauugauacaacaugggaugacacaucauaaugcg

SEQ ID NO: 4763 - RNA, 77 nt, Homo sapiens
ggcgcugcccacacccaggggagcugcugcuucugaugaaaugcacggcuccaccgggcaggggcacaaccaccgcc

SEQ ID NO: 4764 - RNA, 85 nt, Homo sapiens
gcuccaguacauggcauuaacuccuaaaguguggacuucaggaguuuaacuccacacuuuuggaguuagugccauguacaagagc

SEQ ID NO: 4765 - RNA, 68 nt, Homo sapiens
aggucauaacauauuuuucucaguaaagacauugaccaagucuucacugagcuaauauguuaaagccu

SEQ ID NO: 4766 - RNA, 91 nt, Homo sapiens
agcacauggcugucaacuccaagguaccugccagauagaaaguaugagggaaagcauuuugcaggcacucuggaguuuucagccaccugcu

SEQ ID NO: 4767 - RNA, 86 nt, Homo sapiens
gucgcaugggucggacaccagcggcggcagcccggccccaccgucggacugggcggcacgcuccuggugcuccgugcccagacgau

SEQ ID NO: 4768 - RNA, 67 nt, Homo sapiens
ccgucaccaucacccggugcugggcgggcaccauguggacuccacuuggcacugggccgaugggcgg

SEQ ID NO: 4769 - RNA, 60 nt, Homo sapiens
uuaacaccagaccuuucaggccccaucaaauuuaacaaggccugacagauuugggauuaa

SEQ ID NO: 4770 - RNA, 80 nt, Homo sapiens
ggcucaggucugugguggccgcgggagagccagcuccacgcuguguggcuggugacauuuccggcugccagggcccagcc

SEQ ID NO: 4771 - RNA, 94 nt, Homo sapiens
gaagcaucgucugggcacggagcaccaggagcgugccgcccaguccgacgguggggccgggcugccgccgcugguguccgacccaugcgacuuc

SEQ ID NO: 4772 - RNA, 91 nt, Homo sapiens
uguccacacuuuucaaguacauguuguucaaaagccacauguucucgucuaugaggucaagagcagcaugagcuaugaacuggugcagaca

SEQ ID NO: 4773 - RNA, 76 nt, Homo sapiens
uucacaauguuccacauaugcuuaguuuuuguccacucaccagggacagaaacagaauauggugugacaucaugaa

SEQ ID NO: 4774 - RNA, 107 nt, Homo sapiens
gacgcaucuacuucccagcaguguugaggccuaauuucauuugauugaaaagccuuugggcuuuuuccaugaucagcuguauuugguuucagaaguucagaacuguc

SEQ ID NO: 4775 - RNA, 87 nt, Homo sapiens
gggacagcuucucagaggaagugguauugacacugagaucugcuagugagucucaguugacugaaccaacuuccccucagaguuccc

SEQ ID NO: 4776 - RNA, 70 nt, Homo sapiens
ugcucacccccuagaccuuuaggccgaggccugccagccucuggaugacugugguguaggguggcaggca

SEQ ID NO: 4777 - RNA, 88 nt, Homo sapiens
aguccaugcugcccuguagaucugugccucucaccaccacuguggaaccacagugcagagacaugugccuaugggguagcaauagacu

SEQ ID NO: 4778 - RNA, 100 nt, Homo sapiens
uguucagaaagucuguuguuguaaacauccccgacuggaagcuguaagacacagcuaagcuuucagucagauguuugcugcuaccggcuauucacagaca

SEQ ID NO: 4779 - RNA, 75 nt, Homo sapiens
cccucagagcugauaugaguguggagauuccauucacuucaaaggaagcuucacgcuuggaucuucuccacaggg

SEQ ID NO: 4780 - RNA, 77 nt, Homo sapiens
gccccagccgcuggccccucccuccagggcugcagcugggcugagccuccaggaggggggugcuguggugacugggc

SEQ ID NO: 4781 - RNA, 56 nt, Homo sapiens
uccucaaggcagagaagggacuggaugaagcucccagugccccuuccugcccagga

SEQ ID NO: 4782 - RNA, 132 nt, Homo sapiens
ucagcaaacuaacagaaagucacuucaaugaucaaauaaccacauuguuuauaaguauaaaguuuauacuccuuauuuauacuuauaaauaaugugguuguuugacuaaaucgcuuucuguuaggggacuga

SEQ ID NO: 4783 - RNA, 98 nt, Homo sapiens
ugagcaaagaaauuggcuuuuaaaguuguuuccaggcucuguucaucacucauuccugggugagaugccaggaaauaacuuucaugguuuuuuccuca

SEQ ID NO: 4784 - RNA, 64 nt, Homo sapiens
acugcaagcauaucauuuuguuccuguaacugaaauguacaaugggacaagaugagaugacagu

SEQ ID NO: 4785 - RNA, 74 nt, Homo sapiens
gcugcaauauuucuucaggucugcagagucauaauuaaagcugaacugagcggaauuggagagggaaggucagc

SEQ ID NO: 4786 - RNA, 75 nt, Homo sapiens
gccucacacuggguuuugauguuuugucauucagcauguuguugauacgaaugacaaaacauugaaaucuaaggu

SEQ ID NO: 4787 - RNA, 98 nt, Homo sapiens
gccacaccuggguaggaagaaaagguauaugguggguggaaugaggagccacccugucccuccacuccuucccuaccuuuuuuuuuaacccuacuggc

SEQ ID NO: 4788 - RNA, 75 nt, Homo sapiens
cuugcaguguaauuggggaaacugagguccagagaggagaaaggacuuacccaguuuccccaauugcaauacaag

SEQ ID NO: 4789 - RNA, 101 nt, Homo sapiens
aacacaggaagaaggggauuugagaaaaaguggaaagaagggacaucacacaaaggucccuuuauauugcauucuuucuucuuucucuuucuucaauuguu

SEQ ID NO: 4790 - RNA, 80 nt, Homo sapiens
ggcucagcauggcggggcagggugugggcacggggccaggcccaugguccucccuggcccuguccugguggugauaagcu

SEQ ID NO: 4791 - RNA, 66 nt, Homo sapiens
ggagcaugugcagugagaugggugccugccuuguaggcugugguacccugccucacugcauucucc

SEQ ID NO: 4792 - RNA, 89 nt, Homo sapiens
gacccauuuagacacuuagcaaaagaguccagagucugggcaucuuccagagucagacuguggguuccugggcuggguggccugagguc

SEQ ID NO: 4793 - RNA, 83 nt, Homo sapiens
gccucauggggcugaaguucuaggagcuagucuugaccucuaaggaaggcagagauuaggguuuggauuuuauccccuagggc

SEQ ID NO: 4794 - RNA, 83 nt, Homo sapiens
cauucaucaaaggcauuugcuggugguggcaggggaaaugucacagcacugcugccaccacugccagguaucuuuuuaaaaug

SEQ ID NO: 4795 - RNA, 77 nt, Homo sapiens
gugacauuuauuuauauuuuguucuaaaaugugcauuucucaaauguacguuuuaagaucgagauauaaauauuuac

SEQ ID NO: 4796 - RNA, 68 nt, Homo sapiens
gcacccacccguagaaccgaccuugcggggccuucgccgcacacaagcucgugucuguggguccgugu

SEQ ID NO: 4797 - RNA, 88 nt, Homo sapiens
gaggcccguuucucucuuugguuaucuagcuguaugagugccacagagccgucauaaagcuagauaaccgaaaguagaaaugauucuc

SEQ ID NO: 4798 - RNA, 56 nt, Homo sapiens
cugccccacugaagauggcuuccuguacacagagucauuaugguucagugaagcag

SEQ ID NO: 4799 - RNA, 84 nt, Homo sapiens
gcucccccucuugaauccuuggaaccuaggugugagugcuauuucagugcaacacaccuauucaaggauucaaagaggcugagc

SEQ ID NO: 4800 - RNA, 150 nt, Homo sapiens
gcuucccacagcaacuauaacuuagccucaucuggcguguguaguauuuuguguuaguguggaugguguuauauguuaagacauuaaaguuaacaccauaagcagagcacaaaaugcuugagggggcugaguuaugaugacugugugagc

SEQ ID NO: 4801 - RNA, 83 nt, Homo sapiens
ggugccuuuuuaaaaugcauugagaguguugguuagcuguugcagcuguacaacacuuuuaauaugcauuuuuaaaaaucacu

SEQ ID NO: 4802 - RNA, 79 nt, Homo sapiens
ugccccucccuggggccagcccacacacauagucucucuggaaugaccuuccuuguguggguaagucuuggggauggca

SEQ ID NO: 4803 - RNA, 70 nt, Homo sapiens
gaggccugcucuggcccagagcgcacgugagugaggccucugcugugggcucugggccggaggcauccuc

SEQ ID NO: 4804 - RNA, 114 nt, Homo sapiens
agggccgggcaguggcgcagugagguggucuuggcuacggggucucccucaggcagggagccuccaccagacccugaggcccaaccagcagcaaugcacccacucacccucccu

SEQ ID NO: 4805 - RNA, 85 nt, Homo sapiens
gucccccccggcccagguucugugauacacuccgacucgggcucuggagcagucagugcaugacagaacuugggcccggaaggac

SEQ ID NO: 4806 - RNA, 101 nt, Homo sapiens
gaggcccugccaauauccgcacaucacuggcaugauagaccauaacagcuucuucugagcuguuccggucuaucgugucaaugcguacucggggaguccuc

SEQ ID NO: 4807 - RNA, 72 nt, Homo sapiens
caaaccagauuuggcuccaaguggcuacucauccuugggagcaagugacaacuuggagccagacuuuauuug

SEQ ID NO: 4808 - RNA, 105 nt, Homo sapiens
ggcaccauccugcuucacucacccagucuuccacugucccgccuccacgcuggggacaggcaggcuugggacgagcuggaggaaggggaggggaggaaaaaugcu

SEQ ID NO: 4809 - RNA, 79 nt, Homo sapiens
ggcuccacuacugcaaggagggcauuggcuguuggaagcaaagcauucuacuucccggugcucuuggcaguuccaagcc

SEQ ID NO: 4810 - RNA, 79 nt, Homo sapiens
ucucccagccugaggugcagugcugcaucucuggucaguugggagucugagaugaagcacuguagcucaggaagagaga

SEQ ID NO: 4811 - RNA, 69 nt, Homo sapiens
ggcucccggcgcgcgcuccccucugaccaccuacggaaugaccucagagugggagaaugugccaaggcc

SEQ ID NO: 4812 - RNA, 84 nt, Homo sapiens
gcucccccucucuaauccuugcuaccugggugagagugcugucugaaugcaaugcaccugggcaaggauucugagagcgagagc

SEQ ID NO: 4813 - RNA, 118 nt, Homo sapiens
gccucccgugcugcccguaucucgcauggccuccauccccuccaugaucggggagaagcugcccaccgccaagggguuggaggccgggcuggacacacccaagguagccaccaaaggc

SEQ ID NO: 4814 - RNA, 82 nt, Homo sapiens
gggucccuuauugcuguuaggcccagggcuggaaccagcaauaccugagucuccccugagcugacagcaggagccucagccc

SEQ ID NO: 4815 - RNA, 83 nt, Homo sapiens
gcagccugcgccggggcucagccccaucucuccccucuuccaggaagcccuccgugaguuuggggcugagccuggugcccugc

SEQ ID NO: 4816 - RNA, 69 nt, Homo sapiens
caccccucagacuggccucucacuggugaagaugugguucagacagugucucagaggccaucuguggug

SEQ ID NO: 4817 - RNA, 111 nt, Homo sapiens
gcucccucauguauucccugcaaaugaccacugaaaauuugacauuguuuaagaucagcaagcccaaaauaaugucuuaucccaguguguugcacggaauagguguugagu

SEQ ID NO: 4818 - RNA, 132 nt, Homo sapiens
gcaaccugaaugaaaauuauuuccugacuuuuacuagccuaauacugugcuuucaauuaaagaauaccgaaggcacagcauuaggcuaguaauaguaaaagugaggaaguaauuuuccuccuauuucuuugc

SEQ ID NO: 4819 - RNA, 76 nt, Homo sapiens
gcucccugugaguaggaagaccagaaagaaaagauaucucccaaucugcuuuuuggcuucuuauucacuccagagc

SEQ ID NO: 4820 - RNA, 91 nt, Homo sapiens
gcgcccuggccgcgcagccgcagagugcgcgagcgagcgccucacaauuucgcccagcucauccucgcaccacugcgccugcgcggcgcgc

SEQ ID NO: 4821 - RNA, 118 nt, Homo sapiens
gcgcccugugugugucucucucuguguccugccagugguuuuacccuaugguagguuacgucaugcuguucuaccacaggguagaaccacggacaggauaccggggcacccucugcgu

SEQ ID NO: 4822 - RNA, 72 nt, Homo sapiens
ggggccuuccucaggcuaugaaaaaauacuucaugucuaacccuaauuuuuuccauagcuugagguuacccc

SEQ ID NO: 4823 - RNA, 138 nt, Homo sapiens
guagccuuggcugaaugcgcuggaccgggagggccgaggccuccucuccccgucuccauggccacgggcgugcgccugacccuggagccggcuggggcggaacccucggacuaccuucccgccuucagcaaacucuac

SEQ ID NO: 4824 - RNA, 105 nt, Homo sapiens
uuggcgcaaacagagccucuugcuggucucagaaauggggaaagugagaacuaaccaccaaccccaaugagaccagugcaggaaggauuuugaaguuuggacuag

SEQ ID NO: 4825 - RNA, 133 nt, Homo sapiens
uagccggugacaaauguaugugaaugaccagcucacaggaaguggccuucaauaguccgauagcuuccuguauccugacauugugaaggcccacuuccugugcugucucugaaaauacagcaagucaaagcug

SEQ ID NO: 4826 - RNA, 94 nt, Homo sapiens
gggacuucaguuaacggaaaggggugugucccaacaaagacucauacagucaacugucuccaugcuggcaugccccacuguuaauugauuuccc

SEQ ID NO: 4827 - RNA, 66 nt, Homo sapiens
gggacuaagcuaaggggcugucccauuucauucuccugaugaggugggucccuuugguuucauccc

SEQ ID NO: 4828 - RNA, 87 nt, Homo sapiens
gccucuccccagggccaguugagaggcacccccuagggacuucuuccccccggccaucuuccuccucgaaaggcccuggggcagggc

SEQ ID NO: 4829 - RNA, 55 nt, Homo sapiens
gcagcuugauggcugauggaggguuggagucagccuuacacgcagccauuacugc

SEQ ID NO: 4830 - RNA, 72 nt, Homo sapiens
gccacuggaaauucaugggccagauggaaucacagauuacaccauuuuccuacuggccugcaauuuucuggc

SEQ ID NO: 4831 - RNA, 74 nt, Homo sapiens
uuggcuuggggaaaacugacaggggagguccccccauaccaccaguaaaccugcccugucgccucccuguccaa

SEQ ID NO: 4832 - RNA, 83 nt, Homo sapiens
cuggcucccuuccugcgugacguaggcuggcgugggcucuucccccagccccuugccggugcugccacgugagaagggcccgg

SEQ ID NO: 4833 - RNA, 83 nt, Homo sapiens; identical to SEQ ID NO: 4832

SEQ ID NO: 4834 - RNA, 115 nt, Homo sapiens
cauacuuggucacuuguuaaugaagaaaauuaaucacuguuuuuauguaaucagugcuucaaaaguacuugaggguacuugaaagcaguugauuuucuuagguagauuauuuaug

SEQ ID NO: 4835 - RNA, 106 nt, Homo sapiens
uccucuauucacauccaucagggagaggaguaggcugauggugccagcuaaggaccucggcacuccuagaccuauuccugaaccauuaauggcucugaauuuggga

SEQ ID NO: 4836 - RNA, 74 nt, Homo sapiens
gcuucuguccugugcugugcaucuugaugaccuaggccugaaggucacaagggcagcacagugaggacuuaagc

SEQ ID NO: 4837 - RNA, 83 nt, Homo sapiens
gaggcuaagaagcaugggcaaggccaugcagcuaguaagugguggagcugggcugcuccuggucugucucauguucuuuccuu

SEQ ID NO: 4838 - RNA, 86 nt, Homo sapiens
agggcuggagagaggggaggacagagguaugaguuggauacaagcugggcaaaacucuugucucaauccuccucgucucuuucccu

SEQ ID NO: 4839 - RNA, 108 nt, Homo sapiens
gguucucagcugaggcuguucugauggggguuggggcgauggcuucuaagagcugagcuucuuccauggcccucccugaauuccuagagaagcagccagcuguaagcc

SEQ ID NO: 4840 - RNA, 67 nt, Homo sapiens
auggcucugaguacauaauggcccucaccacgggcaagcaugaggguuauguacacuucgggaccau

SEQ ID NO: 4841 - RNA, 69 nt, Homo sapiens
ugcacuguacaggaaggcuccaggcugccacuuggcagaaaaaucuccaggaguuguccguauucugca

SEQ ID NO: 4842 - RNA, 121 nt, Homo sapiens
gcuucuuagugauuuccugcauuucuucuuuugugccuauuugaaccuacaacugucaccaguuguuccagugaucagaaaggcacaggcgcugugugggugaaauucugugacugugagc

SEQ ID NO: 4843 - RNA, 141 nt, Homo sapiens
gcaacugggguuagcaagacagugaggcacuuuauccuuuaucacuugcugugaaugaaauugacuaggaucauacacagcaggggucaaggguaaagugcuuccuugcuggcguucaacuugugcuaccucuccucuugc

SEQ ID NO: 4844 - RNA, 102 nt, Homo sapiens
uccccuuucgccccauuuuuccaucacugucuuucuugggccacauuuugauuucauaauaguaguugcuugaaggcagugggggaagugggggaauuggga

SEQ ID NO: 4845 - RNA, 67 nt, Homo sapiens
agagcuugcuuucucccuggccaggagcucaaagugaacuuccucgccuggggugaagucauccucu

SEQ ID NO: 4846 - RNA, 74 nt, Homo sapiens
gaaccugccagaucagaauaguguauucugugcacccaacaggguggaagacauuauuuuguuuguguuaguuc

SEQ ID NO: 4847 - RNA, 87 nt, Homo sapiens
ucuccugcugugacccucaagauggaagcaguuucuguugucugaaaggaaagaaagugcuuccuuuuugaggguuacuguuugaga

SEQ ID NO: 4848 - RNA, 65 nt, Homo sapiens
gguucuguggccucuuagacacugaggcccuuaccaacuccucgguucugagagccgcuuagacc

SEQ ID NO: 4849 - RNA, 107 nt, Homo sapiens
uuaccugucuacagcaccacuugcaggggagggggaggaggcaguucuuuaggaaggguagugcaaugcuuccuccucuucugcaagcagugcuggagauucuguag

SEQ ID NO: 4850 - RNA, 122 nt, Homo sapiens
ggagcuagauucuuugucuagcucuagaaucucuuugugcaaaaaucccugugaguaccacacagagggauuuuugcacagauucuagagcugaacaaaggaucuuuaagucuauuuucucc

SEQ ID NO: 4851 - RNA, 67 nt, Homo sapiens
guuccucuuucccagcccugcuugggugugggugaagcuuacaagccacguaggugggagacagagc

SEQ ID NO: 4852 - RNA, 71 nt, Homo sapiens
gccccucucucacuccagucagagucagccuggcaggaggucaugacucagucuggggugcagaauugggc

SEQ ID NO: 4853 - RNA, 71 nt, Homo sapiens
uucucucuccugagagccacaggcuggugggcucagccaugugccagcccgugugcuccaggaaaacagaa

SEQ ID NO: 4854 - RNA, 113 nt, Homo sapiens
ggcgcucggcaggggugcggcguggcggggagggagcuguggcuuugauuucagcugaucugagccccagccucccucccccagcagagccgcuuggcccagccccauaugcc

SEQ ID NO: 4855 - RNA, 70 nt, Homo sapiens
cagacucaggggcgggagugugccuuagaaaaacuccuuuggggcaguuauucugugcccccacccucug

SEQ ID NO: 4856 - RNA, 83 nt, Homo sapiens
cucccucaaauuggcuccauuucagacccccaagaccaagaaagcauugaaaggggaguccugaaggaaccauuuauauggag

SEQ ID NO: 4857 - RNA, 80 nt, Homo sapiens
uggccuguuuaauuuccuuccagguuccuaaggcucaggacuucuagggccauuagacugccaggaagggccuaaagcca

SEQ ID NO: 4858 - RNA, 74 nt, Homo sapiens
gauccuggugggcaucaagaaguccugucaaacagaaaaagcacugacagggaaucaggugucugcagaugauc

SEQ ID NO: 4859 - RNA, 119 nt, Homo sapiens
acaacugagggaggaagggacuauuuuuucaaaggcuuuuagaggauguuguuaaaagaauauauagugacaucauuuaaaagccuuuuaaauaauaguccucuuucccucccaauugu

SEQ ID NO: 4860 - RNA, 79 nt, Homo sapiens
uaugcuuggggcuggggaagccagaaaccaauccauuugaugucugugugguuucauggcuuguuaagucccuuucaua

SEQ ID NO: 4861 - RNA, 136 nt, Homo sapiens
gguccuucuguggcuucagacuuuuaauuccagucuuaacucacccuucugcugcaucuccugcuucauuuccugaauguagugugaccaggggagagcagaaggaagcagggauuggaucugaaaucaguagacc

SEQ ID NO: 4862 - RNA, 71 nt, Homo sapiens
cucccuucaacuuuaacauggaagugcuuucugugacuuuaaaaguaagugcuuccauguuuuaguaggag

SEQ ID NO: 4863 - RNA, 61 nt, Homo sapiens
uccacuugaugacugucucguacaccagcuccucagccuugguguugaggcugucguugga

SEQ ID NO: 4864 - RNA, 74 nt, Homo sapiens
cacagcaccaggaagccugagaaugaauccugagggcucuagcccaggcuuugucccaggcuuucuggugugug

SEQ ID NO: 4865 - RNA, 70 nt, Homo sapiens
cacagcaccaggaagccugagaaugcuuagggcucuagcccaggcuuuguaccaggcuuucuggugugug

SEQ ID NO: 4866 - RNA, 63 nt, Homo sapiens
aguggcaggagaguggguuugccauuaguucaacacaaacuguuugcccauucucuugacacu

SEQ ID NO: 4867 - RNA, 99 nt, Homo sapiens
gcuugcugaaguaauguugcuuaugcacuucuccucaggccccaguuaaaaggaauucagaggcaggagugcauaaacagcuacauuacuuuggggagc

SEQ ID NO: 4868 - RNA, 60 nt, Homo sapiens
ccagguggaacaggccguccugacuguuuggugacagacagggagggcuuguucugcugg

SEQ ID NO: 4869 - RNA, 71 nt, Homo sapiens
ggagguuggguaaggaaggagaaauugagaugugcacgggcccaucacaccuucccccuugcucaagcuuu

SEQ ID NO: 4870 - RNA, 91 nt, Homo sapiens
cucagauuuccagggacccacaugccagcacuaucccagccucgggugucugagguaccuagaccagaggguguggcccuggaggugugag

SEQ ID NO: 4871 - RNA, 103 nt, Homo sapiens
uacagagguuaaguguacagcuuuggggucagacagacugguuugaaugcuggcuguuaauuucucagcugugugacuucaggcaaaguacuuaaucugugug

SEQ ID NO: 4872 - RNA, 86 nt, Homo sapiens
cacagcugccagugucauuuuugugaucugcagcuaguauucucacuccaguugcauagucacaaaagugaucauuggcaggugug

SEQ ID NO: 4873 - RNA, 72 nt, Homo sapiens
gcgcggccccuccuuugucucaggggugcccugagcacagaggccuccaggugagcacaggaggggcggugu

SEQ ID NO: 4874 - RNA, 74 nt, Homo sapiens
ugggguaaccaaccauccccgugugucugggacuuuuauugucauaggcacacuaggaugaguugguugaccua

SEQ ID NO: 4875 - RNA, 116 nt, Homo sapiens
gggaguaagugaacugacugguuuuuauuuuguuuuacugcuuuuaacauuacaguaacuguuacagguuccagcaggcuaacuggguggaaaugaguuugguuucacuuagucuc

SEQ ID NO: 4876 - RNA, 116 nt, Homo sapiens; identical to SEQ ID NO: 4875

SEQ ID NO: 4877 - RNA, 63 nt, Homo sapiens
gcaggcucugaggucccaggauucuguggagauucacaggggaccuaggacccucggagcugc

SEQ ID NO: 4878 - RNA, 71 nt, Homo sapiens
gggugauuuguucauggccccaucuugguguccagucuggccuugaaagggggucuuggaacagguggccc

SEQ ID NO: 4879 - RNA, 92 nt, Homo sapiens
uucuguucccaggcugccugucacuuuggguaagaaaacacacagaguuaugcucgcuuacgcuuacucaagugaggucucuugggaaagaa

SEQ ID NO: 4880 - RNA, 59 nt, Homo sapiens
aaggggcauuuagggcaguagauucuaagcugcuucacuaacugcacuagaugcaccuu

SEQ ID NO: 4881 - RNA, 93 nt, Homo sapiens
auacguugaguuaaaugagaugccggugauacggcuaaaaccaaaaccaaggaggcuguuggauaaaucaccggcauuucaaacuuaaggugu

SEQ ID NO: 4882 - RNA, 72 nt, Homo sapiens
gaucgaucuggccugguggugauucuccagaaacuccauuccucagggcugugaccaccaagccaggugauc

SEQ ID NO: 4883 - RNA, 101 nt, Homo sapiens
gcccgguacuugcugaaggggauggggguucuggauccaggugcaccccucucaggaugccccugaugggccucgggacucucagcccucaaguauggggu

SEQ ID NO: 4884 - RNA, 68 nt, Homo sapiens
uggugugaaagggacagagagggucgcuucaaaucgauuuuacuuguccuuucugucuuuucggauca

SEQ ID NO: 4885 - RNA, 77 nt, Homo sapiens
ggaaguacaaggggaguaagucugguccauguucccucugaugcuaacacggucacagucugcuuucuuuguguucc

SEQ ID NO: 4886 - RNA, 61 nt, Homo sapiens
ccgggcccuggauggcagcgcucgacaggaaaccucgagcgaggagccagcugggggccgg

SEQ ID NO: 4887 - RNA, 60 nt, Homo sapiens
gagugucauuuaagccuuuugccccucuggacacuagaaggcagauggcgaaaugagcuu

SEQ ID NO: 4888 - RNA, 71 nt, Homo sapiens
aggggcuccuccacuccagguccuugggguauguguacccccagaggagggcggaguagugaggagacccu

SEQ ID NO: 4889 - RNA, 167 nt, Homo sapiens
gggugacagagcugucuccauggccuggcacugguuuucauccugguauuagaaaugcaucagugcucccuggggaaggggccaguuucaccagcuccugccccaugagcugugaaaaugcacauucuaagaaggagccaggcagggccugagucccucugugaccc

SEQ ID NO: 4890 - RNA, 105 nt, Homo sapiens
gcugguggggcggggagccgcuucuuccaggagagagagaggggugauuuucugaugacucacuuuuuucccacucuuggaggauuaaguucuggccccaguggc

SEQ ID NO: 4891 - RNA, 69 nt, Homo sapiens
ggaugccuugccaagugucuaaaauggugaguacugcuuuugcuuaaaagacugcuuggccgagggucc

SEQ ID NO: 4892 - RNA, 82 nt, Homo sapiens
gcaggcaccauguuucugaccacccucuucauccguacucacauaccugcuagacaguggaucgggaugcacugguggcugc

SEQ ID NO: 4893 - RNA, 106 nt, Homo sapiens
cucugugguuaagcccauuaaaucucuugugcuuucauagcagcuuggcuaaagguuauuacuaugaaggcuggagggagagugggagauaacuucgaccagagag

SEQ ID NO: 4894 - RNA, 65 nt, Homo sapiens
ggcugugagacuuguucagggucaucggaacugcauuucgcugagccagaaugagauuucaggcc

SEQ ID NO: 4895 - RNA, 65 nt, Homo sapiens
gcaugcccauuaguuuuuccauuagugaauucaacaauacuaaugggauuacuagcaugggaugc

SEQ ID NO: 4896 - RNA, 67 nt, Homo sapiens
uacagguccuagcaugcaauggccugauuucaugugggccacagagcacugcuuguaaggacgugua

SEQ ID NO: 4897 - RNA, 74 nt, Homo sapiens
aggagagaggaagaugggagagcucuggaaugacugugauuucuccacccugcuuucuuaucucccuuuauccu

SEQ ID NO: 4898 - RNA, 66 nt, Homo sapiens
ccaggagcauaugcagcagcggcugcuugugcgcucagccaggcagccugguugcaaugcugcugg

SEQ ID NO: 4899 - RNA, 84 nt, Homo sapiens
gguaguugcugggggcuucucuugcugggcugguuuagugcuucccugaguaacuggcccgggagcagaggccugaguaaugcc

SEQ ID NO: 4900 - RNA, 78 nt, Homo sapiens
cagagccagcggcaaaggcagggaacaggcaccgcccacucuaggacugggcccugguucugccugugagcuggucug

SEQ ID NO: 4901 - RNA, 80 nt, Homo sapiens
gucagucaaauaguuuuuauuggucugaaugggugagcugauauguuuauucauucagccaacaaaauguuuuugaugau

SEQ ID NO: 4902 - RNA, 83 nt, Homo sapiens
auaugagguuugggggcuugacuccucccugagaaaacgcaagaagcucuuucucagaggagucauaccuaaauagccugugu

SEQ ID NO: 4903 - RNA, 77 nt, Homo sapiens
gagagaacuauuguucacaauucuauaaugaacaauagucuugugcugauagaauuguggcuacaaugaguuaucuc

SEQ ID NO: 4904 - RNA, 80 nt, Homo sapiens
aggaggggaaggggaaauccauaagcuuugucugauuucuuauagaaaaaaguagauggauuuaguccagguccugucuu

SEQ ID NO: 4905 - RNA, 79 nt, Homo sapiens
guaugauucauugauaugccaguaacaucuuggcuucagcauacagugucuagaugugcuaguguauccagaauggugc

SEQ ID NO: 4906 - RNA, 67 nt, Homo sapiens
uuuugggcacagcggcaacaugauaugacuuguuuuaaaaggaucacuggggccgcuauguugagaa

SEQ ID NO: 4907 - RNA, 95 nt, Homo sapiens
acaaggagacagauggaaauuuguggaauuuacucucaggagccugcauggucauacggaguguuuuuaacaggguuuccaauucuucucauugu

SEQ ID NO: 4908 - RNA, 106 nt, Homo sapiens
caccgaguccccuccaacccaggacucuagacauucaggacagggcugcuuguaccacucugcugcuucugaacugggguccuggguuugugccagcgacugggug

SEQ ID NO: 4909 - RNA, 81 nt, Homo sapiens
uccugugacgggcgagcuuuuggcccggguuauaccugaugcucacguauaagacgagcaaaaagcuuguuggucagagga

SEQ ID NO: 4910 - RNA, 88 nt, Homo sapiens
gcagguaauuuuuccaguguaccauuccaaccugcaaaaccucacauuuaaaugcaaauuucuugguaagcugugaaauguuggcugu

SEQ ID NO: 4911 - RNA, 99 nt, Homo sapiens
agcugugcgucucugucuacccagggcaggcaggccagcggcugggcgucauuggagcagcagucccugcccugugcccugggaucagccugcaaagcu

SEQ ID NO: 4912 - RNA, 80 nt, Homo sapiens
cucuggccauuuguuuaucuggugagaaacugcugugggagaccuguauggcaguaguuuacugaguggacuggcaagag

SEQ ID NO: 4913 - RNA, 72 nt, Homo sapiens
cagggccacucugcugccugucgggucccugccccugggggcugcccagagcgguuagcagagcugggccug

SEQ ID NO: 4914 - RNA, 72 nt, Homo sapiens
guaggggaggcaguguugaaaaggagagccagccagggcuuuguucucccaucagccacuuccgucugcuac

SEQ ID NO: 4915 - RNA, 70 nt, Homo sapiens
gccuguggaguagguggugcauuguccccucucuggaugaaggaaggcacugaguuaccugccccaaggc

SEQ ID NO: 4916 - RNA, 82 nt, Homo sapiens
cauuguucaucuucuggccccuguugucugcauguaacuuaauaccacaaccaggcauaggggaaagauuggaggaaagaug

SEQ ID NO: 4917 - RNA, 67 nt, Homo sapiens
cucuggcuccccuugagauuggguuuccugugcccuggacgcuccagaaucucagaggaagcgggag

SEQ ID NO: 4918 - RNA, 95 nt, Homo sapiens
uccuguggcaagggcauagcuuucucugucagucucucugguggagaucugaaacuucaucagggcugugcacagaaggcgaugccuccaagggg

SEQ ID NO: 4919 - RNA, 66 nt, Homo sapiens
gaauguguguuccagaggaguccuguaagcaaagcaagagaggaccuccuuccugggaacagguuc

SEQ ID NO: 4920 - RNA, 82 nt, Homo sapiens
ggccggcaugugccuucgcugcucagccugugccuugaacucgguggugcagagcgugcugagcaagcggacacugcaggcc

SEQ ID NO: 4921 - RNA, 114 nt, Homo sapiens
ucuagaaaucugaacaggcacggauaggacagagggcuccucuaacuauugggguguggggcaguucaaaggauagggaggccucucagaggccuugaaguuggguuuuguaga

SEQ ID NO: 4922 - RNA, 94 nt, Homo sapiens
guauguauuauauucugucuguugauaucuguagguucuggaauucuuuuuauuaaccccuagauaucaacauauagaauaucuguguagguau

SEQ ID NO: 4923 - RNA, 80 nt, Homo sapiens
ggggguguuucuucuucuauuuuccuggaaaagcagaaagcaaggucucaggaagagugggagaauuuggggacagcccc

SEQ ID NO: 4924 - RNA, 66 nt, Homo sapiens
uagugcauuuggcuaauuuucuuuuccaggcuuuuuacuguaaagaaaauuggccuccauggauua

SEQ ID NO: 4925 - RNA, 96 nt, Homo sapiens
ccgggccauuucucgugcucuuccucaucgaucacggaauuaaacugacagaaggagaauuucagagcgacuugggaggggcaggggcugggccgg

SEQ ID NO: 4926 - RNA, 77 nt, Homo sapiens
gcgcggcgcggccucuccccgggaggagagaacacaaagaaaagcucucuccaauccggucagagccguggcggcgc

SEQ ID NO: 4927 - RNA, 66 nt, Homo sapiens
aaaagguagauucuccuucuaugaguacauuauuuaugauuaaucauagaggaaaauccacguuuu

SEQ ID NO: 4928 - RNA, 84 nt, Homo sapiens
ggaugagaaggcagaagggagcuggaauggguguaagacuaacuagaguauuugccugaugccagcucucuuaucuccuggucc

SEQ ID NO: 4929 - RNA, 73 nt, Homo sapiens
uuguggcauuuggugggguuuuuuaauguggcuuuuuucaaagggucuuuaaaauaugccacugaagcagcaa

SEQ ID NO: 4930 - RNA, 59 nt, Homo sapiens
uccugccguagaaauguugguggggaaacaguccuuauuugaucauuuuuggggaagga

SEQ ID NO: 4931 - RNA, 68 nt, Homo sapiens
cuccggugccuacugagcugauaucaguucucauuuuacacacuggcucaguucagcaggaacaggag

SEQ ID NO: 4932 - RNA, 71 nt, Homo sapiens
ggguguugugccuuagucccugccucugccucuugggaacagaaguuggugggagugaggacgagaggccc

SEQ ID NO: 4933 - RNA, 56 nt, Homo sapiens
cagaggcgcaaggcgccccucccccaccucggggcgggagcagccuucagugucug

SEQ ID NO: 4934 - RNA, 71 nt, Homo sapiens
gacugggggagaggugaaggcugcccuggguuggccccagcccuggggaggagcguucacccuuuccaguc

SEQ ID NO: 4935 - RNA, 66 nt, Homo sapiens
gagugugugucuccacugugcuauuuuucagaagaauaugaggaacaguacucggaggccagacuu

SEQ ID NO: 4936 - RNA, 73 nt, Homo sapiens
uccuggcuccucucucuuccugacacauuccaaaaaggaauuuauggauguugggaaggacaaagggugagga

SEQ ID NO: 4937 - RNA, 63 nt, Homo sapiens
uugggugucucagagucuccugggauucccuaaacucuguucccagagagaccuagcaaccaa

SEQ ID NO: 4938 - RNA, 80 nt, Homo sapiens
ggcaguuuguuuuauuccuuuccuugggcuaagagagaaauuguagcugcccccugagggaaggaauagaaugaaauguu

SEQ ID NO: 4939 - RNA, 66 nt, Homo sapiens
ucccgcccugaugugugucggcuggaucagaggcgccucuggaacuggggcacauuagggaaggga

SEQ ID NO: 4940 - RNA, 96 nt, Homo sapiens
ggauguaaggggaacauucuguacauaaguaaucugauaucagcuucuggcagaacaaacagauuacuuauauacagaauguuauccuuagaguuc

SEQ ID NO: 4941 - RNA, 85 nt, Homo sapiens
ccagguaucauaaugaagaaguuugcugugugcucucugugugagcaggacaccagagcaacucccuucauuaugaugacauugg

SEQ ID NO: 4942 - RNA, 75 nt, Homo sapiens
uuuaguuggagagacagguggauauuuugagcucuguuaagcaguaaaguuuuuaugugucucucuggaaaugaa

SEQ ID NO: 4943 - RNA, 161 nt, Homo sapiens
ugacggcugccaagcccaacagccaucccugguuacaagcuagaggaaaagucccugagcauaucuguuguuuccuguguguaaagaugcuaaaugccaggugcuuuccucuagaguggaagggccggggcggggcagugccugcagaggcagcaagguca

SEQ ID NO: 4944 - RNA, 93 nt, Homo sapiens
cuggggcaggcagggaggaggaggcucagggaccuagccaggggcauuccauuccccaucucugggccucagucuccccuucugcagcaccag

SEQ ID NO: 4945 - RNA, 69 nt, Homo sapiens
ggaggagcgggagggcccagggugaggggcucccgggcucccuccccggggucuugcugcuggagcucc

SEQ ID NO: 4946 - RNA, 79 nt, Homo sapiens
guaggcagucuuccaaguaugacauuuuagaggauuccacuaccuucuaaaauaccagauuuggaaaacugaauacuac

SEQ ID NO: 4947 - RNA, 87 nt, Homo sapiens
cuaaguuaaggaaugauggugccuaagucauuuagcuaaaugauguauuuaagaaagauggcugcaccguuuuccaugaacuauuag

SEQ ID NO: 4948 - RNA, 86 nt, Homo sapiens
uugugggucucagcaguggucagcccaggagguuuuuacaucugccucuucccuguauugaaaaugcugcuggggccauauggcag

SEQ ID NO: 4949 - RNA, 76 nt, Homo sapiens
uaccguccaguuacucugggacucguugagauccugcaacaggagacagggagccugaguaacuggaauguaggug

SEQ ID NO: 4950 - RNA, 70 nt, Homo sapiens
uucugaaguugcaggagaagcuuuuggcccuacaggaagagaagcaccagcuuuuccugcagcucaagga

SEQ ID NO: 4951 - RNA, 79 nt, Homo sapiens
ggaagacaagcucuaggagagugugaacccuguuugucauuuucacugugggguccccaccuucuggagcuugaauucc

SEQ ID NO: 4952 - RNA, 85 nt, Homo sapiens
auaggaagaaggagggaguaacugaugguggaaaagagacaguuaccuaaauuuuaccgucaggcuauacucuccuucugucuau

SEQ ID NO: 4953 - RNA, 56 nt, Homo sapiens
uacagaaaguauugguaguuucuucccuguccauggaagcugcagugcuucaugua

SEQ ID NO: 4954 - RNA, 84 nt, Homo sapiens
gucagaauaaugucaaagugcuuacagugcagguagugauaugugcaucuacugcagugaaggcacuuguagcauuauggugac

SEQ ID NO: 4955 - RNA, 122 nt, Homo sapiens
ucucgaggcucuaucgggcgcgcaugcucagcgcgccgcucguggccccacuagccucacugcgcgcuuccgcggcagccgcggcggccgagcugagugugcgggccaggagagccaagaga

SEQ ID NO: 4956 - RNA, 135 nt, Homo sapiens
guuugacaugaagucuuuguaucugaggaugucagccauugaacuaugcaggcuaacucucaucuucacaaagagagucugucugcacagcaguggcuugcaacuuaauauuuugcauaaaaauucaugaggagc

SEQ ID NO: 4957 - RNA, 69 nt, Homo sapiens
uugagaugugggugucaggcagugagcuagaauuacccauuagcuacaugauuuguucccacacaucag

SEQ ID NO: 4958 - RNA, 69 nt, Homo sapiens
cuuugaugucuggugggaugagcggcaaagggcucugauuuuugcccuucuccccauugaggcaaagag

SEQ ID NO: 4959 - RNA, 84 nt, Homo sapiens
gccugaguuucuggcuggaguggaugauagagguggauggggaaugacauacagcucgucagcuacuguaggugugaaauaggc

SEQ ID NO: 4960 - RNA, 160 nt, Homo sapiens
ucuugacagaaccuccugaccuaggguuguugcccagugguagugagcuuuuccccuggaggauccucaugccccaucuccaccuagggaucgucaaagggaauggaucacuaacacuguaaaacaacaagccuauucuucugaggaagaucugaaaaga

SEQ ID NO: 4961 - RNA, 80 nt, Homo sapiens
cugugacuggcggcggccuguccccagugcuugucauuuccugacaugccugacaggauggggacagccgccccagacag

SEQ ID NO: 4962 - RNA, 169 nt, Homo sapiens
ggcugagggacgggugucuucagggaaauacuacauuuuaaagggaagauuuuuuuuuuuacuuuucagagaauuucaaaucuuggcacuaaagagggggaaaaagguaugucuuuucuuugaaauacuggcuuuuuuuuuucugaaaagaccacccucuccccaagcc

SEQ ID NO: 4963 - RNA, 75 nt, Homo sapiens
gguagagggacuggaggaggcauggagggucugaaaacagaggggcccccauggccuuucccgcauuccaauacc

SEQ ID NO: 4964 - RNA, 75 nt, Homo sapiens; identical to SEQ ID NO: 4963

SEQ ID NO: 4965 - RNA, 76 nt, Homo sapiens
cagggagccuggcuccacaggccagggugugggaggaccgccuggccacaccucagccauguggaggaggcaccug

SEQ ID NO: 4966 - RNA, 81 nt, Homo sapiens
aggagaacucucacaugucuucucugugggauacacaggauagucccuggauccuaagagagggcagaugugagucauccu

SEQ ID NO: 4967 - RNA, 90 nt, Homo sapiens
cggugauggaaggccucuucuggaacccgagccucuggcauaguuagcuacuaguggguuuggggucugggcugaggcuaccuggggccg

SEQ ID NO: 4968 - RNA, 79 nt, Homo sapiens
cagggagggcaggaucagcaccaugaagaucaagaauauguagacuuuggucaucaugaucugguuuucccccgaccug

SEQ ID NO: 4969 - RNA, 113 nt, Homo sapiens
uugggagaguggccauagugcuuccuugcugguguccaaccuuggcccacagcucaccauugcugcacagacguugugacagaagcaaugauuccacuggccauauccuccaa

SEQ ID NO: 4970 - RNA, 76 nt, Homo sapiens
cagggagccuggcuccacaggccagggugugggaggaccgccuggccacaccucagccauguggaggcggcaccug

SEQ ID NO: 4971 - RNA, 131 nt, Homo sapiens
aguggaaugcguuugcaguagggcuuugggaauggggcugugucacuguggguauagcauacaccauuaguacaauauccucacagugacacgagcccccacaaaauccuccugucccugcgggugucacu

SEQ ID NO: 4972 - RNA, 78 nt, Homo sapiens
ugcugacucugcaauggagaaagugagacugguuugucuccagcucugcuuacacuuuucauucguagagggaaagca

SEQ ID NO: 4973 - RNA, 70 nt, Homo sapiens
gccugaggugccggcuggaguuucugcuggccuggcuugcaaaaugcauuccggugggcaccagaaaggc

SEQ ID NO: 4974 - RNA, 95 nt, Homo sapiens
ggaagauuuguggguguucccgggaacucaucagucuccuguucauuuucaauaggagacucacaaguuccugcaaaugcacacaaacuuauucu

SEQ ID NO: 4975 - RNA, 76 nt, Homo sapiens
ucuagaaaggagcuggaggccuggugcuguuggcgcuucugcugcccagcugucaccucuucugguuucucaugga

SEQ ID NO: 4976 - RNA, 81 nt, Homo sapiens
cccugaacuuuacuccacuggcugccaugaccccaggccagaucccuggcugaagggcaaggagccaguggaggagaaggg

SEQ ID NO: 4977 - RNA, 77 nt, Homo sapiens
uuaugaaaaaauggauucuugccaguuuugcaucuauuacgcaaaugcaaagcuggcaagaauccauagagcaauaa

SEQ ID NO: 4978 - RNA, 76 nt, Homo sapiens
ggaugaaauuugccuccaaaagaggacagugaucuuuucacaaacacuguccuuuguccugaggcacacaaaaucc

SEQ ID NO: 4979 - RNA, 98 nt, Homo sapiens
aacugaagaacugccugaggccuaaaagacauacagccaguccccgaaaggaguguugaggacugaagucuugccgggucucagcgcagugaaagguu

SEQ ID NO: 4980 - RNA, 74 nt, Homo sapiens
ggcugaaggaugaggguaggugggguggcugcucaggaggacuguggaggccacaucgccuaaccuucgaggcc

SEQ ID NO: 4981 - RNA, 81 nt, Homo sapiens
uucugaccccagugggagacuggucauggaugcaugagccugaaauguccaggcucccugacacucuccccaugggaagaa

SEQ ID NO: 4982 - RNA, 109 nt, Homo sapiens
uugugacugcaugcucccagguugagguaguagguuguauaguuuagaauuacaucaagggagauaacuguacagccuccuagcuuuccuugggucuugcacuaaacaa

SEQ ID NO: 4983 - RNA, 78 nt, Homo sapiens
cccagagucuuggucuguuugcuugucucacagugcacaagaggcaagagcuuagaaagcagaucagggaagaguggg

SEQ ID NO: 4984 - RNA, 85 nt, Homo sapiens
gggugagaucacaggugauggagagagacagagcucagcugagagaccagugcuggccugucucuccucuguccugugaaaaccc

SEQ ID NO: 4985 - RNA, 85 nt, Homo sapiens
gggugagaucacaggugauggagagagacagcgcucagcugagagaccagugcuggccugucucuccucuguccugugaaaaccc

SEQ ID NO: 4986 - RNA, 85 nt, Homo sapiens; identical to SEQ ID NO: 4985

SEQ ID NO: 4987 - RNA, 68 nt, Homo sapiens
cucugcguguucacagcggaccuugauuuaaugucuauacaauuaaggcacgcggugaaugccaagag

SEQ ID NO: 4988 - RNA, 72 nt, Homo sapiens
ucaagcuguguccaguucuguuacaugacaagccuccugaacauguccucagcaggacacgacauaaguuga

SEQ ID NO: 4989 - RNA, 73 nt, Homo sapiens
cucugccugugucccucucugcauuaagucccaugcugggguuugggcauuuagugcaggacacacagaggag

SEQ ID NO: 4990 - RNA, 88 nt, Homo sapiens
uccagccuccaaagcgcagccgccugggucuuccccuccagccuccgggacaaggggaaucucaguggcugaaacuucuggggaugga

SEQ ID NO: 4991 - RNA, 70 nt, Homo sapiens
augugcaccauaugucauacuguagcuugacaauuaccucaacaggcagugucagacagaugguaaacau

SEQ ID NO: 4992 - RNA, 83 nt, Homo sapiens
gcuggcgacgggacauuauuacuuuugguacgcgcugugacacuucaaacucguaccgugaguaauaaugcgccguccacggc

SEQ ID NO: 4993 - RNA, 66 nt, Homo sapiens
cuuugccgagacuagagucacauccugacacaacucuuguccuggugugcuagaguacucgaagag

SEQ ID NO: 4994 - RNA, 108 nt, Homo sapiens
cucugcucugcaaccucuccaaggagcugaucgagagagccgucuugaaguaacuuggaaauagcuuagaguuugggucagcucuauagagaggaugaacagaaagag

SEQ ID NO: 4995 - RNA, 60 nt, Homo sapiens
gagcgcugcggggccuccacaaauaaaaacaaauacacugaggauggcccuccaaagcuc

SEQ ID NO: 4996 - RNA, 94 nt, Homo sapiens
uccugccucccacucuuacuccugcugucacugcaguucccuccuccuuggcagagcaugcagugacagcaguugggcuuugggagagaaagga

SEQ ID NO: 4997 - RNA, 65 nt, Homo sapiens
uacugcagcagggagaaggaaguggaauauuucugguugauguggcacuucucuccuuguaagua

SEQ ID NO: 4998 - RNA, 80 nt, Homo sapiens
cugggcaucuuguucugacaaucucuuuggcagugacccaaggacaguguucagaggguuugggaagagcaagacaccag

SEQ ID NO: 4999 - RNA, 72 nt, Homo sapiens
gccagcauugugccaggaagagccugcaugguuaacaaagcaauuaguagccuuucucugaugcacaguggc

SEQ ID NO: 5000 - RNA, 68 nt, Homo sapiens
agcugcaguucgccaggcgcguucccggagugggugugggauccgggacgcccuuggggagcagagcu

SEQ ID NO: 5001 - RNA, 75 nt, Homo sapiens
gagagccagggaggagugaguuguccaugcuagguccagaugcucauguggaccgcagcucucuccuuccuucuc

SEQ ID NO: 5002 - RNA, 65 nt, Homo sapiens
uccagccauuucucuucugucagagcucuaaugagguuuuagugccaggagggaaaguaaaugga

SEQ ID NO: 5003 - RNA, 83 nt, Homo sapiens
agaugccuucuuuccagcaggaauuacucugacagcggggcuggugucaucaagaguaauuucugcugaaaagguuccaaucu

SEQ ID NO: 5004 - RNA, 73 nt, Homo sapiens
gugcgcuaggagcaugugugggggugugguacagagaacucucuuuccaccagcucauacaguucuaaagcac

SEQ ID NO: 5005 - RNA, 122 nt, Homo sapiens
ggccgcuaugugggugguauauggugggcuguuggguggagcggggcgggucguuacugaucuaucuggaauacccgcuuuaucucuacccagcaaacugcuacccauccaagacccaggcc

SEQ ID NO: 5006 - RNA, 122 nt, Homo sapiens
gguggcucccgcuggcucccccaccacuccuggugauguucuccccacgacugucuuauaauaggaccuguggcaguccuggggaaacaccaaaaugacgguggggagcuuuguggaacauc

SEQ ID NO: 5007 - RNA, 89 nt, Homo sapiens
ggucgcugggcugggauggaaaguguguuccguugggauuguacaacuguuauuauucaauuacacucuuuucuuccuaguuaaagacc

SEQ ID NO: 5008 - RNA, 71 nt, Homo sapiens
cucugggguuccaacaauuuucccguuuccccugacaauuccaguugcaugguaaauuguuggaacuggag

SEQ ID NO: 5009 - RNA, 123 nt, Homo sapiens
gcaggguuuauuccacaucuggccaaaauuguuaacugcacauuuuaugcaauucauuugaguugcauuuagaauguguguaauaauucuagcuagugacuguauuugugggaugagaacugu

SEQ ID NO: 5010 - RNA, 72 nt, Homo sapiens
ucuuggcaaaggauaaucucuggucacaucugauugaagucaguuguggccugggccgauuucuuugaggga

SEQ ID NO: 5011 - RNA, 67 nt, Homo sapiens
uccuggucccuucauccucagcccugacgccuggccccagccagcugagcagugaaggagaaaagga

SEQ ID NO: 5012 - RNA, 60 nt, Homo sapiens
cauugguccagaggggagauagguuccugugauuuuuccuucuucucuauagaauaaaug

SEQ ID NO: 5013 - RNA, 69 nt, Homo sapiens
guuugguuucaguaguuuagcccuaaggagugaggaauuuguuugguuagacauacugaagauaaaaac

SEQ ID NO: 5014 - RNA, 108 nt, Homo sapiens
ggaaggaauaugaauguggugccggcucuaccauggggccuugaggccucguccaagccauccagggaccuuaugaaaguggaacggaacucuuuucauguauauucc

SEQ ID NO: 5015 - RNA, 139 nt, Homo sapiens
ggcaggaagacauuggagccaggaggaggcaggaaagcugcugugguaagcucuacacuucaaugugcugguauguguggugggagacgcuggagcagugccaaagucauccaucugaccuuuaauguugugaaauguc

SEQ ID NO: 5016 - RNA, 74 nt, Homo sapiens
cccugguugguccuucugaagcuucuucauuuagguuuaccagucagugaggagcagagagggagcaugagggg

SEQ ID NO: 5017 - RNA, 147 nt, Homo sapiens
gucugucugucgggucuguccaccugccgcgccccccgggcugagguaggagguuguauaguugaggaggacacccaaggagaucacuauacggccuccuagcuuuccccaggcugcgcccugcacgggacggggcccggcggggac

SEQ ID NO: 5018 - RNA, 75 nt, Homo sapiens
gugggugggagauggggguggccgaggcuuggcugcuccuggcccugagcuucggagcccuauuuucuccuccgc

SEQ ID NO: 5019 - RNA, 82 nt, Homo sapiens
guuuguguuccaagguugaaucuagguaccugguggccagggccggggggugucuguauucaguuugugaggacuuuaaaau

SEQ ID NO: 5020 - RNA, 75 nt, Homo sapiens
gccuguaucccgcugggggucauccuaucucugaggucaagugucgugaaggguggccuccugaagugggaaggc

SEQ ID NO: 5021 - RNA, 70 nt, Homo sapiens
ugggguauaagugguccaggauuuguucuucauauguugucagaggcaacuccuggccacuguucaccca

SEQ ID NO: 5022 - RNA, 99 nt, Homo sapiens
uucugugaccccuuagaggaugacugauuucuuuugguguucagagucaauauaauuuucuagcaccaucugaaaucgguuauaaugauuggggaagag

SEQ ID NO: 5023 - RNA, 81 nt, Homo sapiens
uaagguuuugaauagugucccaguuugcagccuuggcugaauauaaucccuuggcugcaaacugggauacuauucaacuua

SEQ ID NO: 5024 - RNA, 90 nt, Homo sapiens
gcuuguuuugaguucauuguucagcagaugagcuuguucaagauuucacuuucagcaguucauuugauugaacuugggaccaauaaaagc

SEQ ID NO: 5025 - RNA, 84 nt, Homo sapiens
ucccguugcauggcccaaggaggaggaaagggaagugcccuggcugguggaggugcuucccuuuccuccccuuacuauggggga

SEQ ID NO: 5026 - RNA, 78 nt, Homo sapiens
gaguguuugcagaagugccgggaacaagaggugguggagcaaagcaucucuuuccugguuuccuucugcucugaacuc

SEQ ID NO: 5027 - RNA, 89 nt, Homo sapiens
acacucgcgcgcacacgcucacuccguguccgcgaccgucgucgccggcggaaagcgagccacgggagggagugugugcgcgcgugugu

SEQ ID NO: 5028 - RNA, 80 nt, Homo sapiens
uggcuuucuugccucauuucccuucuccuuuuggaaaauggccucacauuuaggaaaaggaaaaugagguaaggauguca

SEQ ID NO: 5029 - RNA, 75 nt, Homo sapiens
gaguucucauacuccaccuguaucuaaaaagagucccuccaacuucuuuuuagauagagguggaguaugagacuu

SEQ ID NO: 5030 - RNA, 85 nt, Homo sapiens
uuugucaguuaaugaccuguugggcuaauggccuucagcuuugccuuaggcacauaaguccuccaguaggucauuagcugccaga

SEQ ID NO: 5031 - RNA, 68 nt, Homo sapiens
cggcuccgggguucacgcucgggggucccggcucgagccucuacccggcccgcgugaacccugggccg

SEQ ID NO: 5032 - RNA, 69 nt, Homo sapiens
gcccuggaggcagaaauaggacuugugauucaccuucaguuuaaaagcgcuaauuucugccuucugggu

SEQ ID NO: 5033 - RNA, 110 nt, Homo sapiens
agcauaucaauaggaagcugggcagggucagaaauccugcugucagaacuacugguuuugugaagaugacuucaggauuucugaacuuguaaaacuuccuauugguugcu

SEQ ID NO: 5034 - RNA, 74 nt, Homo sapiens
caggugcagugcugggggagguugugggugaagagacuaaagccugccucccaucccaccccagcacugccuug

SEQ ID NO: 5035 - RNA, 71 nt, Homo sapiens
gagauggggugcggcucugaggggguagcacugaucagccacaugcccuucagcaagucgcauccccucuc

SEQ ID NO: 5036 - RNA, 75 nt, Homo sapiens
ucaguuuuauaguuucccaacuaauuauucugcuuuuauguaauagaauaauuaguuuugaaacuauaaauuuga

SEQ ID NO: 5037 - RNA, 58 nt, Homo sapiens
uggaugccauugauaugucucagcucagucaugagccuggugauaucagugguuucca

SEQ ID NO: 5038 - RNA, 119 nt, Homo sapiens
acuguucuacuccuuggauaauauauucauaucccaaauauagguaacaggcuguacuaacuggcacacucuacagacuguuaccuaaauuugggauauuaaugaaggaguagaucagu

SEQ ID NO: 5039 - RNA, 68 nt, Homo sapiens
cggcuccgggguucacgcucggggguccuggcucgagccucuacccggcccgcgcgaacccugggccg

SEQ ID NO: 5040 - RNA, 67 nt, Homo sapiens
cauuuggauguguaaugauuauguuguugggaaaaaguaacucacaugguaaguauacaucccagug

SEQ ID NO: 5041 - RNA, 77 nt, Homo sapiens
ggggucaguaggaaccuagggucaaaaaaugggauacagucucccccuuuaugcaguugaucuuuucuugcugcccc

SEQ ID NO: 5042 - RNA, 68 nt, Homo sapiens
uucuuuuuccuuagggaccuguguuuggaguaugcuuaugagccagacagagaauuggggaagcagaa

SEQ ID NO: 5043 - RNA, 88 nt, Homo sapiens
ugggugagggggauaggccugcuuugguuuuggaggcaggggcuggauguccuguaguuuccaaaccacagaagccuccucuucccca

SEQ ID NO: 5044 - RNA, 86 nt, Homo sapiens
uacguuuaacuucucugguuguugcccacaucuguucaagguuuugcacaaacagaguuggacaacaaccaaggaaguuaacugua

SEQ ID NO: 5045 - RNA, 84 nt, Homo sapiens
aguaugcaggugagcuuccucguguggacccaacccagcccuuccacggaccaggcuccacaugagaggcuguaccuguuugcu

SEQ ID NO: 5046 - RNA, 153 nt, Homo sapiens
ccagugggagggaaaagggguggggaaaccuggcccagagaccugggagggagcugggagaguuuggaguguguucucucucuccuuugcuuucucuugcucucucuuucugggucagcaugcuaggccaccgaccauccccucucccccugg

SEQ ID NO: 5047 - RNA, 76 nt, Homo sapiens
ugaguggggguccuaccuccgugucccuaaaacaaucgcuucuuagugcguggcuacgauggugagaccccccucg

SEQ ID NO: 5048 - RNA, 86 nt, Homo sapiens
ggauugugcugugugggguggggagguggucugggcaccugagaggggucagggcugggacuccuccccacuggacggcaccaucc

SEQ ID NO: 5049 - RNA, 84 nt, Homo sapiens
gcucuuccucucuaauccuuugucccugggugagagugcuuucugaaugcaaugcacccgggcaaggauucugagagggugagc

SEQ ID NO: 5050 - RNA, 66 nt, Homo sapiens
gauuuguggagagcagcugccgcccccgccacaucaaggaggcgggcuccagcugacuucacaauc

SEQ ID NO: 5051 - RNA, 80 nt, Homo sapiens
ugaauaggccaauaagaaugccagcucccccaugaaacuuuccgacauugccaggcaguuggcuuucuucuggucuuuca

SEQ ID NO: 5052 - RNA, 92 nt, Homo sapiens
agggucagcuucugaaauggacauuucccugaaggccuguaccuguugauuuuggccuucaggaaaauguccauuuaaaccaagcugcuucu

SEQ ID NO: 5053 - RNA, 76 nt, Homo sapiens
gcccuggcugggauaucaucauauacuguaaguuugcgaugagacacuacaguauagaugauguacuaguccgggc

SEQ ID NO: 5054 - RNA, 85 nt, Homo sapiens
uggguggccaggaggguugaggauuggaacuuggaaccaaagucucugaaauaaaguucgaaucaaucauacccucugguuccca

SEQ ID NO: 5055 - RNA, 79 nt, Homo sapiens
gggauggggccugcugccuccucccucugcccagggaaggguucccagaugcgagggggaggaggugcggcuccuuccu

SEQ ID NO: 5056 - RNA, 146 nt, Homo sapiens
gucuugugagaggaaaggccaucagcagguauacagcaguucuguguauacaugcucuguguggacuuggguauuauucugcaccugcuuguguagugcacucuacucuguguaucugccuccucuguacacacuccucaccagau

SEQ ID NO: 5057 - RNA, 162 nt, Homo sapiens
ggagugaaauuuaggagggcagaacaaagcagucaaauccaagugaugagagcugucaauagaucugccaugggauaaaauuggcagguucugcuuggcucuagucacagguggaacauaauuugauggcuuuaucuauaccucuccugagcauuuuuuucc

SEQ ID NO: 5058 - RNA, 74 nt, Homo sapiens
agacuguggcauuugcuggauuuuauaauuggacaaauuuagguuacuguacaugccagcaaaagcuauuguuu

SEQ ID NO: 5059 - RNA, 81 nt, Homo sapiens
gauuuucccaacauuuuauggcaauuuguuucauuugccgcaggcccguaacgaugcaaauugccauaaagugggauaauc

SEQ ID NO: 5060 - RNA, 65 nt, Homo sapiens
gaauuaucuuccauugccaaguccucaaaacuucuaucaauagggaguuggcaggugagauguuc

SEQ ID NO: 5061 - RNA, 89 nt, Homo sapiens
ggguucuuugcuuccucgguggcggaggggccuggggccucucuccagcaccucugcccuuccgcagccaucgaguugaucaaagaccu

SEQ ID NO: 5062 - RNA, 112 nt, Homo sapiens
ucauuuuugacuacugucauccagcaggacucaguuggucauaaacuccagugacuggucgcuaggguccaugauccacuaagaccugguggacgauggcaaucgaauauga

SEQ ID NO: 5063 - RNA, 158 nt, Homo sapiens
ucucugggaagacacaggcccuucuggaggcugcaauaacugaguaagaccacugggguaccauuugguaaacugcagcuucagugcacucaauaguaccuuaguggccugaaagaguuaaugcagcaucuagugguacaugacuuaauuccuuggga

SEQ ID NO: 5064 - RNA, 102 nt, Homo sapiens
aggguagauggcugccuggagucggggacuugcaccugcagcggcaucugcacgacucaaagcaagggcaagcucugcuccguuggaggcugacgucucccu

SEQ ID NO: 5065 - RNA, 102 nt, Homo sapiens; identical to SEQ ID NO: 5064

SEQ ID NO: 5066 - RNA, 102 nt, Homo sapiens; identical to SEQ ID NO: 5064

SEQ ID NO: 5067 - RNA, 67 nt, Homo sapiens
uccuuagcacugucuacucuggauuucuaauaaagagaagggaaaucgagggugaacugugcuagga

SEQ ID NO: 5068 - RNA, 69 nt, Homo sapiens
uacuucucuuugguauaucuggcuagguuuugucaucaguucuugugcuggguaauucugagaguggua

SEQ ID NO: 5069 - RNA, 79 nt, Homo sapiens
ucuuucucuccucccugccauccuccccucuuucugagccaagcugcaucaucacggggugcagggagguagaguagga

SEQ ID NO: 5070 - RNA, 79 nt, Homo sapiens
gcccucccuccccacggcccugggcagggaaugucuuguucccgccgcucccuccccggggccagagggcagggcgggc

SEQ ID NO: 5071 - RNA, 116 nt, Homo sapiens
gacuucuggauuccagaagauagggggagccauuuuaagguuggaagcagaggacuggugugaucugaucuggccuuuaagaggaucuuccuggcugcugucgggaaaccagaguc

SEQ ID NO: 5072 - RNA, 58 nt, Homo sapiens
gacuuacacacucugcccugcuguugucaauaacaauaaagggguggagggugugguu

SEQ ID NO: 5073 - RNA, 67 nt, Homo sapiens
cccaugcuuauuuucgugucuuagaaaguguugcagaccugcgcugagacauggaguagagccuggg

SEQ ID NO: 5074 - RNA, 159 nt, Homo sapiens
gugaucaucgauguguuuuagcagugguccuuucuauaauggaguugggugggguuuucucugcauuugguguauuauauuuuacuaggcugacagggacuacaccuacaucaauaacuucacacaaaguagggccuuuuguaagcaugagaugcucac

SEQ ID NO: 5075 - RNA, 83 nt, Homo sapiens
aggcuggaguccaaugccuuccccaccagcugccuuugaccgccagugacccuggcagcugguggggaggguguccuccgccu

SEQ ID NO: 5076 - RNA, 69 nt, Homo sapiens
gggaucuuuuggggaaguuugggaucuggcagggcaucugcauaauccauagaaaucccugagaguccc

SEQ ID NO: 5077 - RNA, 107 nt, Homo sapiens
auccuaauugggcauuaaagacauguucauagaaguuacaguguggucaagauaucugcauauucuguagaauguucugugaacagucuagugacuuacauuuggau

SEQ ID NO: 5078 - RNA, 86 nt, Homo sapiens
uucaugggggacugggggguggcagcagguggaggacccccaccucacuagccgccucagcugccacaccuccacaccgcccugag

SEQ ID NO: 5079 - RNA, 134 nt, Homo sapiens
cuuauuugaucaaucccccuguaauuaauccaucaccuccuucagguucuucccuuucuucucugaaaaauauuagggaagaaccagagggagguaauggauuaguuaauugcagggggauuaguguaauuaag

SEQ ID NO: 5080 - RNA, 95 nt, Homo sapiens
acaguggaggauguggugaagagaggggccuuugugauuaccauaucagugagaguuguaaucaccccuuuuuuuauucuaucuuguuucucugu

SEQ ID NO: 5081 - RNA, 75 nt, Homo sapiens
guuguggcggguggagggguguggggcugugggcaguguggcccauccucccaccccugugcccugcagcccaac

SEQ ID NO: 5082 - RNA, 74 nt, Homo sapiens
agaaugagaguuuaauguuuuuaugcaguuuagcucagguagaauaaagugcaagaaaacauugaaccuuuucu

SEQ ID NO: 5083 - RNA, 74 nt, Homo sapiens; identical to SEQ ID NO: 5082

SEQ ID NO: 5084 - RNA, 118 nt, Homo sapiens
aguuugcaauucauuugaggauccuuuacauauggccugaaguauauguggcauuuaauugaaaaaccaccaaauaaaggcuuuugggccauguaaaggggccaugugggugccaacu

SEQ ID NO: 5085 - RNA, 106 nt, Homo sapiens
uguguagaaaccccuggaagcugccuggagcagggcaaggaggguugagcagcugguucacugcugcuccuggcccauguuuuagguguugugggggcaucuuaca

SEQ ID NO: 5086 - RNA, 70 nt, Homo sapiens
acgcuggcaugugagugaggagguuaagaguauggguucugaacucagcuccuccacuuacuagcugugu

SEQ ID NO: 5087 - RNA, 86 nt, Homo sapiens
ugcaugggauguauuagaagguguuacuagaauugucuuagauaaagcgauguuaucuaggcugguuccuguaacauuguccugca

SEQ ID NO: 5088 - RNA, 71 nt, Homo sapiens
acucuagacagggaggagaaguugaccaagcagcuaccucugucccccaggcuucuccuuccucuuugagu

SEQ ID NO: 5089 - RNA, 73 nt, Homo sapiens
gucauggacucuugcuuuucccugugcaagcaggaggcugugcaaguacaggguaggggccaggaauucugac

SEQ ID NO: 5090 - RNA, 84 nt, Homo sapiens
uccuuggccaccucaugcccaucccggccaucuagggucagcacaacccagaugaggccgcugaagggcaccggaugcccagga

SEQ ID NO: 5091 - RNA, 76 nt, Homo sapiens
cauuugcacuagggucagagccugagccaggaggcagaaauauugccacaacucuuggacucugacccuugcagug

SEQ ID NO: 5092 - RNA, 101 nt, Homo sapiens
aagguaagguaaaacaagagcccuuucaaacuagcagcaccucccuuagaaaaaaacugagguguugcuaguuugaaaagacucuuguuuuaacuucccuu

SEQ ID NO: 5093 - RNA, 80 nt, Homo sapiens
uggcugcugcagugacugagcguggggggugugugaucgaaggauacagacaguccccuuguuaucacucuggguugcua

SEQ ID NO: 5094 - RNA, 95 nt, Homo sapiens
uucauuaggcagugagcaguggguuuuauugggaaaggauuugucauguugaaagcuauccaaguauaaggccauuguuugcuuugacuauugaa

SEQ ID NO: 5095 - RNA, 75 nt, Homo sapiens
ccagucugggagacgggagacaggauauuuggaguaagcucaggauggccuguuuuuauucuguuuggcagcugg

SEQ ID NO: 5096 - RNA, 85 nt, Homo sapiens
aggauauguggggcagagagcaagaaguaucacccaucccugggacccagauacuauucuaugcuuuuuggaccccccguuuucu

SEQ ID NO: 5097 - RNA, 88 nt, Homo sapiens
ucucuguuucaccucccccaccccuuucuccuccaaguugggugccuccugcccugcugggugaggaggguggggauugcaaccgaga

SEQ ID NO: 5098 - RNA, 72 nt, Homo sapiens
gcccuaccuccggcccuugcgaccacacccauucucacugugaaucuccccgcuggggucggagcgucgggc

SEQ ID NO: 5099 - RNA, 106 nt, Homo sapiens
uggauguuggccuaguucuguguggaagacuagugauuuuguuguuuuuagauaacuaaaucgacaacaaaucacagucugccauauggcacaggccaugccucua

SEQ ID NO: 5100 - RNA, 70 nt, Homo sapiens
gagcugggcugacgggggagcagccugugggcccugaaacccucccugcucuccuugccagcaccugcuc

SEQ ID NO: 5101 - RNA, 87 nt, Homo sapiens
cucuuuccucagguggccaggugcauaucuuggugugaggaccuucacuguaucugggaaugccuacuggucaccucggugacagag

SEQ ID NO: 5102 - RNA, 96 nt, Homo sapiens
agauucccagcugcuuuaaaaaaugcuuugaguaaaugccagaagguacaaguggcauuuacucagaaaauauuuuuagagcagcugaugguguuu

SEQ ID NO: 5103 - RNA, 73 nt, Homo sapiens
ggcuugcagcacauagguuguuuggcaagugguaauuuauuauuauugccauuuagcuuuguguggguuaguc

SEQ ID NO: 5104 - RNA, 152 nt, Homo sapiens
guguugcaggcaaaauacaagagcuaacaugcacaugaguaacacaugcacaucaucagcugugucugcaacacaaagugccacaugucaggcacaguugauuaugugcauguguuuacucauuuaguccuuaccucaggccgaggucacac

SEQ ID NO: 5105 - RNA, 152 nt, Homo sapiens; identical to SEQ ID NO: 5104

SEQ ID NO: 5106 - RNA, 61 nt, Homo sapiens
uugcucccuccccuuuggguucagagaauagaauugagacaacaccaaaggggguggguaa

SEQ ID NO: 5107 - RNA, 76 nt, Homo sapiens
gcugucucuccaguugggauucuugguucugggguccucccgccccaaccaaggaugcccagcuggccaagucagc

SEQ ID NO: 5108 - RNA, 86 nt, Homo sapiens
agcaugcgaguaguuuguuauuauuuuucuuuuuuaggauugauucuacauaaccugagagagggaaaagcagaauuacuguugcu

SEQ ID NO: 5109 - RNA, 70 nt, Homo sapiens
guggucagugagucugggggcguguguguggguuuccguacuacauauccccggauuuucuaguguccac

SEQ ID NO: 5110 - RNA, 82 nt, Homo sapiens
gcaguccucuguuaguuuugcauaguugcacuacaagaagaauguaguugugcaaaucuaugcaaaacugaugguggccugc

SEQ ID NO: 5111 - RNA, 84 nt, Homo sapiens
guccuaguaguaccaaagugcucauagugcagguaguuuuggcaugacucuacuguaguaugggcacuuccaguacucuuggau

SEQ ID NO: 5112 - RNA, 109 nt, Homo sapiens
uagcuccuccuugaaauucgugcuugcauauuuaagguggggcucagaaaauaccuuuucuccuccugucccaccuggaagcugugaggcaaacauucugguggugcua

SEQ ID NO: 5113 - RNA, 102 nt, Homo sapiens
gugauuguuuguacagauggauuuacuuaggaugaaggauguucuuuuaaucccauuuggauagguuuuauccuauguauaucuaucuguaacauuauuugc

SEQ ID NO: 5114 - RNA, 70 nt, Homo sapiens
ggaauuuggugguugguauucuguuaacauuccucaucuaguuauaagucaugccagccaccagucuucc

SEQ ID NO: 5115 - RNA, 142 nt, Homo sapiens
gggcuccccgagaugggcacacuggggucaggcucugccagcauccugccguggcgcucucagucgugugcacuuacugagagccuauuguaggcacauggcaggcacucgggggcccucaggauguuccuuggggucgccu

SEQ ID NO: 5116 - RNA, 76 nt, Homo sapiens
caggugccuccuccacauggcugagguguggccaggcgguccucccacacccuggccuguggagccaggcucccug

SEQ ID NO: 5117 - RNA, 72 nt, Homo sapiens
uccuuaugaggauaaauagccgaagcacauugagguuaauauugcuuuuaagcuauuugucuccauuuggga

SEQ ID NO: 5118 - RNA, 101 nt, Homo sapiens
gcagugucccuggggcagacauagaggguggugaggcuccccuccugccuacuggcccagcuucauuucccucuuggcuucuauaccccagugacuucugu

SEQ ID NO: 5119 - RNA, 78 nt, Homo sapiens
cagguccuggggggcugggagaguaaaaggcagggucuccuguggauuccuuuugcugcccaggccucuugguuccug

SEQ ID NO: 5120 - RNA, 104 nt, Homo sapiens
uuagugcuagcaggucucccaauaugcagaugcugccuuguugagucaaagaacauuccaaguagaagcauuugcauucuggggacuagcuucuaugcuucuaa

SEQ ID NO: 5121 - RNA, 111 nt, Homo sapiens
ggggugguagugguggccaguaggagcagggcugggcagccucccuaacccacguucaugagacuugaagcuggcugguuuccuguccccuggccucccuugcccauuccc

SEQ ID NO: 5122 - RNA, 110 nt, Homo sapiens
gccaugggcguggaagcuggguacaucgucaucuaugauuuccaucuucuucccggugaaguugggguuuucauagaggaugaucuugugcucuuggcuguccuauuggc

SEQ ID NO: 5123 - RNA, 155 nt, Homo sapiens
guccuuggcacuaagucuuagguuccuugucacugaacagccuucuuuccacuuggcuucucuuggccagcauccuggcacaccaucagaggagaaaauaaugagaaagaagugucuuacagggauggggagcacugguggcuuaccauaugggc

SEQ ID NO: 5124 - RNA, 81 nt, Homo sapiens
ugggugugcucccagcaggggacguucuucaguguuuguuuguuaaugaugaauauuuccugccuuugggucacuucccca

SEQ ID NO: 5125 - RNA, 67 nt, Homo sapiens
acaguuuuacccaauaggcuuaaaugcuccaaaggagcaguuugagccucuuugguagauaaucugu

SEQ ID NO: 5126 - RNA, 153 nt, Homo sapiens
ggguuggggaguugggggaaggguggaggcagggcuguuuuuguuucuccuaagccaggaaguuguguggaugagucaagguugaauggagagcccuaggcaguguugucccgcccgcccugacucaccugucccccaaauccccugaugccc

SEQ ID NO: 5127 - RNA, 74 nt, Homo sapiens
gacuugcuccaaagagagcaacuggcuuauuguuauccaaauaagcugguguagcuccuuuagaguuuauaguu

SEQ ID NO: 5128 - RNA, 100 nt, Homo sapiens
gacuucccuuucuuucuccauucucuuccucacacugcagugucucaaagggugaaaaugucugugugugggagagggugguggugguagggcagugguc

SEQ ID NO: 5129 - RNA, 146 nt, Homo sapiens
ccccucucucccccuuucuccagcuccgugucauuuccuccuugcgcucgcucgcugccugagcgucuccagccgggagaguaggcggagcagggcggugcgggguggcguagagcuggagggcgaugguggcggagcugcugggg

SEQ ID NO: 5130 - RNA, 132 nt, Homo sapiens
cauuuauguuagagguuaacauuuguguuauuuccucuuauugccuggcuuuacagaauguuaugccccacugcuuuuauuaaauccagguaauagaggaaauaacaguguuauuaaccucuaacacugaug

SEQ ID NO: 5131 - RNA, 56 nt, Homo sapiens
cuuuuacugccuuuguuuuaccauucuugucuuagguaaggggaagguggggaaag

SEQ ID NO: 5132 - RNA, 65 nt, Homo sapiens
ugguuagguggguggucucugcaguuccccauuuaaacugggaacuaagaaaccagccacuacca

SEQ ID NO: 5133 - RNA, 67 nt, Homo sapiens
uuguuacuauuuggauguuagccucaguccauaaagggacuugcuacacaucaucaaacagcggcaa

SEQ ID NO: 5134 - RNA, 85 nt, Homo sapiens
aaucuaggaggcaggugcucacuuguccuccuccaugcuuggaaaaugcagggaggaggccauaguggcaacuguuaccaugauu

SEQ ID NO: 5135 - RNA, 82 nt, Homo sapiens
uugauagaagggucaauagaaucauuguagguccuugaacaaaggacggauuuaaugagaaauauugagcccuuugguucag

SEQ ID NO: 5136 - RNA, 76 nt, Homo sapiens
gacauaacugauugacuuuagugaugugccuugaaaguucaaauucaaggugugcacuuauuucagucagcuuguc

SEQ ID NO: 5137 - RNA, 56 nt, Homo sapiens
gagcuaaacuugaacugaacauuucuuuaccuugugaaauguucaguuaagugcuu

SEQ ID NO: 5138 - RNA, 101 nt, Homo sapiens
gcccuaacucaucuuucaaguuugaaauuuaaauguauguuucuuuguucugagugacugaaacauacacaugaagacaacuuugguggaugcaggugggc

SEQ ID NO: 5139 - RNA, 85 nt, Homo sapiens
gugguaacaauuuuaauuugggagcaugcugauaauaaaaagaugugugugcaugcaugcauccacaaguuaaaaaugaguucac

SEQ ID NO: 5140 - RNA, 83 nt, Homo sapiens
uacauaauuucuaccagggccauauuagcagugaaacauuuuaaacugcagaaauugugguuuugguucagaaacaaguugua

SEQ ID NO: 5141 - RNA, 80 nt, Homo sapiens
cccauaaucuucuuccccagcacaucucuccauuuuucauguuguuuuccggucauugaaaugggggugccugggguggg

SEQ ID NO: 5142 - RNA, 83 nt, Homo sapiens
gagguacaaggagcaugugcagugagaugggugccugccuuguaggcugugguacccugccucacugcauucuccacuuccuc

SEQ ID NO: 5143 - RNA, 119 nt, Homo sapiens
cguauacaaaccguaagagagucuuaaagauacaucaggguaggugggauacuauaacaacauuuagcauauuguuauacuauuccacccaccuuaaugaggauccuuuagguguugcg

SEQ ID NO: 5144 - RNA, 117 nt, Homo sapiens
uauguacccagagccaaaagugauuggaggugggugggguuaaugaauagacaaguguuaaaacuaaaagucaugccuaucucuccuuccuccucaguuuuggcuugauuuuucaug

SEQ ID NO: 5145 - RNA, 74 nt, Homo sapiens
cagauacuguaaacauccuacacucucagcuguggaaaguaagaaagcugggagaaggcuguuuacucuuucug

SEQ ID NO: 5146 - RNA, 64 nt, Homo sapiens
cauuuauuuucagcugggaaaucugcuauuaauucauauagugacuuucccagcugaaauaaug

SEQ ID NO: 5147 - RNA, 73 nt, Homo sapiens
gaacuaugggaugaaaagacaauugaaaaacagaccuaggcuauguuuccaaaugauuuuucauccccuguuc

SEQ ID NO: 5148 - RNA, 89 nt, Homo sapiens
caccuauuuuaagugguuuguucagugacuucuaucuugcauacacguguacagaaagcauaaguggaugaacaaaccaacuaauggug

SEQ ID NO: 5149 - RNA, 56 nt, Homo sapiens
cuuuuccucuccacuuccuguucacacaggggggggcgggaaguggagggaggaag

SEQ ID NO: 5150 - RNA, 74 nt, Homo sapiens
ugugucggguuaaugaacucuucuagggcacucaauagaaccagcgugccuuuaaaggacucauugaccucaca

SEQ ID NO: 5151 - RNA, 56 nt, Homo sapiens
ucucucaggcuuggaggggccauagauaccaacugccaccugccaggccucuggga

SEQ ID NO: 5152 - RNA, 155 nt, Homo sapiens
gaggucagaauuuugaggagaugaagagguuccagcagggauucuuaaauguuugugccauuuaucccucuaggcuuuaccgggcaacuagauggaugcaucacacaaaacauuuaagaaacccugauggauuguucuucaagaguucuagucuc

SEQ ID NO: 5153 - RNA, 65 nt, Homo sapiens
ugguucuugugaaacuggaaguaagggguggaguucacugaugacucccagguucauagcugcua

SEQ ID NO: 5154 - RNA, 82 nt, Homo sapiens
ugguucaugguuuuggcuggcccuagcauguguucaguaauuuguaaaggucauauguuggagugaguuggagccaucacca

SEQ ID NO: 5155 - RNA, 69 nt, Homo sapiens
aagcuccaagugugguguuuggcacauagcugguacacaaugaaugccauccaucaguauuugugguuu

SEQ ID NO: 5156 - RNA, 66 nt, Homo sapiens
uucaucucaucuaagugcuggcauaugaugugauuguuaacauagcuggccaccagaugaagugaa

SEQ ID NO: 5157 - RNA, 88 nt, Homo sapiens
agaauccucagggucucuuaggacuguucaagggcucauuugcugaggagccuuugaacagucaguccuaagagacgcugagacuucu

SEQ ID NO: 5158 - RNA, 81 nt, Homo sapiens
guuuuccaucaugaggccauuugaagugugagauuguuuuucugaaagaucaacacuuuaaaaaucuuucugaugacaaac

SEQ ID NO: 5159 - RNA, 65 nt, Homo sapiens
uccuuccugagcuaauuaagggucacuccgggaucuucagaguuuucuuugguggcuucagagga

SEQ ID NO: 5160 - RNA, 106 nt, Homo sapiens
gcaauccaggauguauuuuauagggcuauuaauauaugccucgaguggucaaaggcuuugccacucacuugaggcaaauaguaauggccaauaaaacuugccuugu

SEQ ID NO: 5161 - RNA, 77 nt, Homo sapiens
cggcucuucuucgagucuucucagagguuggagauucccugucuucuccaaccucugccaagucuucagagagguug

SEQ ID NO: 5162 - RNA, 96 nt, Homo sapiens
ugucuccaucugcuuucugugaaugcuggggcaauaggaugggcauggacuugaaauccuguuucucugccauuuacaguuaggugaaugugggca

SEQ ID NO: 5163 - RNA, 77 nt, Homo sapiens
cagcuccaggggacauggccccauggccaaggucucagauauggacccugagcuuggggcuauuucugcuguuguug

SEQ ID NO: 5164 - RNA, 67 nt, Homo sapiens
cuagucccugagacccuaacuugugagguauuuuaguaacaucacaagucaggcucuugggaccuag

SEQ ID NO: 5165 - RNA, 75 nt, Homo sapiens
gcccucgugggagggggcugcgcugcagcuccuccuuuuugggaguacugugcucaggcuccacccacuaugggc

SEQ ID NO: 5166 - RNA, 117 nt, Homo sapiens
cucaucaggauuuuaagauggugaaucuauagugcccggaaugugaugaugauuguggucauuguuccaggugcuguggauucacuauccugaaauccuuacaacaaccuuuuugag

SEQ ID NO: 5167 - RNA, 67 nt, Homo sapiens
ccuuucaauuugucuuucccaagguggcucuuuauuuaagagcuaucuugaaggaggaggaauaagg

SEQ ID NO: 5168 - RNA, 64 nt, Homo sapiens
gcccucauggagucucaggagaugagaugaagcugcucccuuuucuccugggguaccggugggc

SEQ ID NO: 5169 - RNA, 64 nt, Homo sapiens
accuucaaauugccaguguuuuaucucaauuuaacauuuuguuuauugacauuggcaauggggu

SEQ ID NO: 5170 - RNA, 160 nt, Homo sapiens
auacucaauauauggagaauauaugaaggaauaggucuuuuaugacauuucuuuuuaugagugagaagagaccuaauaaauuacuuuauuaaaucucuucucacaagugaagauaaaugucaucaagggcuuaaggucucauguauuacauauaauguau

SEQ ID NO: 5171 - RNA, 70 nt, Homo sapiens
ggaaucaucucccuucuuggagucuccguguccuccuugggaauguggagguuccuuaggagggaguucc

SEQ ID NO: 5172 - RNA, 83 nt, Homo sapiens
ccccucauagaaagcgaauuggcucuccccacguuggcucccauggaaaggacugaugggagagagagugaggagagcugggg

SEQ ID NO: 5173 - RNA, 63 nt, Homo sapiens
agccuccucuccugauaaccuaagugcucugauugaaaggcagaggguaucaggagaauggcu

SEQ ID NO: 5174 - RNA, 90 nt, Homo sapiens
ggguucccagggagccuggcuccacaggccaggguguggaaggaccgccuggccacaccucagccauguggaggcugcaccugcacaccc

SEQ ID NO: 5175 - RNA, 90 nt, Homo sapiens
ggguucccagggaaccuggcuccacaggccagggugugggaggaccgccuggccacaccucagccauguggaggcggcaccugcacaccc

SEQ ID NO: 5176 - RNA, 79 nt, Homo sapiens
ucacuccugcaugagggguagggaaaaggcacaggcuggcaugugaugccuuuucccuuucuccucacuagcaauguga

SEQ ID NO: 5177 - RNA, 107 nt, Homo sapiens
uguguccuuccagaauuugccagcccagggaggcccaggguuggaccagagucuggguccauccucccugggccucucuggccucacuguucugggcuucccucaca

SEQ ID NO: 5178 - RNA, 112 nt, Homo sapiens
guguuccuuuccuacuuauuacugcuaacgaaugcucugacuuuauugcacuacuguacuuuacagcuagcagugcaauaguauugucaaagcaucugaaagcaggaugcac

SEQ ID NO: 5179 - RNA, 69 nt, Homo sapiens
uggcucuuagcucccccuggcaggaccuccucagggugcugggucuguccugucuggguggggcugcca

SEQ ID NO: 5180 - RNA, 77 nt, Homo sapiens
guggucuugguggggaagucugagcggcaguuuucucugcuaucguaaagcucugccagccauucucccugccucac

SEQ ID NO: 5181 - RNA, 86 nt, Homo sapiens
gcucugguggagauauugcacauuacuaaguugcauguugucacggccucaaugcaauuuagugugugugauauuuucacaugagu

SEQ ID NO: 5182 - RNA, 132 nt, Homo sapiens
gagguggagggguuuuguuccaagucacagaggaaaugaauguuuuagaggccagaaagagcuccugaguucugugaagcauuccuggcucugggaccuucaguucuccuuugggccaaacuucucucccuc

SEQ ID NO: 5183 - RNA, 71 nt, Homo sapiens
auauugguuccaauauuucucacauauggaaaaugucauuuucccugggaauuaauauuuggaacuggugu

SEQ ID NO: 5184 - RNA, 101 nt, Homo sapiens
ggcgugucuccgccccgcccccuccaccgggcugaccggccugggauuccugccuucuaggccuaggcccggugagagacuccacacagcggagaacugcc

SEQ ID NO: 5185 - RNA, 101 nt, Homo sapiens; identical to SEQ ID NO: 5184

SEQ ID NO: 5186 - RNA, 61 nt, Homo sapiens
ugggugagcagcugcagcugagaggacuucaauuuucuccuuggcucaggcuguuuccuca

SEQ ID NO: 5187 - RNA, 134 nt, Homo sapiens
ggugugcucagaagaccacccugcaaguuucugccucuguggucacagcuucaugccgugggcguaaaggugggugugcagccagaggcaggaugugcaggcaagauccaaugugguuaaaauuugggaucacu

SEQ ID NO: 5188 - RNA, 56 nt, Homo sapiens
caguuggaugguuccugcccucugcagagcugcccccagggcagucacugucacug

SEQ ID NO: 5189 - RNA, 72 nt, Homo sapiens
gagguggcagauggaggagcauccagguuuuaggauagcuuauccucugaagcucuuccauuuugcucccuu

SEQ ID NO: 5190 - RNA, 105 nt, Homo sapiens
acugugagggggcagaaauccuguccgauacaggcaguggucugcaaaccuggucuguggggaccacuggcuuaugggacauucuaagauguuuccccuugcagu

SEQ ID NO: 5191 - RNA, 65 nt, Homo sapiens
augcugauugguuggauuucccagugcuuauuacgaaugcaucaggaagucuuaacaauuggcau

SEQ ID NO: 5192 - RNA, 90 nt, Homo sapiens
gcugugcauuggugcaugcaugugugccauggaagcacaugcucacgugugcauguguguucguggccauguguuuacacugugugcagc

SEQ ID NO: 5193 - RNA, 81 nt, Homo sapiens
agcauggucucauugauaauguuguggggauggaggaguugaauuggcccuccgucccuggcauuacaauuugauuuugcu

SEQ ID NO: 5194 - RNA, 98 nt, Homo sapiens
cuccugccaccuaccugggaacugaugcuccccagcaucuccugcaccucugcaaggcccuagcugcuggugggcacagugggugggugcgguggggg

SEQ ID NO: 5195 - RNA, 104 nt, Homo sapiens
cacuugguaguuaguucucucucccuucuuccaagagucuguggcugaagcgaguccagaucuggaagcugggagguucugcaggacuggcccuuggcugagug

SEQ ID NO: 5196 - RNA, 57 nt, Homo sapiens
cagcugggaaggcugggucaggcagggcaggcugcagcaggcccagcagccuggcug

SEQ ID NO: 5197 - RNA, 69 nt, Homo sapiens
cuccugcacuggauugucaguauuuaaggcugucuuacucaaaguauuugauaguccugccugugggag

SEQ ID NO: 5198 - RNA, 75 nt, Homo sapiens
ucccuggugagaagauuuuaaucugaggugcaguuccuaagaacugacaauuugggguaaauuuucaacauggga

SEQ ID NO: 5199 - RNA, 84 nt, Homo sapiens
auccugggucugugcucuuggccugcuguucagggaauagcaugaucuccaugcuggcauuuggcuggagccuuagccuggggu

SEQ ID NO: 5200 - RNA, 85 nt, Homo sapiens
gggguggauggagggggaggggaaagaugagggaaggcaaaggacuaugugggucuuuccccuccuccauuuccugcucugcccc

SEQ ID NO: 5201 - RNA, 130 nt, Homo sapiens
gagcugguuucucaucuuccccaugcuuucuguggagcugauccaagcacagagucuacuugaguacugaaauagccucugcacuuggaucuucuccaugaggguucaaaguaagaugaaacacugguuc

SEQ ID NO: 5202 - RNA, 55 nt, Homo sapiens
gguuuggggagcacucauagaagcagauagccuggaugaagugcuuccgacagcc

SEQ ID NO: 5203 - RNA, 78 nt, Homo sapiens
gagaugggguguugagcgagaaucuugccugggaguccagaaaccuggguuugaauucuuguucugcauccaccucuc

SEQ ID NO: 5204 - RNA, 111 nt, Homo sapiens
cuggugagcaccccugggacccgagcagcauccucaggagccagugccggagccaucuggcauccagcagugcucuagagcgugccuccugcggucucagcugccccccag

SEQ ID NO: 5205 - RNA, 97 nt, Homo sapiens
gcccugcaaagcuuuuaguuucccugucaguuuccccucugcugagcaggugauucagugagggcugaggccaggggagagaggagcagagaugggc

SEQ ID NO: 5206 - RNA, 90 nt, Homo sapiens
agguuggcuugucaaauuaugcugcagcauauuguacuggccugcugcuggcccgcaggcuuuucaauauguuuggcauggacaagaucu

SEQ ID NO: 5207 - RNA, 125 nt, Homo sapiens
gggguguaugaaggaagccugguuaguggggagagugggauuagggaacagcugcuuaaccuggcuuguuucaagucccccuuucucccuuuuugcccucaaaaaguuccccucauuuuuucccc

SEQ ID NO: 5208 - RNA, 81 nt, Homo sapiens
caccuguaagcaaccauaggcuugcucuaacaaugcucaucaaaauagugaagucuuugggaugugccuaugguuguggug

SEQ ID NO: 5209 - RNA, 66 nt, Homo sapiens
gacauuauuauuuuuccuacuuuacagaugaggaaacugauccacagagaggaagaauaguuuguc

SEQ ID NO: 5210 - RNA, 109 nt, Homo sapiens
acuuuuugccugcauguggcuuugagccugggaagaguugaggggagggaaugugcugaaguuuucccuuucuucuucagcccuggggagccacaggcaggugcugagu

SEQ ID NO: 5211 - RNA, 94 nt, Homo sapiens
augcuuauugaccuuaauaaucugcuccacugaggacccacaaggaagugaggagcguauuugagcagauggacuguugagagucaauuugcau

SEQ ID NO: 5212 - RNA, 75 nt, Homo sapiens
uugauugacuguagaggccuggauugaggaggccugugcuucugggccccuggcuaggcuuccacaguugcucaa

SEQ ID NO: 5213 - RNA, 69 nt, Homo sapiens
cuucuuuuuugccagguugugcuuucagguugaugcccgauucccuggagcacaccaguaaaauugaag

SEQ ID NO: 5214 - RNA, 104 nt, Homo sapiens
ggguuuaucucauagggaauugaugucgguguggcuuuuuauuuguugcuuugugaauggaggaacaaauuagagccuaucuuaucaguuuguuggagaugccc

SEQ ID NO: 5215 - RNA, 73 nt, Homo sapiens
cccguucccagcugguggaggcucagccaggcaggaccucccaccucugggcccccagccaccuggggguggg

SEQ ID NO: 5216 - RNA, 90 nt, Homo sapiens
guuuuugaugucgcagauacugcaucaggaacugauuggauaagaaucagucaccaucaguuccuaaugcauugccuucagcaucuaaac

SEQ ID NO: 5217 - RNA, 83 nt, Homo sapiens
agaguuccuguguuuaccaucuucugccuugucuagagugggauuucuguuucagaagcagaaguaggugagcucgggccucu

SEQ ID NO: 5218 - RNA, 68 nt, Homo sapiens
gugguuuuccuuucugacccuucucauugaaaccuugggagaaaaggggaagaaagccaggaugucac

SEQ ID NO: 5219 - RNA, 69 nt, Homo sapiens
acuguuguugaucagacagcacuucuuuaucucuuuaaguuuuaagugcuguuucugaugaaugccagu

SEQ ID NO: 5220 - RNA, 68 nt, Homo sapiens
ugcuuuaacgcucaaggaugccucugcuuuugauuguacaugggccugaagcauccuagguuuuggca

SEQ ID NO: 5221 - RNA, 120 nt, Homo sapiens
cugguugugaaauuuuagaagagguuaaguuuagaagaagcaaguuuccuuuguugcagguugcugaaaaggaaauuuaccucuucuaaacuuuaccuguucuaaaauuucagccuccag

SEQ ID NO: 5222 - RNA, 111 nt, Homo sapiens
ccaguucaguuucaccacuuauauuuucucuuucccaacuuacuuuacucugaauaguauagguaggaggagggaaguuggguagggugguugggggugggaguggguugg

SEQ ID NO: 5223 - RNA, 68 nt, Homo sapiens
gaccuuaguggucauuguuaaggucacacagccaucaccagaaugugaccugacaguggccucugguu

SEQ ID NO: 5224 - RNA, 65 nt, Homo sapiens
gcaguuggugaugguguuguauagggggguaauaauauaacucuaugccaacuauuguccccugc

SEQ ID NO: 5225 - RNA, 103 nt, Homo sapiens
guguuugaagagguaaguuauuaaugcagggaucaugguaucugguacacugcaagcccuugauacauguuccuugcuauuauucuucaucuuuuccucacac

SEQ ID NO: 5226 - RNA, 71 nt, Homo sapiens
ugaauucuggccaagggucaggccccuagcauacaacaugaguggccaauugacuuguggccaguucuuca

SEQ ID NO: 5227 - RNA, 73 nt, Homo sapiens
ggguuuucccugagggaagguagcaucuugccauuuucuuccugcacagcuuugccuucccagggauccaccc

SEQ ID NO: 5228 - RNA, 73 nt, Homo sapiens; identical to SEQ ID NO: 5227

SEQ ID NO: 5229 - RNA, 69 nt, Homo sapiens
uuccuucugcccccuccccaccucagcgcacacacaucccuguggugggagagcgguggggguacggaa

SEQ ID NO: 5230 - RNA, 63 nt, Homo sapiens
acauuuuuccugucuugcugacuucagagcuuuagggguacagcauuugcaggaauuguaugu

SEQ ID NO: 5231 - RNA, 72 nt, Homo sapiens
ccccuuacuguggucccacgucccuggccagugaguggccggugaccugggggaugggggcuauagaugggg

SEQ ID NO: 5232 - RNA, 68 nt, Homo sapiens
gauauuaauauguauugaguacuuuaguagguuccaauacuguacuaaaguacuuuacauauauuauc

SEQ ID NO: 5233 - RNA, 80 nt, Homo sapiens
uccuuuagcccuguucuccuuguuuuuccauucauauuuucaugucuaggaaggaaaacauggggaacagaggccuggga

SEQ ID NO: 5234 - RNA, 107 nt, Homo sapiens
agucuuaaucuuauuaaguuauauauaugaugucauuuaucucagaaaggcaaggcaaggcauuucugagauggaugacauguaucuaugacuuaauaggagugacu

SEQ ID NO: 5235 - RNA, 94 nt, Homo sapiens
uccuuucucucccaaagcccaacugcugucacugcaugcucugccaaggaggagggaacugcagugacagcaggaguaagagugggaggcagga

SEQ ID NO: 5236 - RNA, 93 nt, Homo sapiens
auuauucugaugaaaauccacaaugucuuugagcuucugguuguguaaugcugggguuuaaagucaccauuuguggguuuggcaucaauuaau

SEQ ID NO: 5237 - RNA, 80 nt, Homo sapiens
gccuuuccucuacuccacauccucccuaaaugcccucucucucuaccgagguuggggcaggauggugagaggagaugggc

SEQ ID NO: 5238 - RNA, 69 nt, Homo sapiens
cugcuucccucucuccacugaacacucauuuucugcacugugagcuuuuuguggcaggaaggucuguag

SEQ ID NO: 5239 - RNA, 86 nt, Homo sapiens
uggguucagggcauaucugaggucuuccgauuugcagcucagaauccccugagcugagaucugggcugccuuccccaugccuccca

SEQ ID NO: 5240 - RNA, 99 nt, Homo sapiens
ggcauucaaaagaagcagcuuaggaggugaaggucaguguucugguggccuccugacuuacuggcuuugcagcuugucuagucugcuucuugcauugcc

SEQ ID NO: 5241 - RNA, 91 nt, Homo sapiens
ggcuuucugccuaccacaaccauuuuagaccucucuugaccagcaaugggugguuuagaugagucuagaauggaugcaauagguuuuggcc

SEQ ID NO: 5242 - RNA, 110 nt, Homo sapiens
cagguucuaaauuacaaacuuacugauuucagcugcaaauaacacuaccuggcuacaaaaaaccaggcaguguuauuuguagcccaaaucaguagucugauauuuuccug

SEQ ID NO: 5243 - RNA, 80 nt, Homo sapiens
gccauugaaaggcaugaagacuuuuggugacaggaauagggaaacugagucaccaagggcuuugagugccuuuguuuggu

SEQ ID NO: 5244 - RNA, 82 nt, Homo sapiens
gagcuuguuguccucacaaccuugcuguuccugucaucuucucuccaggcgacaggaacagcaggguugugagggcuugcuu

SEQ ID NO: 5245 - RNA, 90 nt, Homo sapiens
cucauuucuuucuuauuggcucugugaguugaugacaucuuuaagaguauucaucaugucaacagcucacagaccaauaagaaaguuggg

SEQ ID NO: 5246 - RNA, 85 nt, Homo sapiens
uagauuuacggauguacugcagggagagcaaaggauuuuuaauuuuuuucuuccuuuauugcucuuauauugcaucuguucucug

SEQ ID NO: 5247 - RNA, 125 nt, Homo sapiens
acgguuuguuucagcaguagauggcuacaggugacgcagguauccagaaauccugcccuccaaaugaucaaagcaggccuaguccuggaugccugugacaucugaguguaucugaaaccaucugu

SEQ ID NO: 5248 - RNA, 88 nt, Homo sapiens
gggauuugggagcuuaucagaaucuccagggguacuuuauaauuucaaaaagucccccaggugugauucugauuugcuuccuuuuccu

SEQ ID NO: 5249 - RNA, 111 nt, Homo sapiens
ucaguuugauggaaugagcacuggaccaagagucagaagaacuagggacucagaucaccucucccuuugauuucuucugugaccuugggccaguuaggugaucaucucuga

SEQ ID NO: 5250 - RNA, 80 nt, Homo sapiens
auaguuuguggcugggccacuagcuuuaaacuugaaaugaaguguccaguuuugaguuacuguguccaaccaccauuugu

SEQ ID NO: 5251 - RNA, 81 nt, Homo sapiens
gagauuuugugacauuauguguggcauauuagguuguguaaguggauuauaaccuaggguaccaaaguagugugacaucuc

SEQ ID NO: 5252 - RNA, 141 nt, Homo sapiens
gugcuuucacucuucccagaguccucccucaccacgucaccacccccagaacagcuuuaagacacugaaugccagcgcuaagccuuuguccagaacuguucugggggugggcuuuggagagggugggucagggucaugcac

SEQ ID NO: 5253 - RNA, 96 nt, Homo sapiens
caauuuuuuuguaugucugagcgaagcccaggcauucagcgaaucauguaauuuauucugcagugccgagccugggcugucucagacaucauauug

SEQ ID NO: 5254 - RNA, 80 nt, Homo sapiens
ggccuuuuuauuugugggaggcagauuguugagucaaagaguacucuuuucucugaaauucacgcugucuuccccaggcc

SEQ ID NO: 5255 - RNA, 82 nt, Homo sapiens
cugggaggcggcagcagcaguggggaccccgagcuggccuucgagugccagucccucccugcagcugcugccgccuccucag

SEQ ID NO: 5256 - RNA, 101 nt, Homo sapiens
guaacacacgggggcgccaggacgugcgcggacgcgggcaaggcagcacaaggugguuuucguccgugugaguguguccgugggcgucuuugugugucugc

SEQ ID NO: 5257 - RNA, 87 nt, Homo sapiens
gcauauucaaauaugcagagaguaguaagugaaaguauacucuauuuguguuuuuaccuacuagucucuuguauauuugaauauugc

SEQ ID NO: 5258 - RNA, 81 nt, Homo sapiens
uucugucuagucuaacaccauaaccucagccugcuugcauugugcuaggagcugagguuaugauguuggacuagacaugga

SEQ ID NO: 5259 - RNA, 100 nt, Homo sapiens
uucuaguuauguaacuagaucugugauaccaucaauaccaagagauggcaucacaaaagauggauugaugcuuucacagauccaguuacauaacuaugga

SEQ ID NO: 5260 - RNA, 69 nt, Homo sapiens
gccucuuuguccaucagaaugugggggaagcuacagcuacggaccaaacuauggauggacgaagacggc

SEQ ID NO: 5261 - RNA, 71 nt, Homo sapiens
ucuugcauggcguccggagcugucuccucucccuaagcacaaaggccagcuccagagaugcugugcagaga

SEQ ID NO: 5262 - RNA, 71 nt, Homo sapiens
gcuucuggucagggccccugaguuccacgacaccgucaccgguucggggaaguaguccuugaccaggcagc

SEQ ID NO: 5263 - RNA, 55 nt, Homo sapiens
cucccccucccccaggugccacuuaccccggaggcaggagugggggaggggagag

SEQ ID NO: 5264 - RNA, 81 nt, Homo sapiens
ugacuuauuuuuugugguccuaucuucuagccugaguguuaaccagguggacaggcagauuaggauuaggaaauaagauca

SEQ ID NO: 5265 - RNA, 79 nt, Homo sapiens
ggagggggcugaggcuuucagccaaguaguagguuguccccgaaagccaaacauuugguuuugaguucagcucccauuc

SEQ ID NO: 5266 - RNA, 88 nt, Homo sapiens
cuucuucuggaagcugguuucacaugguggcuuagauuuuuccaucuuuguaucuagcaccauuugaaaucaguguuuuaggaguaag

SEQ ID NO: 5267 - RNA, 73 nt, Homo sapiens
ggggccggagcagggaacgcggccagccgccugcaaucgcugcaucugcgcccgcuccugugcuccggcgucc

SEQ ID NO: 5268 - RNA, 56 nt, Homo sapiens
ggcgucgcuuggcuccucacucccaacaauggcagcuccgagacugagcggcggcu

SEQ ID NO: 5269 - RNA, 88 nt, Homo sapiens
ucucuuuuuuagagacguggauuguuuccuuuagagaggcccucugacugucaccaaaggagacaauccacgucccuaaaaaagaaga

SEQ ID NO: 5270 - RNA, 66 nt, Homo sapiens
gcuaggcugguuagauuuguggucuucuuccuccuguggaggacccuagagagagccagccugagc

SEQ ID NO: 5271 - RNA, 74 nt, Homo sapiens
guugugugcauacagugggucuuuguguguuugaacucccaccacauaagggcaaacucgauaugcaugcuaac

SEQ ID NO: 5272 - RNA, 67 nt, Homo sapiens
agccugugguuuggaguuugaagacagcagagggcgugugucuguaagcacucaaaaccacagagcu

SEQ ID NO: 5273 - RNA, 83 nt, Homo sapiens
ucucauguguucuacaaaccuguaaaagguccuugcagcuucaacgagcuucccccguacagguuuuauugaacacauguagg

SEQ ID NO: 5274 - RNA, 72 nt, Homo sapiens
ucaggcugcaacuagagcuuaaacuuccuauaugauugguugaaguuucagucccuuaguuugcagcuguga

SEQ ID NO: 5275 - RNA, 81 nt, Homo sapiens
ucccagugccaagagcuaccuucacacagggcccaggagaaggcuggggucuagugugagcguagucuauggcacugagga

SEQ ID NO: 5276 - RNA, 62 nt, Homo sapiens
ggccucaaauguggagcacuauucugauguccaaguggaaagugcugcgacauuugagcguc

SEQ ID NO: 5277 - RNA, 73 nt, Homo sapiens
gaaguccccagaaaugaaaaugggaguguguguccaggcacaauugcuucucccagucuuccuggggauguuc

SEQ ID NO: 5278 - RNA, 73 nt, Homo sapiens
ugggggaggggcagccucagggaucuugaggggcauauccuaaggagcaggaugccugggucuccucccucca

SEQ ID NO: 5279 - RNA, 83 nt, Homo sapiens
acaaagcuuucuguacauaaaggaggcucuuugccaagauugguauuugcaaagagaauccuguguguccugagagcuuaugu

SEQ ID NO: 5280 - RNA, 65 nt, Homo sapiens
aggguauagaauuaacuugcacgaugauaauuuauauuuuaugcgaguuuuauuuuuauacaccu

SEQ ID NO: 5281 - RNA, 97 nt, Homo sapiens
aacuuugcacugaguguccucgcccuuccuuuagcuaauccuauacauuacagagaauuccuaggacagggcuggcgacaauucauguguaaauguu

SEQ ID NO: 5282 - RNA, 75 nt, Homo sapiens
caguucuuuaaugucuacaucagcagagaguaacugaugcccucucauucuugcuguguggaugugaagaaucug

SEQ ID NO: 5283 - RNA, 88 nt, Homo sapiens
acuaacacuuacuuuuguuugccucaacuucuuuugcgcuccgcgugaaagcgacagaaguuguggcaaacuucugaaaguguucagu

SEQ ID NO: 5284 - RNA, 159 nt, Homo sapiens
caccacagacaucagcggauguuacaaaucaggcuucuuuuuccccgugaaucagccuccuguaccacuccggccccucccuggugcaggagcagugcagugagcugauucaugcggagaaagauuggucuggccugccccgugaacggucugugugug

SEQ ID NO: 5285 - RNA, 101 nt, Homo sapiens
ggucccugcacuguagaagcaugauccagugggcucuccugaauggacuugguccaaaaagcugaagggaggggccacuggaugguguuaugcagggaacc

SEQ ID NO: 5286 - RNA, 64 nt, Homo sapiens
caaaguuggugaaugcaccugcugucagauuuuaguggaucucacggugugcaaucagcuguug

SEQ ID NO: 5287 - RNA, 92 nt, Homo sapiens
gcccagggguuaugggacaaggagagcacaaaaucaguccaguccaugugggacugaauuccaggcuuaguuuuuuuccauaccccuguggc

SEQ ID NO: 5288 - RNA, 68 nt, Homo sapiens
ggccagguguugggaagugccaggaagaggaggguggccaugccuggccauuuccugauaccugugcu

SEQ ID NO: 5289 - RNA, 71 nt, Homo sapiens
ucugccuuccagggaacuccuggagaguagagauuuacucuuccuuuccagagucaucugugagggcaaga

SEQ ID NO: 5290 - RNA, 77 nt, Homo sapiens
gagcuggagugcuggacgcggacgcucgccacagcaagggcugugguggccgcucugccuccacauccuccagacuu

SEQ ID NO: 5291 - RNA, 68 nt, Homo sapiens
gggcucaguguuuuuuauucuuauguggauuaucaaucugcagugaauugggagccaggcugagaccc

SEQ ID NO: 5292 - RNA, 68 nt, Homo sapiens; identical to SEQ ID NO: 5291

SEQ ID NO: 5293 - RNA, 74 nt, Homo sapiens
uguggucauccuggugggaaauuaucuccucugacaggcucagcgguggugguguccugucagaauggccuaca

SEQ ID NO: 5294 - RNA, 60 nt, Homo sapiens
agcuguaaacggcuucuuccucuggccacaacaggggaugggaacugccuuuuacaugcu

SEQ ID NO: 5295 - RNA, 56 nt, Homo sapiens
ggcucacagcagugcccaaccuuggucuugccauuguguuggcauccugugaugcc

SEQ ID NO: 5296 - RNA, 153 nt, Homo sapiens
gcugcuuuacaaacuucacggaaugcugugagagucuggcugggguugacagggcaggccugugcuugugggcccuggggccccaagcacagcugagguucugggaccaugugccaggguccuaagucagugaaguugacaacuagagugagc

SEQ ID NO: 5297 - RNA, 55 nt, Homo sapiens
uccccuccccugcccgugagcuggauuaauaguuaaugauggcucgggaggagga

SEQ ID NO: 5298 - RNA, 79 nt, Homo sapiens
ccgccaccacugcccugccgugcucacgcugcaugggggugcccucgcagcgggaguguguguuuguccugguggccgg

SEQ ID NO: 5299 - RNA, 70 nt, Homo sapiens
ugcaacauugccuaucuguuggaagaauggauuuuuagcauauuguccacacagauagaugauguuagca

SEQ ID NO: 5300 - RNA, 75 nt, Homo sapiens
agccaggcugggguggcacagucgggacguaacacagcuggguggaagccccugguguccaccaaagccugugcu

SEQ ID NO: 5301 - RNA, 71 nt, Homo sapiens
acccuguggggauuugucuaccucuuugucuugguucugagaagagggagggagagaaagacugcagaggu

SEQ ID NO: 5302 - RNA, 66 nt, Homo sapiens
gggaggaucucguuucaaaaggguuaacccacagccaaugggagccugggggagcggauccugcuc

SEQ ID NO: 5303 - RNA, 77 nt, Homo sapiens
cacuacaguuugugccaggauuuaauaagauaguguuugugaaaagcaccuuguucagaucuuacacacuguaugug

SEQ ID NO: 5304 - RNA, 70 nt, Homo sapiens
gcccucgggugcgggacagagguuggaaugggcuccuccuuuugacuuugagugugugugccugggaggu

SEQ ID NO: 5305 - RNA, 96 nt, Homo sapiens
cuggaacucuguucuugacagcaaagcagagccaaggcuucugcugccuaaugagaagaugcccugguucugccuuuugucuucuugaguucucag

SEQ ID NO: 5306 - RNA, 57 nt, Homo sapiens
gcacccucauuucucuauggagcgccggcugcuauaucccuagagucugggggcugc

SEQ ID NO: 5307 - RNA, 90 nt, Homo sapiens
gucuccugacucaauuuaauucuacaagcauuuauuuagcaccuacuaugugccagguacagugcuuagauuuugggaguacagggugac

SEQ ID NO: 5308 - RNA, 87 nt, Homo sapiens
uggggcagggcagcccggggccaucucggggguugaaucucggucuugcugccuccgagcguggcccugggcuggccucugccucca

SEQ ID NO: 5309 - RNA, 90 nt, Homo sapiens
gccaaggugaauuugauagucuuggcuguacagcguagugguuaaaagcaugccauuuggagccagacuguuuagguucaaaccuuaggu

SEQ ID NO: 5310 - RNA, 55 nt, Homo sapiens
aaccugagacccuggcagggugcccuucuccacugggugcuugccauucagaguu

SEQ ID NO: 5311 - RNA, 120 nt, Homo sapiens
ggcuaagccaauuucauugaugcauuuuuaaacauuauuaaacagguucagaaacaauguuuccaaaguugcauuugaaauuguuuaacaauguuuacaucagugaaauuaguuuaggcc

SEQ ID NO: 5312 - RNA, 61 nt, Homo sapiens
guggcuugcuugcauguaaccuagagauguguuugucucuauuacauacauucaagcucau

SEQ ID NO: 5313 - RNA, 81 nt, Homo sapiens
uggcugcacucaacauucauugcugucgguggguuugagucugaaucaacucacugaucaaugaaugcaaacugcggacca

SEQ ID NO: 5314 - RNA, 67 nt, Homo sapiens
ucuugugagaggggagacuuggcacugaugacucagguauuccaagucuucacuaaaaucacauaga

SEQ ID NO: 5315 - RNA, 92 nt, Homo sapiens
gaccuuucugucaacuccauuucccugccuccugcacugcgaggcuaccuucuugccuagggggccgggcagaagagagaacugagagcguu

SEQ ID NO: 5316 - RNA, 80 nt, Homo sapiens
gccccagauccaucuggaagccagauacucagugugugggcauaaaacugucuucuguuccaggugcugucucugguggc

SEQ ID NO: 5317 - RNA, 94 nt, Homo sapiens
gugcuguguguagugcuucacuucaagaagugccaugcaugugucuagaaauauguuuugcaccuuuuggagugaaauaaugcacaacagauac

SEQ ID NO: 5318 - RNA, 59 nt, Homo sapiens
agaggccucccucccagcugguugugcacgccccauucaguuggcugggauggccgucu

SEQ ID NO: 5319 - RNA, 96 nt, Homo sapiens
cagacgagggcagaggagagagagcgaggcuuugagagaaagagcaaguauuuuuggagucugauuucuccucugagccuaugaauauuuguacug

SEQ ID NO: 5320 - RNA, 91 nt, Homo sapiens
gauuuggagggcagggugagguggcaacauggucaugguguugucuugggauuuuuccacagccguguuccacugccuugucccuaauguc

SEQ ID NO: 5321 - RNA, 65 nt, Homo sapiens
cagaagaaggagcggcccuugugaccagugcccuuuugguucacaaggaacuucuccucuuguug

SEQ ID NO: 5322 - RNA, 65 nt, Homo sapiens; identical to SEQ ID NO: 5321

SEQ ID NO: 5323 - RNA, 65 nt, Homo sapiens; identical to SEQ ID NO: 5321

SEQ ID NO: 5324 - RNA, 65 nt, Homo sapiens; identical to SEQ ID NO: 5321

SEQ ID NO: 5325 - RNA, 65 nt, Homo sapiens; identical to SEQ ID NO: 5321

SEQ ID NO: 5326 - RNA, 94 nt, Homo sapiens
ccaagccauugagcgcugcauucccggcccccuggcgacggcccuggccacggccaucuccggggaggcaggaauguggcgggcggggcucugg

SEQ ID NO: 5327 - RNA, 107 nt, Homo sapiens
gaagucuaugaaagccaacauuuguggugagcagggaacgucaguuaaucacauauuagggaugauuccuuuguucauugugcaaaagugguuucuagcagacauuc

SEQ ID NO: 5328 - RNA, 69 nt, Homo sapiens
cuuguggaaaagcauuaagaucauuuuaccuuaaaaagaaggugaggugacuugaugacuaccacuaag

SEQ ID NO: 5329 - RNA, 56 nt, Homo sapiens
gugggcuacagcugcuuguggguugcuuagcaacuagaaguaguucugagccacac

SEQ ID NO: 5330 - RNA, 81 nt, Homo sapiens
uuucccucggaggaaaucguacugucauuuguuuuuauuuucaaaaugaaaacaaauggcacuauaauuccuaagggcaaa

SEQ ID NO: 5331 - RNA, 128 nt, Homo sapiens
gaggccugcagaagagacuccauguuugggguagguggaagggaauuuugagaaggggcagccuugggguauugaguucuccauuuccucccacccucccugggcccugggcuucuacugaggcucuu

SEQ ID NO: 5332 - RNA, 57 nt, Homo sapiens
guguccauaauagcauagagugaacuauaugucacuaauugugcuguucugggucau

SEQ ID NO: 5333 - RNA, 65 nt, Homo sapiens
uagggccugcuggugcuuccauugagacacccacucucgcaacaggaaggaccagcuggccucug

SEQ ID NO: 5334 - RNA, 70 nt, Homo sapiens
agugagcugagagggcccugagaguuggggcagacgagccuccauuuccagagggucccucugcucugcu

SEQ ID NO: 5335 - RNA, 111 nt, Homo sapiens
ugggacguaggacagacauguuuugacagggcaaggggcccagcaggugauccuaaauuuuaacuguucagccucuuuccuugccagucccuaaugcugccuuugucucca

SEQ ID NO: 5336 - RNA, 65 nt, Homo sapiens
uagggccuccuggugcuuccguugagacacccacucucacaacaggaaggaccagcuggccucug

SEQ ID NO: 5337 - RNA, 80 nt, Homo sapiens
uuggaaauguguaaagcuuuucuuuguucagugagucuuuucauuauuuaaaauagagagcagcuuugcgguuuucucaa

SEQ ID NO: 5338 - RNA, 68 nt, Homo sapiens
ccacuuuugccucuagguguauugcaaauuuagaugucuucuauguaauaccuguaggugaaagaugg

SEQ ID NO: 5339 - RNA, 79 nt, Homo sapiens
uacccuguuuuucaguuccaucucugcucuguccuauagcuuuauaaaaccagaguguguggggcugaggucaggagua

SEQ ID NO: 5340 - RNA, 70 nt, Homo sapiens
gguuuaccaggauugccaccugcccaagagaauguuauggggauccagguggccaaaucuggauaauacc

SEQ ID NO: 5341 - RNA, 56 nt, Homo sapiens
gaggagaaguccugcuuacuuccuguuagaagggagguaacaggguuuucucucuc

SEQ ID NO: 5342 - RNA, 74 nt, Homo sapiens
cucccaaagguuuucaugucucucuucuccucaaacaacuguuggaagagacaaacaugaaaaccucuggagag

SEQ ID NO: 5343 - RNA, 88 nt, Homo sapiens
gacguuacugcccucuugcgugccccggccacccccggguggcuuguagccggugcgcgggguggcuggggcuacgugcagagcuguc

SEQ ID NO: 5344 - RNA, 69 nt, Homo sapiens
gaaaagaagcacggcuccggggacuggcgccugcuuggagaccugcuccccgaagccgugcgcuucuuc

SEQ ID NO: 5345 - RNA, 114 nt, Homo sapiens
agaacaaacugaauauaucagaucucugugaaagggagugugauacuagaauauaauugugaccucuugucuucuccuuuucucuugaguucugagaugacuucggcugucucu

SEQ ID NO: 5346 - RNA, 64 nt, Homo sapiens
ucuccaauaggugguucuaggcuuacuauuauuauuauuuuaagccuaaaacuuccuugguaga

SEQ ID NO: 5347 - RNA, 80 nt, Homo sapiens
ggaccucagaggaugccccaagacccuuccuggauuucugacucuccucccaugucuuggugccuucucucuuaggaucc

SEQ ID NO: 5348 - RNA, 80 nt, Homo sapiens
ccaccccgccccugcuggcucaguccucugccccuugagguugaccucuuuagggugggcuggcauggggcaugggaugg

SEQ ID NO: 5349 - RNA, 78 nt, Homo sapiens
ccucaugacugcagccaguuuaaauaugccaucuauccuucuaacuuugguuuuaaacuggcauugcagugaugcagg

SEQ ID NO: 5350 - RNA, 87 nt, Homo sapiens
ccuccuggauaaugaggccuccagagaccaguggaggucugaaccucauuaugguucucucgguaggccagcaucaauaaaggcagg

SEQ ID NO: 5351 - RNA, 85 nt, Homo sapiens
ggccuggggguuuucuggucccuguuugguucaacuugcaaaauggggcuguuggacuagacaacuuaucagaaggcauagugcu

SEQ ID NO: 5352 - RNA, 125 nt, Homo sapiens
cccccggugcaccacauguuagcuggaugucugcuccaggacaggggccccaggcagaggguaccccaaagaaacaugggccccagccccuggggacagacagaaugacagggugagguggaggg

SEQ ID NO: 5353 - RNA, 124 nt, Homo sapiens
gagagcugcagcccucuugucuggcugaucaggaagcuacugccagcagccugcagcccugggggcgcacaggucugcugcagagcauggcuuuccucggcccagacggcuguuccugcuccuc

SEQ ID NO: 5354 - RNA, 90 nt, Homo sapiens
gcccuuuggggugagguaguagguuguauaguuuggggcucugcccugcuaugggauaacuauacaaucuacugucuuuccugaaguggc

SEQ ID NO: 5355 - RNA, 135 nt, Homo sapiens
gcugaaugaauggcuguauuauuaucaagguaauucaaaacaaauuucaagcugugacaauaaaaugguucuuguaguagguugggguuugugcugaaauugccaguuggaaugagaacaguuauguuuucaagc

SEQ ID NO: 5356 - RNA, 81 nt, Homo sapiens
uaggcugcucucaaggaacuccagacuguuggugccccaaguccucaccaacaguuaggaguucccugagagcaggcgcug

SEQ ID NO: 5357 - RNA, 83 nt, Homo sapiens
gccuccccuuccaggucauuaccugcggccgcggaggcaacagcugccaccauggccugaugagugaucuggugggcgacggc

SEQ ID NO: 5358 - RNA, 66 nt, Homo sapiens
ggaccacaauacagugggaggcacaggucugaaaggcucugcgccucccaucugaggugcggaucc

SEQ ID NO: 5359 - RNA, 66 nt, Homo sapiens
ggaccacgauacagugggaggcacaggucugaaaggcucugugcuuccccucugaggugcggaucc

SEQ ID NO: 5360 - RNA, 80 nt, Homo sapiens
ugccuauggugagccccugccuaccucaucagcucaugacaguccuggcuguggggagcagggguucugaacacagagca

SEQ ID NO: 5361 - RNA, 61 nt, Homo sapiens
cugggagcugggaccucacccaugggucccccauggggugggaguccguagucaaccacag

SEQ ID NO: 5362 - RNA, 73 nt, Homo sapiens
gagguagaaauguggugguugggggguagagguaucccccuguuauccccccaucuuucccauuuacacacuc

SEQ ID NO: 5363 - RNA, 74 nt, Homo sapiens
caugaaggcuucaggcucccugaggaaggugacuagugggaaacuaguauccacaggggucugugcucucaaug

SEQ ID NO: 5364 - RNA, 94 nt, Homo sapiens
ugacuccuccaggucuuggaguaggucauuggguggauccucuauuuccuuacgugggccacuggauggcuccuccaugucuuggaguagauca

SEQ ID NO: 5365 - RNA, 102 nt, Homo sapiens
cuccaguguaucuugugggucuagugcauuuuguuuucuggaagaauugccuacugauggggaugccaaacaaagugccgacccacugagaaauagugugag

SEQ ID NO: 5366 - RNA, 77 nt, Homo sapiens
ugcgcgaggcugcacuggcuaaaggcugggugccauugucuuucagcaaauagccuugguuugugcaccuggcugca

SEQ ID NO: 5367 - RNA, 82 nt, Homo sapiens
gcccuguccccacaccuccugcuccccgacagccucagccagcuggaggaguuuggccggcagaggaaguggcacaagaggc

SEQ ID NO: 5368 - RNA, 86 nt, Homo sapiens
guuacuucaggccaucugggcguauaagugcaagucacaggggaugugauggcuuggcuugggcucagaggccugacgauguuggc

SEQ ID NO: 5369 - RNA, 75 nt, Homo sapiens
ggaagugggagggauagacaugauuuggaagcucuuguuggcuuuauuuuuugucuguaaauccuucuguucucc

SEQ ID NO: 5370 - RNA, 90 nt, Homo sapiens
gugaguguuucuuuggcagugucuuagcugguuguugugagcaauaguaaggaagcaaucagcaaguauacugcccuagaagugcugcac

SEQ ID NO: 5371 - RNA, 87 nt, Homo sapiens
ccagauuuggcuucuauguaagaaaauagucaaccacaagugauuacaaugguugacuguuuucuuacauaguagccaaaucagugg

SEQ ID NO: 5372 - RNA, 55 nt, Homo sapiens
ccacagagagagaaguaagugagagagagauuucacuugcuugcuuucugcuugg

SEQ ID NO: 5373 - RNA, 78 nt, Homo sapiens
ggccucccccagggagucaugaguuggcaaccccagcagaggggaagcuggcaugaagcuccuguguggggagaugcc

SEQ ID NO: 5374 - RNA, 92 nt, Homo sapiens
cuacagggucuugcucuggguuuuaaaaaugaauagcucuaaaaagauaaagcaacaaucaacucuuuaaaacccagauuugcccugcuugg

SEQ ID NO: 5375 - RNA, 93 nt, Homo sapiens
ugggaaaaguacauacuguuauauuccggcacaucagaauuuuccagggaugugccugguaucuuggaguaaagccaaugugauuuucugcca

SEQ ID NO: 5376 - RNA, 106 nt, Homo sapiens
gggaggugaaggaaggguuuggguucaguaaggggauguugucauucuggaaaguuccaagauuugcucuccuuccucugcccaagcuauauaaauaaccuggccc

SEQ ID NO: 5377 - RNA, 84 nt, Homo sapiens
aguccaggggccgccucccuacuggccuuugcaugccugccuuaguggagcaugcccaggaggagggaggagcagcuggucacu

SEQ ID NO: 5378 - RNA, 84 nt, Homo sapiens
ggcccacagugaccuccaucucccucccucugccccccaccacaaccagggcggugggaguaaggggagugugcucuggaugcc

SEQ ID NO: 5379 - RNA, 179 nt, Homo sapiens
gaggaugacuaucacaugcuuaguacauauacuaugucagguauugugcugauauuauaugcacaugaauuuuguucaucugcauguaauauugaauauugaaucuaguucauguguauauaauauuagcauaaugccugacauaauguauguacuaagcauaugacagugauuaacuc

SEQ ID NO: 5380 - RNA, 142 nt, Homo sapiens
cuucugcagcuggcaccucaucccccgcugcacuaaaucgacacuucuggaaguagcagcuucggagugacugacgagagccauugcuugcccaagugucaauuuagugcagcaggggauggaguagcagcugcagcaaaag

SEQ ID NO: 5381 - RNA, 70 nt, Homo sapiens
gcugaggagaacaaggccauggucuguugucaaaaaacgcacacccgugcgcuuugcuuuccuuccaagc

SEQ ID NO: 5382 - RNA, 70 nt, Homo sapiens
gcuagguagaagaaauuagcauaaauuagaauaaaacagucugauuuugcugaucucuuugccucuaagc

SEQ ID NO: 5383 - RNA, 83 nt, Homo sapiens
ccugaaucuaaagacaacauuucugcacacacaccagacuauggaagccaguguguggaaaugcuucugcuagauucugaagg

SEQ ID NO: 5384 - RNA, 65 nt, Homo sapiens
gcggccacuguggagcugagggguugaaggggccacucuagauccccaggacacagggcacccgc

SEQ ID NO: 5385 - RNA, 84 nt, Homo sapiens
ccaugucuaguccaacaucauaaccucagcuccuagcacaaugcaagcaggcugagguuaugguguuagacuagacagaaaugg

SEQ ID NO: 5386 - RNA, 84 nt, Homo sapiens
gcugcuggccgccgcccagcgcccccaccugggcgagcagcgccucaaagcugagggggccugggggcacggccagcgacaggc

SEQ ID NO: 5387 - RNA, 98 nt, Homo sapiens
gcuaccaccuccccagaguccagcugcucacaguccacucacauugcggugugaugugguggccgugaaggcuggcucucccuuuggugguuuggagc

SEQ ID NO: 5388 - RNA, 56 nt, Homo sapiens
ggggccaaguuucuuggaugagcugcagucaguuuuccaaggauaugguugauccc

SEQ ID NO: 5389 - RNA, 105 nt, Homo sapiens
gcaugcccaaggcaguggucaggaugcaucagacugucagcauuauguaagguaaaccugaagguucaugaugugauccugaugccugguuugggacacuauugc

SEQ ID NO: 5390 - RNA, 105 nt, Homo sapiens
gcuugacaagcugggaggagagcugucugucugccugucugucuuccaaguggaagcuugggguggagcaggcagguagaggcugccucacuugucagaauuagc

SEQ ID NO: 5391 - RNA, 120 nt, Homo sapiens
ccgggggcccagcugcucgcucagcacguccaggaagcggucaguaucgcggcuucgcacagggugggagaaggugaagagcuuccugcggcugggcgggcgggugggguccgggcuugg

SEQ ID NO: 5392 - RNA, 83 nt, Homo sapiens
uacagugguguagcuggcucugacgccaguguccuauguucauagcauaggucacuggggucagagccagcuguaccaccgug

SEQ ID NO: 5393 - RNA, 67 nt, Homo sapiens
aggacgggguguccuggcccagccugggugugaggcccauccgcggcucuccaggacaccccgcccu

SEQ ID NO: 5394 - RNA, 79 nt, Homo sapiens
gggagcugagggcugggucuuugcgggcgagaugagggugucggaucaacuggccuacaaagucccaguucucggcccc

SEQ ID NO: 5395 - RNA, 67 nt, Homo sapiens
uggaggaaaaguuauugucagcauguguuuuauuuuuuaauuuacacuguaguaugauuuuucccca

SEQ ID NO: 5396 - RNA, 89 nt, Homo sapiens
guuaaggggagacuaacccaucacagacacuggguuauugcaaguuauccagauccaguaucugugauggguuaaagucuccccuagau

SEQ ID NO: 5397 - RNA, 66 nt, Homo sapiens
gcgagugaggcaggaggauggaggagaaaccgcagcgccacauuccugcggccccugccuugccgc

SEQ ID NO: 5398 - RNA, 75 nt, Homo sapiens
gauauucucugugugcuaacucagucuuuacuagauccccagagggugaagaaggaauuggggcacagagaaauc

SEQ ID NO: 5399 - RNA, 125 nt, Homo sapiens
ugcaucucugcuuuucucuccauauuucuuuucuccacucgcuuccucucucccagcugcagggauucguccucuaaaagaguggaggugggagggaacaagaaauggaagcaaagcagggagca

SEQ ID NO: 5400 - RNA, 73 nt, Homo sapiens
uucaagggggcgggugcuugcugcaugcaggcuggggucugagauggauggagcuagucccugcccccuagga

SEQ ID NO: 5401 - RNA, 94 nt, Homo sapiens
cucacuugacaugagaaggcuggcauucuuuugaauaagcacgcuucuugcauauugcauucaaagcaaugccaggcuucccaugucaagagag

SEQ ID NO: 5402 - RNA, 67 nt, Homo sapiens
gguaugggaagagagugggagagaaacuuugggcuuugaaaaguuuucuuucaguucuuuccaaacu

SEQ ID NO: 5403 - RNA, 130 nt, Homo sapiens
uagagguaauaugcuuacuccacacacacuugaauuuucagaagauguggcuacauagagaaagaacaggguaguauaaccacaucuccugaaaacgcagauguguguggagguaaccauauuaccccua

SEQ ID NO: 5404 - RNA, 61 nt, Homo sapiens
uagauagcuagagccagauuucuggcauucaugccagaugccagaagaucuuuagcuacug

SEQ ID NO: 5405 - RNA, 77 nt, Homo sapiens
cugaacugacaaagucuuuccuuuaguuucugcuaggucagacuuggugcuaaauggaggagaguuugucaguauag

SEQ ID NO: 5406 - RNA, 123 nt, Homo sapiens
ucuaugaagcacaucauuuggaauuuggggaaugaugaagcagaaaccuugacaguacucucuagaagcgagauuucuacuuaaauauuguuuccccaguuuccagauucugugcuuuagaga

SEQ ID NO: 5407 - RNA, 76 nt, Homo sapiens
ccuaccccuccccucgcgcgcucgcggaccucgcuggagccggugccuuacacagcgaagcgcggggaggggcagg

SEQ ID NO: 5408 - RNA, 72 nt, Homo sapiens
gucauucacuuuguccccacccaaacucugaugagcuauuugggagugcgcggggacugggaagugagggac

SEQ ID NO: 5409 - RNA, 76 nt, Homo sapiens
gggaggggagggaggagguuggggugaaggaaaccaaccuacugcaccuccauccccaacccugccuuccccgccc

SEQ ID NO: 5410 - RNA, 106 nt, Homo sapiens
uucaucuguuguauggugcuucucuucucugccaaguggucugagagccuaaucguaucacuauuagcccacuugggagaggagagaagcacugcacaacagggaa

SEQ ID NO: 5411 - RNA, 55 nt, Homo sapiens
caaaaauagcaccauuugccucauuaauuuuaaugagguuguuguguuguuguug

SEQ ID NO: 5412 - RNA, 71 nt, Homo sapiens
gggaguuugcuggcuuguucacaggggaggggucagagauuaucucccuucuggaaaacucagcaaacccc

SEQ ID NO: 5413 - RNA, 73 nt, Homo sapiens
uucaucuuugucucuccauuaugauuccuuccuuccuuccuggacuagaggaaauaauggagggcagggagaa

SEQ ID NO: 5414 - RNA, 90 nt, Homo sapiens
gagagaaaggaaugggagggggagcuaaugggcauugcugagguuggcaugaaguuuugguggugccaggcuucugauuuuuuuuuccuc

SEQ ID NO: 5415 - RNA, 74 nt, Homo sapiens
gucauccucuuucuaggucggaacucucuuagaaugagacaaagaaaaauccgggccuggaauaagaggaagac

SEQ ID NO: 5416 - RNA, 78 nt, Homo sapiens
uaaaacaauugaauuagauguuguaguccuaauuucugggguuagaggacuacaauauguaaucuaauaguuguguua

SEQ ID NO: 5417 - RNA, 61 nt, Homo sapiens
ccaaccguguucgggaacacuugucagaacuacaauugacaaguguuuccaauauggcugg

SEQ ID NO: 5418 - RNA, 84 nt, Homo sapiens
gacacugggguugggcguggccgcaggggcccaggguuuucagccccuccauccuucccugcaaccccuuccugaccccagguc

SEQ ID NO: 5419 - RNA, 91 nt, Homo sapiens
cacacugucaaacccaggcugaggugaaggugugcagucacagcucacugcuggucaugcaccugcacuccagccagggugugacagagug

SEQ ID NO: 5420 - RNA, 96 nt, Homo sapiens
cugagaacucaagaagacaaaaggcagaaccagggcaucuucucauuaggcagcagaagccuuggcucugcuuugcugucaagaacagaguuccag

SEQ ID NO: 5421 - RNA, 77 nt, Homo sapiens
gugagagggacugggacaggaaggauggagacaaccugucucugcuacucuccaccagccuguuccauuuucuccac

SEQ ID NO: 5422 - RNA, 84 nt, Homo sapiens
ugaaaguucacucgaagccuaucucuauuaauucagagcccggcucuccgaauuaaaaagagauaggcuucaaaugaacuguca

SEQ ID NO: 5423 - RNA, 84 nt, Homo sapiens; identical to SEQ ID NO: 5422

SEQ ID NO: 5424 - RNA, 96 nt, Homo sapiens
gcuacucaauguugguccucccucuccugcuucauccccaugguuuucuugaggaaagaagacagggucagcaggggaggguggaggguugagagu

SEQ ID NO: 5425 - RNA, 115 nt, Homo sapiens
ccuacugggugacuaauuacaaaggcugggcuggagcuucagaggcugcuuguuaaacacuucauuaagcggcacucugaaagcugccaccugcgcauucugggagcucagaggg

SEQ ID NO: 5426 - RNA, 76 nt, Homo sapiens
uucaauggucgaaaucaccaaacuagaaaauauaaaugccuuauauuuucuaguucaguggugcuagacuguagag

SEQ ID NO: 5427 - RNA, 63 nt, Homo sapiens
cagauggcaggccuaacugagguuggcagcaacugcuguuguccccagugucacugcuaccug

SEQ ID NO: 5428 - RNA, 72 nt, Homo sapiens
ccaaucagagggaagccuaggauuuuuguuuuauugcagagaauacagaaguucuuuuuuuucucugaaugg

SEQ ID NO: 5429 - RNA, 69 nt, Homo sapiens
ugaaaagaugguugaccauagaacaugcgcuaucucugugucguauguaauaugguccacaucuucuca

SEQ ID NO: 5430 - RNA, 91 nt, Homo sapiens
aagacuacauuauccuguuucuaauuccuuuucuuucuuccugcggaaauguaauugcagaagcugggagaagggauuggagugugggcuu

SEQ ID NO: 5431 - RNA, 55 nt, Homo sapiens
uguaucugugugcacuuugguguaugugcccauacauuugugugugcacggggca

SEQ ID NO: 5432 - RNA, 71 nt, Homo sapiens
gguaugguucugugguuguugucuguuugcgguuuuauugcugaauuaguaguaaccacaguaaucacacc

SEQ ID NO: 5433 - RNA, 63 nt, Homo sapiens
gugaguucccggaucuguuccauccaaacacuguggaagcaagagacggauccgcgggaccgc

SEQ ID NO: 5434 - RNA, 70 nt, Homo sapiens
gccagcagggcaggcugggaccccacugacuguccaugcaggcucuggggucccaccugcuccuguaggc

SEQ ID NO: 5435 - RNA, 88 nt, Homo sapiens
agaaacauaaagggaauaggagggaggagauggagaugcugcaguguuccauugguucucuuccuuguauucucuuuucugugucucu

SEQ ID NO: 5436 - RNA, 80 nt, Homo sapiens
gucauccccacugauucaaucucuugacgguguacccugacaaaagauuugccuagacuugauugaaucuaggggaagau

SEQ ID NO: 5437 - RNA, 70 nt, Homo sapiens
cucaugaggagcaggcugugugggccucagcacccuugggugcagagaccagcaaggccuggccucaggg

SEQ ID NO: 5438 - RNA, 68 nt, Homo sapiens
ugaacuuggagugagaagaccuggguucagauuccacauuuguuaucucagucaucucggccaaguca

SEQ ID NO: 5439 - RNA, 70 nt, Homo sapiens
gacaggagcagggcugcaggaggaggaguggacaggcccaccucccugccuccuccugcaggcuccaguc

SEQ ID NO: 5440 - RNA, 62 nt, Homo sapiens
cugacagccauguuuuagagaauuugaugacucuuuuaaacucuuuagaaagaggcugccag

SEQ ID NO: 5441 - RNA, 103 nt, Homo sapiens
agaaaaugucauucagcaguaaagcuccugcugucauaaacacuuagcuuucagggcucacuguuuauggaacaggaggaguuuauugccuuauacauugucu

SEQ ID NO: 5442 - RNA, 89 nt, Homo sapiens
ccuacuguugcugccccucuugccacccucuacucucaggguugucacacuuuccaaagaguugagggggcgggguggcggggcagagg

SEQ ID NO: 5443 - RNA, 89 nt, Homo sapiens
uccacccaggccacacuucuucuucccugucucuucccuuagacaaauggaggagacggacagcggagaaguggagggagcugggggga

SEQ ID NO: 5444 - RNA, 76 nt, Homo sapiens
gccagcccugagcccccgcgcccgggcagcgcugccaugcaaccagaggcgaggccggcgugggggugggggcggc

SEQ ID NO: 5445 - RNA, 65 nt, Homo sapiens
gucaucagggggauauaggagagaacuuccucaaggcaaguugacuucuacuauuuuccuggggc

SEQ ID NO: 5446 - RNA, 179 nt, Homo sapiens
gucaugaaguguaguuggugagaaggucacagauccugaaagguaaaaagaagugcaaagggaauaggagagagaagauggagaugcugcaggguuacaucgguucucuucccaguauucccuuucugugucccuaaucuuccagccucuguaaucuuggcaguucucuaccuucagau

SEQ ID NO: 5447 - RNA, 71 nt, Homo sapiens
gguaaaggaugguccagggaauccuaugugcuguuuucuuugcuaggauccucugagaacccuccuucacu

SEQ ID NO: 5448 - RNA, 114 nt, Homo sapiens
ccaaggaguuugguuuuguuuggguuuguucuagguauggucccagggaucccagaucaaaccaggccccugggccuauccuagaaccaaccuaagcucgcgcaucauuccugg

SEQ ID NO: 5449 - RNA, 58 nt, Homo sapiens
uuaaauuacuagguaccuagugaaagagccauuuuuucuuagguacccuguaaucuaa

SEQ ID NO: 5450 - RNA, 167 nt, Homo sapiens
agcaugaccaaguuuaaacacagggacaagggcgcuaaacauacuucacugcacaagacauccugcugcuguugcuccaggcucuugggaguugcuaggggugggcuugucuggaggaugaggggcacauuauaguguccuguccucugugggugcuugugucagcu

SEQ ID NO: 5451 - RNA, 116 nt, Homo sapiens
ugaaugcacuguggaucuuuguguguaagcagaauguuaauaagcuguguaucuuauguucuacggcaucaguuuauuaacgcuauguuuacacaugaagauccagaguugcauca

SEQ ID NO: 5452 - RNA, 105 nt, Homo sapiens
cccacgcacuguggaggugcgagagagguugcuccgugcggugcuauucgaggcagaugcagagagcgcccuggaguaagcucuccaauccuagagcugcgcggg

SEQ ID NO: 5453 - RNA, 135 nt, Homo sapiens
uugacagcagggcagccccuugauuucuuccgcagacugcaccuccagcggcuggugagcaaugagagccagaggcgccagcugguggggaagcugcagguccuuguggaggaggccuuugguugccagcugcaa

SEQ ID NO: 5454 - RNA, 96 nt, Homo sapiens
cccagcucagaaguccgcccacauucugcgguggagagaguugccaaaaccauucucugcaccuguaggaugaagucgcagguucacagagcaggg

SEQ ID NO: 5455 - RNA, 100 nt, Homo sapiens
uagaagaaaucaugugguuaggaagacugauaacauauauggagacuuggaauggccuacuguauaugcagugagucuuucuaucauguggcuucuacug

SEQ ID NO: 5456 - RNA, 68 nt, Homo sapiens
ggcauuccccuuuacccauggagcucacugcagugugcagcgauggcccaaggguggagaggaagguc

SEQ ID NO: 5457 - RNA, 73 nt, Homo sapiens
gagagaagcgggaauggaaggcagggaugaggacugguaacagacccucugccuccuuccuuccucuucccuc

SEQ ID NO: 5458 - RNA, 74 nt, Homo sapiens
cccacucacgugaagucucaugccccugaaagugccauucaccacuggccaggcucaugaggccacaugagggg

SEQ ID NO: 5459 - RNA, 74 nt, Homo sapiens; identical to SEQ ID NO: 5458

SEQ ID NO: 5460 - RNA, 109 nt, Homo sapiens
gggaggcacuggcaggccugcccgacacucuuucccuguugcacuacuauaggccgcugggaagcagugcaaugaugaaagggcaucggucagguccagccugcuaccc

SEQ ID NO: 5461 - RNA, 144 nt, Homo sapiens
gccacaugggcuucucaggagccucagucuccauaccuggaaaaugggaacaccaccaccuggcucagugggguccgagccaagcggugcuguucucauuguucagguguggaguggcaugggauaaagggaagcacaugaggu

SEQ ID NO: 5462 - RNA, 71 nt, Homo sapiens
cccaggccggccccuccgagccuccgcggggauacuacggccccgccgggacggagagggcgaggccgggg

SEQ ID NO: 5463 - RNA, 99 nt, Homo sapiens
ucuacuuugcccugguccugucugccauuagcccaguccaggccaucagcuucucuucccuggacuaggccaguggcaaacaggacuggaagaaaggga

SEQ ID NO: 5464 - RNA, 103 nt, Homo sapiens
gggauggauuuuaagcugguuucuccuauuucugucuuggccagggguaggaauuucccuugaguaagacaggaauagaggaaaccagcuuagacuccaaccc

SEQ ID NO: 5465 - RNA, 129 nt, Homo sapiens
gugagugcuuagcuuugaacuugcucauggaguuuagcucaauggguuauuuucaggacuugauucuuuuccugugcauuuuccauuugagucccauccaauuaugcagauucagugcugugcacccac

SEQ ID NO: 5466 - RNA, 80 nt, Homo sapiens
acuaaggguaggugugcguguuccccuggaucuacagacuccucuggagucacagggguugcggacacuuuucccucagu

SEQ ID NO: 5467 - RNA, 117 nt, Homo sapiens
gggaagcgacagagcugcagguaggacuaagguaugggggaugucaggcaggcccuuguucugcguggccauccugacucauguccccugcauuuuagccagcuuugucugcugccc

SEQ ID NO: 5468 - RNA, 65 nt, Homo sapiens
uucaguagugccgguguugucugggaaaagccagguuucccucagacaacauugggacauacgaa

SEQ ID NO: 5469 - RNA, 98 nt, Homo sapiens
gguacuucucagucuguggcacucagccuugagggcacuuucuggugccagaaugaaagugcugucauagcugagguccaaugacugaggcgagcacc

SEQ ID NO: 5470 - RNA, 69 nt, Homo sapiens
acuagcuacguuuuuuccucagcacuuucuguguagagaguaacugaggcccagagaagcgaaguaagu

SEQ ID NO: 5471 - RNA, 76 nt, Homo sapiens
cccaccaacuucccuagcucccaugucucccauuccuccaaauaaugaggaggcaaggaagagagggagguggggg

SEQ ID NO: 5472 - RNA, 112 nt, Homo sapiens
agcaaggacaugggaacauuuucggcuugaggcaguacuggcauuccaagaggcaguuccuggcucugucagugcuguucuucagcuggaagcucuguuucucugcuuagcu

SEQ ID NO: 5473 - RNA, 70 nt, Homo sapiens
ugaagauagagaauggaaagaggcagggaagacuaaaaaacucuuugcuucuuucuugucuuggaucuca

SEQ ID NO: 5474 - RNA, 78 nt, Homo sapiens
accauggaacauaguggacacaucccugcugucaacaugcucacaacuucaguaggaagaugguuugcuggccaaggu

SEQ ID NO: 5475 - RNA, 160 nt, Homo sapiens
ggcauuaauuaaguaauaacgaucaagguauggggcauuuccuggggauuaaugaccagcugggggaguugauagcccacagugcagccaagggccauuaaccccagcuggucaucaauuccugggcccuguguuauagucauuauugcuaucauaagcc

SEQ ID NO: 5476 - RNA, 96 nt, Homo sapiens
gugaaggcagaaauugcuaaacucuguagugcuaucaggggcacaugggcaucuuccuggaacuagcacuaccagaguguagcccucucccuacau

SEQ ID NO: 5477 - RNA, 84 nt, Homo sapiens
gucacugcccuuuuauccccggcacccgggcuguggggugacccugggugacagcucuggggccgggaugagaggaacagaggc

SEQ ID NO: 5478 - RNA, 66 nt, Homo sapiens
gugauguguuggugagacaaacugugucccauucuggaacauauuaaguuugucuccaggacacac

SEQ ID NO: 5479 - RNA, 88 nt, Homo sapiens
gcgagauuuucuguugugcuugaucuaaccaugugguugcgagguaugaguaaaacaugguuccgucaagcaccauggaacgucacgc

SEQ ID NO: 5480 - RNA, 72 nt, Homo sapiens
cccaucgucuucuccccucccucccagauuuuuuauaaacaaacuggcgaagggaaaggagggagugacggg

SEQ ID NO: 5481 - RNA, 119 nt, Homo sapiens
ggaagacucugcccacuucaaaucccugccuggggaaggacacaugggaauggggccgggggaaaaggcgggccaccucgggccuucgucaccugugucagcuccuagggauugucucc

SEQ ID NO: 5482 - RNA, 77 nt, Homo sapiens
gggagguuuugcuaucaagaaaucuaaugaggcuuaaagaaaacugauaauucauuagcauucuugaacgugccccc

SEQ ID NO: 5483 - RNA, 71 nt, Homo sapiens
gagacccugagauugaacaucagcaggcgagggggucccucuucccugcucuguucuggucucagaggcuu

SEQ ID NO: 5484 - RNA, 66 nt, Homo sapiens
cacagaugagagaauuggccuuagagagguuaaguaacuuuucuaaggccccucucuuagucagug

SEQ ID NO: 5485 - RNA, 66 nt, Homo sapiens
gggaugccggucugcagaguccuggagcugaaauuagccaccaggguaugcggauauggauaacuc

SEQ ID NO: 5486 - RNA, 65 nt, Homo sapiens
cucagccagaggcaaagcagccgcaucugcgcguaagaucacguuugcuuugcuccugagcagag

SEQ ID NO: 5487 - RNA, 56 nt, Homo sapiens
gcuagccugucugcuguguuuucaaaguagcaaagagugcacaguggaagagcagc

SEQ ID NO: 5488 - RNA, 85 nt, Homo sapiens
gcuacugacaagggugugaucugauuugaaggguuuauuucugguaaaucagcauucugucagguuaacucuuguccucagaagc

SEQ ID NO: 5489 - RNA, 81 nt, Homo sapiens
cuaaggaauuaauggcccgcugagguuaaugagucccuccucugggccaucaacucucccagcuggccauuaauccccuag

SEQ ID NO: 5490 - RNA, 73 nt, Homo sapiens
ugaagcacaggaaggacccaggccccagaccaucacccaccccagggcugggcccugggccacuccuggcuca

SEQ ID NO: 5491 - RNA, 125 nt, Homo sapiens
ggaaggaggccuaccgccagaggucugggguggugcguggagaacugacagucuagcuucucggauucgucggcuccguccaucuccccuucaucacuggacagucggcuggcgaggucaccucc

SEQ ID NO: 5492 - RNA, 81 nt, Homo sapiens
augacaaaugaugcagcugcucuuccucuauuggacacauguacaaaacaggaagagaggagcaguugcuacauaugccau

SEQ ID NO: 5493 - RNA, 88 nt, Homo sapiens
cugagcagggaucgaucuggccugguggugauucuccagaaacuccauuccucagggcugugaccaccaagccaggugaucaggccag

SEQ ID NO: 5494 - RNA, 88 nt, Homo sapiens; identical to SEQ ID NO: 5493

SEQ ID NO: 5495 - RNA, 72 nt, Homo sapiens
ugaagacacugguggaauuuuuuccauaugugguucauaaucacauguagaauugauuucccagucuccuca

SEQ ID NO: 5496 - RNA, 124 nt, Homo sapiens
ggaaugcaguuggcccuagacagaccuggagccagaagaugggguagagucaggcccccaggcugugugccuagccaucugccucugccucacuuugcagaccagcucugucugccacucgucu

SEQ ID NO: 5497 - RNA, 134 nt, Homo sapiens
uugaggcauuuuacuucuuaucccaggagagcugguguggauggggguuggggucucuuuaugaagagcaccuuccuccacccacaacuaguuucuuuuagcaccuucuugggaagagagaagcaauaccacaa

SEQ ID NO: 5498 - RNA, 73 nt, Homo sapiens
gggagccuggcuccacaggccaggguguggggggaccuccuggccacaccucagccauguggaggcagcaccc

SEQ ID NO: 5499 - RNA, 73 nt, Homo sapiens; identical to SEQ ID NO: 5498

SEQ ID NO: 5500 - RNA, 73 nt, Homo sapiens; identical to SEQ ID NO: 5498

SEQ ID NO: 5501 - RNA, 93 nt, Homo sapiens
ccuaagccugcucuagccuaauuuuagaucuggucugcuucaguuucacuccaagcagacuugaccuacaauuagccuagagcagaacuaagg

SEQ ID NO: 5502 - RNA, 96 nt, Homo sapiens
gacaugcuguccacaguguguuugauaagcugacaugggacagggauucuuuucacuguugugucaguuuaucaaacccauacuuggaugacaguc

SEQ ID NO: 5503 - RNA, 73 nt, Homo sapiens
gcaagccugucuuuggcauggucugagcuugggucugccccagcggugauuagaucauguuauggcuagcugc

SEQ ID NO: 5504 - RNA, 124 nt, Homo sapiens
ugcauugugcucacauucccuuaaauguuguuuccaaaggugcucagccucuagcccagcuggaaucuccgggaagaggcagagacaguuuggggaaaaagacacaggggaggagcgggaggca

SEQ ID NO: 5505 - RNA, 87 nt, Homo sapiens
ccaaggguuugggggaacauucaaccugucggugaguuugggcagcucaggcaaaccaucgaccguugaguggacccugaggccugg

SEQ ID NO: 5506 - RNA, 82 nt, Homo sapiens
gccaguguugagaggcggagacuugggcaauugcuggacgcugcccugggcauugcacuugucucggucugacagugccggc

SEQ ID NO: 5507 - RNA, 81 nt, Homo sapiens
uagacuguggaccucagagcuuggguuuucuuaauggaggaauuaucagggagaaaacuggagccugggguugcuaagcua

SEQ ID NO: 5508 - RNA, 99 nt, Homo sapiens
gucacuuagcuaggaauugauggagauggguuucacacuccuucagggaaacuccugaagcuaagcuuugagacccgcuucaucuucuagcuuagagau

SEQ ID NO: 5509 - RNA, 102 nt, Homo sapiens
ggaauaugagugaguguggagggaggaggggaaaugaaaggauauuauauauuuuuuuguaucugucauuucccugcuaucucccauaugacuucuuaaucc

SEQ ID NO: 5510 - RNA, 65 nt, Homo sapiens
ugaaacuuggcuuuuagcugcauggcauguuaaaguaccuccgauguggcuggaagcuuguauua

SEQ ID NO: 5511 - RNA, 108 nt, Homo sapiens
ggaaaguauaugagccuauaacuggcuuuuacagaugauuaaaugcucagguugaagccgaggcuuuugauaacugcuagagccauuuaugaccucauauacuacucc

SEQ ID NO: 5512 - RNA, 117 nt, Homo sapiens
cccaccagcuuucccuuccuuucucucccuuucacuuaacuagcccagccuaauagaggcagugaaggacaggcaggugaggggcagacaggacaaggaagguggaggcuggcaggg

SEQ ID NO: 5513 - RNA, 98 nt, Homo sapiens
ggcaaagagucacagugagaaugggaagggagagcccuuggcugugucacacacagggauccaguguccuuccuuuccauggaaguggcuuuugagcc

SEQ ID NO: 5514 - RNA, 101 nt, Homo sapiens
uggaaagacugcccagguuugaauuucaaugcuuccucuuaugaaugguauuaagcucacaagaggaagaacugaaauucaaaccagagcagucuugacca

SEQ ID NO: 5515 - RNA, 94 nt, Homo sapiens
gucaucuuuuucuguuccugaaucaucccuucugucuuuauugccccaaguggggaaggacagugagggaggaagggggcugagagagagaggc

SEQ ID NO: 5516 - RNA, 80 nt, Homo sapiens
gggaggauguuagacuugcguggaucaugacuugcugcccaggacggagcucguauucagugcaagucaacguccagccc

SEQ ID NO: 5517 - RNA, 178 nt, Homo sapiens
ugaauccuguggcucugugauggcuuuacaccauuuaauugucacagcagcccugugagguguuucuguuuuauagcugagaauacuggaaucagagagguucaggaauaucucauagggcuguugugacaguugaacgguguaaagcucucagcacagugucucuaauaggggcuca

SEQ ID NO: 5518 - RNA, 70 nt, Homo sapiens
uccauggccacauucugggucuaaggaucagcaaaacauuacuucugagauccagaggauggcuacagga

SEQ ID NO: 5519 - RNA, 119 nt, Homo sapiens
gacaucaucuuuucucuuuccaucccauucucuugccagcuucugccacuggguggggauucaggauaagguaggaguugggggugaaaaagggauggaaugaagugggcauggggguu

SEQ ID NO: 5520 - RNA, 89 nt, Homo sapiens
gggagugucugaugagaguacuagggguuucccuagcacugggaaaaagggaagggaggccccaaagaguucuauucagagcacggccc

SEQ ID NO: 5521 - RNA, 87 nt, Homo sapiens
cugaagcucucccuuuugggcuaagugcugauaguuucaguuggccuuagugugacuucagcacuuuccagaaggugaggcucccag

SEQ ID NO: 5522 - RNA, 78 nt, Homo sapiens
guuaccccaggaagcaaaguauuuggggggcaucauuaaacauuuugcccuauggucuuuuguuuucugggggcagac

SEQ ID NO: 5523 - RNA, 77 nt, Homo sapiens
ugcagucaggaauugauuuuggauaucaacucccuaguaugggauuagcauucagaaaucagauucuuggccaggcg

SEQ ID NO: 5524 - RNA, 74 nt, Homo sapiens
augaaagaugcgcucucgagcuauguguagcugaucuaagcacaccauuguucaaaagaucgcgucuugggcau

SEQ ID NO: 5525 - RNA, 74 nt, Homo sapiens; identical to SEQ ID NO: 5524

SEQ ID NO: 5526 - RNA, 74 nt, Homo sapiens; identical to SEQ ID NO: 5524

SEQ ID NO: 5527 - RNA, 74 nt, Homo sapiens; identical to SEQ ID NO: 5524

SEQ ID NO: 5528 - RNA, 74 nt, Homo sapiens
cuuaucucacacuggguuugagggucacuuagcaaagaguguguggcuccaccaaacucagggugggaguaaag

SEQ ID NO: 5529 - RNA, 95 nt, Homo sapiens
gucagguguggcuggaugugguggcugaggcagggggaugguccagggucugggcugaucuccuggcugcaggcuacucaggacaugcuguggac

SEQ ID NO: 5530 - RNA, 87 nt, Homo sapiens
ggcaaagaauucggcccugugaagaguuggguucggccugucucaggcccugcccacaucccaucacagggccguggacuugaagcc

SEQ ID NO: 5531 - RNA, 77 nt, Homo sapiens
gcaacuuuggggguuuguggauauguuguuauuggguagagaagccuaguaguguccauaaucucuagagauacugc

SEQ ID NO: 5532 - RNA, 79 nt, Homo sapiens
cugaccccaaaugcccuuggggcagccuucuuauuuuucuugaugauguugaugccccaggggguuuugggggcugcag

SEQ ID NO: 5533 - RNA, 79 nt, Homo sapiens; identical to SEQ ID NO: 5532

SEQ ID NO: 5534 - RNA, 113 nt, Homo sapiens
ggcauggggaugcuucagcagcugauguggugggggagaggugucaaugcccacagacaaggagggcccucuucccugcagccacggccagucugcagccuccccagaggguc

SEQ ID NO: 5535 - RNA, 63 nt, Homo sapiens
gucagccugcaauuagugaaauggaggcacacaugcugguuugcagauugugggugggaggac

SEQ ID NO: 5536 - RNA, 65 nt, Homo sapiens
gagaagccugguaauuuucagucaaguacuuggauuaagggcuuuaucgaaaauuacuaggccuc

SEQ ID NO: 5537 - RNA, 83 nt, Homo sapiens
cugaauuuuaucucugggucccaggccugaugguaccuucaaccuuuagcugccuuuugccugggucuagagauaagagccag

SEQ ID NO: 5538 - RNA, 56 nt, Homo sapiens
gggaaaagagagaauuuauagccccagggcccugugggcagauucuuucuuggcuc

SEQ ID NO: 5539 - RNA, 71 nt, Homo sapiens
cugaaauagguacuauucccauuuuguagacaaggaaacugagacuccaagaggugaaagugcuuaugcag

SEQ ID NO: 5540 - RNA, 80 nt, Homo sapiens
aggaaaggaaauuuguuuauucuugggaguaaauagccagacauucucuggcuauuccaggaguccaggguuuccuaccu

SEQ ID NO: 5541 - RNA, 93 nt, Homo sapiens
gguaacugcccucaaggagcuuacaaucuagcuggggguaaaugacuugcacaugaacacaacuagacugugagcuucuagagggcagggacc

SEQ ID NO: 5542 - RNA, 84 nt, Homo sapiens
uggaagcaaguaacuaaaggccaaaguuuucaggcuaaaaaacaacauugagaugagaacuuuggcuuuauuuacuugcaacca

SEQ ID NO: 5543 - RNA, 86 nt, Homo sapiens
aggaauuguaagcaucggucucuucugcacuuuuccgugagguugaaaagauggagauguugaaggacuggagcuuugcagagccu

SEQ ID NO: 5544 - RNA, 79 nt, Homo sapiens
uggaaggagagcagcggcauuugguuugguggugggcagauuuucuuuuacgacugcuaaaugccugccuuucucccca

SEQ ID NO: 5545 - RNA, 111 nt, Homo sapiens
uugaagauuagguuuccugagaagucucuccccuucccuuuuuaaacacagcugucuuuaaggauggggaggaggaguguuuuaaacaggaguuguuuaacuaauugccaa

SEQ ID NO: 5546 - RNA, 81 nt, Homo sapiens
cugaaggucaaccaguccucaugguuagcagaaacaagcuuaaaaccaccucugauucccaugagugcuggugaccaccag

SEQ ID NO: 5547 - RNA, 80 nt, Homo sapiens
gauaaccgaaaagcacagcuggacagguuguuugaaaauucauuuuuauaaucuguuucccagcugagacuuuggggguc

SEQ ID NO: 5548 - RNA, 111 nt, Homo sapiens
aggaauguauucagccuagggaauggauagaaacaggcaggacugggagagcuggcaaagugcuuuuucuguucuguucaucuguucacucuuggagcucugugcaaaccu

SEQ ID NO: 5549 - RNA, 101 nt, Homo sapiens
gggaagaggacauaagcugggggcagaggaaacuggggucaacaggauauucaaagccggccacucccccgcccccucugcuuccgcuccccccuccaccc

SEQ ID NO: 5550 - RNA, 80 nt, Homo sapiens
gucaacugucaaugucuccaagagcguugagggucuacauuuuugcuuagugcuuuuggacagacauugaguuagaggac

SEQ ID NO: 5551 - RNA, 102 nt, Homo sapiens
gccaaagaagacacaggaaaggcaagaguggagucuguucagaugggugccacacacauggcagaugcaggacuuugccuugcuuuuccuggucucuggggu

SEQ ID NO: 5552 - RNA, 69 nt, Homo sapiens
gugaaggaagggucuuaggggauccuagcaaaaagaacagcacacaggauccccuagaccaucccccac

SEQ ID NO: 5553 - RNA, 88 nt, Homo sapiens
gccaaaagagcauccaccgcacccgcauguccugguccuuucagggcgcccugaggcggccaggacagagguggagguggcuuagggc

SEQ ID NO: 5554 - RNA, 88 nt, Homo sapiens; identical to SEQ ID NO: 5553

SEQ ID NO: 5555 - RNA, 68 nt, Homo sapiens
gguaaggauuugugggcgcaauucaugaugagagccagcguggaaauugugccuccagauacccaacc

SEQ ID NO: 5556 - RNA, 87 nt, Homo sapiens
gguaagauuguucauuacugcuguuugccacugugacauucauuccuauguaugaaggugcagggagcaauugugaacauuugagcc

SEQ ID NO: 5557 - RNA, 88 nt, Homo sapiens
ugaaagauuaagauuuauuagaugcuuaccugcgccaaugggagauauacuggcccaaguaagcauccaauaaauguugauucccuca

SEQ ID NO: 5558 - RNA, 145 nt, Homo sapiens
gggaaugaagaggaagagauggauuugagaaauaucagaaaauagugcaauuguugcuuuuaguugcagugcagaagcacccaacagaaaaguggcauauugcagaacugauaagucucuuacuccaacugcuuuuuagaaaccc

SEQ ID NO: 5559 - RNA, 94 nt, Homo sapiens
ugcaaacagaagugauuuuaaugccuguuauuuuggaagcaguucaaaguuguuuuuuccauuguaaauagcauuaaagugcucuuuggaggca

SEQ ID NO: 5560 - RNA, 74 nt, Homo sapiens
uggaaagccucugacaagcaugcuaugugcugcggaaauugcaaacagacuuggcaugcuugcucaggagccca

SEQ ID NO: 5561 - RNA, 56 nt, Homo sapiens
uucaaaugggaucuucagcuuucucucagacaaggggguugaaggucgugacagaa

SEQ ID NO: 5562 - RNA, 138 nt, Homo sapiens
ggaaaaauugcacaauguuaaagcaacaauaauugguuccuccuggcuuuucccauugaaggaaauugaaauucaauugacuuucaauggaauagccauggaguuccaauugucauugcuccgacuuugugcuugucu

SEQ ID NO: 5563 - RNA, 87 nt, Homo sapiens
gacaaauugcagauuagaggacauacaaaugagggagccaguugcuacuuuugccuuuauuauuaauguuuuguggcucugcggguc

SEQ ID NO: 5564 - RNA, 81 nt, Homo sapiens
gagaaaugcccuauuuucugcugucuuggagaucucaagaucaucacugagacuucaggauaaacaggaaagggguuacuc

SEQ ID NO: 5565 - RNA, 88 nt, Homo sapiens
gggaacaggcuaaggaggacagaggggaggaaagcccuuuuauuucaaaaccucaauuuggccucuucucuuccuccucauaccaccc

SEQ ID NO: 5566 - RNA, 112 nt, Homo sapiens
gcuaacaaaggccaagcgcccugccaagcgguguccuggauuggggugggcguggggguucgccucagguccaggcuccgggaugucgugcaggacagggcgcggcugcggc

SEQ ID NO: 5567 - RNA, 99 nt, Homo sapiens
gcuaacugcacuaaccaggagagcuggcugguuggggagaagacacuaacccugugagucugaccucagccagcuaaccugcccuggggugccaccagc

SEQ ID NO: 5568 - RNA, 77 nt, Homo sapiens
cucaagcacaggcgugggaaaggcccccggcccgacagccccugcuaucccagggccguccugagccugugauggag

SEQ ID NO: 5569 - RNA, 85 nt, Homo sapiens
cagaagccugggagucuggguuucaugggcacuggcucucugccauaucagccggucccaucuuaauccaagcauccagggacug

SEQ ID NO: 5570 - RNA, 82 nt, Homo sapiens
gagaagccaauucuugucuccaugcucuaggaaguguuuucuuuguaguacuguuggcauggaggugaagagccuggaacuc

SEQ ID NO: 5571 - RNA, 77 nt, Homo sapiens
cucaagaccuugcugcuugcucuaaauccauaugagacaguuaaguaaauguggauuagacuggcagcaaaguagag

SEQ ID NO: 5572 - RNA, 100 nt, Homo sapiens
ccaaagaaagaugcuaaacuauuuuugcgauguguuccuaauauguaauauaaauguauuggggacauuuugcauucauaguuuuguaucaauaauaugg

SEQ ID NO: 5573 - RNA, 97 nt, Homo sapiens
gcaaaugcucauucucucuguuccauaggaaaggcacuuggguuccaccugggucuaugugugugcuuugcuguggggcagugggaguggccacugc

SEQ ID NO: 5574 - RNA, 65 nt, Homo sapiens
ccuaauuugcagaaugcuuuuguucaggauucuuauuucugagauugaagcauugcaacuccagg

SEQ ID NO: 5575 - RNA, 77 nt, Homo sapiens
aagaauucggcccugugaagaguuggguucggccugucucaggcccugcccacaucccaucacagggccguggacuu

SEQ ID NO: 5576 - RNA, 77 nt, Homo sapiens; identical to SEQ ID NO: 5575

SEQ ID NO: 5577 - RNA, 136 nt, Homo sapiens
aggaccaugcacacacaugucaucccccacagaacauaggcugcagaccccaaucuucuuggcacaggcacaggcccaagaaggucaggggucugcaaccuauguccuguggugggugacaggugugugcgugccu

SEQ ID NO: 5578 - RNA, 80 nt, Homo sapiens
cugacuggcuuguauggagguucuagaccauguuaguguucaagucuacauggauggaaaccuucaagcaggccaagcag

SEQ ID NO: 5579 - RNA, 55 nt, Homo sapiens
aagacuagcugggcacccgggccagccuucaccugcucuggucccagcugcccuu

SEQ ID NO: 5580 - RNA, 65 nt, Homo sapiens
gugacccacaucgccugccugacacacuccagacacugcagggagugcaggcugggauguggcac

SEQ ID NO: 5581 - RNA, 80 nt, Homo sapiens
cucaccacuugguuccaaagacagaaagcuugugucaaagcgaccugucacagcuuucacgauuuggaacaggugaagag

SEQ ID NO: 5582 - RNA, 83 nt, Homo sapiens
cagaccagcagugaaggagacaucaggguggauucuuucucucucuuccaccccuauccugugucuucucuccugcugcccug

SEQ ID NO: 5583 - RNA, 74 nt, Homo sapiens
cccaccccucccgagccccaauucccuuuacauaaaacaugaagcuggagaugagggcugcgcagagggcaggg

SEQ ID NO: 5584 - RNA, 107 nt, Homo sapiens
gcuaccaccacuagaacguuaauucugggagugauguuacagcacuaaugauucagucuuuccugggcuguaaugcgaucccagaauuacugucuuauggugucagu

SEQ ID NO: 5585 - RNA, 80 nt, Homo sapiens
agcacucuuuccucuuccaccuccuccagccacagagccuagccaugccuggguguggggaggggagggauagauucgcu

SEQ ID NO: 5586 - RNA, 90 nt, Homo sapiens
gacacagugugagaccucgggcuacaacacaggacccgggcgcugcucugaccccucgugucuuguguugcagccggagggacgcagguc

SEQ ID NO: 5587 - RNA, 116 nt, Homo sapiens
gagaccaucaccgccugccgggugcugaaauauguuaucauuaggcucaacaugcuauuuaguuaauuaaaugucaugcuuuugauggcauuaauuagacccgcugccgauuccuc

SEQ ID NO: 5588 - RNA, 97 nt, Homo sapiens
uggaccaacuaugucccccucagugcuucaguaaccuuagaaguuaagcaaacacagaaaugcugacucacuucagaggggggcauugugaagccca

SEQ ID NO: 5589 - RNA, 108 nt, Homo sapiens
gccacgcuguuucuccagaacugagccggccuugugucuguugggaagaaagacaugaaaaugagggcuggagcggacgcagggccccgauuccaggagaaacagggc

SEQ ID NO: 5590 - RNA, 79 nt, Homo sapiens
ccuacucccagaggcuuugcagcugcucuuagagccuguaccccggagucuuugaagcacugugagcuccugggugagg

SEQ ID NO: 5591 - RNA, 80 nt, Homo sapiens
gcaaggggugggggguggggagaaugggcaugugacccaccacacuuguccuuuuucuuucccuccuccccacucucugc

SEQ ID NO: 5592 - RNA, 101 nt, Homo sapiens
gagaggagcccagcacugggauuccgagguguuuccauucagugaucugcacugaacacagaggacucgccauggaguuugggcugagcuggguuuuccuu

SEQ ID NO: 5593 - RNA, 88 nt, Homo sapiens
uccagcuucugggccagagccauauccuugaggcugccccuuugggauggcuggcagcugcggaugggcaucaggcuucaggggggga

SEQ ID NO: 5594 - RNA, 123 nt, Homo sapiens
gggagaugcucuucaccccccauuuuguguucucauuuguguccuuccagggaagucacugaaacaaccugaggacuucuccaggaggauuuacaaagaggacacaaggggagggcauugcuu

SEQ ID NO: 5595 - RNA, 91 nt, Homo sapiens
gagagggagauagauucaggaagauuuggaaaagaaggacaaccccuaucccaucuucucccaaacucuuccugcuugacaucucuugcuu

SEQ ID NO: 5596 - RNA, 81 nt, Homo sapiens
aggagccaaacaugaccuggcaguguaguuggguccucuggaaguaucuggagcuacacugucuaggucugcuuuggaccu

SEQ ID NO: 5597 - RNA, 79 nt, Homo sapiens
cugaguugggcacauuguuuggccucucuggcaaguuccauuuucuguuaaaaaggcuaaauaauguuacccaauccag

SEQ ID NO: 5598 - RNA, 89 nt, Homo sapiens
gccagucauaggugcuuugacagaaccaaaaagggccuaucagacgcuucuaggaucuuuuugguuuugucacagcaccuaagugaggc

SEQ ID NO: 5599 - RNA, 78 nt, Homo sapiens
cagagggacaggaggagcgccaggcuccagcucgcugcucccccagagccucccagccuggugccuucugguucgcug

SEQ ID NO: 5600 - RNA, 77 nt, Homo sapiens
acaagauggauucacagaauuggagcaucuuaggaucuuaggagccucagaugcucagggcugugacauuauucugu

SEQ ID NO: 5601 - RNA, 115 nt, Homo sapiens
aagagcuaacaugcacaugaguaacacaugcacaucaucaacugugccugcaacccaaagugcuacaugucacacacaguugaugagugugcguauguuuacucauuuaguccuu

SEQ ID NO: 5602 - RNA, 121 nt, Homo sapiens
gcuaggauaguuuggguuuuuaauauuuagcuuucuguggccagucacuggagaggugagaaggcagggcuaguugacuggccaugguaagcuaaaccuuaaacacccaaagcaucaaagu

SEQ ID NO: 5603 - RNA, 84 nt, Homo sapiens
gagagcucaaggacuacaacucccagugugcaccacaauugcuuuguauguaccuugggaguuguagucccccuugagaagcuc

SEQ ID NO: 5604 - RNA, 74 nt, Homo sapiens
ccaaggguggaagagacugugguuccccaaagcuucccagugcacuugaggguucacacucucccaccacaugg

SEQ ID NO: 5605 - RNA, 139 nt, Homo sapiens
agcaguuaaacuuggaacagagguugaggauucauggaugauuagauguggggucugagggaaagcaggaacgcaaggaugacucccagaucuucagcaugaacaacucagcacacucugguuugagguggagaaagcu

SEQ ID NO: 5606 - RNA, 78 nt, Homo sapiens
gggagagguuguuccauccagggcaguuggucuccagaaggaaauucucuguaucugggugcugcaaccuaggugccc

SEQ ID NO: 5607 - RNA, 67 nt, Homo sapiens
ucuagagagacugaguacuuuuccuuuuacugaauaggagguucuggaaaaguacuggguuuccaga

SEQ ID NO: 5608 - RNA, 88 nt, Homo sapiens
gcuagagaucuuagcauuucugguacuguauguacuauucagaggguacaaacuauucacaguuccagaaauguuaauaucaaagagc

SEQ ID NO: 5609 - RNA, 74 nt, Homo sapiens
ggcagagcaggaggguguggagguucagggcaccugccauugguccuagagccacccacaccugcacugaggcc

SEQ ID NO: 5610 - RNA, 78 nt, Homo sapiens
uccagcucugagcugugauugcaugcaggugaacagccugagaggacuguaccuuugugccacacagcucgggaagga

SEQ ID NO: 5611 - RNA, 66 nt, Homo sapiens
ggaagcagggggcggaggccgcugugcagucagccuggcugugggcggccccugccugcuccgucc

SEQ ID NO: 5612 - RNA, 71 nt, Homo sapiens
gacagcuccuccccgcccccucugccggccccacuuccuaggcggcggagcgggucggggagggaaggguu

SEQ ID NO: 5613 - RNA, 84 nt, Homo sapiens
cccagugcagggauggcagcaggagaaggugcccucaugcaggagcugugggcagcuccuccugucaucugucuuugcccaggg

SEQ ID NO: 5614 - RNA, 89 nt, Homo sapiens
gaaagucacucaugcccuuuuucggaauccggcagcuuugcucuagauggaggcugcuagauucagcaggaaggggcaggguguuguuc

SEQ ID NO: 5615 - RNA, 131 nt, Homo sapiens
gggauccugcccugcgauaguccagugacugaguccgcaguaaggcagugguccuccaaugcuggaguucacggcgugguggggucacgguccuucagugucuuaguccauggguaccagggcgggggucc

SEQ ID NO: 5616 - RNA, 132 nt, Homo sapiens
gggauccugcccugcgauaguccagugcuugaguccgcaguaaggcaaugguccuccaaugcuggaguucacggcguuguggggucgggguccuuuggugacuuaguccagggcguaccagggcgggggucc

SEQ ID NO: 5617 - RNA, 132 nt, Homo sapiens
gggauccugcccugcgauaguccagugcuugaguccgcaguaaggcaaugguccuccaaugcuggaguucacggcguuguggggucgggguccuucggugacuuaguccagggcguaccagggcgggggucc

SEQ ID NO: 5618 - RNA, 71 nt, Homo sapiens
uguauugaaauaagaggauugcuaauguguauuccugacauuuuagcaguaucaaaucugauuucaucaca

SEQ ID NO: 5619 - RNA, 101 nt, Homo sapiens
gaaauauuugcuagggaagcuggggucgggggacacuggggcaagaggaaaacucguuccuugcuccagugucuugcuacggaagcuucugcaaguucuuc

SEQ ID NO: 5620 - RNA, 58 nt, Homo sapiens
ucgaucaagaagccggaugugggagccaauccaaucaaacaucugguugcuuggcuga

SEQ ID NO: 5621 - RNA, 97 nt, Homo sapiens
gagauggggaaacugagguacacagaggaacacugacuugcucaaggguguggcugugacaagucacuguucuucaaugaccucuccccgcccccuc

SEQ ID NO: 5622 - RNA, 93 nt, Homo sapiens
ucaauuugacgucuuucucuacccacaguuugugaggagagugaugcaaacauuuuucuucauuggcuguggcuggagaaugcaucaacauga

SEQ ID NO: 5623 - RNA, 97 nt, Homo sapiens
gucauuucccuagaugccagccuuucuuugugaagacggaaauacugugucggugucugucuaaaccuacaagaggaaggaggccaauaaggaagac

SEQ ID NO: 5624 - RNA, 84 nt, Homo sapiens
gcaaucugggagugcuuucuggagucugauaagaacauacuggcacauugccugugacgugugggacccaggcauuuucagugc

SEQ ID NO: 5625 - RNA, 98 nt, Homo sapiens
cugaucuuuggcuguuaaagugcaaagaagaagggaaaggagaucggacuuagauuuucugccuuuccuuucuuguugccaugacagcuugagggcag

SEQ ID NO: 5626 - RNA, 143 nt, Homo sapiens
uccaugccagcacagcugcuuccccccugggguuucugacacucucaggauguggguuuucacacugugucucucgcacaguaauacacagccauguccucagaucucaggcugcucagcuccauguaggcugugcucgcgga

SEQ ID NO: 5627 - RNA, 105 nt, Homo sapiens
cugaugugacagcuucuguagcacuaaagugcuuauagugcagguaguguuuaguuaucuacugcauuaugagcacuuaaaguacugcuagcuguagaacuccag

SEQ ID NO: 5628 - RNA, 100 nt, Homo sapiens
gugauccacacucaaacugcugacaacauaaaaccuuuguccuuagaagucugaauuucaaaauuuuuaaaacauaaugaauguuguuaugugaggccgc

SEQ ID NO: 5629 - RNA, 71 nt, Homo sapiens
ucgauucagcagcuccucguauguguagucucuuucugagccugcccaagcagggccugucugauuacuga

SEQ ID NO: 5630 - RNA, 85 nt, Homo sapiens
guuauagucauguguuuuucauuuacaaauauggugagaaguaguguuuuugcaauauuccuaaaugaguaacauaugacacaac

SEQ ID NO: 5631 - RNA, 70 nt, Homo sapiens
ggaaucacuuccuuuuuuggagucuccauguccuccuugggaauguggagguuccuuaggagggaguucc

SEQ ID NO: 5632 - RNA, 135 nt, Homo sapiens
gagaucccauggaaggaugcaugauggcagagcucuuguaugacauucaucuucaugagugagcuguuccaucuccucucacgagcggagauaaaugucagaagagaucagccguuguguauuacauggccacuc

SEQ ID NO: 5633 - RNA, 116 nt, Homo sapiens
ggcaucacucagccugcuccugguuguggguccauuaucugcuccuaauauugucuuucgucucgggauugugaacagauaaggaacccacagccaggagcaggcugggccuggcc

SEQ ID NO: 5634 - RNA, 79 nt, Homo sapiens
caaaugcuauaugcugccuucagucucuucaagaacuuugcugugaccuccuguagagauugagggcaaguauagguug

SEQ ID NO: 5635 - RNA, 74 nt, Homo sapiens
aggaugacuggaugucacacccaugaugcuauuagguccucauaauagcauagugagguggacagcuaguaccu

SEQ ID NO: 5636 - RNA, 108 nt, Homo sapiens
gagaugaaaggcuguagcccacaguuuguugcuuuggaugaagauaguuugagaaguuaaaacucagucucaccaguaacagccucagugggaggcaguagaaagcuc

SEQ ID NO: 5637 - RNA, 74 nt, Homo sapiens
ggaaugaggguggggggcggggaggugacgggcccaacagguugugccucauuccugccccgccucucacuucc

SEQ ID NO: 5638 - RNA, 80 nt, Homo sapiens
gcuauuaguaaauggguguguuugaugaauugggcaucaugcccagauuuccaugcaucaccucauuuaaucuucacagc

SEQ ID NO: 5639 - RNA, 66 nt, Homo sapiens
gcaauuccuuuuuugaagcuggagggaaggguccaagaaagccaacucccaguuccaagaaagugc

SEQ ID NO: 5640 - RNA, 111 nt, Homo sapiens
cccauucugcuugcucugguggagauauugcacauuacuaaguugcauguugucacggccucaaugcaauuuagugugugugauauuuucacaugagugcaugcacacggg

SEQ ID NO: 5641 - RNA, 102 nt, Homo sapiens
ggcauucagugauuuuccccaagcauugccuagguaccggcagacccucaauucuaaccaaggucugacuggugcuuacuucaguacuuuuaaucacaggcc

SEQ ID NO: 5642 - RNA, 88 nt, Homo sapiens
cucauugggaucucaccaucuuccugugaagcaguggaaguagaugcuauuauuuccauuuuacagaugaagaaaguaagauucagag

SEQ ID NO: 5643 - RNA, 68 nt, Homo sapiens
aaccuaucugagugguuaagugagcauacuuuuugaccuguaugcucauuuaaccauuuagauaaguu

SEQ ID NO: 5644 - RNA, 134 nt, Homo sapiens
cugcuccugcugcuuguuucucaguugaaggcauaauccuuuguuugugacuaugaaauuggcuuauguagagaugauuaugauguacauucagagaauugugacuucaggugagaaauaagcagcaggaacag

SEQ ID NO: 5645 - RNA, 91 nt, Homo sapiens
uaacaaauuaaauguuuaaacagccagugcaaacauuuagaucugagucaaaauuguuugcacucugccaguuuaggcauuuaauuuauua

SEQ ID NO: 5646 - RNA, 87 nt, Homo sapiens
uaacuaauccaucaccucccucagguucuucccugauauuuuucagagaagaaagggaagaaccuaaaggaggugauggauuaauua

SEQ ID NO: 5647 - RNA, 65 nt, Homo sapiens
acacagagaaagagagagaguauacaucaccuaccuaugucauguguuuuucuuuuucucuuugu

SEQ ID NO: 5648 - RNA, 70 nt, Homo sapiens
gagccuccaguaccacgugucagggccacaugagcugggccucgugggccugauguggugcuggggccuc

SEQ ID NO: 5649 - RNA, 55 nt, Homo sapiens
gcuccaguaacccuuuggugucuuggaaguccagccaguggaggguuauugaagu

SEQ ID NO: 5650 - RNA, 71 nt, Homo sapiens
uggcgggggaaggggcacggagcggaagagggggaugcaaaacccaccucuuucuggucucuucccuccca

SEQ ID NO: 5651 - RNA, 67 nt, Homo sapiens
aggcacucaauaaauagucauuggugauaaauuccuuauucuuccagugaauauuuauugaguuccu

SEQ ID NO: 5652 - RNA, 79 nt, Homo sapiens
gcucuagagaauuuagugccucugcgucucuucuccuucucauuaggagacagcagugguguuuuaaauucuuuaaagu

SEQ ID NO: 5653 - RNA, 66 nt, Homo sapiens
gcacugugcacugugacuggcagggggcgcugaaaccgccuuuucugccccacauggugcgcaugc

SEQ ID NO: 5654 - RNA, 95 nt, Homo sapiens
gggccuggcaugcagcaggugcucacuaaacaccugcuuacuggaugcauaaaggcgagcuacuguuuaguaggcaccuacugugugccagcccc

SEQ ID NO: 5655 - RNA, 58 nt, Homo sapiens
gcucgcgcccggagcccugcccgcgcgacugagcaugcccagagcuccgggcgccggc

SEQ ID NO: 5656 - RNA, 90 nt, Homo sapiens
aggcccauauccugacauugauccaagugcggaacucccauugaagucgaugagaguguuguauagaaaucaaugacaggauauggaccu

SEQ ID NO: 5657 - RNA, 87 nt, Homo sapiens
uaacuaauccaucaccucccucagguucuucccugauauuuuucagagaagaaagggaagaaccuaaaggagaugauggauuaauua

SEQ ID NO: 5658 - RNA, 75 nt, Homo sapiens
gugcgggcucugggcuccccagcccccucccugggcccaauccaggccaucugcugggggacucagagccuccgc

SEQ ID NO: 5659 - RNA, 68 nt, Homo sapiens
agucagagacagaccuaggggaaaaaagaagagaaacauggauucuaacuugggcucugucucuaacu

SEQ ID NO: 5660 - RNA, 66 nt, Homo sapiens
ccacuuuuaugccugugacagcuucaugaagcacaaaacauggagcaauacauggcaugaaauugg

SEQ ID NO: 5661 - RNA, 71 nt, Homo sapiens
cagcaugucagagucccucaguggagcguguuaacuugaagagcugguccaguggggaucucugauauuug

SEQ ID NO: 5662 - RNA, 75 nt, Homo sapiens
ggccgcugcacgcagggcgggaggcgauggaggcugcccgcgccuugcgccuccugcucguggugugcggcugcc

SEQ ID NO: 5663 - RNA, 69 nt, Homo sapiens
guacuugaggagaacagauucuguuuugagugucagcucugucaaaacagaauuggucucuuuaauuau

SEQ ID NO: 5664 - RNA, 59 nt, Homo sapiens
caccauuagagcagaauggagacugguuaacugauucugggcuccauguucuaguugug

SEQ ID NO: 5665 - RNA, 80 nt, Homo sapiens
agccuccuggcuguaccuuaugugaucauggguggguccuuggcccagugguggcucauauguagucuagccaggaagcu

SEQ ID NO: 5666 - RNA, 71 nt, Homo sapiens
uuacauauuuccagucuccauucuuuucuuguaucccagagcauaaagaacugagacugggagguauuuaa

SEQ ID NO: 5667 - RNA, 70 nt, Homo sapiens
cuccaagaagucuccugcagucucuguaccugaggucuuugguugggauguggggacugacuucuuugag

SEQ ID NO: 5668 - RNA, 71 nt, Homo sapiens
uucccugugagucacugaguuuugggcaucacaucagguaaacaagaacucaguuguacauucacagagaa

SEQ ID NO: 5669 - RNA, 75 nt, Homo sapiens
uuccugagccauaaugagcuuagguuuuuaaucagacuaaugagaaaagaucuguaauucagcauggcucaugag

SEQ ID NO: 5670 - RNA, 85 nt, Homo sapiens
uuccagcugugaugcuguaggagacucacuuggaggaaauuguguagcaacccuccccucucuucuacucauuuuacagcuugaa

SEQ ID NO: 5671 - RNA, 77 nt, Homo sapiens
uggcaaggucaagguccuggagugggccauaguugccaacuccugcuaggcucaacuucagaaucugugacuuucca

SEQ ID NO: 5672 - RNA, 139 nt, Homo sapiens
guccaagaugucugagccuagcugaaccugcacuguaccccauugugacggagcacuuuuacauuuugcggaaaacaaugauauguucuuucacagauggggagaaaguugcagccagucuaagccaaacaucuuugac

SEQ ID NO: 5673 - RNA, 82 nt, Homo sapiens
ucccgggugcacagggccuguuuucccgguggcuggcgaagcaauguccuucccccggguaaagcagcccaugcguucugga

SEQ ID NO: 5674 - RNA, 82 nt, Homo sapiens; identical to SEQ ID NO: 5673

SEQ ID NO: 5675 - RNA, 94 nt, Homo sapiens
acucugcaaauggcaauuacauucaauggaaaccagauguugcauggaauuugacucucuugguuucuuggugaaguagaugaauuuguaaagu

SEQ ID NO: 5676 - RNA, 73 nt, Homo sapiens
guccaccaugcugacuaccaccagacgccaucaagcaaaaggggugcuggaaugugacguuggcauggucgac

SEQ ID NO: 5677 - RNA, 82 nt, Homo sapiens
acccaggcagcagggugcacaaaguuuagccaccuuuuagaaauaggugccaaguauuguguccugcucuguuugccuaggu

SEQ ID NO: 5678 - RNA, 76 nt, Homo sapiens
gcgcggcggcugguuagggggcgggaagggcggcggcacccgcagccccgucgcccccgcagucacgccgccucgc

SEQ ID NO: 5679 - RNA, 100 nt, Homo sapiens
guucuuggcuacaggccauuacuguugcuaauaugcaacucuguugaauauaaauuggaauugcacuuuagcaauggugauggauuguuaagccaaugac

SEQ ID NO: 5680 - RNA, 55 nt, Homo sapiens
ggacgacgucacgggggccucugaccgcuauucauuucaguccccgggugucucc

SEQ ID NO: 5681 - RNA, 83 nt, Homo sapiens
ggccaaggguaaguuggagagggagggcuguuuagcuuuagaaugcaccacacaaccucuuucuccaugccaagcccuuugcu

SEQ ID NO: 5682 - RNA, 84 nt, Homo sapiens
uggcugagucacauggaguucagauccugugccuagugcaggaacacaccagccacagauuugaccacuccagagacuuaccca

SEQ ID NO: 5683 - RNA, 77 nt, Homo sapiens
agccauaaugcaugguuuuaaggucacugccgguuauuaucugaccaguaaugaccacaaaacuauacauuauugcu

SEQ ID NO: 5684 - RNA, 110 nt, Homo sapiens
gucccuggcccagacccuucucuuccacccaaucucauugccuuuagccacaauaaauaucacagggccugggacaggguggaacacugacaggguugcuggccggagau

SEQ ID NO: 5685 - RNA, 98 nt, Homo sapiens
agacagguaagauaaccaaagaaggaaaauaagcuuuucaaauaauuagcaauccuuagacaaaacuuguuuuccuuucuugguuauguuaccuauuu

SEQ ID NO: 5686 - RNA, 70 nt, Homo sapiens
uuccucuccugcucucaguccauccucugcuggccacagcaauuccgggacugagggaaugggggaugag

SEQ ID NO: 5687 - RNA, 70 nt, Homo sapiens
cuccucucuugcucucaguccauccucugcuggcugcagccacuccgggacugagggaaugggggaugag

SEQ ID NO: 5688 - RNA, 109 nt, Homo sapiens
aggcgggggcggggcacgcugcagggguccuccccacgcuggucggcaggagugacgccugaagcuacagcugggguggacuccugccuacugcccaccugucccuccu

SEQ ID NO: 5689 - RNA, 68 nt, Homo sapiens
ggacggaggugaagagaaggcgccucccugucuggugacagcagcuggggcccuugcugccucccucc

SEQ ID NO: 5690 - RNA, 69 nt, Homo sapiens
ggccugugcagcgagccuugcucuaucaugcauuaaacugugaaagagcaguggcuccaugcacaaguc

SEQ ID NO: 5691 - RNA, 76 nt, Homo sapiens
ccacugucccucucaccucccuuagucccugggaaauggaagacagccugggagugagggaggaaaggggacaugg

SEQ ID NO: 5692 - RNA, 56 nt, Homo sapiens
acaccgcaaauaucuucugaucacaguucauuaauugugaucagauuuuguguugu

SEQ ID NO: 5693 - RNA, 67 nt, Homo sapiens
cggcugggguuccuggggaugggauuugcuuccugucacaaaucacauugccagggauuuccaaccg

SEQ ID NO: 5694 - RNA, 74 nt, Homo sapiens
agacaucaucuugaaugacugugauuuucuugaacugaucaccaggcuauuauagucucucaagaaugauaucu

SEQ ID NO: 5695 - RNA, 101 nt, Homo sapiens
ccccagccagagccccgcccgccacauuccugccuccccggagauggccguggccagggccgucgccagggggccgggaaugcagcgcucaauggcuuggg

SEQ ID NO: 5696 - RNA, 99 nt, Homo sapiens
auucugagccuugcagauuacaugauaauuauacuuaagggcugccaaggaacuucaggaauaauuaucauaugauuugcagguuuucaagcucaugau

SEQ ID NO: 5697 - RNA, 60 nt, Homo sapiens
ggccgguucaagggcagucagaugaaucgacccuucuuacaggcugucuacgaaccaguc

SEQ ID NO: 5698 - RNA, 64 nt, Homo sapiens
cagcugguaacucuaauuuggguaaguucuuucuuagcacuugccaaauuugaaauaccaucug

SEQ ID NO: 5699 - RNA, 74 nt, Homo sapiens
ccacugucccacuguccucgcaggggaugggaucaggugucagcaccuccccauggaguacaguugggcaaugg

SEQ ID NO: 5700 - RNA, 176 nt, Homo sapiens
uuccguagccagcuggagaaggagaaaugcagagugaaaaggagaaagaagaacuggacaaaauuaaaaugcucuucugucauuguaauaguucauaugggcacugacaggagagcauuuugacuuugucaagugugucugcuacucauuuauuccaucuccugcuuguuaccgaa

SEQ ID NO: 5701 - RNA, 85 nt, Homo sapiens
caccugcuccucagaucagaaggugauuguggcuuuggguggauauuaaucagccacagcacugccuggucagaaagagcaagug

SEQ ID NO: 5702 - RNA, 88 nt, Homo sapiens
guucuguuuugcacgaggcugcucuauucauguaggcagaacugcugguguaauauacaugaauggaguggccuggugcaaacaaaac

SEQ ID NO: 5703 - RNA, 118 nt, Homo sapiens
acucauuacuccgucaaggauuuggcauuucaaucgaugggaaaugaugugugaucauucuaauuuauuauacaucauuucccaucaaucgacgaacuaaagccuugacguaauaagu

SEQ ID NO: 5704 - RNA, 86 nt, Homo sapiens
uuucauacuugaggagaaauuauccuugguguguucgcuuuauuuaugaugaaucauacaaggacaauuucuuuuugaguaucaaa

SEQ ID NO: 5705 - RNA, 80 nt, Homo sapiens
ggccuuucaggggucgccuugucucuuuacccacaucugagauguguccgcagggauaggggaugcccuuaaggaaagcc

SEQ ID NO: 5706 - RNA, 136 nt, Homo sapiens
agacgagcgugugggaggucucuguguugggcgucugucugcccgcaugccugccucucuguugcucugaaggaggcaggggcugggccugcagcugccugggcagagcggcuccugcaugggacauggcucuucu

SEQ ID NO: 5707 - RNA, 72 nt, Homo sapiens
agacaggcaggggauggggaggagaacaggacuaaaagcagucaccucuuccucucuucccccagccuaucu

SEQ ID NO: 5708 - RNA, 103 nt, Homo sapiens
uuccucagaaaguucuaaugaaggaugauaggauagggaagggaugaguguuaguauucauuacuuuucauuuauuacuuuuucaauagaauugacugaagaa

SEQ ID NO: 5709 - RNA, 85 nt, Homo sapiens
agcccugaacggagguaugggugagagagaggcgguggcugagggaggaaagcugucuuuucacuggugccuucuuguuagagcu

SEQ ID NO: 5710 - RNA, 71 nt, Homo sapiens
ggucgaugcugcccuguuuggacagcccggucuuccggggccgcacguuguccagcugggcaucguccacc

SEQ ID NO: 5711 - RNA, 82 nt, Homo sapiens
uuccaguccccugggacaacuguccauguccauuggaaaauuauucauuccaauagacauggacaauuguccaugacuagaa

SEQ ID NO: 5712 - RNA, 96 nt, Homo sapiens
guccaucucucucuucuucuugaguaacaucagauucuucaucagugccaacugaagucccacucugauucaacuuggcaggagacuuagauagac

SEQ ID NO: 5713 - RNA, 96 nt, Homo sapiens; identical to SEQ ID NO: 5712

SEQ ID NO: 5714 - RNA, 102 nt, Homo sapiens
gggcaugggcugcugggguggcccaccuuccccgguguacauacugugucuguguaacauuuuguauauuccagaggguagggcugccccuguaucauaccu

SEQ ID NO: 5715 - RNA, 83 nt, Homo sapiens
caucucuagugcaugcugccaccugugguagucuguaguuacugucagucaccaccagguggcaguauuguugaauagaaaug

SEQ ID NO: 5716 - RNA, 69 nt, Homo sapiens
ccaccacuuaaacguggauguacuugcuuugaaacuaaagaaguaagugcuuccauguuuuggugaugg

SEQ ID NO: 5717 - RNA, 86 nt, Homo sapiens
ucccucuauacaagguggguuuugcauugucccacacauagucugcugauggccgugggauggcaaagucaucuucauuagacgga

SEQ ID NO: 5718 - RNA, 76 nt, Homo sapiens
uccccucuuuauccagccuucaaguucagucauauauuuuuuuauuugaaaugaacuaaagcugauuuagagcgga

SEQ ID NO: 5719 - RNA, 106 nt, Homo sapiens
ggucaaauuuaguuucagcaaaguguucuugcacugccugccaagaagaugggguuaauugguaggaaagugugggaggaaacugauguuaguggaacauuuaacu

SEQ ID NO: 5720 - RNA, 84 nt, Homo sapiens
cagcgcgccggcaccuuggcucuagacugcuuacugcccgggccgcccucaguaacagucuccagucacggccaccgacgccug

SEQ ID NO: 5721 - RNA, 75 nt, Homo sapiens
ggccccgcggugcauugcuguugcauugcacgugugugaggcgggugcagugccucggcagugcagcccggagcc

SEQ ID NO: 5722 - RNA, 114 nt, Homo sapiens
ugacgcacacugucccaccuaauucgcccagcccagcccgcugggaggugggugccgugguucccuucccacgggucaggggcugaggcucagagaggugaaaugacuugcuca

SEQ ID NO: 5723 - RNA, 94 nt, Homo sapiens
gcucucucccagaugaagauuccugcagaaucacgcagccacaggagcugcugggcuguguguuucugugggaguguugcaaguguuggauagc

SEQ ID NO: 5724 - RNA, 69 nt, Homo sapiens
gccccagcugggggcuggccuuggcacuagcugcccuggcaguggcugcugggcugguccuucugaggc

SEQ ID NO: 5725 - RNA, 85 nt, Homo sapiens
gcucugugcccccuggugucuaugagagugggcuuugcuggggugggcagccugaagcccauucugaggcuccagggggacaagc

SEQ ID NO: 5726 - RNA, 65 nt, Homo sapiens
ggucuauggugggagaggaagauuucugaguuucauucaaaguuuucugaguccuauaguaugcc

SEQ ID NO: 5727 - RNA, 114 nt, Homo sapiens
gagcggaguguuuaugucaacuacauauuccccuagauacgaauuugugaccacaaaauuccuuacacaaauucggaucuacaggguauauacagaagacagacagaucuucuu

SEQ ID NO: 5728 - RNA, 99 nt, Homo sapiens
ucccucagccuggcugccaagcuucccgggcagcugggcagauuuagccacucucuccccagcugucugugaacgcuggcagccaguucaagugacgga

SEQ ID NO: 5729 - RNA, 66 nt, Homo sapiens
gagcagguggaagaagggccgagucagggagggggcauuuccuggcugauccucuucauuucucuc

SEQ ID NO: 5730 - RNA, 79 nt, Homo sapiens
uugcccuuuucugagcauccggagaggugauuccgagaaugccuccggauccgacuccccugugcucagugcaggucaa

SEQ ID NO: 5731 - RNA, 103 nt, Homo sapiens
agacugaggcccaaagagggugugcagggaagggcaugcuauuggcaaagcgaugaagauggugaugcuuuucugauuugugccucccucuuugggcccaucu

SEQ ID NO: 5732 - RNA, 67 nt, Homo sapiens
gccccuaccugcaguggcagcuucauucaccuucaugagaagaugaagcaguagcuccaggaguggc

SEQ ID NO: 5733 - RNA, 105 nt, Homo sapiens
ugccagaugugcucuccuggcccaugaaaucaagcgugggugagaccuggugcagaacgggaaggcgacccauacuugguuucagaggcugugagaauaacugca

SEQ ID NO: 5734 - RNA, 71 nt, Homo sapiens
gugcgcaaacccuccccucaccccaauucccggugguucugagagaugaggugagguggggagggggccac

SEQ ID NO: 5735 - RNA, 93 nt, Homo sapiens
ggcccuagcccgagcacucagcccuggcuguuggcacucagauguuacaacaggccccgacagccacaggcugagggauaaccgggaagugcc

SEQ ID NO: 5736 - RNA, 91 nt, Homo sapiens
ccucguauucagagccagguugacuuacuguuugcuggcugauaggacuggcagaaguuacagcuuguaugauagagucagccugggcagg

SEQ ID NO: 5737 - RNA, 81 nt, Homo sapiens
guucgccaggugaagaagggggggaagggcguuccagccagagggaacuuggcccaucuccucccuccuccccaugccaac

SEQ ID NO: 5738 - RNA, 72 nt, Homo sapiens
agcccuguuucccaaauguaaauuccaucaucaucuugaucaugaugggguucacuccugggaaagggaguu

SEQ ID NO: 5739 - RNA, 79 nt, Homo sapiens
ggacuugaguucugagauccugcacaugugggcauguuauauguacaauaagcguguggggugucaugaacugagaucc

SEQ ID NO: 5740 - RNA, 88 nt, Homo sapiens
ggcccugagagcaauacucauauugauugcauuuauuucacucuagggaggagagauaauucuucaaugugggacacaucugggagcc

SEQ ID NO: 5741 - RNA, 73 nt, Homo sapiens
ucucgcucccucccucccgcccuccuuuuguguacaagcugucuacgacagggggugggagggggcaugcaga

SEQ ID NO: 5742 - RNA, 72 nt, Homo sapiens
gggcauugggugauugggccugcuuaucuuugugaccucauuacuuacccucuggcccucacucaauuuucc

SEQ ID NO: 5743 - RNA, 114 nt, Homo sapiens
gcccagguccccugggggaggggccgucccuguccccgcugucccccagcccuggccagggcuguccucaggguggggaaggcaggcccccgccacccucucagggccucaggc

SEQ ID NO: 5744 - RNA, 74 nt, Homo sapiens
ccucugcaguggccucaggcccucugccaguccugauugacuggugagggugccugggccaucucuguauaagg

SEQ ID NO: 5745 - RNA, 86 nt, Homo sapiens
ccuccacauaacaggugcucaaauaagacuuguugguuuauuuauucuuucaacaaauacuuauugaggaccugcuauaugccagg

SEQ ID NO: 5746 - RNA, 74 nt, Homo sapiens
ggccauggcaagcccuugccuaccacacugcgguccaugacaccagucugguagccaaaugcugucauagugcc

SEQ ID NO: 5747 - RNA, 118 nt, Homo sapiens
cugcccagugcuauuguuugguacuuaaagcgagguugcccuuuguauauucgguuuauugacauggaauauacaagggcaagcucucugugaguaucaaaccuugucuuggacccag

SEQ ID NO: 5748 - RNA, 96 nt, Homo sapiens
ggccaaagaaugaucuugaaaacauuggcuucuaaaagucugcuugauaguaguguggacauuagagcuaaguuuuuggauuguucuuucagagcc

SEQ ID NO: 5749 - RNA, 71 nt, Homo sapiens
gagcaggaauagaagcucuguugcuaugguagcaaauaugccuuauacucauagaccuucuauuuucucuc

SEQ ID NO: 5750 - RNA, 73 nt, Homo sapiens
gaacagagacagcuggccuggcggccucccucucacugcaugcaagagucuguuagggcggcugucuugcuuc

SEQ ID NO: 5751 - RNA, 73 nt, Homo sapiens; identical to SEQ ID NO: 5750

SEQ ID NO: 5752 - RNA, 66 nt, Homo sapiens
uaccauaugcaaaggggaaggcuuuacuucucuuuggaaacauagccuucccuguugcauacagua

SEQ ID NO: 5753 - RNA, 66 nt, Homo sapiens; identical to SEQ ID NO: 5752

SEQ ID NO: 5754 - RNA, 56 nt, Homo sapiens
cgccagugggagucgggcccagccgucuuggcgcucgcccgacucucccgcccgcg

SEQ ID NO: 5755 - RNA, 124 nt, Homo sapiens
uuacaacauccauuaaaaguuaguaacauuaauuuaacagggagaaaaucuaauagaguucuuagagugauacuggcauuuuuccauuaaauuaauguuacaaacuuuuaacaggaugucuuaa

SEQ ID NO: 5756 - RNA, 68 nt, Homo sapiens
ucccagagccggccugcuguggagggacuuccuggguaucaggguccccacggcuggcgggcucagga

SEQ ID NO: 5757 - RNA, 67 nt, Homo sapiens
guucacaccuaugaauuccuggaguggccagagaacauguuacuacuccagggucaaugguggaagc

SEQ ID NO: 5758 - RNA, 93 nt, Homo sapiens
gggcaggaguccucuggugcagaaguccaggacguaauggagugggaguacuccaacgccagaguccagggcucugcggggcaggguuccccc

SEQ ID NO: 5759 - RNA, 95 nt, Homo sapiens
ucccacugcccugagcuuggagacucaaaggauaaaggagucuccgagaaagcucucccauagccuucuaauucuccaagcaggggcagcaagga

SEQ ID NO: 5760 - RNA, 68 nt, Homo sapiens
gugcaaauggcaguuuuguuauuuggugucaaaguuaccagucgcacaaugacaagcugccauaacac

SEQ ID NO: 5761 - RNA, 96 nt, Homo sapiens
aggcaaguuuuauuggccauuacuauuugccucaagugaguggcaaagccuuugaccacucgaggcauauauuaauagcccuauaaaauacauccu

SEQ ID NO: 5762 - RNA, 171 nt, Homo sapiens
ugacaaaagcaaggaaauucacaguuaaaggggaaacgugccauauguucuucaauaccuaagagcaacggggugcauuuggaaagucauuaaagcggcacccaguugugccuagguauuggagaacauauggaaucuuuuccuccgcgaguguaauuuucccugcucuca

SEQ ID NO: 5763 - RNA, 81 nt, Homo sapiens
ccucaaacauuaugagcccacuggugaauccccagcuccaccucuguacccccauucaccagugggcugauaguccccagg

SEQ ID NO: 5764 - RNA, 85 nt, Homo sapiens
gcccaccuggguuagggucgaagccccacuccccacagaagguuuuccuaaaggagauggagccagggcccuaacccaguuaggu

SEQ ID NO: 5765 - RNA, 62 nt, Homo sapiens
ggccacacgggguaauaauaacuugucgauaagcugcgcggguuauuuuuaugccgcaagcc

SEQ ID NO: 5766 - RNA, 96 nt, Homo sapiens
gcccaggcggggcagggcuggucugaggggauguuuuugacggagcggagcuccagaugcugcacauuccugaucgggucaggccugcccugcggc

SEQ ID NO: 5767 - RNA, 70 nt, Homo sapiens
gcccagagggcgggagcagggaguggagacgggguccucacccccagccccuccccuuucuccgcccggc

SEQ ID NO: 5768 - RNA, 77 nt, Homo sapiens
gcccagagugggguuuccccagccuagagguaugaaaagacacuucacacucuguggcacgggggaagucccaaggc

SEQ ID NO: 5769 - RNA, 150 nt, Homo sapiens
ucacauuuugaggcuuuaaguggaaaauaucagcucaugauacccuugggccuaagcuugugucuacaaauagcuucuuuuuguggcaacaaauuaguucugggguuuauuuuauucugcauuauuuccgaugucugccucgcugccuga

SEQ ID NO: 5770 - RNA, 124 nt, Homo sapiens
aacccuccuugggaagugaagcucaggcugugauuucaagccagggggcguuuuucuauaacuggaugaaaagcaccuccagagcuugaagcucacaguuugagagcaaucgucuaaggaaguu

SEQ ID NO: 5771 - RNA, 93 nt, Homo sapiens
ggucccugcccucuagaagcucacagucuaguuguguucaugugcaagucauuuacccccagcuagauuguaagcuccuugagggcaguuacc

SEQ ID NO: 5772 - RNA, 93 nt, Homo sapiens
cgccccccaacuggcaccacugcugccccugccccuacucucagccucacgugacucucgggcagaggcagugguggggcagccagggcagcg

SEQ ID NO: 5773 - RNA, 93 nt, Homo sapiens; identical to SEQ ID NO: 5772

SEQ ID NO: 5774 - RNA, 86 nt, Homo sapiens
ucucccagguggaccuuucugcagaacuacagagccucaggauuuaccaggcuguguguuucugucggaguguuucgaguguugga

SEQ ID NO: 5775 - RNA, 86 nt, Homo sapiens
gucccugggcuggggagaggggaggauuggggcgcgggaggcucuguucuccuccuccccucuuuuccccaccucccaaaauuggc

SEQ ID NO: 5776 - RNA, 73 nt, Homo sapiens
gggccaucagauggggcacgcagacccuauucacccuauagugucccguagggcugcugccucacucaccccc

SEQ ID NO: 5777 - RNA, 99 nt, Homo sapiens
gcuccccaaaguaauguagcuguuuaugcacuccugccucugaauuccuuuuaacuggggccugaggagaagugcauaagcaacauuacuucagcaagc

SEQ ID NO: 5778 - RNA, 79 nt, Homo sapiens
gcacccccucgcugcuccccaugacaggcugcuccagugcuggagucagugugagcauggggagcagugaacaucaugc

SEQ ID NO: 5779 - RNA, 79 nt, Homo sapiens; identical to SEQ ID NO: 5778

SEQ ID NO: 5780 - RNA, 95 nt, Homo sapiens
gugccuggccugaggagcagggcuuagcugcuugugagcaggguccacaccaagucguguucacaguggcuaaguuccgccccccaggcccucac

SEQ ID NO: 5781 - RNA, 99 nt, Homo sapiens
gguccuuaaacacugaaagagcugaaagggcaaaagacugaagacugaacauccugcuguagcagucuuuugcccuuccagcucuuuaggugugucacc

SEQ ID NO: 5782 - RNA, 85 nt, Homo sapiens
aaccgauaauuauugagcacugacucugugccaggaacauguacaaaguaccuggcacagaguaagugcucaauaauuguuaguu

SEQ ID NO: 5783 - RNA, 67 nt, Homo sapiens
guacguaucucccuccccacugcgcuguuuugucaauccugcguaguugguggggggagguaguuac

SEQ ID NO: 5784 - RNA, 69 nt, Homo sapiens
gcucgggggaugcagggccccacugucccuuagucagcaugaggccaaaaugggcccuucauccccagc

SEQ ID NO: 5785 - RNA, 83 nt, Homo sapiens
gcucgcuuuuuugcaagccuugggugugggaggguaauuaagaugccaacgguccuacacucaaggcauggaggagagaaagc

SEQ ID NO: 5786 - RNA, 64 nt, Homo sapiens
ugucgucagcuuugugcugcuucuugucacuuuaaugcaaagagacagcauggagcugauaaca

SEQ ID NO: 5787 - RNA, 72 nt, Homo sapiens
gcacguaggcgaacacgguggcgagccggacccacuucuuguuggucuuggccgccaucuucgccuucuugu

SEQ ID NO: 5788 - RNA, 71 nt, Homo sapiens
gcucugcagggcuuugguuguggcugcuucuccacugcucugcugcuugcucagccagagcccugccaagc

SEQ ID NO: 5789 - RNA, 116 nt, Homo sapiens
cagcugcuggaagguguagguacccucaauggcucaguagccaguguagauccugucuuucguaaucagcagcuacaucuggcuacugggucucugauggcaucuucuagcuucug

SEQ ID NO: 5790 - RNA, 77 nt, Homo sapiens
ugccuggccacggauccuucacccuggcuugacagcugguuuaaucugcaagccaggguggaaugcguggucuugca

SEQ ID NO: 5791 - RNA, 75 nt, Homo sapiens
gggcuucuuugaugaaaggguucuugguaaguacuguaccaaaagcagccugccacccuccuuucaaagauaccc

SEQ ID NO: 5792 - RNA, 62 nt, Homo sapiens
gugcucucagcaucccccauccccccuuaauugcagccagaggagaggaggagcugagucac

SEQ ID NO: 5793 - RNA, 66 nt, Homo sapiens
caccugggcuucagagguuguugcuaugucuggugacaguaagcccuaacuucuaaaaagucugug

SEQ ID NO: 5794 - RNA, 94 nt, Homo sapiens
cagcuggagucggggauuacccccugcugcugacgugaggacggugaacaaucgggaacguucgguggaagggggaauuccccgccgcucccug

SEQ ID NO: 5795 - RNA, 72 nt, Homo sapiens
gcacugcccacauuuccaaagaugccagucacugaacuccgaguggagcuggcuuguggaaguugggcuugc

SEQ ID NO: 5796 - RNA, 82 nt, Homo sapiens
ggccuugaggcaaguguauaugcccauggacugcauggugcuggcuuccacgauguaguccaaaggcacauacccucacgcc

SEQ ID NO: 5797 - RNA, 76 nt, Homo sapiens
ggccucugugugauauguuugauauauuagguuguuauuuaauccaacuauauaucaaacauauuccuacaguguc

SEQ ID NO: 5798 - RNA, 69 nt, Homo sapiens
guucuaaggugcaucuagugcagauagugaaguagauuagcaucuacugcccuaagugcuccuucuggc

SEQ ID NO: 5799 - RNA, 84 nt, Homo sapiens
gagcugguucuggagggugggucagugcacccgaggcucagagcauccauccaccccacuggcccuccuuccagauacccucuc

SEQ ID NO: 5800 - RNA, 83 nt, Homo sapiens
ggacuugaaguagggugcacccggaauugaccaauacaaacaguggacugcacuggauucuucuugugcccugucucauaucc

SEQ ID NO: 5801 - RNA, 110 nt, Homo sapiens
cuacugaguucccgaguucucuugauuauggucaaaaggcauagguggcuuuccagagugccaccugugcuuuuaaauuguaaucaagagugaucuauuauaaucuuuag

SEQ ID NO: 5802 - RNA, 158 nt, Homo sapiens
ugacuacuuuuucuaucucuucuuuucugugcuuagcucccucggggcuguucaaucaagacucaauaaaaauuguugaacuguucagauuuuuauugagagccuugaugcuauagccccacaggagcccacugaagaagggauuauccuuguuauca

SEQ ID NO: 5803 - RNA, 70 nt, Homo sapiens
gcccucucaggacugggucauucuguuccucgccagugggagagcaguggggccuggucccgagcguggc

SEQ ID NO: 5804 - RNA, 79 nt, Homo sapiens
ggacucaggaucuuuuggggaaauuugggaccucgcaggacaucugcacaauccauagaaaucccugagagccccuucc

SEQ ID NO: 5805 - RNA, 114 nt, Homo sapiens
gcucucucuaggcuccccuucuguucucucguuuuuuucgcccgcaggaacacuccaaguuccacaguuaaagaggaccgggagggcaggaauggguggggccuggaaaucagc

SEQ ID NO: 5806 - RNA, 110 nt, Homo sapiens
cgccucagagccgcccgccguuccuuuuuccuaugcauauacuucuuugaggaucuggccuaaagagguauagggcaugggaaaacggggcggucggguccuccccagcg

SEQ ID NO: 5807 - RNA, 103 nt, Homo sapiens
caccucucugcuucaccuuucuuuuagcaaagaugaggauuucuaccuucaacauacauuguuggucuugucuucuguuuuuguuaggagggacagcagugug

SEQ ID NO: 5808 - RNA, 73 nt, Homo sapiens
cagcugaacugggaggaucgcuugagcccagggguuugagaccagccugggcaacauagcgagaccccgucug

SEQ ID NO: 5809 - RNA, 90 nt, Homo sapiens
ggucugcaguggccuucucugaugacaucucagccuucguucugccugaaaugcuaagcguggcucagagucaucggacaaggucaaacc

SEQ ID NO: 5810 - RNA, 68 nt, Homo sapiens
aggcuugagaaucaaagcuucucccaagccucccaaaccgaggcuugggagaagguuucuuucucccu

SEQ ID NO: 5811 - RNA, 98 nt, Homo sapiens
gugcuucuagauggaguugggggaacauugugugcugaaucccuuucugaggacuugguguucacuuuucauacaugugccuuaacuucauuuuucac

SEQ ID NO: 5812 - RNA, 116 nt, Homo sapiens
acacuugcucaaauuaaugaccaaaaugucagauguguccacagcuaauuauucauuagaugcuuaauuagugugggaugaucaugacauuuuaauguuauuaauuuuuauacugu

SEQ ID NO: 5813 - RNA, 72 nt, Homo sapiens
uuccuuuggauugaugacuggcugggaggaguugauagucauuaacccccaacuucucauuaauccuucgaa

SEQ ID NO: 5814 - RNA, 65 nt, Homo sapiens
ggagaugcguuggggcaggggagguccagguaggcuuggcccgaccccugccccagcgugugucc

SEQ ID NO: 5815 - RNA, 119 nt, Homo sapiens
aaggcugccuuauagcaagaacagaucauguuuuuuccaauagugaauaugccacuaaaauucacuggcauauucaccacuggacaaaucauuagcaguacuugcuauaaggcaggcuu

SEQ ID NO: 5816 - RNA, 65 nt, Homo sapiens
ccugagcccucuucccuagugaucgggacugcugcaggaucugguucuggggaaggggguugggg

SEQ ID NO: 5817 - RNA, 102 nt, Homo sapiens
ccugggagggcuggugcuuuguggggucuccugcuagagacaccagaggcaggguagggcagagaaagcagagacuccagaaacaguaucagucuuccaagg

SEQ ID NO: 5818 - RNA, 96 nt, Homo sapiens
gcagauauuggcuuaugauggggucaauaucacgauuuauuuaacucuggagacaauaaaucuugauauugacuaaaaacauaagucaauaugugu

SEQ ID NO: 5819 - RNA, 70 nt, Homo sapiens
gccgcgccgccugcgccgggcucagucuuccucccccgaggcuaggcgagcgcaggcgcgggcggcgggc

SEQ ID NO: 5820 - RNA, 72 nt, Homo sapiens
uuugaggccacuagggaaccaguaaguguccugaaguaauaacuaacugaaugggacccuaguggccugaga

SEQ ID NO: 5821 - RNA, 119 nt, Homo sapiens
guugcuaagcugcuguuguuuaaauuaauggggcaacagggcugagugggaagggcuaaacuugacaggcgggcuuaucuagcucaauuccugagugccucauuuaguagcuuagggac

SEQ ID NO: 5822 - RNA, 58 nt, Homo sapiens
ucugcucagcuguuuuguuuccaggagccugagagagagacagaagcagcugggagga

SEQ ID NO: 5823 - RNA, 65 nt, Homo sapiens
aaggugauuaaaccagauguguugauuucuacagggguuuaagccaucguuggguuuaauuacuu

SEQ ID NO: 5824 - RNA, 73 nt, Homo sapiens
uccgccgccuccccaccucacccugcucggcuaguuuaaacagauccagcggugggcagaggggaggcgggga

SEQ ID NO: 5825 - RNA, 71 nt, Homo sapiens
agugugauuaaucaccauggauguaugauugagucaauugacuguuacuuuuucaugaugauuaaucagcu

SEQ ID NO: 5826 - RNA, 104 nt, Homo sapiens
guugauggccucaccaaguuuagucauagauacccaaggucagggagggccauuacccugugaaacuuuggggaucuacggcuggaccacguggggccaugagc

SEQ ID NO: 5827 - RNA, 59 nt, Homo sapiens
gcaguuuggaggagaaagugcggguugauuauugacccacgccuucuuucuucaaaugc

SEQ ID NO: 5828 - RNA, 69 nt, Homo sapiens
ggggcgcgcagcccggacuggccggaggcgcggccaccgcucuuggucgguccuuaggcugcgcggccc

SEQ ID NO: 5829 - RNA, 86 nt, Homo sapiens
ggaggggaggauacaagaggaaugauaaauggcaaggaaaaccacucacucuuaaugcuuuuugucauacucauguccucuugucc

SEQ ID NO: 5830 - RNA, 114 nt, Homo sapiens
ggaguaagugaacugacugguuuuuauuuuguuuuacugcuuuuaacauuacaguaacuguuacagguuccagcaggcuaacuggguggaaaugaguuugguuucacuuagucu

SEQ ID NO: 5831 - RNA, 114 nt, Homo sapiens; identical to SEQ ID NO: 5830

SEQ ID NO: 5832 - RNA, 90 nt, Homo sapiens
guuguaguuuuucagguuuucucucuugccuagcuccuguggauucacaucugagcauagaagagagagggggccauguaagaacuaaac

SEQ ID NO: 5833 - RNA, 70 nt, Homo sapiens
ccuguugcccucccucucagugccugaaguagaauauuaaaggcacgcagaggaggaagaggguaggagg

SEQ ID NO: 5834 - RNA, 72 nt, Homo sapiens
uucgccuaagauaguucuguauauucuucuguuaacuggguagcaaaagcauauagaaagguuuugggggga

SEQ ID NO: 5835 - RNA, 65 nt, Homo sapiens
uucgucauccuccugaggccuggggagagcucuaacaaccagacggccaaacagaggaugaggag

SEQ ID NO: 5836 - RNA, 79 nt, Homo sapiens
cagggcagggaucaggagggaggggaagaggcaggugucccaggccugucuccuggucccucccuccgucccugugcug

SEQ ID NO: 5837 - RNA, 62 nt, Homo sapiens
acugaugccccucucaggcccugagggauuuggccucagguugcccuggaaggggugugagu

SEQ ID NO: 5838 - RNA, 144 nt, Homo sapiens
gaugucaaaggugccgagaccuccuccacacgugccuggcuugccuucucccugaaugcugugggcacuugauucagucugcguauucaggcaggaagacagagaugggcugcgcgaggggguugaucugggagccuuugaauc

SEQ ID NO: 5839 - RNA, 90 nt, Homo sapiens
ccugaccccaccucggugugucugccugcgguuuccuucugucuccguccuuucaggauggaagcccagcugccaccugguggggugagg

SEQ ID NO: 5840 - RNA, 57 nt, Homo sapiens
acagugagaacuuuuccugaaaggggcugcuccacugcagggaaauguuuucggugu

SEQ ID NO: 5841 - RNA, 94 nt, Homo sapiens
guggguauuaugaccuaauaaugacaugcccugguaguuuggacugagugccauuaacugccaaggcacaucauugcucgucuauaauacacac

SEQ ID NO: 5842 - RNA, 58 nt, Homo sapiens
ggugagccauucuauuuagauucacgaccggcugagucaugauuggaaaugguuggcc

SEQ ID NO: 5843 - RNA, 69 nt, Homo sapiens
ccugcagcucccacucacucugggcugggaccguggucuggaugccagggaguggaaaggagcugaagg

SEQ ID NO: 5844 - RNA, 76 nt, Homo sapiens
acaggggagugggauggacugaggcugggugggauguggccggcacaccagccuccucuuuuccugacuuccaugu

SEQ ID NO: 5845 - RNA, 98 nt, Homo sapiens
guuguuuuccagccccaucugcccagacacagcccugugaagagagggccgaaugcagagccagggcuguguugacugcagaagggacggaagaaaau

SEQ ID NO: 5846 - RNA, 86 nt, Homo sapiens
aguggcggggcacaaggcgccagcggcgagcacuggcuugcuucacagugaacgccuucguugccuggcgacuagucccugcggcu

SEQ ID NO: 5847 - RNA, 115 nt, Homo sapiens
cuuguuggcacuggagcggggccugguguggugggggugggcaguggugagggggcaggggcuggcacagacauugcuggccccagaaugcugaggcccauucuuugccaggggg

SEQ ID NO: 5848 - RNA, 68 nt, Homo sapiens
gcugcugcgcgcaaccucuggggcaaccuccccccgcugcugcugccccagaggcugggugcaggggc

SEQ ID NO: 5849 - RNA, 77 nt, Homo sapiens
guggccucguucaaguaauccaggauaggcugugcaggucccaaugggccuauucuugguuacuugcacggggacgc

SEQ ID NO: 5850 - RNA, 66 nt, Homo sapiens
uaggagaggcuggccucaggagcuaaaaugcugggauuguguuccagcuccugccugccucugcug

SEQ ID NO: 5851 - RNA, 87 nt, Homo sapiens
gaggacugccugacuuucuggcugcccauauuuuuccagaugauaaggccagggaagagucagggagccagaugcuuggcaguacuc

SEQ ID NO: 5852 - RNA, 66 nt, Homo sapiens
ucugugcuagguacacuggucuuugugaauacuuugcaauugugcuggugauaacuauagcagaga

SEQ ID NO: 5853 - RNA, 88 nt, Homo sapiens
uuagcagagagucuagcugcagaggacccucaguugcucaaagcucauuuuuuaaugaggagucuucaucagcuagauacucugguga

SEQ ID NO: 5854 - RNA, 85 nt, Homo sapiens
ccagcuccccagcucccugcuccaaggcugcagcuaccuccggcuuuccgggcuggagcccaggcagcugggagccugggagugg

SEQ ID NO: 5855 - RNA, 116 nt, Homo sapiens
ccuguuccacagggacugcucuggccuggacuuuggguccuguggccuagaaguaaagggaccagaucuuagucaggccucaggacagaagccgagccagucaaaucuggaggagg

SEQ ID NO: 5856 - RNA, 126 nt, Homo sapiens
uaugacaggcaaaaugugggagcaggguauuguaaauaauucucagccaauucuaaaaauggcuugcagccauucuaaauauugccuaggaauuauuuauaaugccugauauaacauucugugaua

SEQ ID NO: 5857 - RNA, 77 nt, Homo sapiens
aguguugcauaggccugcugacccagggagagguuacgcaaacaucuggccuugggucagagagggcucugcaagcu

SEQ ID NO: 5858 - RNA, 103 nt, Homo sapiens
cuuggugugccugagaaagugcaaagaggagugggagaagaaaaaugccaaaaaauuuuugcauuccggccuccucuuucuagauuccauaggcaacacaaag

SEQ ID NO: 5859 - RNA, 71 nt, Homo sapiens
gcugaccaauggcaucaaagagcugggccccuacacccuggacaggaacagucucuaugucaauggugagc

SEQ ID NO: 5860 - RNA, 71 nt, Homo sapiens
acugaccaaugacauugaagagcugggccccuacacccuggacaggaacagucucuaugucaauggugagu

SEQ ID NO: 5861 - RNA, 58 nt, Homo sapiens
cgaguccugcugacuuccugcccagcagguaguggugaccaagggagucagaggaucg

SEQ ID NO: 5862 - RNA, 98 nt, Homo sapiens
cggggcuggcugucuucuacuuucucaugccuggguuuccagcccuugcuaugguggcucaggaacccaggugaggguggggcaaggcagcagcgcug

SEQ ID NO: 5863 - RNA, 115 nt, Homo sapiens
ugcguuuagucuuguguuaaacuguguuacuguucucagguuucaugccagcuuccugcggaagacuggccaaggcugaggacagcacaacaggaguccccuuaaggugaaggca

SEQ ID NO: 5864 - RNA, 91 nt, Homo sapiens
ccagccaguaugggugucaucccugucccccguggaggcuccuggaccucaggugcaggggcuucucuggugacagggucuguccuggugg

SEQ ID NO: 5865 - RNA, 87 nt, Homo sapiens
gauggucagguaaaugauguucaaagagaaacaacuagagcuuugaacuugagguuguuuuucuugucacaauuuacuuagaugguc

SEQ ID NO: 5866 - RNA, 86 nt, Homo sapiens
ucugggcugaagauggggaauaguuuuguucuuuuuuuauguugucagaagaaagagguggaugguuucccuucuuugcgccaaga

SEQ ID NO: 5867 - RNA, 71 nt, Homo sapiens
uuuguuccugagcugagcugcggggaaucacccuguuugaaauccucgaucagcucaugcuagagaagaga

SEQ ID NO: 5868 - RNA, 76 nt, Homo sapiens
ccugggcacccaguccccgggcagcaggcggguguuccccaaccuggcugcugcccggcugggcucggggcugagg

SEQ ID NO: 5869 - RNA, 79 nt, Homo sapiens
gcuggugaaguuccugccaccuugggggccccugugugagaagcuggcaggccucccgaguggcacgggcagcacaagc

SEQ ID NO: 5870 - RNA, 103 nt, Homo sapiens
cgugcggcggcggguccgcucgguccauuucugggcgcugcaagaucagcagaaaccugagaaagcgccuggaauaccgagcagcgauuggcccacccgggcg

SEQ ID NO: 5871 - RNA, 86 nt, Homo sapiens
gcaggaacaccccucauuuaugugugcaaauaggguaauuaaguguccaauuaccagauuugcauuggcaaaugggggcuuugugu

SEQ ID NO: 5872 - RNA, 79 nt, Homo sapiens
ggggaagggagccaagggcccuuauggaggucucuaaggaggagucaugggccuguuaggggcucuagcuuucuugucc

SEQ ID NO: 5873 - RNA, 56 nt, Homo sapiens
ggagugguuggguugcauuuggugcuaugacacauuaagugcagcccacccaaucc

SEQ ID NO: 5874 - RNA, 99 nt, Homo sapiens
ccugcccucagagcccuaccaccaguguugggcauuggggcuaggcuggagcugggcucugagcccagagcugguggugguuuccaggccugugggagg

SEQ ID NO: 5875 - RNA, 59 nt, Homo sapiens
cucgucguaguggaggugcagcagcugcaggugcaggagguggacuccauggugaagag

SEQ ID NO: 5876 - RNA, 89 nt, Homo sapiens
ggugaaaucagccagccagguccugcaggaaagaucuuccucccaaagaggacacaccccuugugcagcaacucagcuggcuuuuggcc

SEQ ID NO: 5877 - RNA, 85 nt, Homo sapiens
cuggccuccccccacccccaugccgcgugcuccuggacgcgcuaauaugcucagucacugcggcugugggugaggggacggacgg

SEQ ID NO: 5878 - RNA, 67 nt, Homo sapiens
uucgugugcuagggccagaucaucccaggaauucugggauaggaggucugaguccaugcagcaagaa

SEQ ID NO: 5879 - RNA, 116 nt, Homo sapiens
gcagccucccucuuccgaggccuggaggagcucccggguggcucuucucucccaccgccuucucaggagccccuuggagcaucucacugucauccggcaagaggauuugaaggugc

SEQ ID NO: 5880 - RNA, 79 nt, Homo sapiens
gguggacagggaguuaguuaaugaccauccccuagagaugacuuuccaaggugguuauuauguggcucaaugauuaacc

SEQ ID NO: 5881 - RNA, 85 nt, Homo sapiens
gcaguuccuuccuuggguuuaaggauuccccaaugccagauguuaagucugcuaggaaaucuguagaccacagggaagaaaaugc

SEQ ID NO: 5882 - RNA, 85 nt, Homo sapiens; identical to SEQ ID NO: 5881

SEQ ID NO: 5883 - RNA, 71 nt, Homo sapiens
uggguccagacugggugagaaccgccaggacagaggcuugcuguccugguucugcacuugguccugagcca

SEQ ID NO: 5884 - RNA, 85 nt, Homo sapiens
aggggagugagaggaggggaggguccuggaagggcgggugcaaccucaacccagcggaggacccugcugaccugcuuaguuguuu

SEQ ID NO: 5885 - RNA, 68 nt, Homo sapiens
cugggcucuguuguguggccucaugugccagguugacuuugggacagaggcacagaugauaggcacag

SEQ ID NO: 5886 - RNA, 78 nt, Homo sapiens
gaggccuggaauuccgaauggccccagucccgggaaccgaacgccuccugguuguggccacuuggauuucuugggcuc

SEQ ID NO: 5887 - RNA, 79 nt, Homo sapiens
gggggcugcuggggggcuacugacagaggagacaucuucauccaucucucugugagaugccuuccugagccuugcgccc

SEQ ID NO: 5888 - RNA, 74 nt, Homo sapiens
gugguguccuacucaggagaguggcaaucacauguaauuaggugugauugaaaccucuaagaguggaguaacac

SEQ ID NO: 5889 - RNA, 74 nt, Homo sapiens
gcagugucuggccuucccccugaccugcugauguauuuuuggccucauuaguagucagggagaugccuuagugc

SEQ ID NO: 5890 - RNA, 95 nt, Homo sapiens
cugguccuuuccccugccaaagggagggauggaggcccugaggacccaggcucuuccuucuucauccuucuugcuggcagcacuggaggaagcag

SEQ ID NO: 5891 - RNA, 83 nt, Homo sapiens
gcugcuguugggagacccuggucugcacucuaucuguauucuuacugaagggagugcagggcaggguuucccauacagagggc

SEQ ID NO: 5892 - RNA, 81 nt, Homo sapiens
ggagcugauuuuguaugaagcaaaacuaaucagagcuucugagcagcauguccugguuuuguuucauacaaaacagaaucc

SEQ ID NO: 5893 - RNA, 100 nt, Homo sapiens
gauguccugaugucacauuugccuugccuuuagugccucugaggacagauggagaacugggucaggggagggcagaaaggaggaaagcauugggaaaauc

SEQ ID NO: 5894 - RNA, 79 nt, Homo sapiens
acugucuguuggacagagggggaaauccagaaaggauuaguacucauucuggauuuucccuauggcuagcagguaaagu

SEQ ID NO: 5895 - RNA, 92 nt, Homo sapiens
gcugggaugugucagguaggcaguguauugcuagcggcuguuaaugauuuuaacaguugcuaguugcacuccucucuguugcauucagaagc

SEQ ID NO: 5896 - RNA, 76 nt, Homo sapiens
guugcuuuuuuagcuguaguuauuauauuccugaucugauaaaggaguugcagcugcagcuaugaagagaugggac

SEQ ID NO: 5897 - RNA, 86 nt, Homo sapiens
cuggugugcuuuucauuuugugaaagugaaggagauagaccguagcaaccacccucacauuuacacaguggcagcgcaaaccacag

SEQ ID NO: 5898 - RNA, 78 nt, Homo sapiens
ucugacucaguuuucgcaggaucccucuggcuacuugugcggguagaugauaggaggugggguggaggcugaggagga

SEQ ID NO: 5899 - RNA, 78 nt, Homo sapiens
uaggaagagagugggagagaaacuuugggcuuugaaaauguauguuguguuccuaguuucagucccagcuuucugcua

SEQ ID NO: 5900 - RNA, 65 nt, Homo sapiens
cuggauugcucucucguuucuuaauguuuuguucaugcaaacauuaagauccagaagcaagacag

SEQ ID NO: 5901 - RNA, 88 nt, Homo sapiens
gccgauguuaggaguugggagagauggaaagcaagauagagucacuuuauuucuugcuuccaacucucauuaugucuauuacacaggc

SEQ ID NO: 5902 - RNA, 88 nt, Homo sapiens
ccagaugccagucacugccuaaggcacuggguauaugguauccccaaacaagaggcauaaucccaguccuuagguagugcuagcaugg

SEQ ID NO: 5903 - RNA, 79 nt, Homo sapiens
cuggauuaacucaagaugacagcaggacuggcaaugaaaaggaagacugccagucaugugcuguuauuuuugaagacag

SEQ ID NO: 5904 - RNA, 92 nt, Homo sapiens
ugggagcugagcgguuucuauggagaugggaauuagugaggaagugcuuuccuuuugauuauucuccauccuaauagggacaauugcaacca

SEQ ID NO: 5905 - RNA, 68 nt, Homo sapiens
acagaagccacuuagagcguaauauuaacacuguacaucaaugucgucccgcucuaaguggcgcaugu

SEQ ID NO: 5906 - RNA, 99 nt, Homo sapiens
acugaacacuguucuaugguuaguuuugcagguuugcauccagcugugugauauucugcugugcaaauccaugcaaaacugacugugguagugaaaagu

SEQ ID NO: 5907 - RNA, 122 nt, Homo sapiens
acugaaugccugaccccucagaauggccauucucuugccugccucuccagcucucuguagugacaucugagcaugccguggggaggcaggaggggaggcuugcuggaucucuugguggaagu

SEQ ID NO: 5908 - RNA, 100 nt, Homo sapiens
agagaaacuugggagcuuuuaguguuccuuuuuccugauuaaaugcagaucacauaagggcucuuaaugggagaaagggaguacagcucccaguacaucu

SEQ ID NO: 5909 - RNA, 75 nt, Homo sapiens
gcagaacuauauagcaguuuuaggagaucuguuggugcccagcaagagcuccaaacgggcuauaugcagggaugc

SEQ ID NO: 5910 - RNA, 70 nt, Homo sapiens
aaagaaaaccuuaguauuauuaaugaguuuaccauagaauuguuggaaauacugaagacaggugcaauuu

SEQ ID NO: 5911 - RNA, 104 nt, Homo sapiens
ugggaaaaaggugcuuugagggcauagaucaauuuaucucuuguccagugcuaugaccaggacaggagauaaauugaucugugcccucauuuacuugacaacca

SEQ ID NO: 5912 - RNA, 73 nt, Homo sapiens
ggagaaaauggauuuguaggaggaagggauaaauaaaaguucucugucccuuuucuacaaauuuuaaauaucc

SEQ ID NO: 5913 - RNA, 89 nt, Homo sapiens
gcugaaagugguaaaugccagccugcucauuacagcaaaacaaacaauaccaagguacugauuugagcagugcuggcugccucggaagc

SEQ ID NO: 5914 - RNA, 97 nt, Homo sapiens
ccugaauggggcccacccuguugagcaacuggccaucccaguggcacauauugagccuggugggggguggugcaguuucaaugggguugggucaagg

SEQ ID NO: 5915 - RNA, 171 nt, Homo sapiens
guggauggcccacugcccaucuggacacccuuccuaugccagcugauccccuaagcccuaggcuuccaucauaucacugaccaaagcauagggcaguuugagugggggucagaggccuggggggucucuggcuggaaggacuugguagucuuuucuaaggugggucuacac

SEQ ID NO: 5916 - RNA, 82 nt, Homo sapiens
guggaugguuugaaguaguugguuuaggaguuuggacccaucugauagggcauaaacccuaaggacuacaucagauugacau

SEQ ID NO: 5917 - RNA, 76 nt, Homo sapiens
ugggcuggaggccuguguuccuucccauaagcagggccugugggguguauggggcagaacauaggccuccacacca

SEQ ID NO: 5918 - RNA, 94 nt, Homo sapiens
ugggccagggccccagagcuccugccugagcuggaccuuaugcaaacauuucugugccugcuggguaggggcacgucugaggggcccugcucca

SEQ ID NO: 5919 - RNA, 84 nt, Homo sapiens
ggggccccuggugcugcuguccucuuugcuuggucugaugggagaaugggagggcagggaggaaggcccugugccagggcuccc

SEQ ID NO: 5920 - RNA, 86 nt, Homo sapiens
ucagcuuccuucugugaguggacugcacuauggucucuacucaaguaaaacucgauuuugucaguucggcucaaggaggaaaauga

SEQ ID NO: 5921 - RNA, 88 nt, Homo sapiens
uuggcuauaucucugcccucucugggccuugauucuugguccuguugguuugggaagccaggguggaaggggucugagguguaaacag

SEQ ID NO: 5922 - RNA, 72 nt, Homo sapiens
uaggccaacugguagcuuuuuauugacugcagaugguuacugaguaugcaauaaaaaacuuccaguugacua

SEQ ID NO: 5923 - RNA, 77 nt, Homo sapiens
ggugccagguucucagucagcugggggugagcagccuguuuuccggaagcaccccaggugacccugaaccugcugcc

SEQ ID NO: 5924 - RNA, 81 nt, Homo sapiens
gcagcaugcagagguggcugcacacugggccgagugucaggagaugaggcccaccucuguguggucacccauugcauaugu

SEQ ID NO: 5925 - RNA, 111 nt, Homo sapiens
acagcugguuccaccccugauucuacaauggauuugcucugugaccuugggcauuuuauuaaagcucuuuggcacugagcagcaucuguaaaauuggggcaguaucaaugu

SEQ ID NO: 5926 - RNA, 70 nt, Homo sapiens
ugggcugugguugcuuccagugccuguuuagaauuauucagcaggcauggaagcaauaaaaaacauucca

SEQ ID NO: 5927 - RNA, 76 nt, Homo sapiens
cuggcuuguuggggaucaugguuauauuccuacuagauaauaaaaggaaaaaugacccugagcccuuuuaacacag

SEQ ID NO: 5928 - RNA, 68 nt, Homo sapiens
ucagcagcuaaagagacaaucugaugugugaugucuuaacuuugccaucuauugcucuuuggugaugg

SEQ ID NO: 5929 - RNA, 83 nt, Homo sapiens
ccagcaggcguggggccagggacgucaccaacuuuaaagagugacugauaguuggcuucgucuuugaucccauagcuaaaugg

SEQ ID NO: 5930 - RNA, 70 nt, Homo sapiens
caugcaggccuggggcuggaggaguucccgagguguggucucaggaaaugccucuggccugguaaagaug

SEQ ID NO: 5931 - RNA, 80 nt, Homo sapiens
cccgcccccaacucagagcguccucuuccaccccaccccagcgggugucauggguagaggccuccugaguuguuacaggg

SEQ ID NO: 5932 - RNA, 147 nt, Homo sapiens
ccugcuguugaaagagacccucuucauauauacaacauucagguaauugcuucuaagcuuacuugaaaggaagcuuaucccuauuuuaaaugagauuagaaguccugccugaguguuauuuuggucucagugccuuucaaacaaagg

SEQ ID NO: 5933 - RNA, 86 nt, Homo sapiens
gcuggcucaggcuccuuaaacuaauauuugccucuuggccccuagcagccacagcugaggguaaauauugguuuagccugggaagc

SEQ ID NO: 5934 - RNA, 77 nt, Homo sapiens
cgcggcgggggaccgagagggccucggcugugugaggacuagaggcggccgaggcccgggccgguucccccgaggcg

SEQ ID NO: 5935 - RNA, 81 nt, Homo sapiens
gccgggagcuguggaagggcuggccaggagggaggaagagguauuuuuuccuccuuucuaguuaccauuuugcagcucggc

SEQ ID NO: 5936 - RNA, 69 nt, Homo sapiens
uggggagaaagguaucaucugcugucucuuuacuccuaauaccaacugcagcgaugcuguuucuuucca

SEQ ID NO: 5937 - RNA, 96 nt, Homo sapiens
caggguggggggcagccaguccagaggagcugagaguagggcagggaguugacucccugagucuuggcuucuuggcuguguucccucuccgaucug

SEQ ID NO: 5938 - RNA, 86 nt, Homo sapiens
gcuggucaggaaccagcacagaccucaggcugugucuaaaacaaggugacugcacaugcaggagccugugcugggcccuggagagc

SEQ ID NO: 5939 - RNA, 74 nt, Homo sapiens
aggggaguugcgggcuuuugguucacugucaccugggaaaagguguugucaguguccggacccucaacuuuccu

SEQ ID NO: 5940 - RNA, 57 nt, Homo sapiens
gcuggagaggaaagcaugguuccuuucuuaaagaaaucuuccauguuuucucuaagu

SEQ ID NO: 5941 - RNA, 58 nt, Homo sapiens
cugggagcuuuugcuuucuacuuuaagaauaaaauuggaugggagcaguggcuuucag

SEQ ID NO: 5942 - RNA, 69 nt, Homo sapiens
uuggggagaugagaccuacuaauaugcugggugucuacagcagcauaauacaggguuuauuuuuuucaa

SEQ ID NO: 5943 - RNA, 105 nt, Homo sapiens
cuggggcaaggacacauuaaacuggucccugugggucaggucugagugggggaggaccuccccuccccacugccucccacaggggcuugugaugcaggguuucag

SEQ ID NO: 5944 - RNA, 78 nt, Homo sapiens
ccugggcgucuggccacugccugacccucaaaccaaggggaguguccgagagucaggcaggagggccaggugcagagg

SEQ ID NO: 5945 - RNA, 88 nt, Homo sapiens
agcggggucacuggaagaagagauggugguugugcagccaacugaaaugcauacugcauaacaccaacauuuuuccacagugcuagcu

SEQ ID NO: 5946 - RNA, 69 nt, Homo sapiens
gcuggcaccugccucugcucuccccuccucuugccgagaaggcaggaugcggaauggcaggugaaaggc

SEQ ID NO: 5947 - RNA, 117 nt, Homo sapiens
uccggaucaagauuagaggcucugcucuccguguucacagcggaccuugauuuaaugucauacaauuaaggcacgcggugaaugccaagagcggagccuacggcugcacuugaagga

SEQ ID NO: 5948 - RNA, 138 nt, Homo sapiens
ggaggacauguguuaagauggguccccagggguccagggcugauuugcugggguugcugggucugcucugcagauugcaggcugauugcagcagauuagcugggaccuaaaaggggccuugucacagcccaugaaucc

SEQ ID NO: 5949 - RNA, 70 nt, Homo sapiens
aguggaaacagcucagucacagggugugaauuugaguccuggcucugcuuugugacugggcuugagaacu

SEQ ID NO: 5950 - RNA, 114 nt, Homo sapiens
ucuggaccagggcuguccccugggccgugagugccgggcguggagagcugguguagaugacauuuguagcuccacaugcccuggccugggcgccaaggacagccgcagagaaga

SEQ ID NO: 5951 - RNA, 67 nt, Homo sapiens
cccgguuuucccagcaccuccuccugcccuacucuucaguauuaauuggggugugcugggagaaggg

SEQ ID NO: 5952 - RNA, 91 nt, Homo sapiens
gaggugggggccgcagaggggcuugaggcccugauggccaaggaagacggagccaggggcagggccaugggccucguguggccccccgcuc

SEQ ID NO: 5953 - RNA, 55 nt, Homo sapiens
gggguggggaaggaggucacagccaagaaaacugcccugugacgacuucccuccu

SEQ ID NO: 5954 - RNA, 83 nt, Homo sapiens
guggucucagaaucgggguuuugagggcgagaugaguuuauguuuuauccaacuggcccucaaagucccgcuuuuggggucau

SEQ ID NO: 5955 - RNA, 109 nt, Homo sapiens
uggguuauuucaacaucuaauucccauuuaacucuucuuguuuucacuugucuggggacaggcaugaauuugaacagaguugaauacgaaaugauguggaaauggucua

SEQ ID NO: 5956 - RNA, 109 nt, Homo sapiens; identical to SEQ ID NO: 5955

SEQ ID NO: 5957 - RNA, 83 nt, Homo sapiens
gauguuuuaaucucagguaaaugccaaucaggagacaaacacuuguuuaucuccugauugguauugaucugaauuaagcuguc

SEQ ID NO: 5958 - RNA, 124 nt, Homo sapiens
ggugucucagucucucugagccucagucuauaaaggggucacagacuccugguagccagugaacagggugguuguuuuuggggguggguggccccuagggcugugcagggaggccugggguacc

SEQ ID NO: 5959 - RNA, 81 nt, Homo sapiens
cagguuucacccagacuccaguuugagccuuuaaaacuguagaacagggaugguucaugcagaggucugggauggagucug

SEQ ID NO: 5960 - RNA, 74 nt, Homo sapiens
acuguucuggcaagcacuguagggaugcauagggucacugcagaccuaagcaugcuggaggcuugcuaguaagu

SEQ ID NO: 5961 - RNA, 82 nt, Homo sapiens
agaguuuaaucaugagcugguaggucaugcagcugccaauaaucuagggggugcugacacuuccggcaugauggauauaucu

SEQ ID NO: 5962 - RNA, 90 nt, Homo sapiens
gauuaauugaguaccaguuaguuaaguuuggaugcauggaugcaucaccuuaaauguauccaagcuuaacuaacugguauucaauucauc

SEQ ID NO: 5963 - RNA, 74 nt, Homo sapiens
cucuccagagguuuucauguuugucucuuccaacaguuguuugaggagaagagagacaugaaaaccuuugggag

SEQ ID NO: 5964 - RNA, 65 nt, Homo sapiens
uuuuuauuuaccugagagaaccaggcuguccuuaggugccaacuggucucucagguaaauaugaa

SEQ ID NO: 5965 - RNA, 66 nt, Homo sapiens
ccaucuucuaggcagagggacagcagaacaugaacagugacccaagcauucucugccuagaagugg

SEQ ID NO: 5966 - RNA, 71 nt, Homo sapiens
ggguaccuggccaggccccuugcagggcagaaccucaggugaaugggccucucagggucuggccggguccc

SEQ ID NO: 5967 - RNA, 69 nt, Homo sapiens
uagugaccuuugaacagcccagggaugcuucacagugucuuauucuugaugcuuguuuaaagguuucua

SEQ ID NO: 5968 - RNA, 73 nt, Homo sapiens
gaguaaggaggaaaguaguaugggaugaugcuggagaaggagcagagucagaccacagcuuuccuuuuuuuuu

SEQ ID NO: 5969 - RNA, 68 nt, Homo sapiens
gguucaugaauuccugcaguuucagcugucaggacuuuucaagcagaaaugccaggaauuuauguacc

SEQ ID NO: 5970 - RNA, 113 nt, Homo sapiens
cuguggucguggcugagcaguaccugacucugaccaaccucugccucuaauuaguuacaacacaauuuagaacccgggaugguuggcguuugggacuugcagccacggcccag

SEQ ID NO: 5971 - RNA, 132 nt, Homo sapiens
uccugcuggggagggcauggaguauuucagaguaggaaagaaugagggagaggauagucagauaaaucaaaguuucauucuuuuccuccucuuucuuagcucgucaaauccuacacuuucucuccagcugga

SEQ ID NO: 5972 - RNA, 77 nt, Homo sapiens
guguacacuucugauguuauccucgcucacaugucaccagcuugcaacuuugagugggaugaguuagagguguccau

SEQ ID NO: 5973 - RNA, 66 nt, Homo sapiens
uucuuuuuguuuaguguuuuggggccucuaguucuaguagguaaccaauaaauuaagcaaaacgaa

SEQ ID NO: 5974 - RNA, 66 nt, Homo sapiens; identical to SEQ ID NO: 5973

SEQ ID NO: 5975 - RNA, 94 nt, Homo sapiens
ugauacuguaaacaacugacacagccauggaggaguaguguaucugaaauuguuuauacaaaagaauuccaucugucagucuguuuauaguuca

SEQ ID NO: 5976 - RNA, 90 nt, Homo sapiens
uccucaggacaaacuuguucuguuccugaugauucuucuggaacuauagucaaugaaaucaucacgaacacaacagcguuuguucuggga

SEQ ID NO: 5977 - RNA, 66 nt, Homo sapiens
ggcugucugcagcacauagauuagaauaaagggcuugcuuaguguuugugaauguugcggauugcu

SEQ ID NO: 5978 - RNA, 104 nt, Homo sapiens
gguuccuaaggaagaaguacagguaguagguugcguaguuugaggacagggauuuuauccacaaggagguaauuauaugaccugcugcuaccuuucuuagggcc

SEQ ID NO: 5979 - RNA, 95 nt, Homo sapiens
gucugucuccuaucccaggacugcuaagcaguugccuugauuuuaguagggaguugucaggaguaccugcuuauugcagucgaugggagauuggc

SEQ ID NO: 5980 - RNA, 76 nt, Homo sapiens
gcuucagccucaaguggggauuggguugcaguggugaaccagggccaacacagcccgcccucuuugagguugcagu

SEQ ID NO: 5981 - RNA, 66 nt, Homo sapiens
uggugacagggauguggugguggaggcuucugccucuagcuuucuaauccucccauucuuguccca

SEQ ID NO: 5982 - RNA, 119 nt, Homo sapiens
gaguguuguuuuggguagagauuaaucaagcccgguguucagacuucccucgguguugcugauuuuagaagagucugaugauaucuugcuugauuuuaucaugaccuuaaaacaaucuc

SEQ ID NO: 5983 - RNA, 67 nt, Homo sapiens
gaguaucauaaagauggcgauuguauaucacuuuccagugaaauugcuugccuuccuuuaugauuuc

SEQ ID NO: 5984 - RNA, 64 nt, Homo sapiens
gcuuuucucaugacacauccacaguuuggccuguggucucagcuggaaucaucaugggaauagc

SEQ ID NO: 5985 - RNA, 76 nt, Homo sapiens
gucugcuggggcccugaggccuucccccuacccugcugcaauuggaagccuggauggagggccuggccccagcgac

SEQ ID NO: 5986 - RNA, 79 nt, Homo sapiens
cauucacagcaccaguuucuaccuggcagcacuaguuccaguugaguaucugucagguacugucugagugcugugcaug

SEQ ID NO: 5987 - RNA, 86 nt, Homo sapiens
cucuguguccugccagugguuuuacccuaugguagguuacgucaugcuguucuaccacaggguagaaccacggacaggauaccggg

SEQ ID NO: 5988 - RNA, 72 nt, Homo sapiens
cuuucaccuucugacuguucugucuauagcaaaccauagagaguuuuucuggacaguccaggaagguguaag

SEQ ID NO: 5989 - RNA, 70 nt, Homo sapiens
uggugagccuggaggaagacuugcauugggcccaauggcccuggaccagugucugucagccagguuccca

SEQ ID NO: 5990 - RNA, 81 nt, Homo sapiens
ucauggagggaaauaggaucagggguuuggggugaguggccucgcuugcccccggacuccuggcccuccuuuuuucccugg

SEQ ID NO: 5991 - RNA, 59 nt, Homo sapiens
agcuggcagcucucagggguacgugaguccaggcugaucucauccuuggggcugcugcu

SEQ ID NO: 5992 - RNA, 72 nt, Homo sapiens
gguugggagggguggcagagugguaagagauguuaucaauaaucucccuaccucuucuccucccucccugcu

SEQ ID NO: 5993 - RNA, 69 nt, Homo sapiens
gaguauguggggugggaggugaggggaagaggaucccucuucucuuucuccuuccuuuuccuauaucuc

SEQ ID NO: 5994 - RNA, 92 nt, Homo sapiens
ggaugugaggagugaggaagaggggugcuggacugggagaaagaaguaaagguagaucccucagcaucaaccucuccuuccuccucauuucc

SEQ ID NO: 5995 - RNA, 79 nt, Homo sapiens
gccuccgcuccgugacucacuggcaaagaucuugcugcauaggaucaguuuguuuuuuucagggggguuggaguggggc

SEQ ID NO: 5996 - RNA, 66 nt, Homo sapiens
aaguggcuuuuaagcaauuagaccaagcacugggcacuuucaaaucuaauuguuucaaaagcccuu

SEQ ID NO: 5997 - RNA, 128 nt, Homo sapiens
guguccccuauugacucccuggggcuggucacucaguuuuuggccucugcugcaucccucauacuguuccaaguguggcagggggaauugagaggccccuccucaagccuuggucaugauagggguac

SEQ ID NO: 5998 - RNA, 107 nt, Homo sapiens
cauuuuuuauuggauagaaaagggucauaugacucuggaaaacugugugccugaaaaaggaaagcaggauugucauaauggcucauuucugcccugaauaaaauaug

SEQ ID NO: 5999 - RNA, 87 nt, Homo sapiens
accugcuuuuuaucuuauuucaagacaccaauaagcaccucugugugugguguuuauuggcaucuuaaaauaggagaaaaaguuggu

SEQ ID NO: 6000 - RNA, 78 nt, Homo sapiens
ggaugagguggagaggagauggggugcagagagaagggacaauccuccagacucacccucauggccucccacuucucc

SEQ ID NO: 6001 - RNA, 59 nt, Homo sapiens
ggcugacaauggcuccuugugucugugccgacggugggagaggggagguauuguuugcc

SEQ ID NO: 6002 - RNA, 75 nt, Homo sapiens
ucuuggauguuugggcccugaaagcacgcaugaucagcccuguuccuguguccuuucagggccuaacaucccaga

SEQ ID NO: 6003 - RNA, 101 nt, Homo sapiens
gccugcaggugcccuccacagggcacacaggugcaccccgccccgacguagaagcccaggugcaccugugugcuaaggucagggggugcaugccugcuggc

SEQ ID NO: 6004 - RNA, 80 nt, Homo sapiens
uccuguuuuucucuuccuauagauguugggugugucaaaguagagauguccacacaucuaucuugggagaaaaaacugga

SEQ ID NO: 6005 - RNA, 58 nt, Homo sapiens
gguuggcuuucccugugcacuagggcccugcugggccuucaguggacaugaagcuacc

SEQ ID NO: 6006 - RNA, 75 nt, Homo sapiens
accuugcugucugaaugcuguugcuugccauuggacuauucuggaacaggaaguauagcauucuaacagcauggu

SEQ ID NO: 6007 - RNA, 83 nt, Homo sapiens
ucaugcuguggcccuccagagggaagcgcuuucuguugucugaaagaaaacaaagcgcuccccuuuagagguuuacgguuuga

SEQ ID NO: 6008 - RNA, 138 nt, Homo sapiens
ugauuucuacgguuagauugaaggugagggcggauguggcucagaggcaaugucaggaaagaggaagcauaguacacaccuccucuuuccucaaguugguguuggaaucugucccacuuugaacucaaguggaauuca

SEQ ID NO: 6009 - RNA, 76 nt, Homo sapiens
cagucccuggguacuauaauuugcauugcaauaugaggcuuccauuuaaugcuugcaaauuaugggaccagggcug

SEQ ID NO: 6010 - RNA, 74 nt, Homo sapiens
gccuuuaagaucagggacucugucuuuauuauggugacacaugggagugaaauagagcccuuguucuugauggc

SEQ ID NO: 6011 - RNA, 70 nt, Homo sapiens
ggaucaggaguuggggcauggggcauuuugaguuucgugcuuauguugccuuccccccaucuuuugcucc

SEQ ID NO: 6012 - RNA, 71 nt, Homo sapiens
ucuugguuuuugcccaccugggagucaaagcuuugaaugcuuauugauuuucaugggaagcaagaccuaga

SEQ ID NO: 6013 - RNA, 69 nt, Homo sapiens
gugugaauauugcuucuauuuguuuuauacuugccguggugauuguaggggagagaagugauauucuac

SEQ ID NO: 6014 - RNA, 78 nt, Homo sapiens
cucugaacggcauuucucauuagcaacagacacuaaguuaauguaguuuguaguuaaugagucugugcuuguuuugag

SEQ ID NO: 6015 - RNA, 80 nt, Homo sapiens
ggguccaggcugagggcggggaucccuggcuuugggaaacccuccucagacagggcuccccgcaccgcagcccuggcccc

SEQ ID NO: 6016 - RNA, 78 nt, Homo sapiens
gugugcccugcgggaugccccgagggcuccugcuuguguugccagcaccugcccuugggagccgucagcuggggccac

SEQ ID NO: 6017 - RNA, 65 nt, Homo sapiens
auguccuguggcuguauuuggccagagcuggaugcuccuggugaaaugccagccaaagcaggcgu

SEQ ID NO: 6018 - RNA, 74 nt, Homo sapiens
gcguggcucauaguaagugcauaauaaauguuaauuauuuuuauucauuuauuaaauacuuacugagagucugc

SEQ ID NO: 6019 - RNA, 67 nt, Homo sapiens
caguggagaagggaccgggaaggaaguaauuggaaaucucucuuccucccagguucuaucuccucug

SEQ ID NO: 6020 - RNA, 68 nt, Homo sapiens
ggauaucauaaagguggcgaugguaugucacuauccggugaaacugcuugccuuccuucaugauuucc

SEQ ID NO: 6021 - RNA, 72 nt, Homo sapiens
uauucccugacagaugagggaguauucucaggcagaccucuagaaucacuguuuccaucuaggcagggugua

SEQ ID NO: 6022 - RNA, 75 nt, Homo sapiens
caguccaggccauccugccagcccugggccacaucagcauuaucagguuuggguuaguaggaugauccuggccug

SEQ ID NO: 6023 - RNA, 72 nt, Homo sapiens
ucauggagucuccuaauaugaguaagauuucaccaggaccucuauuuccuggcucauuuaggcagcuucuga

SEQ ID NO: 6024 - RNA, 128 nt, Homo sapiens
ccaugggcucuugucuccuguucccugucccauuucuuuccauuucucccacuacccagcauggucugggcccuccagccugcuaccggggugggggagaggggggcggagcacggggaagccccugg

SEQ ID NO: 6025 - RNA, 116 nt, Homo sapiens
ugguggggggagcugggggcgcgggcagacaggcagcaggagggagucgcaaagccgugccuggucucguuuccucgcucgccuuuccccugcgcccccucccugcacccccucca

SEQ ID NO: 6026 - RNA, 64 nt, Homo sapiens
gccugcaggguuugcaucaauuacucgacgacauguggaaaaugauugaugagcugccugcggc

SEQ ID NO: 6027 - RNA, 71 nt, Homo sapiens
guguagggguaggggaauggagccaggaacugcucaguccugcaacgacaucccuuucccuuccuuuccac

SEQ ID NO: 6028 - RNA, 84 nt, Homo sapiens
ggcuccugcuguccaggcuugggcccugcguguuuccggcaggggcagccaagaagcagguggggcuguugggacugcaggguc

SEQ ID NO: 6029 - RNA, 83 nt, Homo sapiens
ucguggugguuuccuuuugucuccuuuauuacaugggacucugacaugugcccauagcuagggugacaguaggaucuacccga

SEQ ID NO: 6030 - RNA, 83 nt, Homo sapiens; identical to SEQ ID NO: 6029

SEQ ID NO: 6031 - RNA, 83 nt, Homo sapiens; identical to SEQ ID NO: 6029

SEQ ID NO: 6032 - RNA, 83 nt, Homo sapiens; identical to SEQ ID NO: 6029

SEQ ID NO: 6033 - RNA, 83 nt, Homo sapiens
ucguggugguuuccuuuugucuccuuuauuacaugggacucugacaugugcccauagcuaggguggcaguaggaucuacccga

SEQ ID NO: 6034 - RNA, 69 nt, Homo sapiens
gugugagaagaggcacaaaugcuacacuggaagugaaaacagagucugcaauugugcuccuuucucuac

SEQ ID NO: 6035 - RNA, 87 nt, Homo sapiens
gguugccaaucuguucugugaucaaguucucugccuuucccuuccuccuugggucagaggaccuugauacagacagaucuugguacu

SEQ ID NO: 6036 - RNA, 73 nt, Homo sapiens
gggugggagaugagaagggccaaaaggugaauguaugcaccuguuugugugccucuugucauccuuccuuccc

SEQ ID NO: 6037 - RNA, 72 nt, Homo sapiens
uauuuugccuaagaaucucucugauuauccgacacuuggagguauucucgagagauucauagcagcaaugua

SEQ ID NO: 6038 - RNA, 67 nt, Homo sapiens
guauguaaagcuuucagugcaaugccuuguauuuggcaagugcauuguaaaugggaguauuaucuac

SEQ ID NO: 6039 - RNA, 109 nt, Homo sapiens
cuguugcgcuguccuuccucuggggagcaggcuccgggggacagggaaaagcacacaaggaacuuguccucuagggccugcagucucaugggagagugacaugcaccag

SEQ ID NO: 6040 - RNA, 67 nt, Homo sapiens
uuguuaccuccuccucaaugaggcuguugggaaacacuucaaacagucuguuccggagggguaccaa

SEQ ID NO: 6041 - RNA, 81 nt, Homo sapiens
gccucuccuuccagcucgagacugacucugacucauggggcagcuccugugcgcaggggagucucagguggguggggcggc

SEQ ID NO: 6042 - RNA, 78 nt, Homo sapiens
cgaugggauggaguccuucaguccagagguuagggaauggugucugagaaaguuugggcugugggaauccuucuuucg

SEQ ID NO: 6043 - RNA, 111 nt, Homo sapiens
ggguggggugggugugggggacagguuuggagaguguagagagagagguuuggauuuacucuacuuuccucuuucuaacacuuuucugauauccaacacaguuccucuucc

SEQ ID NO: 6044 - RNA, 93 nt, Homo sapiens
gcaugcuguaggagccucuaagaguucuuuucuccugcuuuuucuuuuaauaggccuaucccaggaggaggacacuugagccucccagcuugu

SEQ ID NO: 6045 - RNA, 84 nt, Homo sapiens
guguuuguucgaucuuuccaucuccucauuguuucucucuaaauagagagagagagaugagggcagaggaggaauugcaaucac

SEQ ID NO: 6046 - RNA, 67 nt, Homo sapiens
ggguccggggggcugcggccgcccggcgucccgcucuggggggccgggaccgcagcgcucacggccc

SEQ ID NO: 6047 - RNA, 87 nt, Homo sapiens
ggauccuagcucuccugauuagguuuccauagcugguagagaagauucaguuacacaugggaaccugaucaggaaauuggcaggucc

SEQ ID NO: 6048 - RNA, 73 nt, Homo sapiens
caguggcaggugauggacaguguagccauagagagcacaucagcucugugcucauucccgucucccgucucug

SEQ ID NO: 6049 - RNA, 67 nt, Homo sapiens
guuuaccagggaaggcccugggagagaaucugcucagugacacucuuccuggggccucagagguggc

SEQ ID NO: 6050 - RNA, 90 nt, Homo sapiens
ggcuggacagcgggcaacggaaucccaaaagcagcuguugucuccagagcauuccagcugcgcuuggauuucguccccugcucuccugcc

SEQ ID NO: 6051 - RNA, 90 nt, Homo sapiens
acauggccaggacacagaaccgugggggcagccccagcccuucccugccuguuacaggccccugccccuguuccugugucccaugccugu

SEQ ID NO: 6052 - RNA, 83 nt, Homo sapiens
gccuuggccauguaaaagugcuuacagugcagguagcuuuuugagaucuacugcaauguaagcacuucuuacauuaccauggu

SEQ ID NO: 6053 - RNA, 68 nt, Homo sapiens
gcuuucugacaugguagacuuuugguggaacuaguuaucagccaaaagacugcucaugggaagauagc

SEQ ID NO: 6054 - RNA, 73 nt, Homo sapiens
gggugcugccuccacauggcugagguguggccaggagguccccccacacccuggccuguggagccaggcuccc

SEQ ID NO: 6055 - RNA, 73 nt, Homo sapiens; identical to SEQ ID NO: 6054

SEQ ID NO: 6056 - RNA, 70 nt, Homo sapiens
gggugccgccuccacauggcugagguguggccagguccccccacacccuggccuguggagccaggcucuc

SEQ ID NO: 6057 - RNA, 70 nt, Homo sapiens
uggucacgugaagaugacagccgaugagcuuguguauaacauucaccuggcugucaacuucuugguguca

SEQ ID NO: 6058 - RNA, 91 nt, Homo sapiens
gguuuggucacuaggggcagauuuucugaggccauuagggaauaauguucucuuugauggacuugggaacuuuugucucuggugcugugcc

SEQ ID NO: 6059 - RNA, 83 nt, Homo sapiens
gaaugguugagguaguuuuucaaguauuuggggcagaaaaacacacauuuaccucagauauuuggauaauugccuccacuuuc

SEQ ID NO: 6060 - RNA, 102 nt, Homo sapiens
uguucauucagucccaccauggugggggaaagggacuugccuguuugggggaacccaugguaacaggacaagcuuuugccauugcaguugggacugaugaca

SEQ ID NO: 6061 - RNA, 69 nt, Homo sapiens
ccuuggguccugagugaggaagagaguagagugcaacccauugugagcucuuucucaucaggcucuagg

SEQ ID NO: 6062 - RNA, 59 nt, Homo sapiens
gguucagugguuagggccaaccaucuacuucaguuccugucuggcccagaucucugacc

SEQ ID NO: 6063 - RNA, 68 nt, Homo sapiens
gguuaguuaauaagauuggaagaaacgaauauuauuguuucagaaucuuccagucuuaucuacuuauc

SEQ ID NO: 6064 - RNA, 99 nt, Homo sapiens
guguguguugucccagaguagcaggaucuggcagaaggaaauuuccuucuaacccucaaacaauucacauaaaucuuguuacauuugggauuuuaccau

SEQ ID NO: 6065 - RNA, 75 nt, Homo sapiens
gaaugagggucugggcacuccuggggacagcugagugguaggacuccuggguccccagggggcagguccaucuuc

SEQ ID NO: 6066 - RNA, 75 nt, Homo sapiens; identical to SEQ ID NO: 6065

SEQ ID NO: 6067 - RNA, 75 nt, Homo sapiens; identical to SEQ ID NO: 6065

SEQ ID NO: 6068 - RNA, 75 nt, Homo sapiens
gaaugagggucugggcacuccuggggacagcugagugguaggacuccuggguccccagggugcagguccaucuuc

SEQ ID NO: 6069 - RNA, 92 nt, Homo sapiens
gagugcacagggcucugaccuaugaauugacagccagugcucucgucuccccucuggcugccaauuccauaggucacagguauguucgccuc

SEQ ID NO: 6070 - RNA, 72 nt, Homo sapiens
cuguugaaauguuaauuccauuguuggaugccacagcugugagcauuacucaugggaucaacauucuauuag

SEQ ID NO: 6071 - RNA, 88 nt, Homo sapiens
gccucaaugcuuauaagagaaaaccaaggccugagcuggguagucacagaauggcucagucuugggucggguuuucuaagcacugggc

SEQ ID NO: 6072 - RNA, 89 nt, Homo sapiens
ucuuggagccuugauuucucuaucuuugaggcugcaggaaugaaauaauucugguauuuuugcagccuggugaggaaauagguaucaga

SEQ ID NO: 6073 - RNA, 66 nt, Homo sapiens
aguucuccucugucuaccacgaggguaagucucuuuuuggcgcuuuuguggugauggagaggcacu

SEQ ID NO: 6074 - RNA, 82 nt, Homo sapiens
ucaucucggggccuggugaauuaggacgacaucggcauuuuuuauugcuaaagacguccagauugauccagcccuuggcuga

SEQ ID NO: 6075 - RNA, 102 nt, Homo sapiens
uugugccaguucugggcuucuuuugcauaaucauuuaucugaaaggacaagaaauaauuugcaauuucagagugugaugcaaaagagacagauauugcucaa

SEQ ID NO: 6076 - RNA, 77 nt, Homo sapiens
ggaucacccccaggccucacuggcucaggcggauguucuccgcuucuccuuuguagcucugaggccugggucugucc

SEQ ID NO: 6077 - RNA, 67 nt, Homo sapiens
ggaugacugaugucuggggcagagucuagcuuuuuagaaggcagacucuuccuccgacauccucucc

SEQ ID NO: 6078 - RNA, 98 nt, Homo sapiens
uucucugugaaaaacuccucucaugaaggcgcauugaggggaguccuccccauggccuccccuugcugugccuuuucacauauguuuuuuaaagugga

SEQ ID NO: 6079 - RNA, 128 nt, Homo sapiens
auuuuggaugcccccgucgggacugugugucacuguacuggaacucgagugaacacuuagcucaaaaucuauugcuguucucuagaauccagcccaauucucaugguuaaauauaagguauguauagu

SEQ ID NO: 6080 - RNA, 72 nt, Homo sapiens
gguugggagagcgggguugggggcggaccccagggccgcaccccuggucccccccauccccuuucuaccgcc

SEQ ID NO: 6081 - RNA, 75 nt, Homo sapiens
guguguguacuuuguggaggggagguuuugccucuccaugguaccuagcccagcuccuccacagaauagacucac

SEQ ID NO: 6082 - RNA, 96 nt, Homo sapiens
auauuguagguuuuugcucaugcaccaugguugucugagcaugcagcaugcuugucugcucauaccccaugguuucugagcaggaaccuucauugu

SEQ ID NO: 6083 - RNA, 124 nt, Homo sapiens
acauucuguaccuaucucuuuucugauuagagagguggcauggagccuggcucauuaggcagaaguaaugagccagucuauacgccaucucuaauuagagaaaagauacaguagguacgacugu

SEQ ID NO: 6084 - RNA, 86 nt, Homo sapiens
accuuguccucacgguccaguuuucccaggaaucccuuagaugcuaagauggggauuccuggaaauacuguucuugaggucauggu

SEQ ID NO: 6085 - RNA, 84 nt, Homo sapiens
ggaucaucuccaaauucuaggauuucucagguguagaagaugaagcaggauacauuugagaaauccgcaggauaaggagugucc

SEQ ID NO: 6086 - RNA, 77 nt, Homo sapiens
gccucuuccuuucguaacuccugacccaagcucugcagggcaguguagggcuagggaggagcauggaccuuaguggc

SEQ ID NO: 6087 - RNA, 79 nt, Homo sapiens
uuguuuuguucauucaugcaucuucagugcuuggcaccuuauaagcacuaaaauauuugcuaaaugagugaaugaacaa

SEQ ID NO: 6088 - RNA, 67 nt, Homo sapiens
acaucuugaagguucuaccauacauguucaucacuaaggcugcuguaugguagggguuuugagcugu

SEQ ID NO: 6089 - RNA, 66 nt, Homo sapiens
gacuuuuguggaguuuguaaauuugaauuugauucaagguagauuuuauaggcuucauaaacuguc

SEQ ID NO: 6090 - RNA, 73 nt, Homo sapiens
aacuugagcagcucggagccauaaggagauuguguugaguuauuaaacacuugugguaaagcugcuuauuguu

SEQ ID NO: 6091 - RNA, 76 nt, Homo sapiens
aucugcuggugauugaauaaaagugucaagaaaauggcugcuugauggccuuuuguucucccucauccagcuugau

SEQ ID NO: 6092 - RNA, 82 nt, Homo sapiens
aucugcagaggcccuacugugcacccacugguaucccugugacuggcccugggauacaagcauagucagggcccuguuugau

SEQ ID NO: 6093 - RNA, 72 nt, Homo sapiens
gccuuaaaauugaucccaagguccuuugcacagccccuuuggccguaagacuuagggaucggacuuacuggc

SEQ ID NO: 6094 - RNA, 81 nt, Homo sapiens
ggcugcaugggcacaguguggccaccuucagucacucugggagggacuggcaguggguggcacuguguccuuuugucugcc

SEQ ID NO: 6095 - RNA, 87 nt, Homo sapiens
gccucugucucccucgugucucuccagggcugcacugugacaaggccacggugucuaccuggacggccacagggacucccaguuggu

SEQ ID NO: 6096 - RNA, 90 nt, Homo sapiens
gccucuauuuccuacugugguacaugcuggaaguugccuaugagugaccacaaagggcagcucaguauaguaccucugggucuagcuggc

SEQ ID NO: 6097 - RNA, 88 nt, Homo sapiens
cguugcaccaccugcuuccuccuccccgcugggacagccaacugggccggcugccaguggggguaggagaggguaugaggggcucacg

SEQ ID NO: 6098 - RNA, 89 nt, Homo sapiens
aguugagauugugcaaucuguuuggcugcuaaagguuccaaauuaugugggcauucugcagccccacagagugguagaauuucuucacu

SEQ ID NO: 6099 - RNA, 72 nt, Homo sapiens
gccugagaggcaagcauggcguuuggagccaggcccaucuggguucaaaucccagcucugccacuuucuggc

SEQ ID NO: 6100 - RNA, 74 nt, Homo sapiens
ggguggccuauuaagagaagccccauuuaagccaccuggcauaaaaugaaguuuucuugaauaggcuucauccc

SEQ ID NO: 6101 - RNA, 97 nt, Homo sapiens
uguugcgcuccucucagucccugagacccuaacuugugauguuuaccguuuaaauccacggguuaggcucuugggagcugcgagucgugcuuuugca

SEQ ID NO: 6102 - RNA, 111 nt, Homo sapiens
gauuauuguacaaucacacuguuuuaugagguaauaauccaguuccugaguggauaaaugagaaaaccaaguuauugccucauaaagcagcauggugguaugguuauuguc

SEQ ID NO: 6103 - RNA, 80 nt, Homo sapiens
gaguaggaaaacaucccuugagagaggaucaccuauuagguacauaauuccagcucuccuucagggguguuuucuaccuc

SEQ ID NO: 6104 - RNA, 69 nt, Homo sapiens
agcuagaaaggcauggaggcaaacuuggucuuaaauucagcacauucauuuugcuucaugucuuuugcu

SEQ ID NO: 6105 - RNA, 98 nt, Homo sapiens
aacuaccaaaggaaauaaaaacuauaaaauguagagagcgauuuucucuuuuaaaaauugcuuuacauauuuuaacucuuguauuucccuuggggguu

SEQ ID NO: 6106 - RNA, 83 nt, Homo sapiens
agcuaguccccagaaugcaaaugcuucuacuuggaauguucuuugacucaacaaggcagcaucugcauauugggagaccugcu

SEQ ID NO: 6107 - RNA, 95 nt, Homo sapiens
uuguaucucugggucccaggagguccucuggaguucugagacacuccuaggauccacaggaacuucagaggaacuccugggacccauugacgcaa

SEQ ID NO: 6108 - RNA, 87 nt, Homo sapiens
gaguaugaagauuagccugaaaauagagauggucuggcucaaggguuuccaauucuguuuucaauggcuuuguucuuuccaguucuc

SEQ ID NO: 6109 - RNA, 71 nt, Homo sapiens
ggauaggcgggcuggggucggaggucggcggccagaagccagauucccuuggccccagcucguccacuucc

SEQ ID NO: 6110 - RNA, 67 nt, Homo sapiens
ugguaggcuuuuaguuuccauagaaaauaaucucucauuguuuucaaaagaaacugaaagcacccca

SEQ ID NO: 6111 - RNA, 104 nt, Homo sapiens
uaguauuaaugauaaucuuuaauuauagaaugaggacauagcuuuuuguuucauuuauuuaaaaggcuguguccucauuuuauaucaugauuugccauuuucug

SEQ ID NO: 6112 - RNA, 142 nt, Homo sapiens
guguauuggggguggugggguccccccugcuggccgcaggugcucugacgagguugcacuacugugcucugagaagcagugcaaugauauugucaaagcaucugggaccagccuuggggaucucccucccuauaacccucac

SEQ ID NO: 6113 - RNA, 84 nt, Homo sapiens
cuuucccgcuuccccgccuccccucugcccaccgcuggaucuguuuaaacuagccgagcagggugagguggggaggcggcggag

SEQ ID NO: 6114 - RNA, 74 nt, Homo sapiens
cucucccacuuuuuugguagugccuucugccauucuuuguaaccgagaaggucaaggccaaaagagugguggag

SEQ ID NO: 6115 - RNA, 65 nt, Homo sapiens
gggucugugucacugugggaguagcagcuaccaccacuacaauauccucacagugacacgagccc

SEQ ID NO: 6116 - RNA, 140 nt, Homo sapiens
gucucuuccagaaacauuuccaaagcagcauuugauacugaaaacauggauuuuccucuaugauuaaccaggaaucacguaaacauagaaggaauauccacguuuuaaauaccaaagaaggacugggcucuggaaaggac

SEQ ID NO: 6117 - RNA, 82 nt, Homo sapiens
uuuucucucuggaggcaauugggacuauaggagcagcugcaacagcagcauuugccauuuugccaguuguucagagaaugaa

SEQ ID NO: 6118 - RNA, 126 nt, Homo sapiens
gacucaugcuaguacuggaauucuuuuugccuugagaaauggaaaggucucuccccacauuuugacuuuuccauuucuacacccuaggcagccuuuuccauugaguucuuccaucuggcgucuguu

SEQ ID NO: 6119 - RNA, 67 nt, Homo sapiens
ggcucagcugcggugcagcgugggucgucaucgcucucacggcccacacuguauucgucagcucgcc

SEQ ID NO: 6120 - RNA, 83 nt, Homo sapiens
uggucuucaucugggauucucugguggucagaaggaaagucucaagcauucagaccacgggaggaacccagucauggaaucca

SEQ ID NO: 6121 - RNA, 84 nt, Homo sapiens
gccucacuccaccaggcccugggggagauggaggaaaggaaaagucuucuccauuuuccaccagagcugcagaaggaguuuggc

SEQ ID NO: 6122 - RNA, 55 nt, Homo sapiens
caaucugcuucucaagccaccauaaaaauuaaugggugguuugcagagcguuuug

SEQ ID NO: 6123 - RNA, 86 nt, Homo sapiens
cccucuuucuguggcagauugggauggauaaaauaaagaagaucgagagguugaagaacccauccuguuuugccagugagaagggg

SEQ ID NO: 6124 - RNA, 59 nt, Homo sapiens
gcuuccuccagggaggggccugcuggacccaugccugcucagccccuccuggcaguggc

SEQ ID NO: 6125 - RNA, 105 nt, Homo sapiens
agaucacuaagguuucuacagccccgaguuuucaggacuucaggguccuuagacucuaggauuucgaaguuuuaaaauuuggaggcucuagaauucuuagcuucu

SEQ ID NO: 6126 - RNA, 56 nt, Homo sapiens
gccuccgugauggccgugguguugcucagcaugcacaccgcccgcugcacuuuggc

SEQ ID NO: 6127 - RNA, 102 nt, Homo sapiens
ugguccugggacuacaguucccagaagacccuaggacucccuccucugcucuucuaggggacucgagccccagggucugaugggaauuauaguuccuaucua

SEQ ID NO: 6128 - RNA, 76 nt, Homo sapiens
ccauccuccagcagugggauaugguguauggcagguuccuccucugcuacagccuguguccugcucugucacuugg

SEQ ID NO: 6129 - RNA, 88 nt, Homo sapiens
acuucgugauuuacagccacaguggaaaauggggcuggguauugauucuuggccuuuucuauugcaaauggguguaauguuuuauagu

SEQ ID NO: 6130 - RNA, 70 nt, Homo sapiens
ugcucgugguccuggcuuccucaucuggcacccaucaggcuagacacagauggggcuccaggccuuugca

SEQ ID NO: 6131 - RNA, 76 nt, Homo sapiens
cugucuccagccugcugaagcucagagggcucugauucagaaagaucaucggauccgucugagcuuggcuggucgg

SEQ ID NO: 6132 - RNA, 89 nt, Homo sapiens
guuucugggcuggagcugagguguuuugugaggcgagcucaugcucuuugcauguguuccucugccgacuauuucaguuccacucugac

SEQ ID NO: 6133 - RNA, 91 nt, Homo sapiens
uccucugcaccccacagugcucauucaagugaagagucaucuuugaaggcaauuguagcuucuugcuuggcugagcaucauggagcuugga

SEQ ID NO: 6134 - RNA, 96 nt, Homo sapiens
cccucuacacagacuggccagugucugcuuggcuccagggcagugaggagcugccuugggacuaacagaaaauuggccagcuuguuuuucuuuggg

SEQ ID NO: 6135 - RNA, 82 nt, Homo sapiens
gggugggagggagugcuuuggauuuuguaccugggcugcagagagugcccagguauagaauugaaagcacucccuccugccc

SEQ ID NO: 6136 - RNA, 67 nt, Homo sapiens
uuuuguuucagaagucaacuagguaaagaacuacagugguucuccugggaugacuuuugaaaugaaa

SEQ ID NO: 6137 - RNA, 70 nt, Homo sapiens
ccuugcaagguuucucucugccuaaaugagucuccauugcaggcgauagaguaggagaggccuugugggg

SEQ ID NO: 6138 - RNA, 71 nt, Homo sapiens
ggguggggucaggugugugcacagguggcccagguuccccugcagccugcagccauugccuggcccugccu

SEQ ID NO: 6139 - RNA, 104 nt, Homo sapiens
ucaugucccucauuugugaaguggacguuguuggggugcucuccaucagaaucggggauggugggggagcauucccugcuccugauucaggaugaggggucuga

SEQ ID NO: 6140 - RNA, 79 nt, Homo sapiens
cauugcagaggugaguugaccuccacagggccacccagggaguaaguagccaaguggaaguuacuuuaccucugugaug

SEQ ID NO: 6141 - RNA, 83 nt, Homo sapiens
ggguggggcacacagauuuauaguuuggaugggaucuuuaaggaauaggcccugguuaagacugaacugacugugcccugccc

SEQ ID NO: 6142 - RNA, 65 nt, Homo sapiens
uccugggguugagucaaggcagagcucuggcccauaccugguugugcugcaggucagcccuggga

SEQ ID NO: 6143 - RNA, 104 nt, Homo sapiens
agcugagguaguucuggucaaccaagucaggugcugagauguuccuggggggcccugggaguuccucuagugccugaggggauaggaccauugcugccuuggcu

SEQ ID NO: 6144 - RNA, 77 nt, Homo sapiens
guguggugaggcccagcauucagggcaggaagaaucguacaagaggugucugucuuugugcugggaucucauugcau

SEQ ID NO: 6145 - RNA, 76 nt, Homo sapiens
uccugccacugccucaucucuuuccacuccaaagguuggggucuaugaaggaaaaugggagggaauggugguggga

SEQ ID NO: 6146 - RNA, 70 nt, Homo sapiens
gucugguacagcuaagaauuucaucuuugucaugcguaagcugaaagauuaaauucauacuguacuggau

SEQ ID NO: 6147 - RNA, 72 nt, Homo sapiens
ucuuguuuuacuguuggacauguguggcucugagucaaccagagguuuaguauguucauaugugaaauggga

SEQ ID NO: 6148 - RNA, 76 nt, Homo sapiens
gucugcagcuaugcaugaggagaggacugagccugaaacacaagacgguuuucaucuucgugccagagcuguggac

SEQ ID NO: 6149 - RNA, 98 nt, Homo sapiens
gggugaguggggagggcuuucaugcucuggggcugaggccggggugucugauccuccugcuccagcccugggguugggagcucaacagccacuuccuc

SEQ ID NO: 6150 - RNA, 78 nt, Homo sapiens
uauugugaggugcagguauguuacuuuuacuccauuguuucuuugaccaguaaguaacauauuuugugcuuuaugaua

SEQ ID NO: 6151 - RNA, 77 nt, Homo sapiens
augugcuguuuugcuguuugggaguguuuuguauauacuuuuuaaaauacaaggcuuucucaaauaggauagaccau

SEQ ID NO: 6152 - RNA, 168 nt, Homo sapiens
ugguguuucuggugucugucaugacgaagugggcugggagaugggacauccuacauaugcaaccagccagcccccucuuauaugaaauagggauuuccuggcagcacuaugcaggauguucaaccucccggcccaugcgaagaugaacugcugcaccaugaaguucca

SEQ ID NO: 6153 - RNA, 71 nt, Homo sapiens
cuguggggaggugguguggcugucgucuacacauagauguacucauuuuggccaaauugcuauccuugcag

SEQ ID NO: 6154 - RNA, 73 nt, Homo sapiens
caguggagucuccugaagaagaggcagaaaaaaugcaggugguuuugucucuauucuaggagcugcucuccug

SEQ ID NO: 6155 - RNA, 135 nt, Homo sapiens
cccugucuuacccuguaaucucagcacuuaguauggggccuuguacaggaauaaaaggaauaaggauuuccauccuacuauuucuuuauuacugacuuuacucuuugccgguguuuccauuacaggagaagaggg

SEQ ID NO: 6156 - RNA, 101 nt, Homo sapiens
cugugcaccacccaucuggggguggaggggagggucuaagucuggauuccuaaccuagaaaccucucacucuccuccucccacugccagacaggugaccag

SEQ ID NO: 6157 - RNA, 68 nt, Homo sapiens
guguguccuagucaggagaggcagguucugugcaaaacgcacuccccaccucguccuugaggauccac

SEQ ID NO: 6158 - RNA, 66 nt, Homo sapiens
gaguggccuaucaucugacauacaguucaggaguauacaucugagagguguuggauggggcugcuc

SEQ ID NO: 6159 - RNA, 81 nt, Homo sapiens
ccuugcuugcagcauaugcauuaauucaagaaaggugaaauccaaaauaugaauaggcuuuguaugugcuuucaagugagg

SEQ ID NO: 6160 - RNA, 67 nt, Homo sapiens
aggugaaaggaaaaggguuuugacuugauuugauaaacgaagaaagggaacucuuucacuuuugccu

SEQ ID NO: 6161 - RNA, 119 nt, Homo sapiens
ggcugcggcggaucaugcccaugguguagccgccaagcggaggcauggcugccggaagguuacugcucuacacuggccucucgcuagcgcucugcgcccucggcaugcuggccguggcc

SEQ ID NO: 6162 - RNA, 58 nt, Homo sapiens
uccugggaaugaggcccgcuucaaugaucaauuucagaaggggguucuuuuccuggga

SEQ ID NO: 6163 - RNA, 55 nt, Homo sapiens
cacuggacuucccaaucccgagaucuccuggagccuccuggaugggagucuggug

SEQ ID NO: 6164 - RNA, 67 nt, Homo sapiens
gcaugacucuucaaccucaggacuugcagaauuaauggaaugcuguccuaagguuguugaguugugc

SEQ ID NO: 6165 - RNA, 72 nt, Homo sapiens
gauugcuucaaacugagcuucaaguggcagcugugagugcugcacauaaaagguagcaguuugaaagugauu

SEQ ID NO: 6166 - RNA, 67 nt, Homo sapiens
gugugaauugccugcugucagccuggaguucucaccuccgcaauccuggcugcaggcauauuugcau

SEQ ID NO: 6167 - RNA, 92 nt, Homo sapiens
gugugaggauuggccaggaugacguguagguggugccaggugauggcuguucccucuacaccccucauggcuccugguccaaugccuuccac

SEQ ID NO: 6168 - RNA, 70 nt, Homo sapiens
uccugccuaguaccuucuuuucuucugggaauagcuuucccuuucuaagggaugaagaggguggguggga

SEQ ID NO: 6169 - RNA, 84 nt, Homo sapiens
gagugcuuucuagcagguagauguuauaucauggcagaauucucuuuacagccuaacucagcaucuugcuuguuagaggugcuc

SEQ ID NO: 6170 - RNA, 87 nt, Homo sapiens
uauugauagggugaucagccaccccaguuugccugggacuaaugaguuucugggcacacugggaugaauuggucaccuuaauugaua

SEQ ID NO: 6171 - RNA, 116 nt, Homo sapiens
ugcuggggcugggcagggcacuggagcaggucugcgagcucugcuggguggccuugggcaagcugguaccuucucagagcuguagccuuggcccugggcccucccagcgccuggca

SEQ ID NO: 6172 - RNA, 57 nt, Homo sapiens
gcuuggagcuccugcuaccauggaauauuuuuaaaugguuacgaaaggagucugagc

SEQ ID NO: 6173 - RNA, 97 nt, Homo sapiens
cugugcuugucauugcggcuucuauuuucugcuucuaaacuauagucuguagcuauaguuugagcaggaauucgaagccaacagcaggacagugugg

SEQ ID NO: 6174 - RNA, 59 nt, Homo sapiens
gggugggugccaggguggggcaggggcaggccugccccugcccuccaccugcccugccu

SEQ ID NO: 6175 - RNA, 66 nt, Homo sapiens
cuuugcuuuaacauggggguaccugcugugugaaacaaaaguaagugcuuccauguuucaguggag

SEQ ID NO: 6176 - RNA, 68 nt, Homo sapiens
ucaugacccagcucuuuuccuguucuucuuuugagacuuuccuaacaggaaaggcucuggguaauuga

SEQ ID NO: 6177 - RNA, 95 nt, Homo sapiens
gcgugugguacuugaagauagguuauccguguugccuucgcuuuauuugugacgaaucauacacgguugaccuauuuuucaguaccaaaucccgc

SEQ ID NO: 6178 - RNA, 68 nt, Homo sapiens
ucaugaagcuuacaguaugaucaacuuuucaccuguggaaaaauauaauuaugcuguaaguuguuuga

SEQ ID NO: 6179 - RNA, 86 nt, Homo sapiens
gccugagcuuugaaagagaggagaggaagccaagucauccagcagaucggacccacaagcucauccucuaguuuuuuucaaggggc

SEQ ID NO: 6180 - RNA, 131 nt, Homo sapiens
guuugauugggagaaggcaccuagggagggaggauggugcaucacuuaauauuaaauugccucccuacacuauguggcugagugucauggaccuuccucccucucugcgccuuugaacucccacuguuagc

SEQ ID NO: 6181 - RNA, 55 nt, Homo sapiens
ggcugccaggcauauggccucuuugugcccacacaauggaggcccugucugugcc

SEQ ID NO: 6182 - RNA, 104 nt, Homo sapiens
accuggagagcauuuaacaaauacuaaugccuggguccuuccucagaccaacugugucugucucuggaggagagacucaggcauuuuuuguuuguuuguuuggu

SEQ ID NO: 6183 - RNA, 69 nt, Homo sapiens
agguguuucuguucuucagagauccccaaauauuuuagguagagggaaaauuucuaagaacaggguccu

SEQ ID NO: 6184 - RNA, 58 nt, Homo sapiens
agaugugggacagagcuccucgaucucguccaaggcagaggagaaacuguccuuuucu

SEQ ID NO: 6185 - RNA, 82 nt, Homo sapiens
uuguucuuagaguuucggguguuuuucuccagucuuguuacuguagacuguagaaagcacgggccccaggcucugagcuuag

SEQ ID NO: 6186 - RNA, 92 nt, Homo sapiens
guguugucccagaguagcaggaucuggcagaaggaaauuuccuucuaacccucaaagaauccacauaaaucuuguuacauuugggauuuuac

SEQ ID NO: 6187 - RNA, 85 nt, Homo sapiens
gucuucuguauauacccuguagauccgaauuuguguaaggaauuuuguggucacaaauucguaucuaggggaauauguaguugac

SEQ ID NO: 6188 - RNA, 81 nt, Homo sapiens
guguuuugugugguaugccucguuuccaguaacccaguuaaauuaaagguuuguugagggcuaggcaaucuacauaaucac

SEQ ID NO: 6189 - RNA, 139 nt, Homo sapiens
gacuuuauggacacauuuuaaacuaauagucacuuuuuaaaagccagcauuauguuuaauuaaaacacacugggaacacauuaaauaugaugcuagcuuuuagauggugacuauuagcuuaaaauggguuuauguuguu

SEQ ID NO: 6190 - RNA, 76 nt, Homo sapiens
acauuuauuaauaugcaaauucuaaguggcaaucuggacccagucggguugugcuaauuugcacauuaauaucugu

SEQ ID NO: 6191 - RNA, 83 nt, Homo sapiens
aaguuccccaagcucuaaggacuuccucaucaucaugcaagaagaagagaaaagugaguguccauagaagcuuuggggcucuu

SEQ ID NO: 6192 - RNA, 73 nt, Homo sapiens
uaguucauguuaucacagaagcaaaugaaaagucucccaaccuuuucauuuacuucuaugacaacaugcucug

SEQ ID NO: 6193 - RNA, 71 nt, Homo sapiens
acauucccagguacaucauuagccaacugggacucaauaaggaucccuuggaaggugagucccuggguugu

SEQ ID NO: 6194 - RNA, 92 nt, Homo sapiens
agauuaacacccuuguacaaagucacaugagucaagcaaauaacccugaagugcaaggugauucuugugacuuuuguaacauuguguuuucu

SEQ ID NO: 6195 - RNA, 67 nt, Homo sapiens
aacuuuggguuacuauggcaauaauuugaacauuuacagagaagaguguuugccguagacccauguu

SEQ ID NO: 6196 - RNA, 105 nt, Homo sapiens
gcuuucauugcaaucguuaauucagcaucauuguucucucaggcuguuacgugacccaacaggcugggggaacaauauugcugaauauaauuggcauaugucagc

SEQ ID NO: 6197 - RNA, 177 nt, Homo sapiens
ugguuucagcuggcccugcgggggacugccccaucuccccagggaggaaagagggucuggagauagccccgggugggggaggucaaccugcagaucccggcuuggggacagcuccagaugacaccucgugagccgccugggguggaggggcccccagugcagggcugcguggcccca

SEQ ID NO: 6198 - RNA, 75 nt, Homo sapiens
guauugaaaacacccucuaagagaggagaauaugcccucacguuaucuucucuuagaggguguagaguucuuugc

SEQ ID NO: 6199 - RNA, 90 nt, Homo sapiens
acuuuaggaagcucauuuaucuugacuggauugcuuaauauuagucuaauguuuaaauuguccaguugagauaacaggguccccuuuagu

SEQ ID NO: 6200 - RNA, 83 nt, Homo sapiens
ucuuuacugccuguaggggaccuccuauagggauagguaauguuuuacucauuccuacaggagguuccccuuaggaguucaga

SEQ ID NO: 6201 - RNA, 87 nt, Homo sapiens
ccauugucucaagauguccugaggcagaggauauccuucccacucuuacuauggucuguccucuccccuaggccaucuuggacuugg

SEQ ID NO: 6202 - RNA, 73 nt, Homo sapiens
guauuucauucuggaaacugaaaugggacauuaaauaaagaauggugucucauuucagggcagagggacuuac

SEQ ID NO: 6203 - RNA, 68 nt, Homo sapiens
agauuggucauaaggucugcuuagauccaaaauguucugugaucuuaggcaguucuuugugcugcucu

SEQ ID NO: 6204 - RNA, 68 nt, Homo sapiens; identical to SEQ ID NO: 6203

SEQ ID NO: 6205 - RNA, 101 nt, Homo sapiens
ccguuccugcuguggagaaggaggcgaagucagagagcucuuccaagcuuuccccaggaagagcucucuggcuuugccuuaaagcuccccagagguuuugg

SEQ ID NO: 6206 - RNA, 140 nt, Homo sapiens
gguuuauaugcucauuuuuagcuuauuucuuguaccuugcagcacacucuacgcacucagcccuuaagggguuuacuuuacaaacugugugccuguaagauguauuagcaauaagauagaaaauugagcaaguuuauacc

SEQ ID NO: 6207 - RNA, 99 nt, Homo sapiens
accuuauaccaaggcuuugacagugucuaucuuauugguuaugguauccauggcuccuaggauggugccuggcacugaguguuggugucuaugaauggu

SEQ ID NO: 6208 - RNA, 152 nt, Homo sapiens
gcguuaaccugcagagggguuggcagcagcugcuuauuucugauuugcuugucuuugaauggggguaauugcugggagcugccaguguuccagguuguucccuggaagagggggaagaagaaauggcugucaugggcucugcggagugcugc

SEQ ID NO: 6209 - RNA, 80 nt, Homo sapiens
guguucugauuucuguuugacaguucuggcuuauuacaggcugagugacaaagccaagacuuaaauagaaauuacuucac

SEQ ID NO: 6210 - RNA, 75 nt, Homo sapiens
cucuucuuugucaguuuacgccauuccuuggugcgaaagugacaaguagugauggugggaaacugacagaaugag

SEQ ID NO: 6211 - RNA, 87 nt, Homo sapiens
ggcuucaaguccacggcccugugaugggaugugggcagggccugagacaggccgaacccaacucuucacagggccgaauucuuugcc

SEQ ID NO: 6212 - RNA, 106 nt, Homo sapiens
guauucacagugcacaaaauucuagguauauaguguaaaaccuuuuuacgaacuuuuuacaaaguuuuugcacuauauaccuauaauuuugggcacuguucuuuac

SEQ ID NO: 6213 - RNA, 89 nt, Homo sapiens
guuuucguaggcaggaguggcaugccucaaagggacuggagggaccagcuuuucuaggucccucugagggucacugacugcuuucugac

SEQ ID NO: 6214 - RNA, 82 nt, Homo sapiens
aaguucuaggguacaugugcacaacgugcagguuuguuacauauguauauaugugccauguuggugugcugcacccuuucuu

SEQ ID NO: 6215 - RNA, 98 nt, Homo sapiens
gucuucucacugucacacccuggcuggaguguaggugcuggaucagcagugagccguuaccaugccccugcccuccagcaugugugugagagugugac

SEQ ID NO: 6216 - RNA, 75 nt, Homo sapiens
uaguugugaggguacagggggaagguagcuuuuggaggggccuggaagacccuucccuuugugccuucgauucug

SEQ ID NO: 6217 - RNA, 66 nt, Homo sapiens
uauuuguuguugaccugcugggugugauauauuucugugcauuuaccaguaggucaauucucugua

SEQ ID NO: 6218 - RNA, 97 nt, Homo sapiens
auguuuuucauuggaaagguacuacccuaccuacuaccaaagguacuaugcuaccuacccuuugguaauagguauaguaccuuaccaaugaacucau

SEQ ID NO: 6219 - RNA, 111 nt, Homo sapiens
agcuuucuucaaaacauauuuuuguaaacccuaagugaaaaauaugcuaagaagaaaagagauucuuagcguguuuuucacauaggguuuauaaaaauccugggguuuguu

SEQ ID NO: 6220 - RNA, 69 nt, Homo sapiens
gguuuugcaggguauaggcgcgcccgcugcagccggccggagaggcgggugggccucugcgcugcugcc

SEQ ID NO: 6221 - RNA, 85 nt, Homo sapiens
gccuuuaagacucucacccugcuuugcggagaauggcaaaaaucugcgaaacaucucagcagagccaggagagaguaacacuggu

SEQ ID NO: 6222 - RNA, 82 nt, Homo sapiens
agguuucaacagcauagagcuccaggccugggagccucacuccuguugguccuuuggucuggagacucuugcuuuuucuccu

SEQ ID NO: 6223 - RNA, 60 nt, Homo sapiens
ggcuuuuguccuguggggcaauucauccuucagaauuuaggauugcucuuuggauuugcc

SEQ ID NO: 6224 - RNA, 78 nt, Homo sapiens
ggguuuuccauugugagggaaacucauucauacucaucauauuuccacagagaugaaugaguuuccuuuccagugccc

SEQ ID NO: 6225 - RNA, 96 nt, Homo sapiens
acauuuuuuccuuguuccagagcuaagaaaccucugaauggagaggaaggugacucuauucagaggcuuucugggcugggagcaggauggcauugu

SEQ ID NO: 6226 - RNA, 88 nt, Homo sapiens
gccaggagguagggaaaucucuugcuccuugagucaugcgauaugaaugaaggacggguguggagcaagauuucucuauuuccugagc

SEQ ID NO: 6227 - RNA, 72 nt, Homo sapiens
ggcuguuccuggggcaagggagaugggaggaauuuaagaaagagugggacagcuuugccuuaggagcagacc

SEQ ID NO: 6228 - RNA, 67 nt, Homo sapiens
guaggucaaguguuggauagcgguugagaguacagguucuggacucagguuuaauacuuggcuucac

SEQ ID NO: 6229 - RNA, 75 nt, Homo sapiens
cccugccuucuccauucacacacaguacccuucccuggaagcuacaagaaaggggggugaaggagggggcggugg

SEQ ID NO: 6230 - RNA, 82 nt, Homo sapiens
cccauuggcauaaacccguagauccgaucuuguggugaaguggaccgcacaagcucgcuucuaugggucugugucagugugg

SEQ ID NO: 6231 - RNA, 71 nt, Homo sapiens
gcccagguuucuagacuccuaggcuauccagggcccucagggcuuguggugaggguuggggagccuggugc

SEQ ID NO: 6232 - RNA, 78 nt, Homo sapiens
uguagauuuguaagcuuauaacauguauagacauacuaugaaugugugucuuuauauguguauguuacaaauuuguca

SEQ ID NO: 6233 - RNA, 65 nt, Homo sapiens
caccuucgaggaaucguuuauuugcucuggguccccugucuagacugcgagcuccuugaaggcug

SEQ ID NO: 6234 - RNA, 60 nt, Homo sapiens
cuccagagcuuucguacaguuuauucuuguugaaguaagcuaaggcaaaagcuuuggcag

SEQ ID NO: 6235 - RNA, 78 nt, Homo sapiens
gccccagcugcccgccagcugugagcgcccgucgggcccggaggucacccgcaaacagcugggucggcagcugggagc

SEQ ID NO: 6236 - RNA, 88 nt, Homo sapiens
gggguuaggaauguguuugcugggugacaguccuugugacauuuauaaggagaaagggcuaucccuuguggacugauuccuaauuacc

SEQ ID NO: 6237 - RNA, 66 nt, Homo sapiens
gggagggaaagaugggaaggggacagcugugauuacugacccauccugccccagcuuucccucacu

SEQ ID NO: 6238 - RNA, 65 nt, Homo sapiens
ggggaggagggaggagaugggccaaguucccucuggcuggaacgcccuucccccccuucuucacc

SEQ ID NO: 6239 - RNA, 82 nt, Homo sapiens
ugaugucugagacagcccaggcucggcacugcagaauaaauuacaugauucgcugaaugccugggcuucgcucagacauaca

SEQ ID NO: 6240 - RNA, 99 nt, Homo sapiens
agcugugucugcagaagaggccagaagaggagggugagggugggauacagcucagccguacucuuugaggcuucuggccucuguuuucaggcauggacu

SEQ ID NO: 6241 - RNA, 100 nt, Homo sapiens
gccacaguuucuaaauugagugucuagcauuuauaaucaacugcuucauuuaauucaggucgauuuuaaaugcuagccauucauuugguggacugugagc

SEQ ID NO: 6242 - RNA, 65 nt, Homo sapiens
gccuugcugacauugugacucugucuugcuggcagugagaacuaguugggauguuuagcaagagu

SEQ ID NO: 6243 - RNA, 98 nt, Homo sapiens
gcugggggcuggggucucugaccagaggaucugucuccuuguguccucaguggacggguggcuucuggucacagcccccaacucugcagccuccaugu

SEQ ID NO: 6244 - RNA, 96 nt, Homo sapiens
agacuaauuaauguuucagaguguuuaaacacaaugccucuacagaagcaauggcauuauaauguguugggacacucuaguguuguaauuaguacu

SEQ ID NO: 6245 - RNA, 73 nt, Homo sapiens
ggauuaugcuuuaaaaggcaugcuuucccauagccgugagggucagggauuauuuuuuuuacagcauagugcc

SEQ ID NO: 6246 - RNA, 65 nt, Homo sapiens
guuuugauaaugcaagucaggcugagcauuuagcuagugucucagcaggcauguuugucaaaugc

SEQ ID NO: 6247 - RNA, 92 nt, Homo sapiens
caccuaccuaacuggguuagggcccuggcuccaucuccuuuaggaaaaccuucuguggggaguggggcuucgacccuaacccaggugggcug

SEQ ID NO: 6248 - RNA, 63 nt, Homo sapiens
cccagucucagugggcuuugacuuuucuaaaagaacaaaguuggggccagugggaggcugagg

SEQ ID NO: 6249 - RNA, 72 nt, Homo sapiens
uccccuccugguagccccugcuuccauaucgacaccacaguaacuggugguaggggugaggaaggaggguga

SEQ ID NO: 6250 - RNA, 65 nt, Homo sapiens
ggaggagccacagccugguaacagggugacuucuggagucugggugcaggcugugcgcuccugcc

SEQ ID NO: 6251 - RNA, 70 nt, Homo sapiens
gucagaaccuuggucaugugaaagggccgguuuucucugucaggccuucaccuggucaggcguuuuguac

SEQ ID NO: 6252 - RNA, 78 nt, Homo sapiens
ugaacaaacugucccaggcaggggcugggcagggccugugugccuugcucagccuccugacaggacacuuuuguugca

SEQ ID NO: 6253 - RNA, 92 nt, Homo sapiens
uccgucuugcuuucccaccccagugcccuuuccuuucucucuacccuuggaggcggaggggaagggcaggggagaagggagggaagaugaga

SEQ ID NO: 6254 - RNA, 84 nt, Homo sapiens
guguuuugguagggggagggagggacuuuuguggaugaugcagaagaaucagcaacguccuuccccacccccuugcagaaugac

SEQ ID NO: 6255 - RNA, 94 nt, Homo sapiens
gucuguuuuuggcuucucucagcuacuucuuuggaagguuuccacugacuucagggagaguuccagaagaagcagggggugucguagacagcac

SEQ ID NO: 6256 - RNA, 67 nt, Homo sapiens
ccgaggcucugggguucccucugccacaggugaccaaggguagguaugacacuccagaggccucagg

SEQ ID NO: 6257 - RNA, 71 nt, Homo sapiens
ggguuagggugaaagguauaaaugaauuugauuccaagagcaaucuggaagggaccuucgccuuugacacc

SEQ ID NO: 6258 - RNA, 70 nt, Homo sapiens
cucugcaaguguucaucaugacgauguacccagaaaggaguucuaaguugugaugagcauccugcagcag

SEQ ID NO: 6259 - RNA, 66 nt, Homo sapiens
cucugcacauguucaucaugacaauguacucaggaguucuaagucaugaugagcauccugcagcag

SEQ ID NO: 6260 - RNA, 77 nt, Homo sapiens
gggggaguccagacaacaggcgagugaccacgagcuuccuaaauaagaggacugggugccucggucuggcucccacc

SEQ ID NO: 6261 - RNA, 56 nt, Homo sapiens
cuaagggcacaggucaccugcgagaagaugagcacucgguguccuugcuccuucag

SEQ ID NO: 6262 - RNA, 94 nt, Homo sapiens
guggcuuaguguauuguaugaaaaucggagauuggguauuuuaagccaaaaauauucaacucugauuuuacauacguggauacuacuggccugc

SEQ ID NO: 6263 - RNA, 56 nt, Homo sapiens
gucccaccuccuggggcuggaugccaggcaggccaucugcuucuggggcugggcgc

SEQ ID NO: 6264 - RNA, 55 nt, Homo sapiens
ccccaccuucccuagaaugggcauaggccugcugugcgcaucugggauguggagg

SEQ ID NO: 6265 - RNA, 71 nt, Homo sapiens
cuaaaagguggauguuccuucuaugcuuacaggauuuauggugaaucauagaggaaaauccgcauuuucag

SEQ ID NO: 6266 - RNA, 167 nt, Homo sapiens
gcccuuucagcuacauucacgugcauagaaaauaacauugucagacgugucauccccagauacaauggacaauaugcuauuauaaucguauggcauuguccuugcuguuuggagauaauacugcugacuuuauuccucucauacaugugaauguggcuguagggagc

SEQ ID NO: 6267 - RNA, 89 nt, Homo sapiens
cacagguucaggcugcugggaagguguggcauguccacugaagcuagcugcagaguugggugaacuguuacucccaucagccccugaug

SEQ ID NO: 6268 - RNA, 73 nt, Homo sapiens
ccgcaagagugcugcuccuuuuccagaugcuuuuccugggggcaguuggauugugagagcugcacuuugcagg

SEQ ID NO: 6269 - RNA, 104 nt, Homo sapiens
gccugauuccaggcugagguaguaguuuguacaguuugagggucuaugauaccacccgguacaggagauaacuguacaggccacugccuugccaggaacagcgc

SEQ ID NO: 6270 - RNA, 93 nt, Homo sapiens
ucugcaaagaugcaaagaaauaggcccuuuucucaauugagaaaaugugacccaaauugagaaagggggcuauuccuuugcaucugagcauga

SEQ ID NO: 6271 - RNA, 107 nt, Homo sapiens
ugagcccaggaguaucaagggggagggguggggaagcaacugcuuaagacuagucuguccgcaucugcugucucugcucuucaccugcaaagcucuucugugcuaca

SEQ ID NO: 6272 - RNA, 75 nt, Homo sapiens
ucuggcagcucucacauaugaucugcagccaggaccccucuucugacuccagaucauuugguggggacuccauga

SEQ ID NO: 6273 - RNA, 91 nt, Homo sapiens
gacugcaaugcccaggccugcuguugcccagcuuguuugcagauuaauugcuuuucgagcuggcaggagcugccucuucagcagccagauc

SEQ ID NO: 6274 - RNA, 86 nt, Homo sapiens
cccggccccggccucuccucacccugccucagcugcacccgaugccuugcagcugguuugggguagaggacaggcuggccccgcgg

SEQ ID NO: 6275 - RNA, 96 nt, Homo sapiens
cccuccccgcccccgcccccugggagcucucaacccgaaucggcuuucaauuaagcugcggcggccagagcucccggggaggaaacaggcgagcgg

SEQ ID NO: 6276 - RNA, 66 nt, Homo sapiens
ggggugggggcgcuccaugcagggggcccaggaagaguuuccucagugcaggagccccugaccacc

SEQ ID NO: 6277 - RNA, 84 nt, Homo sapiens
aggcuggguggggccugggcccaggcagcucugugggaagccgcuggaucugagcugggcuggcucaggcccuuacauggcacu

SEQ ID NO: 6278 - RNA, 81 nt, Homo sapiens
uccugguccagacucuucuccuuccucaaagggagccaaagaccucagcuucccccauaugaagagucugcgggucagaga

SEQ ID NO: 6279 - RNA, 93 nt, Homo sapiens
ucuucuucauucacugugcagugaucccuggagucccuuucacaugugggaggcacacgcuccgggaaacauugcugaaggaaugaugaguga

SEQ ID NO: 6280 - RNA, 91 nt, Homo sapiens
agccuucuaucuccugggguuugggguggguuguaguucaggggucaccuaccuuuacccaccaacuaaauuaaccaggaauaguaggacu

SEQ ID NO: 6281 - RNA, 71 nt, Homo sapiens
ccucuuccccagcuccccaccuuuccuccagagaaaaaggcagacaaguggggaaagcuggggcuagaugg

SEQ ID NO: 6282 - RNA, 84 nt, Homo sapiens
uccucuucucuaaugcaaaaagaaaacauucuuguuccauugauguuggacuugacuguguuccuugcauuggaguaugaguga

SEQ ID NO: 6283 - RNA, 71 nt, Homo sapiens
guucaguuaucacagugacugucauuuuaacaauugugcaagugcaucauucacugugggugacuagaaac

SEQ ID NO: 6284 - RNA, 69 nt, Homo sapiens
ucugacccucuauggucucccucaugccucaguuuaccugugcauaguaagaacccuggagggccauga

SEQ ID NO: 6285 - RNA, 106 nt, Homo sapiens
gugcaaaugaaagugggcaaaaagccugucccuaagucccucccagccuuccagaguuggugccaggaaggauuuagggacaggcuuugugcccacuuuuggcuac

SEQ ID NO: 6286 - RNA, 80 nt, Homo sapiens
gcggcgugcuuccucucagcuccucuccucggggcuuuucggagcgaggagggagguuuagaggaaguuagaaacccagc

SEQ ID NO: 6287 - RNA, 55 nt, Homo sapiens
aaugcuggcuggguuaguagccggccauaaaagucggaugcugaucagcucacuu

SEQ ID NO: 6288 - RNA, 76 nt, Homo sapiens
cccugaaguugucaaguuuugcuaccaauuugacacuuaaaugggcuauagcaaaacuugauuuaaacugaagagg

SEQ ID NO: 6289 - RNA, 75 nt, Homo sapiens
aagcucaaccuuuugccaagaaaaucuccuuaccuccagagaaaacaauaauuuccuugacaaaagguuggcauu

SEQ ID NO: 6290 - RNA, 87 nt, Homo sapiens
ccccuccgcccguccccuccuccccugcugccgccucccggagggacggccuggggaggggagagaggagggacgggccggcggcgg

SEQ ID NO: 6291 - RNA, 68 nt, Homo sapiens
ccucuucccaaauucaugucacuggguuacaagagauggaaucuaagugagaugagagggacugaagg

SEQ ID NO: 6292 - RNA, 55 nt, Homo sapiens
agggggagagggagcaaguuggucaugcccuggacucugacccuucucucugauu

SEQ ID NO: 6293 - RNA, 56 nt, Homo sapiens
caguuugcugcacagauauuuggguuaaacaaucauuugcuguggggcagacugug

SEQ ID NO: 6294 - RNA, 79 nt, Homo sapiens
ggugaagggggcaggugggaggaggggcaucccaggaugaagggcuguggugcucuccgcucccugcuucuauuaaucc

SEQ ID NO: 6295 - RNA, 86 nt, Homo sapiens
gugcuuaccacaugccaggcacuguucuaaaggccucacacuauuaaaaagugcuuagagcaugccuggcacacgguaaguccaac

SEQ ID NO: 6296 - RNA, 97 nt, Homo sapiens
gcggaggagggauggcagcaacugugaacuccucacauuuauuacagaaaauauuauuggaguuuacagucgugggugccaugcacuccuccagugc

SEQ ID NO: 6297 - RNA, 71 nt, Homo sapiens
gcuacaguucugucuaggcaguggcuuggguuuuuaucgagcaacaacuuagacacgugacuguaauaugc

SEQ ID NO: 6298 - RNA, 83 nt, Homo sapiens
agaauaaagagggcaugcuuggcucaguccuguccuuccuguaaagaagggcauggcugagcuaagcauguccucuuuauccu

SEQ ID NO: 6299 - RNA, 76 nt, Homo sapiens
ggagggaggagggaggaggguccgggccaggugggagcuucuccccggaggccugaggcagcuucccuccucuccc

SEQ ID NO: 6300 - RNA, 100 nt, Homo sapiens
ccacucccugaccugugucccccuuuaccaccucguagguucauggccucuuucuucagaggcaugggguggggagguauggugagcagguuagggaggg

SEQ ID NO: 6301 - RNA, 72 nt, Homo sapiens
ggagugccuuuuggaguuggaacguccaggugugauuucacaggcuuggaauuuucaguccaagaggugccc

SEQ ID NO: 6302 - RNA, 74 nt, Homo sapiens
caaguuccccgaagcagaugugugcagaucaucaauucuaacucagacugugcaacuugccuuugggggacaug

SEQ ID NO: 6303 - RNA, 62 nt, Homo sapiens
gcagcagcaggcgcacggccgucuggaucuccgggacgugaugguggagcgcuuguuguagu

SEQ ID NO: 6304 - RNA, 62 nt, Homo sapiens; identical to SEQ ID NO: 6303

SEQ ID NO: 6305 - RNA, 57 nt, Homo sapiens
gcauguggugaccccacucaugguagcagacaccaggugguucaggucaccauaggu

SEQ ID NO: 6306 - RNA, 66 nt, Homo sapiens
ggaggcagagccaaaaccguaacagccagagcuagagacuccggccugggguucuggcucuguccc

SEQ ID NO: 6307 - RNA, 74 nt, Homo sapiens
acacauggucugauggcuuagguaaacacuaguccuggacaauggguuacugaggucguguacagaccaugcgu

SEQ ID NO: 6308 - RNA, 71 nt, Homo sapiens
ugacaucuccacucugcuccuuccgcccagcaugucacugaguguggguggggugcagagaugggggugca

SEQ ID NO: 6309 - RNA, 119 nt, Homo sapiens
gcauuaguucugcugaguaaucuuuaacuugcugcuuuauaaugauuauaaugagauaucacuggguauuauggucuuuggguagcagcaggguagggauuuccaggcugggacuaagc

SEQ ID NO: 6310 - RNA, 66 nt, Homo sapiens
agaucauauuugcuaauaugcaaauuuucagaacuccugaugaguuugcuguugcuggguaugacu

SEQ ID NO: 6311 - RNA, 111 nt, Homo sapiens
gcaggcagggcacaguccauauucacacaagcucugugagcugcuggacccccugccccguuacagggacugggggcacagcagugagcagaaaagaccggguccugccgc

SEQ ID NO: 6312 - RNA, 108 nt, Homo sapiens
ucaucuccagaaggcagugcuuccaggaaugguugcacacugucagcucauuuguguugucagugcugccaccucguucccagaagagcaucuguggauuuggggaga

SEQ ID NO: 6313 - RNA, 65 nt, Homo sapiens
ucaugucuguccucucauaggaucacgagacuaucacauggaucccacagagaagacaggcaaga

SEQ ID NO: 6314 - RNA, 65 nt, Homo sapiens
ggagccugggccaccacaggggaaggaugcugcucagagcccacagaccugggugcccgggcccc

SEQ ID NO: 6315 - RNA, 68 nt, Homo sapiens
agaccgauucugaaguguccccucagcaagcugagguaaagucauucugggggguaugagaguuggcu

SEQ ID NO: 6316 - RNA, 69 nt, Homo sapiens
ccacccuuuccccgcagaccucucugagauagucaacuccagagcucgggugccucgggugagaggggg

SEQ ID NO: 6317 - RNA, 67 nt, Homo sapiens
ugagguuuggagcgggggaggccacacucucagauucaaacccuggcucaucccacucccaaaccca

SEQ ID NO: 6318 - RNA, 97 nt, Homo sapiens
gcacacugguagcugaguacaggggagcugauggccagccuggagcuguggggcagcugaggagcuggccagccuccugggauacagggccaguggc

SEQ ID NO: 6319 - RNA, 79 nt, Homo sapiens
ggagccggcccgcuuccggggcauggccaggauguccaggcgugacagcuucuuggccugcucagcagcuggccggccc

SEQ ID NO: 6320 - RNA, 64 nt, Homo sapiens
ccaucuccagcacuccaaccacagcugaaauccaauucccucagcuggcuuggauuuggagggg

SEQ ID NO: 6321 - RNA, 111 nt, Homo sapiens
guagagagugcauucugcaggaugagugaaaaggcauuuaugauucuugggggcagauguucuacaguugccugugcuaguucaugucuuucugcagaucacauucuuaac

SEQ ID NO: 6322 - RNA, 81 nt, Homo sapiens
caaucagagacuagcuuauacauaaaauuacagauugacuucaccauacugcacuuuuaugaauaagcucauuucugacug

SEQ ID NO: 6323 - RNA, 73 nt, Homo sapiens
ucauuuuucuguguaucucuccagagaugcuuuauguauaucuaagcaacuuggggugguacaaggagaaaga

SEQ ID NO: 6324 - RNA, 126 nt, Homo sapiens
ugagggagaagaggaggcgcucaugugcagcgaugcuucccuggguccuaucccuggcgccaucccuggguacugauagggccugagguaagcugccacuuaccuggugcucuaacauucucccca

SEQ ID NO: 6325 - RNA, 82 nt, Homo sapiens
gcauccucaugcccucucccugcucuucucccccugcaucagagcacuguugggugcugagcagauggaggaagugaggagc

SEQ ID NO: 6326 - RNA, 65 nt, Homo sapiens
ugagcgcuuuguucuucgcuggcuguuguuaccgaucuauaagcggcaggcgggaaaagcgcgca

SEQ ID NO: 6327 - RNA, 160 nt, Homo sapiens
cgaaggaacauuuaucacacuaacacgccuguaaaguggagaggguucauccacaugcucucugcagcuucuauuagaacguuaauuguucauacugaagaaaaggagacauaaggaauggcuuuuaccaucacguguuaaguuuauuuuuguuccucug

SEQ ID NO: 6328 - RNA, 61 nt, Homo sapiens
agagucccugggucuguuccaucuaaacacuguugaagcaagagacagaucugagggaccu

SEQ ID NO: 6329 - RNA, 76 nt, Homo sapiens
acauaccucuuuggcuuuggaguaguuuaauaugaauuaaucacuaggcucucuucagaguuggaaacgagguggu

SEQ ID NO: 6330 - RNA, 60 nt, Homo sapiens
ugacauuuaaauugcaggcagcccuggguccauuccaggagcuggcugugguugagugca

SEQ ID NO: 6331 - RNA, 69 nt, Homo sapiens
ccagccuugaugccaccugagggccugagccucagugggguuggagcccugguggcagcccagggccgg

SEQ ID NO: 6332 - RNA, 80 nt, Homo sapiens
gcaaagcagcaauuguucuuuggucuuucagccaugaccugaccuucugucugugagaccaaagaacuacuuugcuuggc

SEQ ID NO: 6333 - RNA, 95 nt, Homo sapiens
ugauuuuugccaucagcauucucccuaucacggaaucauugcacaauuuaguaugauuaaugguuuccauuuaggagaagcugagaaugaaaaca

SEQ ID NO: 6334 - RNA, 63 nt, Homo sapiens
ugagggggugacucagagugugacugacucugguacuucaaacaugucugaguaacucccaca

SEQ ID NO: 6335 - RNA, 103 nt, Homo sapiens
gcaccugcugccuucugcuuuaacccuuucccagugagccugggcucgggacccucaggguucugggucuagaguuugaagagaggguggaguuggcgggagc

SEQ ID NO: 6336 - RNA, 88 nt, Homo sapiens
ucagaagguuaaaccugugucagguuuacaguccaaugaccgccgugggucauaauccaucuagagcucugagacaggugccuuuaga

SEQ ID NO: 6337 - RNA, 79 nt, Homo sapiens
guacuguuauguugagcuaacagggggcucuagaaacuuggcagauguuuagagcucucugguggccauauuaauagac

SEQ ID NO: 6338 - RNA, 68 nt, Homo sapiens
ugaaagcagcugcagaacccuucucucccucagccugggucuguguuuaggguucuggcuugcuuaca

SEQ ID NO: 6339 - RNA, 59 nt, Homo sapiens
ugagcuugaauguauguaauagagacaaacacaucucuagguuacaugcaagcaagcca

SEQ ID NO: 6340 - RNA, 71 nt, Homo sapiens
cuaaugagaugagaagucugcagcugguggcaagcacaauaaaccaugagccaagggcuucucuucaucag

SEQ ID NO: 6341 - RNA, 80 nt, Homo sapiens
ggaucgcacguggggccgcagacccugggcgcccggacgucagccggaggcgcggggaucucguggcuccgcugcgaacc

SEQ ID NO: 6342 - RNA, 82 nt, Homo sapiens
gaagaagacguuuuggguugugaaaauaggaucaggcaguagcaguugauuaauauguucacauauuccaaaauuucuucuc

SEQ ID NO: 6343 - RNA, 56 nt, Homo sapiens
caagggggugaggaggguggugggagcaaacacuucccucccuuucuuccucccug

SEQ ID NO: 6344 - RNA, 76 nt, Homo sapiens
ggagaaacugaggcacggugagaggcaggggcuggcugagccuaaggggccucuguacucagugccuccguuuccc

SEQ ID NO: 6345 - RNA, 101 nt, Homo sapiens
ccacugcaugaagagaguuaaaagugggccaugcuuggcuuagcagaguccuuuugcaaaagaggugugcuaugccacuaagcaugagccccuugcagagg

SEQ ID NO: 6346 - RNA, 73 nt, Homo sapiens
ggacuacuugugaaguagaaauacacuucuaguuaaaucacagaaguguguguuuuauuuauuauaguagccc

SEQ ID NO: 6347 - RNA, 66 nt, Homo sapiens
ggagagggcacaggcuuggcucucaaaaaggcuccauacaaaccgcugccugccugugcuccuccc

SEQ ID NO: 6348 - RNA, 66 nt, Homo sapiens
ggaggaguaguagaauguaaguucuggagggcaagaccugucuaucuuacauacugcugucucccu

SEQ ID NO: 6349 - RNA, 82 nt, Homo sapiens
ugauacugaggguuaguggaccguguuacauacgucacagauaaagcguacgcuauacggucuacuaucucuccaaguacca

SEQ ID NO: 6350 - RNA, 65 nt, Homo sapiens
ugacuugacugucccggggauuaaagccucgacugguuuccuaaucacccaggugacagcgagca

SEQ ID NO: 6351 - RNA, 86 nt, Homo sapiens
ccaggguagcugaggggaugguagaccggugacgugcacuucauuuacgauguaggucacccguuugacuauccaccagcgcccgg

SEQ ID NO: 6352 - RNA, 89 nt, Homo sapiens
ugacugcauuaucuagacaauuccauccuacgugggcacucgauacaaagauacguccacagugguggaauuguucaggcagagcagca

SEQ ID NO: 6353 - RNA, 80 nt, Homo sapiens
ccaguugaagguuaggcuuuguagagcucuaaggaaagguaggaaaauccuugggucuacagagccuaaagugcaacagg

SEQ ID NO: 6354 - RNA, 72 nt, Homo sapiens
gcagucaauuucgagucagugggcugugaaaagcaguuagaauaauaguuuauugacccugaauguggcagc

SEQ ID NO: 6355 - RNA, 93 nt, Homo sapiens
ccauccaguagggguuucccaccaccguguagcgcuucuugcggucguucuugcgcaaggugcguuucuuggugguggccuucuccauggggg

SEQ ID NO: 6356 - RNA, 82 nt, Homo sapiens
gcaccgguccccgagccaaguaauggagaacaggcuggacagcacacaaccuauccugaauuacuugaacugggucccgggc

SEQ ID NO: 6357 - RNA, 88 nt, Homo sapiens
gaacagauugcuggcauuauggcagccaggauauugucaggaggaacuuggcagugcucguagguguuaugaugcuggcucuuugcuc

SEQ ID NO: 6358 - RNA, 80 nt, Homo sapiens
caaagucccugugaagcuggccauggcucagaugaaggcacaagaggugagccauggcugagaguuuacaggguauucug

SEQ ID NO: 6359 - RNA, 117 nt, Homo sapiens
gcagcccccugggucccucuggcuccgcugucaggggcggccuugccgccaagaucuccggcuuucggaggcgcuaggcugcgucugaaagcgggcuggcgaccccagggaggccgc

SEQ ID NO: 6360 - RNA, 86 nt, Homo sapiens
ccaucccuggccagcagccccagcuccagccccagcacaccaccaccagggcaggagacuaaggggguguuggacaagaaggaagg

SEQ ID NO: 6361 - RNA, 146 nt, Homo sapiens
gaagcaggaacagcuauggggcucuuaguucuccuggugagugggaagcggagcuggggagacuggaacccaggcucugggcuccuuucccagugcuccuuccugccaccaacauucuaccugccccaccuuuucuaugaugcauc

SEQ ID NO: 6362 - RNA, 112 nt, Homo sapiens
ggagcgagcacuccagggcagagguggugggacugggggguugggggacuagagagcugugccuuucccucucucccccgcccucagucccugcccugcccagugugugccc

SEQ ID NO: 6363 - RNA, 83 nt, Homo sapiens
ccauucaucccuggguggggauuuguugcauuacuuguguucuauauaaaguauugcacuugucccggccuguggaagaaagg

SEQ ID NO: 6364 - RNA, 92 nt, Homo sapiens
ugacuuacucagaacagcauaggcuggcuccuugaaagguuuuucccuuuuuccuaccuaaggaaggcguucuaucuguucugcagaaggca

SEQ ID NO: 6365 - RNA, 106 nt, Homo sapiens
gaauagaaugauauaacaaggcaauauuucugaaagcugagaucaacagacugugauuaaagucagcuugcaguuauauuggcugagaaugucaugccagcugcuc

SEQ ID NO: 6366 - RNA, 112 nt, Homo sapiens
ggagguaagggguucggggacccgggcugggcuccaggaguggccuggacaccuccuucggggccccaguucacuccuggccgaguugcauccuugagcccacgucaccccc

SEQ ID NO: 6367 - RNA, 70 nt, Homo sapiens
caacaaaggacaccaaacuaauugggauuaaaaaacucuuuugugucacuuaaggguggugucucuugug

SEQ ID NO: 6368 - RNA, 100 nt, Homo sapiens
gaagguaguucaguuucuccagauuaccacagaagacagcucuguggauccuccucagaugagaugauuuaaugugguauuggggaaaugagaagccguc

SEQ ID NO: 6369 - RNA, 69 nt, Homo sapiens
caaugagcagugaauaucaaugagaggaaaauggcccauuuuugcuucauugauuuuugcuggucaaug

SEQ ID NO: 6370 - RNA, 70 nt, Homo sapiens
ugagcugccuuccugccuuccauucuaguuugacaagugguaaaaaagaagagagguaggaagcaagcca

SEQ ID NO: 6371 - RNA, 128 nt, Homo sapiens
ugagcagggagguccccggcccagcucccaucccagaacccagcucaccuaccuugagaggcucggcuaccucaguguggaaggugggcaguucuggaauggugccaggggcagagggggcaaugccg

SEQ ID NO: 6372 - RNA, 83 nt, Homo sapiens
caaaaguccccuguguagccggcagcagggggacaugugaagacauggagaaggggcuggugcuggacccacaggggcuucug

SEQ ID NO: 6373 - RNA, 88 nt, Homo sapiens
ggagccucguuuacccucaucuggggcuuuaauggaaguuuuaagucaaugggaaauucaagcuuuggaugagcagugaauguggccu

SEQ ID NO: 6374 - RNA, 68 nt, Homo sapiens
ucacccuccucuuuugcccucccccaucugauuaggcgcggacugggaagggugggagugguggggga

SEQ ID NO: 6375 - RNA, 62 nt, Homo sapiens
agagagugcaaggccggaagcccccuccucucaacgggagggcucacggcuugccccucccu

SEQ ID NO: 6376 - RNA, 63 nt, Homo sapiens
guaaccucuuugaucaauagaaaaccaguuuuucauaaaacagguuuucuauugauuggugac

SEQ ID NO: 6377 - RNA, 75 nt, Homo sapiens
ugacuccuguuauguucacuucaggguuguacccuaucuagagccagcccugaccacagacaaagcaggcagcca

SEQ ID NO: 6378 - RNA, 87 nt, Homo sapiens
gcacauuccagacgcguguggucagcggcgggcgugugccaggcccggcaccccugcccgcgcuggccgccucacuggaaacugggc

SEQ ID NO: 6379 - RNA, 113 nt, Homo sapiens
ugacuaauuuuucauccaaggcuugugccuacauuucaauuuccagggaucaaacaaacagacuuaaugggaaacugaaauucagguauaaucccaaggugaaaaaugagcca

SEQ ID NO: 6380 - RNA, 116 nt, Homo sapiens
caacuacagccacuacuacaggaccaucgaggaccugcgggacaagauucuuggugccaccauugagaacgccaggauuguccugcagaucaacaaugcucaacuggcugcagaug

SEQ ID NO: 6381 - RNA, 84 nt, Homo sapiens
gaagcaggccucaccugauuuccacccaccuguaucacuuuuaguaaauggugcagggauggaaauaagcgggggaaccagcuc

SEQ ID NO: 6382 - RNA, 119 nt, Homo sapiens
ggaacagcugcgucgugagaagugaggaggcccaagggggauggugguggugaggaagccgagaggacuuggccauucaccagcuccucagggaaagcacugcucaccacgcaaggucc

SEQ ID NO: 6383 - RNA, 84 nt, Homo sapiens
ucaggccaaaccuuaguggucauuguuaaggucacacagccaucgccugaaggugaccugacaguggcuucugguuuuacccga

SEQ ID NO: 6384 - RNA, 66 nt, Homo sapiens
ggagggcagggcccuaagauacacaucagaaacaaacguccucauugugucuugggcccugguccc

SEQ ID NO: 6385 - RNA, 115 nt, Homo sapiens
agagugugaagacagggaggcauugguaugcagaacacacagucacccuuauauaggucacugcuggaggacugugcugugcauguacuuaagccccgcuucuguuucaagcccu

SEQ ID NO: 6386 - RNA, 72 nt, Homo sapiens
gcauguucucagcaaucaguccucccccagcgccuguccccagagcugggagggggcaacugcugagucagc

SEQ ID NO: 6387 - RNA, 97 nt, Homo sapiens
ggacauuucuaggggauuaauggccagcugggagaguugauggcccagaggagggacucauuaaccucagcgggccauuaauuccuuaggcacugcc

SEQ ID NO: 6388 - RNA, 72 nt, Homo sapiens
guaaccuggcuuuuuguuucaacuuucauuuucaacuugaaagcaaagacaauagcagaaagccagguggac

SEQ ID NO: 6389 - RNA, 72 nt, Homo sapiens
gcagcaaguaaaucuggacagguuguaguuaaucucuaagccaagagccugagacuagguuuauuugccagc

SEQ ID NO: 6390 - RNA, 75 nt, Homo sapiens
ggauuuuggaggagccagcggcuggcuaucgagaagggaagggagcuagcacuugcugaguuucuucaaggggcc

SEQ ID NO: 6391 - RNA, 70 nt, Homo sapiens
ccacucagaugaugucaggcccaguuccucagugcccugcacaaggaacagggcucaucuucugagaagg

SEQ ID NO: 6392 - RNA, 91 nt, Homo sapiens
ggaauauuccucagcuguuucuagucugguuuugugacuagcuaucuuggaauaguuaugccagaucugaagcaacugaggcaguauggcc

SEQ ID NO: 6393 - RNA, 74 nt, Homo sapiens
ggaaggccuuaggcugucagcggcugccgagggaggucaccuccgcuggucguuuggcagcauaggccugcguc

SEQ ID NO: 6394 - RNA, 56 nt, Homo sapiens
agacuuggugagcugguaggaagacuugccaagcacugcuggcuugccaagcuccu

SEQ ID NO: 6395 - RNA, 66 nt, Homo sapiens
aaaccagggggaggaggguguuggguggagaugaaguugcucuugacucuccuucccauggcuguu

SEQ ID NO: 6396 - RNA, 130 nt, Homo sapiens
cuaguggagguacugugcuuuguguguuggaggaugaaaguacggagugauccaucggcuaagugucuugucacaaugcugacacucaaacugcugacagcacacguuuuucacaguacuuacgccccag

SEQ ID NO: 6397 - RNA, 87 nt, Homo sapiens
agaauuucugccuuggucaaaaacucucaguggacuguagcccaggccuuuggucugcugagaguuucugacugaggcggaaaggcu

SEQ ID NO: 6398 - RNA, 78 nt, Homo sapiens
acaacuggggcuuguuaaagaggaaaagugguauuuuaacuccaagugucacauuuuccuauagucagcucuagcagu

SEQ ID NO: 6399 - RNA, 89 nt, Homo sapiens
ggaagaggaagaaucaccgagaaaagggaaggcucccagcagggccaggcaguuggcaguggucccacuucuugagucccuuccuccuu

SEQ ID NO: 6400 - RNA, 92 nt, Homo sapiens
uuaaaggugggcacuuagcacauuuauuacauacggggcuuauuagauaacugggcucuguugugauaaauuggcugugugcuucauuugga

SEQ ID NO: 6401 - RNA, 71 nt, Homo sapiens
agaaugaggcagguagcugggcuccaggaagcucacaugcuuuuaaagcuccaguuaaauagcuuuaagcu

SEQ ID NO: 6402 - RNA, 70 nt, Homo sapiens
ggaaggagcucugauuguugaggagggaacugcgauuucaaaguguccccuuccaaucauagcucccccc

SEQ ID NO: 6403 - RNA, 94 nt, Homo sapiens
gaaaccagaguuucaaguggauacaauguugggaagggucaaacuaacuucaagggauugacccuucucaacauuauauccauucuuugggguc

SEQ ID NO: 6404 - RNA, 84 nt, Homo sapiens
gcaauguguuuccauagaccucuauuuucucugaguaagcaaccacuagggagagauaagggucaugugucauauacacagagc

SEQ ID NO: 6405 - RNA, 86 nt, Homo sapiens
caaaauccccccuguggaagacagcugaguggaugucucuuaggaacacuggagggccauuggguuucuccacaggggagaugaug

SEQ ID NO: 6406 - RNA, 66 nt, Homo sapiens
ucaaauuggugucccauuuguugggcuccuggcaaauauucccagcuuauugggacacugaucaga

SEQ ID NO: 6407 - RNA, 77 nt, Homo sapiens
gcaacucagggauaaaaauacccagguccagagcaugugacaggcacugcuggaaccgguauuaucccugggguggc

SEQ ID NO: 6408 - RNA, 109 nt, Homo sapiens
gaaaaaugagugggaguuguauacagaaaaaugucugcauggcugucugcuacaguguuaguuaugcagauaaucuaugcagcauuuuuuuacuccuaaucaucuccuc

SEQ ID NO: 6409 - RNA, 106 nt, Homo sapiens
ccaaaauaugcucacucauagcuuuuucucugaccuccuucccagccuucuuagaugggaggaaggagggaggggaggggagagcugugcaucagucaggguaggg

SEQ ID NO: 6410 - RNA, 122 nt, Homo sapiens
ggaaaacaaucccccaagaccuuggccuucucccuguggaggaccccuuacccaccuugucauggacgucagggaccccucugaguggaggagucagauagggcuuggggggugucagggcc

SEQ ID NO: 6411 - RNA, 85 nt, Homo sapiens
gcaaacccuuucucucagcaggaaagcaugcaagucaaaugccaucauaaucacuuuguguuucccugcagagggaaaggagggc

SEQ ID NO: 6412 - RNA, 147 nt, Homo sapiens
gcaaaguuuucggcuagcccucacuaucucucaaccccccuuccuccacuucccugcuguucuuucuuggcacacaaaauauaggccaaugagcagugggugggugaggaggaugugagagaaaauuugagaaguaaaaaaaggagc

SEQ ID NO: 6413 - RNA, 81 nt, Homo sapiens
guaagaaaugagaaauuuuuagggccauugagcaccaugcauuuucaguguucaguagcccugaaaauuucucauuuaggc

SEQ ID NO: 6414 - RNA, 67 nt, Homo sapiens
ugaagguuuaggugaauuuugcugcaucuucuccagauggggaugcugagauucaccugaaugugca

SEQ ID NO: 6415 - RNA, 156 nt, Homo sapiens
ggaauggggaagccaguguuggggaaguugagaauguggggacccgaggggccagcagggauuuucuagucucccagcaagguuuuccggagacugaagauggcucuauuggacccaucucuccccaccuuuuccaucacuggguucccccacccc

SEQ ID NO: 6416 - RNA, 143 nt, Homo sapiens
ggaauucuucauaaccgaaguguguuuuccccgaggaguuaugcuaccauuugauuuaauuuuuaauuuuuacauuuuaaucaaaaauagaucaaauggugguggucucuccggggaaacacacuucagauaggaagccggcc

SEQ ID NO: 6417 - RNA, 68 nt, Homo sapiens
ucacuccucuuccuuuuaauugcaauugacccuucagaaaucaaguaaauuaagggggaggggaaaga

SEQ ID NO: 6418 - RNA, 80 nt, Homo sapiens
gcacaggagaggguacuggaagagugugcccuucaccauguagucaucgguacaugccuuccaguaccauuuuucuaagc

SEQ ID NO: 6419 - RNA, 87 nt, Homo sapiens
ggaccccuguuuaucuucaccugcucuacccacuuccaucccacccuaugaaaggagaaguguagacaaggugggaguuaggguccc

SEQ ID NO: 6420 - RNA, 94 nt, Homo sapiens
gcacugacaaagccccucucacucugucccucagucaggccucaccugcacucagagaggcagggcauggggggcucuuccagaugucaucagc

SEQ ID NO: 6421 - RNA, 69 nt, Homo sapiens
ugacucaggugcaguaauugccacagaaauugguuuuggugucuuuggggaauucugcaguugaaccca

SEQ ID NO: 6422 - RNA, 67 nt, Homo sapiens
ggacaggugggaggugggguggggggagcuggaaggagacggcagccccgcccccgcccccacugcc

SEQ ID NO: 6423 - RNA, 82 nt, Homo sapiens
gaacaguugugugcauacagugggucuuuguguguuugaacucccaccacauaagggcaaacucgauaugcaugcuaacguc

SEQ ID NO: 6424 - RNA, 82 nt, Homo sapiens; identical to SEQ ID NO: 6423

SEQ ID NO: 6425 - RNA, 82 nt, Homo sapiens; identical to SEQ ID NO: 6423

SEQ ID NO: 6426 - RNA, 82 nt, Homo sapiens; identical to SEQ ID NO: 6423

SEQ ID NO: 6427 - RNA, 82 nt, Homo sapiens; identical to SEQ ID NO: 6423

SEQ ID NO: 6428 - RNA, 83 nt, Homo sapiens
gcacauuauacuacuuguaacuauaaaagauguaacaaaugaucuaaguacaucauuuguaguuacagguaguauaagggggc

SEQ ID NO: 6429 - RNA, 112 nt, Homo sapiens
ccaccccgguccugcucccgccccagcagcacacugugguuuguacggcacuguggccacguccaaaccacacugugguguuagagcgagggugggggaggcaccgccgagg

SEQ ID NO: 6430 - RNA, 112 nt, Homo sapiens
gcacuacccaaccccagcucccaggacaggcccagggcggggccaaggucagggaggccccaaaugaccccccgccccggugcauucugggaaauucgccgggggugggggc

SEQ ID NO: 6431 - RNA, 95 nt, Homo sapiens
guagcagagccaggcaagcuauacugucauggugacucugagauucaaacugaccuagagucaccauggcaguauagcaugccuggcucugucac

SEQ ID NO: 6432 - RNA, 67 nt, Homo sapiens
ccaggggcuccagcuaccccauucaccccugcacccacagcaguggggucaggcuuggggcccaggg

SEQ ID NO: 6433 - RNA, 88 nt, Homo sapiens
acagagcuguggcccaaggccuacccuggggagacaaggucaggauccugcucuccuucaggagugggcuuugcuuuugcagcugagu

SEQ ID NO: 6434 - RNA, 71 nt, Homo sapiens
ucagaggaggagcugccuggcagaggggcuggugcuggggcagagggcuggcugcgggcagcccuccugga

SEQ ID NO: 6435 - RNA, 67 nt, Homo sapiens
ucaggauccgaggcucccagacccggaaagcccaggucaggccgggcugagaugcccuggaucagga

SEQ ID NO: 6436 - RNA, 66 nt, Homo sapiens
gcagcacaugaaggcgcccacacauuacuucuuagcagcugagugugaggugcaugcaugugaggc

SEQ ID NO: 6437 - RNA, 68 nt, Homo sapiens
ggaggaggccugggaugagcaggagaaggacgagguccaccacccugcuccauuuccaagccucuccc

SEQ ID NO: 6438 - RNA, 144 nt, Homo sapiens
gcagugggucuuauacuuuccggaucaagauuagaggcucugcucuccguguucacagcggaccuugauuuaaugucauacaauuaaggcacgcggugaaugccaagagcggagccuacggcugcacuugaaggacaccaaagc

SEQ ID NO: 6439 - RNA, 106 nt, Homo sapiens
gcagugaguggauaaaugagccgggaguugagaugugagcacccuccuauggagaguuaucucagauuacucuuggcuuccagaaguaacauuuagccaucaaggc

SEQ ID NO: 6440 - RNA, 97 nt, Homo sapiens
ggagcugcaggaaaauacacagggccggaucuugccagaggaggcugaagauggggaggacauggggagaaaugagccuugguggaaugcaggagcc

SEQ ID NO: 6441 - RNA, 69 nt, Homo sapiens
gcaggaaacagaagggaugcgccaaggaaaagaacaggcaaauggcaggcaucccuuuuaguucauggc

SEQ ID NO: 6442 - RNA, 69 nt, Homo sapiens; identical to SEQ ID NO: 6441

SEQ ID NO: 6443 - RNA, 95 nt, Homo sapiens
gaagaucucaggcagugacccucuagauggaagcacugucuguugucuaagaaaagaucgugcauccuuuuagaguguuacuguuugagaaaauc

SEQ ID NO: 6444 - RNA, 87 nt, Homo sapiens
ccagacuuuuccuagucccugagacccuaacuugugagguauuuuaguaacaucacaagucaggcucuugggaccuaggcggagggg

SEQ ID NO: 6445 - RNA, 140 nt, Homo sapiens
ggagaacucuguggaggugcgucgggcauggacacucaccugucuuuuuugugggauccacaggauaaucccaugauccuagaagaaggcagacaugagccagucugaagaaaagccaagcacagccccagaaauagacc

SEQ ID NO: 6446 - RNA, 84 nt, Homo sapiens
caagacggagggcgcggaaggaggcggggcggggggcuuugccuggucaccuugucaccagcccccuccguguccucagaugug

SEQ ID NO: 6447 - RNA, 88 nt, Homo sapiens
ggagcuagcagagugggaacugugaggaccagggguagcugguggugcugacuucagcacuccugaguccuggcccucccucuguccc

SEQ ID NO: 6448 - RNA, 71 nt, Homo sapiens
ccagggcugagacagagggcguuggcaaggaugcugcuccuucaggcugugaccccucugucuuugcaggg

SEQ ID NO: 6449 - RNA, 73 nt, Homo sapiens
ccaggaucuccucucccuugucuccuacauucucccauuggagaagaaaaggggaaaaggcgagaagagaggg

SEQ ID NO: 6450 - RNA, 117 nt, Homo sapiens
ugaucuuuucaguauucugugacuugauugguuguccauucuauuucaguucucacuuaucuggggaauggaggagggauggauuguuaauuaauaugcagaauacugaaaaggcca

SEQ ID NO: 6451 - RNA, 117 nt, Homo sapiens
guauggugugugcuaaguuuugcauuucuuugcauguugggcucauccucuccaaaaagauacuuuggggaagauggcccacauguaguugcagcuuauguugugcuuacaccucac

SEQ ID NO: 6452 - RNA, 100 nt, Homo sapiens
ucauuccaacagcugcuaaagaucuggugagccgguugcuggugguagaccccaaaaagcgcuacacagcucaucagguucuucagcaccccuggaucga

SEQ ID NO: 6453 - RNA, 93 nt, Homo sapiens
gcauugauauagauuuaguugaaauguaaucucuuaaaucuguccaagauucggggagauaauuacacuuucacugaauugccaggggucagc

SEQ ID NO: 6454 - RNA, 85 nt, Homo sapiens
ccaucccugagccccuuucuaaccaugcuguaccacacugcugaccauaucgugggauguccauuuggaauggggcuggggucgg

SEQ ID NO: 6455 - RNA, 70 nt, Homo sapiens
guauggucagaagucgaaggagggccauuuaaucagagaauguggaacugcuuggacuuuugagcucagc

SEQ ID NO: 6456 - RNA, 72 nt, Homo sapiens
ggauggaggggugggggaccccaggagacucaagccucugaagccuccuguccugucccccugcccaccccc

SEQ ID NO: 6457 - RNA, 84 nt, Homo sapiens
guauuuauguaagaaucauauuucucucugugcagaucacuuacagaagugucuguuaacaggagagaaugauacauaaucagc

SEQ ID NO: 6458 - RNA, 68 nt, Homo sapiens
cuauauuccauuaucuuccucugcccuugaacaguugauaauaugggggauggggaagagaggaagag

SEQ ID NO: 6459 - RNA, 77 nt, Homo sapiens
gaaugucccuaucccugcccuccagaagcucccaguguugugggacucugauggauggacagggguagugaagacuc

SEQ ID NO: 6460 - RNA, 70 nt, Homo sapiens
gcaugauguccugggggguugggacccggaaaaaagucucacugcucaccagccccccaggaaacuccgc

SEQ ID NO: 6461 - RNA, 68 nt, Homo sapiens
agauucaucaagcaaagguuaagggcuaguguuguuuuucucuggccuagaacuuggcuuguuuugcu

SEQ ID NO: 6462 - RNA, 91 nt, Homo sapiens
gaauucuugaugguuuaauguaugccaacgcuuagaguaaugugccagccauuauucuaagcauugguauacauuauuucauuuacuccuc

SEQ ID NO: 6463 - RNA, 74 nt, Homo sapiens
gcauuuauuuccaagagcuuauuucugaaugacaaacaucuucauacaugaaauaggauucuggagguuugagc

SEQ ID NO: 6464 - RNA, 125 nt, Homo sapiens
agcacugagacaauuguccauaucauucaagccaaagaaacacuuugauuugaaauucuguaucuaaaugauuggggccagagugcuccuuugguuugagugauuuggauaauuguuucaguucu

SEQ ID NO: 6465 - RNA, 68 nt, Homo sapiens
cucuuucccagggagcuucugagaauuaaugagacaauugccaagugcuugaagcuccuugggaaaag

SEQ ID NO: 6466 - RNA, 67 nt, Homo sapiens
accugcuagauccuuuuuaggcauccccauuugucuuccugccaugaaaagaggggaucuagcaugu

SEQ ID NO: 6467 - RNA, 61 nt, Homo sapiens
accacaaaucccagaagucaccgcggccgcccccacugcaugaccuucugggauuuguagu

SEQ ID NO: 6468 - RNA, 82 nt, Homo sapiens
cuccauccucagguucuucuucuguaaaaugaagaucccuuugcggugaaacguuuugcagcucuggaaucugaggguguag

SEQ ID NO: 6469 - RNA, 118 nt, Homo sapiens
cccuggaaaauuaauuagucaauguaugcuauaaagacuaauaauuuguucauaugcgguaucucuaacguagguuguuauccauuauagcaaaaccugaccaauuaauuuuucaagg

SEQ ID NO: 6470 - RNA, 68 nt, Homo sapiens
ugcagagggagagagcguuaccaccucacaauaauuuucuucucaagaaugguucucucuccuucuca

SEQ ID NO: 6471 - RNA, 70 nt, Homo sapiens
gacacaauucccacacuugaagcccucuggugugaauauaugagagauggccuuaggugggaauugucuc

SEQ ID NO: 6472 - RNA, 74 nt, Homo sapiens
guccagugugcaucugcuguugcuugaccacauugccaaacacaauuuggcaagcacagaaauguacauugagc

SEQ ID NO: 6473 - RNA, 72 nt, Homo sapiens
cucagguggccaggugcauaucuuggugugaggaccuucacuguaucugggaaugccuacuggucaccucgg

SEQ ID NO: 6474 - RNA, 67 nt, Homo sapiens
ugcagguggaagcauggacuuugcuaucuauaaaaaaauuuaauggugaagaucaacuuccgcuuca

SEQ ID NO: 6475 - RNA, 77 nt, Homo sapiens
ugcaaagcaagagcauacuuuugcacuuucaaacacuauagcuuaguguuuuuaaagaaaaguauguuuugcuuuca

SEQ ID NO: 6476 - RNA, 67 nt, Homo sapiens
gcccuuccucaaggcugacuggguccacuggaggacaagaaaagugguacagccuguggggaagugu

SEQ ID NO: 6477 - RNA, 62 nt, Homo sapiens
ggcaaggccagagggcauucaagugacacucaugccaccugggagcugccaccuggccuucc

SEQ ID NO: 6478 - RNA, 178 nt, Homo sapiens
uccccuugguggucugugugcuguccugcauggggucggcagcucugcucagcgcuguaacaaauuuaaaaaaaacuaaaguuugaauuaauuaguuuuuuuucaacuuguuacagcagcgaauggagcugccgugguucgguguagacugcagcacagugaaggagcgccgaggaga

SEQ ID NO: 6479 - RNA, 78 nt, Homo sapiens
cacugaugguggacagaggagaggggaagagagaaggucaagauacucccuacuucccuucuaaguguuaccaucaug

SEQ ID NO: 6480 - RNA, 110 nt, Homo sapiens
agcagggcugaggaugccugacaguaaaaguacagaccuuucuugauaagccccaugguuuccuucuuggagaagggauugugcucuguacagaugcauucagucuucuu

SEQ ID NO: 6481 - RNA, 109 nt, Homo sapiens
ggcuuccaguuggggggccauaugcugucuuuaaucugccugugcaauucucaccgaugucaauaggcgcgggcgggugggugguucaaauggcccgagagcugggacu

SEQ ID NO: 6482 - RNA, 67 nt, Homo sapiens
ggccuguguuuuuaacucuaggagucaugaucugaaugugaaauuccaagggcuacaaacacagacc

SEQ ID NO: 6483 - RNA, 73 nt, Homo sapiens
cucuccccuuuucucaagcccaggcaagggaggugauauccaccggcagcuccuggguuuguagaggggaagg

SEQ ID NO: 6484 - RNA, 67 nt, Homo sapiens
cucuccugucaccuugcucuccuaucaacaugucauuuuuuagaaggggcagcaggagauaggaagg

SEQ ID NO: 6485 - RNA, 77 nt, Homo sapiens
gccgccagcucauagguuucaaagcucugggacagaccucaugaacaucuuggggcuuuaacguguaagcuggcagc

SEQ ID NO: 6486 - RNA, 96 nt, Homo sapiens
gccacaggaaccacaagcagcucauucucauuccaagacguuuuguaaauaaacuaaggaaaugugugggggaagggaagucugcuuuuccugugc

SEQ ID NO: 6487 - RNA, 113 nt, Homo sapiens
gacuagaugaucuuaaaguuccuucccauucuaacauucugugauucuuggauguuauaaauucccagaaucauaaaauuuagaguugaaggaacuucagaagucaucuauuc

SEQ ID NO: 6488 - RNA, 77 nt, Homo sapiens
ggcgaagaggucugggcguaguagugacgaauccuaagacaagggaucuccacuacugcggccacacacuuuucucc

SEQ ID NO: 6489 - RNA, 66 nt, Homo sapiens
ucccuucucccaucuuuauucgcuaggauccaaguaaauucuagugggcaagaggaagagaagaga

SEQ ID NO: 6490 - RNA, 93 nt, Homo sapiens
agcaugaagaggagccuaucuaaagcaggcucuauuuaauacaaugugguuuuaauuggagucuguuuuagaugagccaccuguauuucaucu

SEQ ID NO: 6491 - RNA, 67 nt, Homo sapiens
gccccuuccaguccuucucggaugaagcacaguugccgguuacgcuuccgaggaggacggaaggugc

SEQ ID NO: 6492 - RNA, 94 nt, Homo sapiens
cacauauugacuuauguuuuuagucaauaucaagauuuauugucuccagaguuaaauaaaucgugauauugaccccaucauaagccaauaucug

SEQ ID NO: 6493 - RNA, 102 nt, Homo sapiens
cucugggggaauguggucccccuuuuacugccuuuuucagcccacuccccccaguugaauuuuucugagaggcaguggaagggaaaguauauacccccauag

SEQ ID NO: 6494 - RNA, 76 nt, Homo sapiens
cccguccugacccagucuuggccguaccacccagcaccaguugccgccccauggacaggacuggggccaggacugg

SEQ ID NO: 6495 - RNA, 62 nt, Homo sapiens
cucccuuccaaacggugcucccucugaugccacuuggcugacugagcuacugugggaggaag

SEQ ID NO: 6496 - RNA, 89 nt, Homo sapiens
cuccccaccaggcacugaaaucuugacuguacaccuccuaugggucuaggugggugcagggaggaucagcugcagauaaagguggguag

SEQ ID NO: 6497 - RNA, 97 nt, Homo sapiens
uccccuugccugaccucaauguccucaucugcccagugggauucagauuuuuguguuacccagggaugugggaggaugaagugagggcgcgaggaga

SEQ ID NO: 6498 - RNA, 79 nt, Homo sapiens
cucagcaguggagauacaagaggccugacguguauugauugcccacgacauggcaggaaucauguguuuuggcugcuag

SEQ ID NO: 6499 - RNA, 85 nt, Homo sapiens
gucuagagaggagugugucugugugcguaucuguguguacauacgcacauaaaauauauacacacauauacacucauuuuuacac

SEQ ID NO: 6500 - RNA, 71 nt, Homo sapiens
agcgagggugcagggcugggguacuaauauuagauggacacuauccaugguaccccugccucagccuuccu

SEQ ID NO: 6501 - RNA, 82 nt, Homo sapiens
cgcgauucuugcucccaggaugcaaugcgcccccguucgcccuuuagacccuuuggcguugcaaacugggaguuggaguccg

SEQ ID NO: 6502 - RNA, 138 nt, Homo sapiens
ggcugugggucaguaccuuaaaaaaguagcugaggucagaggaggcuggggcacaggaaaugguuguacaaugaucugcuacuuauaaaugccccaccucccacucacuguggcauuuuagagguucugccccacacc

SEQ ID NO: 6503 - RNA, 77 nt, Homo sapiens
cccuguccuuacugaggucccaaacugguagaccacuauaaaugaaaggaugcuagauggggcuucagggggcaugg

SEQ ID NO: 6504 - RNA, 82 nt, Homo sapiens
ugcgguacuugaagaaaugguuuaccgucccacauacauuuugaauauguaugugggaugguaaaccgcuucuugguaucca

SEQ ID NO: 6505 - RNA, 63 nt, Homo sapiens
ggcaccagaagugcugacgaggauguugcauaugcucacgaugacucagcacuuccugguuuc

SEQ ID NO: 6506 - RNA, 78 nt, Homo sapiens
ggcggcucuaggcuucaggggucugucugcacaggggcuagccccucccagaccucugugaagccaguacgggccucc

SEQ ID NO: 6507 - RNA, 128 nt, Homo sapiens
ucccuucuucagugggcuccuguggggcuauagcaucaaggcucucaauaaaaaucugaacaguucaacaauuuuuauugagucuugauugaacagccccgagggagcuaagcacagaaaagaagaga

SEQ ID NO: 6508 - RNA, 126 nt, Homo sapiens
ggcagucacuuccucgcugggcucuucucaggaagcagagcaaaguccugggcacuucucagauacucagccugccugggauuucugcuaccugaucaaggaagccagcuccaggauccugacucc

SEQ ID NO: 6509 - RNA, 90 nt, Homo sapiens
gucuauuugugucggguuaaugaacucuucuagggcacucaauagaaccagcgugccuuuaaaggacucauugaccucacagggaugagc

SEQ ID NO: 6510 - RNA, 65 nt, Homo sapiens
gacaaacgucuuugcagccaguaaaggucaacuugucaccuuugcucuagcugcaaaucguuuuc

SEQ ID NO: 6511 - RNA, 98 nt, Homo sapiens
gccucuuuucaagcauucccugccuggcccugugcagguguuugacucugagauucugcaucugcaugguugggcuuucuggugcauggacaagaugu

SEQ ID NO: 6512 - RNA, 81 nt, Homo sapiens
ggcgcccagggggagggggcaggcaaaggcccuuuaauuaguuacuuucaaagguucccuguccccuuucucucggguccc

SEQ ID NO: 6513 - RNA, 62 nt, Homo sapiens
gccauuuauggggcuuggauuggggccaaacgcugcccuagaaaauccaggucuuggaaugc

SEQ ID NO: 6514 - RNA, 67 nt, Homo sapiens
gucauagcauugggagaugaauuaaccuucgacauggagagagggauucgucuuucaauuuuauaac

SEQ ID NO: 6515 - RNA, 107 nt, Homo sapiens
ugcuugccucuuuuccaucuccucuggagguucucacaucuccaccaaacauuuuaaaaacuggguggagaaguaugagccuucacaggagaugaaacagaguaaca

SEQ ID NO: 6516 - RNA, 72 nt, Homo sapiens
gccuuccggacacaggcgguggucugggcaccccagggugcagcccagagcagugggguguguugggaaagc

SEQ ID NO: 6517 - RNA, 96 nt, Homo sapiens
ugcugcugguaaugagaaagacagggguggagacagggcucaugauguccucuucuucccuuugucuuucccccuguuuucuuucuaugagcauca

SEQ ID NO: 6518 - RNA, 69 nt, Homo sapiens
cacugguggcuuucuagggucacuuccucuuacaggagguugucgugaccgcugggaaugcagccaaug

SEQ ID NO: 6519 - RNA, 89 nt, Homo sapiens
uccuccugccaaacgcgucuuggcuccgucugaauaucucuccuccucgauuuuuggcuccagcucugggcgcguucacuaaaggaaga

SEQ ID NO: 6520 - RNA, 78 nt, Homo sapiens
agcaucuucgucauccugaaauuucccaucaaaacuaagaauuccugcaguuuaugggagacgggaugaugagauucu

SEQ ID NO: 6521 - RNA, 86 nt, Homo sapiens
uccuucuugcuuaacaggguggaaacuugauaaaauacaccugugaguuaggguuuuuguuauuuccuaccugacagccagaaaga

SEQ ID NO: 6522 - RNA, 71 nt, Homo sapiens
gccgggucuggcugggagacaggcgccgggugggaacacuuagccaagucucccuggucagaauucccugc

SEQ ID NO: 6523 - RNA, 85 nt, Homo sapiens
ggcaguaguuaucacagugucuguauuuauuaaacaagcaugaauaugcuggucaucguguggcaggcacuguuguaaucacuuc

SEQ ID NO: 6524 - RNA, 75 nt, Homo sapiens
ugcuagaggauaaauagagcccucacauccuuuauauucaucuauaggacaugagggcucuauuuucagcuguca

SEQ ID NO: 6525 - RNA, 75 nt, Homo sapiens
gccaugauaaagguguuggaacaaucgugccaauauggccacaggaagcacgauuguucucuccuugcgcauugc

SEQ ID NO: 6526 - RNA, 75 nt, Homo sapiens
gccgugggagcaggagaccagggaggagcagcguuuuccacggcacccucuucccgaggucccagcugacacagc

SEQ ID NO: 6527 - RNA, 78 nt, Homo sapiens
uccccagucugcccacccaugccacagggcuccucuggccagagccgagccacuggguguuuggugggcacaugguga

SEQ ID NO: 6528 - RNA, 78 nt, Homo sapiens
agcggguaccuggccaggccccuugcagggcagaaccucagguggauaggccucucagggucuggccggguccccccu

SEQ ID NO: 6529 - RNA, 87 nt, Homo sapiens
ucccaugcugugacccucuagagggaagcacuuucuguugucugaaagaaaccaaagcgcuucccuuuggagcguuacgguuugaga

SEQ ID NO: 6530 - RNA, 93 nt, Homo sapiens
ggcugugugaggcaggggcaggaccuucagaguccucacagcuuugugaggcaaaagucugaguccaguccuggccucugccgcucacccacc

SEQ ID NO: 6531 - RNA, 93 nt, Homo sapiens; identical to SEQ ID NO: 6530

SEQ ID NO: 6532 - RNA, 93 nt, Homo sapiens; identical to SEQ ID NO: 6530

SEQ ID NO: 6533 - RNA, 70 nt, Homo sapiens
uccaguccauuggggcauuauuuugcacauugaaguggcaauuuauuaaaauaguaccccuguggucuga

SEQ ID NO: 6534 - RNA, 80 nt, Homo sapiens
gccgagcccgcacacugcucccaggacagccggcacaggcagacgcagcccuggcaccgggagcaggugugggcuccagc

SEQ ID NO: 6535 - RNA, 73 nt, Homo sapiens
gcccugauggauuaacugguuccauugucuguggccgucauuggacuauggcacucuuaauccguacagcagc

SEQ ID NO: 6536 - RNA, 113 nt, Homo sapiens
ggcugaaauuuuagaacagguaaaguuuagaagagguaaauuuccuuuucagcaaccugcaacaaaggaaacuugcuucuucuaaacuuaaccucuucuaaaauuucacaacc

SEQ ID NO: 6537 - RNA, 81 nt, Homo sapiens
gccaagucauggucccagcagccaggccagcugacuagacagcaacaaccagauggcacugcugggauugugucuuucugc

SEQ ID NO: 6538 - RNA, 68 nt, Homo sapiens
ggcagagaaggaagcagccagagagaagagcacccgccccaccccugcuggcagcuuccuccuucucc

SEQ ID NO: 6539 - RNA, 87 nt, Homo sapiens
cucagaccucggggggaguugggaguggaggguugcugggggacacuuggcuuucucucccacgugccaccuccccucgugucccag

SEQ ID NO: 6540 - RNA, 58 nt, Homo sapiens
aacaggccagcaagucuuggagagguugucaggcugaguugagacaugcugucccuuu

SEQ ID NO: 6541 - RNA, 78 nt, Homo sapiens
uccauccuccccaccuugggucuuggguuggcagcagagccgaggagcugaggguccagggagguggcaggggaaagg

SEQ ID NO: 6542 - RNA, 103 nt, Homo sapiens
agcaaaagacauuuccuuagaauuaauggcuggcugggaggcagagccaagggccacugguuccucccagcuggucauuaauccucaggaaaugccugcaccu

SEQ ID NO: 6543 - RNA, 96 nt, Homo sapiens
cacacuucagcaaauguagcuggcacuacgauggcugggaccccugugggaugcucagguugcaaguugaagugcuggcuguuuugcugauucaug

SEQ ID NO: 6544 - RNA, 75 nt, Homo sapiens
gacacuggugaauggcaggaggguugcgcaugaagccacaaagcuacuuggguuucuccuucucauuugccuuuu

SEQ ID NO: 6545 - RNA, 67 nt, Homo sapiens
gucaucaucucugguacugcuuuugcgcuuccugugcauugccaagguagucacuggggauguaagc

SEQ ID NO: 6546 - RNA, 79 nt, Homo sapiens
guccagggugugugacugguugaccagaggggcaugcacuguguucacccugugggccaccuagucaccaacccucagc

SEQ ID NO: 6547 - RNA, 104 nt, Homo sapiens
gcccccaggccugcuaaggguagcuuugcauggacaggcacagagggagacacgucacccucccugugucuucugugcaagggcccagguugccaggccugagc

SEQ ID NO: 6548 - RNA, 82 nt, Homo sapiens
gcccccaacacucugaagauacagauuuuuaacaacuaacucugccuauuuguuaaaaaacuguaucuucaggguucucugc

SEQ ID NO: 6549 - RNA, 67 nt, Homo sapiens
ggcgggugggugguccgcagacauauggcacgaauucagcacauguucugagguccaccgacuuucc

SEQ ID NO: 6550 - RNA, 72 nt, Homo sapiens
uccuguuugaagguugcggcagcuucgggaaggagcucuccgacuccgggcugccuuugccuuuaaauuuga

SEQ ID NO: 6551 - RNA, 65 nt, Homo sapiens
uccucucaaggaggcugcuaucugagagcacacagugggguuugauguagccucucuugaguaga

SEQ ID NO: 6552 - RNA, 78 nt, Homo sapiens
aucuccauacuucaccccccucaguuuccuccugcaucugcggucaguucugagacuggggcgugaggcugugggaau

SEQ ID NO: 6553 - RNA, 80 nt, Homo sapiens
uccugccauauuuccuuagccugcucuucccuguguugugcugaaaggaauggggaagagcagauuaagcagguggcuga

SEQ ID NO: 6554 - RNA, 71 nt, Homo sapiens
ggcugccuguuggggcagugcagggccagauagaggugcuaggcuccugugauugccucgcccaggccacc

SEQ ID NO: 6555 - RNA, 66 nt, Homo sapiens
gacuggagcagugagucuuuuacacuucugugcugaaaaaugugagagagcuugaugccuccuuuc

SEQ ID NO: 6556 - RNA, 67 nt, Homo sapiens
gucuguaaagcuuucagugcaaugccuuguauuuggcaagugcauuguaaaugggaguauuaucuac

SEQ ID NO: 6557 - RNA, 63 nt, Homo sapiens
gucuggcuguuguggugugcaaaacuccguacauugcuauuuugccacacugcaacaccuuac

SEQ ID NO: 6558 - RNA, 93 nt, Homo sapiens
uccuccugagaaugcuuccuaaugauuuucuaugucuggaagggcaaacccucuuuagauguauaaauauuaaaaagcacuucuuaggcauga

SEQ ID NO: 6559 - RNA, 103 nt, Homo sapiens
ggcuauauacaauuugacaaggccuugccuggguucaaauccuggcucugucacuuuccagcugggugaccucagguaaguccuuuagucacucuguaucucc

SEQ ID NO: 6560 - RNA, 91 nt, Homo sapiens
gucuccccgaggggcugugagcugcugugggcagggauuuuucuuuuuuuuccccauauuugcccaguguggcccaagcuccugggauaac

SEQ ID NO: 6561 - RNA, 131 nt, Homo sapiens
gccucauaccagagagcugcuuccaagggagcagcauccuucacuugacccacgcauccaggagacuuugcuccugucacccagaguccagggaggacgcugccccaggugugagcucacugggcuauugc

SEQ ID NO: 6562 - RNA, 80 nt, Homo sapiens
gccucugaacaaaaugugccaggaugucuugaucacggcacccccggcucagagaccuuccauggcgucuuuuguucugc

SEQ ID NO: 6563 - RNA, 79 nt, Homo sapiens
gccugaccccaaaugcccuugggacagccuucuuauuuuucuugaugauguugaugccccaggggguuuugggggcugc

SEQ ID NO: 6564 - RNA, 100 nt, Homo sapiens
gucuuuagaacagugccuggcauauaguaggugcucuguguuugauaaauuuauucaacauuuauugagcaccuacuggaugccagaugcgguucuuagc

SEQ ID NO: 6565 - RNA, 69 nt, Homo sapiens
aggcucaagugguagcugucucaucaucccucaccggcugaggccugaggccggcuaccacuuggggcu

SEQ ID NO: 6566 - RNA, 69 nt, Homo sapiens; identical to SEQ ID NO: 6565

SEQ ID NO: 6567 - RNA, 69 nt, Homo sapiens; identical to SEQ ID NO: 6565

SEQ ID NO: 6568 - RNA, 96 nt, Homo sapiens
cugcuugcuauguaaauagagguuuaauuaacacuuaaaguuuugcaucuucacagguugcaaauguuaauuaaaucuguauuuacauggcaagag

SEQ ID NO: 6569 - RNA, 68 nt, Homo sapiens
gagguccucaaaacugaggggcauuuucugugguuugaaaggaaagugcacccaguuuuggggauguc

SEQ ID NO: 6570 - RNA, 70 nt, Homo sapiens
gcgcgcggcgccggccagcccgccucccgccgccauggggcgcugcaggcaucaggccggcgccgcgggc

SEQ ID NO: 6571 - RNA, 73 nt, Homo sapiens
cugauucguggucggcuguucccucucccacacaaggcucccuccugggaaaggaauuucugaccaugaguag

SEQ ID NO: 6572 - RNA, 80 nt, Homo sapiens
uggguuugccuaggugggucauuccugggaaacagugucagucaucccauguaaauuuaugauuugccuaggcaaaugca

SEQ ID NO: 6573 - RNA, 141 nt, Homo sapiens
cugaugaacauaaaaaucccucucccauguugccuuucuguagagauuaucaggccucuuucuaccuuccaaggcucagaagguagaaugaggccugacauaucugcaggaaaaaaaaggagagagauuuauguuuguaag

SEQ ID NO: 6574 - RNA, 141 nt, Homo sapiens; identical to SEQ ID NO: 6573

SEQ ID NO: 6575 - RNA, 118 nt, Homo sapiens
ugguugcuaaggaaagcuuggugcccuggugaugggguuuggugucccauaaaauccucgcagagcuggggccuucugaccugguugccaaggcaaccucauccauccuuggcaaaca

SEQ ID NO: 6576 - RNA, 70 nt, Homo sapiens
caggccaggagcugcuaagugcuccucaagucaucauggccaguggguagcauggagagcuccuggcgug

SEQ ID NO: 6577 - RNA, 74 nt, Homo sapiens
uggggccugcagguuguccucaguuucagauagccacacaaggacucucaggcugaaggcccuugcaggccaca

SEQ ID NO: 6578 - RNA, 94 nt, Homo sapiens
cagccuggacagaugggguucugcccggcagggcuggcaugggggcuucuuuaugccaagccagcccugggggaggccucggcuguccagggug

SEQ ID NO: 6579 - RNA, 98 nt, Homo sapiens
cuguuauugcugauguugccuccuguuagucauggauguugccacuaucacugucuugaggcaucaaguaugacuagugggacagcccaguaauggag

SEQ ID NO: 6580 - RNA, 73 nt, Homo sapiens
cagugcacacuucaggacugugggaaaguggaaccacucaggacucaguuuccccauuugaacagugugugug

SEQ ID NO: 6581 - RNA, 76 nt, Homo sapiens
uugguguccuuggccuggcggucuccacagauggugaucugccugagggucugcugcugggcugagagggcacgga

SEQ ID NO: 6582 - RNA, 66 nt, Homo sapiens
ugguaaguaguaagccagguuaggcaugagaagcacuuugcacagagccuggcacauuauuuagca

SEQ ID NO: 6583 - RNA, 148 nt, Homo sapiens
gggagcucuugcaaaugacaguuuuucaccccuuucuaccacuguucaauagguggaauaaguaauucuucucacuccucauugccucuuuucugccucuuggguagugguagaaacgggugaaaaacuaucacuuccaagagcugcc

SEQ ID NO: 6584 - RNA, 82 nt, Homo sapiens
ucguccucucgcucagucucuggaccaugucuacuccccugucucauuuguggacauuaucuggggcuggaugaggggagga

SEQ ID NO: 6585 - RNA, 96 nt, Homo sapiens
gaguuagagugugcuuguuuaaagaggaaacagaccaaaugagaaaacagauugcauuuucuguuuuucuuuuaaaauuucaagcugcuuuaaguc

SEQ ID NO: 6586 - RNA, 71 nt, Homo sapiens
caggacccuccaggggggucuccuggcaucuggacugauguacuuugguugcccucccugaggggguuaug

SEQ ID NO: 6587 - RNA, 70 nt, Homo sapiens
aaguccagcaggaggagaugcuaaagaauuagguaugaugguuuuuagcauuuuuuaccuuguuggaguu

SEQ ID NO: 6588 - RNA, 66 nt, Homo sapiens
ugggauuggccccagcgccaggugucugggaaucccaggccucugcgugugaaggugccaguugca

SEQ ID NO: 6589 - RNA, 101 nt, Homo sapiens
gaguggcauagugagaaugaguaagaggaaauaucacuuaguauuaacagaugauaauaaguaguguuuccuacuaauugauuauuuaccauaugcuaguc

SEQ ID NO: 6590 - RNA, 91 nt, Homo sapiens
gugagcucagccacuuggcaguccagggucaaacagaggacggcucagcuucccucuguguccugggcucugagcggagcccugagcuaac

SEQ ID NO: 6591 - RNA, 76 nt, Homo sapiens
ccgugacuccacugccugccuccgcuggacuguuccaggagaggggaggggcuagggugcagguggggaguugggg

SEQ ID NO: 6592 - RNA, 68 nt, Homo sapiens
gggcagggcaaacucuacuaagaccuuugucagaguugcugcagguuuggguggagaguguccuggcu

SEQ ID NO: 6593 - RNA, 75 nt, Homo sapiens
cuguggggaugagaauggggcaguaagggaaaggugacuuuucugcuucgugcccucccacucugguuccuagag

SEQ ID NO: 6594 - RNA, 82 nt, Homo sapiens
cugugccgggugccugggugguggggcugggguuuuauuuauaauauugauuuccugcuccacugccggggcucuggugaag

SEQ ID NO: 6595 - RNA, 74 nt, Homo sapiens
gugcuuucagcuucuuuacagugcugccuuguagcauucaggucaagcagcauuguacagggcuaugaaagaac

SEQ ID NO: 6596 - RNA, 66 nt, Homo sapiens
gugcugggaaggugggauggaaaggaccuuaaggacaagaugguccuugguugugccucccaggau

SEQ ID NO: 6597 - RNA, 68 nt, Homo sapiens
cagcuuucuagggcacagacagugcaaaauggcucaggccagaauguaguuuagguuucagaagggug

SEQ ID NO: 6598 - RNA, 86 nt, Homo sapiens
aaguguuaucaaucacagcuuaaucuaauuaagcucuuuaaaauagcuucuaaacuaauuagauuaaguagugauuuauaacaguu

SEQ ID NO: 6599 - RNA, 72 nt, Homo sapiens
cugcccuuggagaucauaccagcauuuauuucaaaucgauguugaaaaauaaaugguaauccucaaggggag

SEQ ID NO: 6600 - RNA, 73 nt, Homo sapiens
uugaggccaggccuggggauccagggcugcucugcucugaugagggaggcccuggagcugggaguggccugaa

SEQ ID NO: 6601 - RNA, 65 nt, Homo sapiens
uaggcaguguaguguaagggcaugaucucuaaaguuuuaaucguggcucuuucauuuacugugug

SEQ ID NO: 6602 - RNA, 67 nt, Homo sapiens
gcgucaggaugcccaggcccugccaugucccuagcccggccuggguggcagggcccagcuccugggc

SEQ ID NO: 6603 - RNA, 101 nt, Homo sapiens
gaguggcauugugagaaugaguaagaggaaauaucacuuaguauuaacagaugauaauaaguaguguuuccuacuaauugauuauuuaccauaugcuaguc

SEQ ID NO: 6604 - RNA, 93 nt, Homo sapiens
uuguggucauuagggcugaaaggguuucauuuauggcccugagaaagagaaugaaggcuguaaaauagacccaggaggucccacugaccagaa

SEQ ID NO: 6605 - RNA, 90 nt, Homo sapiens
ccgccaggcccgccgaaugcggccuccgccccgcgcgccuaaaggaggagcgucgcgggggauggaggcggcgcgcggugggaccugggg

SEQ ID NO: 6606 - RNA, 158 nt, Homo sapiens
uggaauaaguagcuauugacaucugcugaagucaguauaaagauuuauuuaccugaguguagauauugaccaauagggagccuggcucaauguuuacauugaaggacaauaaauugccguauugacugggcugagacaucaauauuugcauuguugua

SEQ ID NO: 6607 - RNA, 56 nt, Homo sapiens
gugcggguggggaggcaggggcggggggagcccgguuccccucccccagcccgggc

SEQ ID NO: 6608 - RNA, 75 nt, Homo sapiens
gcggauggacgguuuuaccagacaguauuagacagagggccaggucuaaccaugucugguaagacgcccaucggc

SEQ ID NO: 6609 - RNA, 66 nt, Homo sapiens
cugggguccugggguaagagaggaucuugggucuccugggcauuuucucccuucccaagaccugag

SEQ ID NO: 6610 - RNA, 79 nt, Homo sapiens
uugccgccgcccgcccccugcgccuccccgcggagccuggguccgggagggggaagguaggggcggcggggggcgggag

SEQ ID NO: 6611 - RNA, 92 nt, Homo sapiens
guguugggggaccuguuuccugucuuuagcuguaggguuuaugugagucucccuacaguaaaagacaggguuggaugaugguuucuuaaggc

SEQ ID NO: 6612 - RNA, 74 nt, Homo sapiens
agggacucuagacccaggaaggcccagaaccacugaugcugaguaacacccuuggccuucuggucugaguugcu

SEQ ID NO: 6613 - RNA, 55 nt, Homo sapiens
aggcccuucagcccuuggaaggguugcugugcccagugaggggcugguggggauu

SEQ ID NO: 6614 - RNA, 83 nt, Homo sapiens
gcgugcccuggucaccaagcucucuucccggcucuccuucuggaggggcagugggaggagggcuggggucaguaaaggcaggc

SEQ ID NO: 6615 - RNA, 79 nt, Homo sapiens
cugccgucuugaagguucuaccacaccaguucaucacuaagccugcuguguggugggggcuuugagcuguuaacgggag

SEQ ID NO: 6616 - RNA, 75 nt, Homo sapiens
gagauggacccggggguggagaguggaggggcagccaucagagccaccucugaguccaccugaugggcccauguc

SEQ ID NO: 6617 - RNA, 85 nt, Homo sapiens
augagcuaaaauggcacaguagacagugagccaccaggagagugagugcuccugggcuucacuaacugugcugcuuccagcugau

SEQ ID NO: 6618 - RNA, 122 nt, Homo sapiens
cugccaaaaaaaucacaguaaaguccuuuugaaaaaacccuucaccgagugugguggcucacgccuguagccaccucacucggcuaaggauuuuuucaaaaggauuuuacuguccuugggag

SEQ ID NO: 6619 - RNA, 100 nt, Homo sapiens
gugagguaaggaagaagacauuucagaauuucuuuuuucuucacucuugauucaucaaguacaggccugagagauucugaagaacuucaucaaaccugac

SEQ ID NO: 6620 - RNA, 68 nt, Homo sapiens
aggcuacccccaaaccuucagcugcucagaguccugcuggaggggcuugugaggguuuggagugggcu

SEQ ID NO: 6621 - RNA, 71 nt, Homo sapiens
gggucuggcacauaauaaaugcuaugugaguauuaucuacuauacucucaauuuuuauaugugacagaguc

SEQ ID NO: 6622 - RNA, 81 nt, Homo sapiens
guguagcucguggcuggacaaaugaguugguaaaccaaugaagaugaggaagaccaacucaugugcagcucauggcuggac

SEQ ID NO: 6623 - RNA, 99 nt, Homo sapiens
uugcugggagcaaccuuugguccuuccauugguccuagggcugaucuaggcugcuagaucagggcaugggaaggacccaagguugguacuccucaggaa

SEQ ID NO: 6624 - RNA, 100 nt, Homo sapiens
gugauugccgggccaaucaaagcuuucuuuuguuucucuuccccuuccccuuggagccaagaaggacacaaggauggcucgguggccuugggcaaaugac

SEQ ID NO: 6625 - RNA, 83 nt, Homo sapiens
gugggcagcuuugcucagaaaggucagcaugagagacaagaacaaagagaucuuucaagcuggccucuggcagggcagccagc

SEQ ID NO: 6626 - RNA, 136 nt, Homo sapiens
uaggacacaaccugggcgcugcaugugagacucucuggguguggagugugacuguguugugugggggugcgggaugugguauauacgcacacacgcagggagcgggguaugugugguuggagaggguugcguugug

SEQ ID NO: 6627 - RNA, 70 nt, Homo sapiens
cagaggaaacuguccuuccuagaggugugcagggugaaucucucaugccucuugggaggagaggccugug

SEQ ID NO: 6628 - RNA, 80 nt, Homo sapiens
gcgggcaagugcagagcccugaagccgacgggcugcugacccuggagcgcccuggcucggggacuccugcccaggcuggc

SEQ ID NO: 6629 - RNA, 56 nt, Homo sapiens
ucgcacaauccgauuccuugggagucccucauacucagggaguuuggcacguggga

SEQ ID NO: 6630 - RNA, 66 nt, Homo sapiens
guguggaugggugaggggggaguuggaccacuucuucaaggccacccucuccccugccccccagau

SEQ ID NO: 6631 - RNA, 110 nt, Homo sapiens
gggugacagcaugaacaaaaaugccaggaagugacuguaucuacaagacucaacuuugagaaauuguagauagcccaugaacuuccugcaauuaguguaucaguucagcu

SEQ ID NO: 6632 - RNA, 88 nt, Homo sapiens
gagguguggaggucagaggaggccaaggcccugugaaauaaugagaugagaccagacuccaaggccuaggcucugcccuccccauguc

SEQ ID NO: 6633 - RNA, 120 nt, Homo sapiens
gugucagccucccugcccccuacccacauuucugcccccagugucccugcuucaggauggacaggaugcagggaguugggagguggcaagcugggugggguggagcggcgggcuagaggc

SEQ ID NO: 6634 - RNA, 68 nt, Homo sapiens
gggucccccauccucgaccaucuuuguuugcccuauuagggggagcaauggcgagggaggggagagcu

SEQ ID NO: 6635 - RNA, 116 nt, Homo sapiens
cagugggcuauuuuacugcuuuccuguuuuucuccugcucuauuuauucagguuggguccaugcuugggagaugagggugggaggaaauucagagccaugugguggggccucagug

SEQ ID NO: 6636 - RNA, 101 nt, Homo sapiens
uugugaggcugggggaggauguugggggcugugaccagccacaggggucccaugcagccuccggugcugggcacccccaggguuccucccucaccccagga

SEQ ID NO: 6637 - RNA, 56 nt, Homo sapiens
guggugugggcaaggaaaagaaaauucuauucaucuucuuuuccuguccaggcaau

SEQ ID NO: 6638 - RNA, 67 nt, Homo sapiens
gggcagcagccucuugggaggggaggugccaggucagaggcagcuuccagccugggggcuggugacc

SEQ ID NO: 6639 - RNA, 67 nt, Homo sapiens; identical to SEQ ID NO: 6638

SEQ ID NO: 6640 - RNA, 79 nt, Homo sapiens
caggagagcacccuggaacagggagcgucaguuucugcaugugucagauaccaaccugccuguuuuaggggcuguugug

SEQ ID NO: 6641 - RNA, 97 nt, Homo sapiens
gagcugugagcaauuucauuuugcuugacuacaucagugaggugacaaaaguggcaagcaagauagaguggagugaaaugggagggcuuugaagguc

SEQ ID NO: 6642 - RNA, 72 nt, Homo sapiens
gggggucaccacacuuugcuaacucuugugugcacauauuuuauaauagaguagcgagggaauggugccgcc

SEQ ID NO: 6643 - RNA, 79 nt, Homo sapiens
gugaauaagguaggagacugguagacucuaacuuucagauucaacuuauagcuguucaccagucaucugcuauuuugac

SEQ ID NO: 6644 - RNA, 68 nt, Homo sapiens
ucguuuucuacuuuccuacauugcugugggccaggagagcccuggauguaauggaaaguggggagggg

SEQ ID NO: 6645 - RNA, 72 nt, Homo sapiens
gugugcagugagaugccucacucgcucuccacagggaugggggaggcguccugaggcauccacaagcaaagc

SEQ ID NO: 6646 - RNA, 96 nt, Homo sapiens
guguugccuaggccagggucgggggucacagugggucgggggaagcugauuucuccaggcucagugugacuccuccauccuccccuggacagaagc

SEQ ID NO: 6647 - RNA, 74 nt, Homo sapiens
gcgucgccccccucaguccaccagagcccggauaccucagaaauucggcucugggucuguggggagcgaaaugc

SEQ ID NO: 6648 - RNA, 81 nt, Homo sapiens
ggggucagggcagccagcuccccuggcaggcuagauuuaugauuuggcugagcuggggagagagggagccugcgacaaucc

SEQ ID NO: 6649 - RNA, 71 nt, Homo sapiens
uggaggaaaggguaggccagggaggaagagaagguagcagagucuccuccccucuguagcccuuucccuca

SEQ ID NO: 6650 - RNA, 80 nt, Homo sapiens
aggacccuuccagagggcccccccucaauccuguugugccuaauucagaggguuggguggaggcucuccugaagggcucu

SEQ ID NO: 6651 - RNA, 107 nt, Homo sapiens
uggaguuucaucagccauggacuuccaccugucuucucuaugguaucaaggggauugucccaugacccuaagagagggcagaugugugucagccugaagaaacauca

SEQ ID NO: 6652 - RNA, 71 nt, Homo sapiens
gcgaauagaguuuuccauuuuguuucacauuagggucuccugagaggcaaaggacuggaaaacacuauagc

SEQ ID NO: 6653 - RNA, 67 nt, Homo sapiens
aggaugacccauuuuaagcaguucccuuugaaaguguugaacaggagcuguucaaaugagucacucu

SEQ ID NO: 6654 - RNA, 61 nt, Homo sapiens
gggagagcacgcugagcaggcccgugacaagcucacgccaucugcauuaguauuuuccucc

SEQ ID NO: 6655 - RNA, 66 nt, Homo sapiens
gggaaccaagugaguaaaugucaagugggagaugagcuuucuuuugauauuuccucacuugugacu

SEQ ID NO: 6656 - RNA, 72 nt, Homo sapiens
cugagagaagaaggagcggcccuugugaccagugcccuuuugguucacaaggaacgucuccucuuguugaag

SEQ ID NO: 6657 - RNA, 96 nt, Homo sapiens
augaaaucaaggcagacaaccaaacaggauauuucaauuuuuauaaccuacuuugguaucuauauuaucccguuugguaaucugccuugaucagau

SEQ ID NO: 6658 - RNA, 84 nt, Homo sapiens
gugaagguugugcccacaggcacgacugguuuggcaauucaguaaaaaugcucaaaccggcugugccuguggacgcagcccagc

SEQ ID NO: 6659 - RNA, 75 nt, Homo sapiens
gagaaacuggcagucgcauggcagccagcuggcucacccaauagcugggugguaaccuugugauccccaaacauc

SEQ ID NO: 6660 - RNA, 103 nt, Homo sapiens
cugaacccucuaagcccucugcccccgccuccugccagggucccaccgcuugaggacuucaaggugcuggaugggguggaggaugcagagggcgaggaggaag

SEQ ID NO: 6661 - RNA, 125 nt, Homo sapiens
cggacccugagcucuggccacggcaucuguuugcaauguuugacucgguaguuuuauuucugcuuggcgguauaauauaaacuaucuuguuacacggcaggcaggcugggcgcagagccgggacg

SEQ ID NO: 6662 - RNA, 128 nt, Homo sapiens
gugacagagaagauaaggcccaggggcuuucaagucacuagugguuccguuuaguagaugauugugcauuguuucaaaauggugcccuagugacuacaaagccccagagccagcaucaucaucaaagc

SEQ ID NO: 6663 - RNA, 55 nt, Homo sapiens
aggagggcagggcggugggaagugauacucauggucacuuccugacccuguugcu

SEQ ID NO: 6664 - RNA, 55 nt, Homo sapiens; identical to SEQ ID NO: 6663

SEQ ID NO: 6665 - RNA, 101 nt, Homo sapiens
gcgagaagaucucaugcugugacucucuggagggaagcacuuucuguugucugaaagaaaacaaagcgcuucucuuuagaguguuacgguuugagaaaagc

SEQ ID NO: 6666 - RNA, 68 nt, Homo sapiens
cagcaacaguccuguggagugggcaugccucacuggggagagcagguuuauuucauuggauuguuaug

SEQ ID NO: 6667 - RNA, 77 nt, Homo sapiens
aggcaaucacacuccuggggauuauaggagcuuggauacaugucuuuccuuauaaugcccuaaggaugugauuaucu

SEQ ID NO: 6668 - RNA, 104 nt, Homo sapiens
gugggggaggaagcugauauuuauucagagacugguuaucauucacugccuacgugaccucgggcgguaaugaaccaucucugagccucaguuucuuccuuugc

SEQ ID NO: 6669 - RNA, 68 nt, Homo sapiens
agggaaacacaagagcaaggugcugagguaaaaaacaccugagguagcuuuuuucuguguguuuuucu

SEQ ID NO: 6670 - RNA, 59 nt, Homo sapiens
agggaucuggggcagauggugguagcacaaccuagagcucacuucugccacagaugacu

SEQ ID NO: 6671 - RNA, 73 nt, Homo sapiens
cagguugcgagauaagauagugcugucccugacaccucagucuuagggaugcuuauuuuuaaaucucagaaug

SEQ ID NO: 6672 - RNA, 66 nt, Homo sapiens
gugggauggcccauguuucaccagcacucagaugcccuggggcucggggcuuaugggcaguuuugc

SEQ ID NO: 6673 - RNA, 73 nt, Homo sapiens
guggaaagauggugggccgcagaacaugugcugaguucgugccauaugucugcugaccaucaccuuuagaagc

SEQ ID NO: 6674 - RNA, 56 nt, Homo sapiens
agggaucuggggagggaggaggggcugaaguggccccucggcucucugcccgggcu

SEQ ID NO: 6675 - RNA, 69 nt, Homo sapiens
gaggaauggacaccucaggaugcuuccugaacagggccuagucaggaaguagccuggaugugcauaguc

SEQ ID NO: 6676 - RNA, 62 nt, Homo sapiens
augucacugugugauguucuucuguugccauaacgacaggaggaugugucaccagguggugu

SEQ ID NO: 6677 - RNA, 65 nt, Homo sapiens
guguagaugucugaccaccuucugggauccauggucaggauucuagaacgguuaggcuucugugc

SEQ ID NO: 6678 - RNA, 81 nt, Homo sapiens
ugguacuuggagagaggcuggccgugaugaauucgauucaucaaagcgagucauacacggcucuccucucuuuuaguguca

SEQ ID NO: 6679 - RNA, 81 nt, Homo sapiens
ggguccuggcuggggcuugaaugggguuccauggucuuggcuggaguguggggucuuggagaggcaguccagcuggggucu

SEQ ID NO: 6680 - RNA, 81 nt, Homo sapiens; identical to SEQ ID NO: 6679

SEQ ID NO: 6681 - RNA, 55 nt, Homo sapiens
guguaugugugugggugguagugggggaaaugaucacccagcccucacucacaau

SEQ ID NO: 6682 - RNA, 164 nt, Homo sapiens
cuguaauauaauucugaaauagcuggaccauuaauucaaccuaauauauguaauuucuuauauuccagaggccacuuaccaucuuccaugaguagucugcagaauguaagagauuccauauuuuguaucaaauuaaugguccaaccauuucagaauuuaaaaag

SEQ ID NO: 6683 - RNA, 87 nt, Homo sapiens
acguguccuuauuuuggaaauaaaugcuucugaaguuaaaauaaauguauuuaauuaguagaggcauuuaguucugagguggaaagu

SEQ ID NO: 6684 - RNA, 73 nt, Homo sapiens
aguggaaaaauucagucaguugguugcuuugucuacaugauuccaaacaaguaggcugacugaguuuuuuucu

SEQ ID NO: 6685 - RNA, 93 nt, Homo sapiens
ugugcggucaucuagaaaacacugagauacacaucucauauauacaugagcuacaugagacguguaucucauuuuuuucuagaugacugccca

SEQ ID NO: 6686 - RNA, 67 nt, Homo sapiens
gauaucuguucucuccacaugucagcacccauucaugucaugguuuggaaauggggagaacagauuc

SEQ ID NO: 6687 - RNA, 79 nt, Homo sapiens
gaugguugguggagggaagagggucucagaccaccauggcucaugcugacauccuuuaagaucuccuuuaucaacucuc

SEQ ID NO: 6688 - RNA, 74 nt, Homo sapiens
ggugagggggugggaggugugguuuccaaagguuauaauuuucaugacauucuacacccaacccgcccccuucc

SEQ ID NO: 6689 - RNA, 55 nt, Homo sapiens
gguggggacgguagugugguugugcgcaugcgcaugggcaccuuauuguuuuccc

SEQ ID NO: 6690 - RNA, 74 nt, Homo sapiens
gguagauggagagaggaaggaggucuguaaggcaguuucucagucagcaccccucacuuuccuucuccaucuuc

SEQ ID NO: 6691 - RNA, 65 nt, Homo sapiens
ucuggagcccaggaagacagagacacacccaagcuauggcugcgaggcuguccuugggcuccuga

SEQ ID NO: 6692 - RNA, 85 nt, Homo sapiens
gcuaagcacuuacaacuguuugcagaggaaacugagacuuuguaacuaugucucagucucaucugcaaagaaguaagugcuuugc

SEQ ID NO: 6693 - RNA, 132 nt, Homo sapiens
gcucuuggccuggccuccugcagugccacgcuccguguauuugacaagcugaguuggacacuccaugugguagagugucaguuugucaaauaccccaagugcggcacaugcuuaccagcucuaggccagggc

SEQ ID NO: 6694 - RNA, 65 nt, Homo sapiens
ggucugguccccuguugcccauagcccuuuacccugagcaccacccaacagacuggggaccagcc

SEQ ID NO: 6695 - RNA, 88 nt, Homo sapiens
ugugugcccaugaaggucaggacugugugucuggguuacagcuguaucucggcagcccagcacagugccuggcacacaugggcacuca

SEQ ID NO: 6696 - RNA, 92 nt, Homo sapiens
gcuagaagaguacagaaagggggagggugaagagaugggauuacuacaggugaucuuuacauuauuuuucaugcuuuucuaaacuuuucugc

SEQ ID NO: 6697 - RNA, 160 nt, Homo sapiens
gauauugccuucaacagugggcaugaccuugagcuagauggcucuuuucaacuucagauauuuaauauauuaaaugcaauucaacuuaagauauaugaaauaucuuaaguuuaaaagagccaucuaguucaaggucaugcuggcuguccagggcaguuuc

SEQ ID NO: 6698 - RNA, 146 nt, Homo sapiens
acuguacaagagcugggggagaaaauauaauguaaggaaugauuugaaaucaggggcaggagaaggcagaggaaugaacuggcugaccccaaaugucuuuuccaucucuaacuccuaugauucuuugaccuccaauuuugugcugu

SEQ ID NO: 6699 - RNA, 77 nt, Homo sapiens
gcuguuacuacuggaugguggguuuucagacucucagccgagucucggccuggcugcccacaucugguagugaccgu

SEQ ID NO: 6700 - RNA, 78 nt, Homo sapiens
gaugggcaggggcccugcuuccguuuaaccacagcccugugacaugccccaaaagggaagcagcagccgccuguccuc

SEQ ID NO: 6701 - RNA, 90 nt, Homo sapiens
cauggagaagagaaaacagcuggucucaaauguuccuucuucuaaaaauagggauuagagcagauguaggcacaguugcuacuucuccug

SEQ ID NO: 6702 - RNA, 69 nt, Homo sapiens
ggugaguuggggcugcguauuuccauguuuucugaagguucacauaaacaugcagccugccaauucucu

SEQ ID NO: 6703 - RNA, 65 nt, Homo sapiens
agucagacugacugcaguguggucauuuuucuaacccauaacugcucacacugcagcagucugcu

SEQ ID NO: 6704 - RNA, 56 nt, Homo sapiens
ccugcgggagaggaggcuggcucuuugggcgaccuccgaagcuucccuccugccgg

SEQ ID NO: 6705 - RNA, 76 nt, Homo sapiens
guuccugccucuccucugcccuuccuaaucaucuuccaccuggacaaaugcaggaggggugaaccaaggcagguac

SEQ ID NO: 6706 - RNA, 60 nt, Homo sapiens
uguccuuugugcagaacaguaauuggauuguguguuucauuuacaucuggacaaaggcca

SEQ ID NO: 6707 - RNA, 67 nt, Homo sapiens
cuucccauccuccaugcaugggaaucuaugaccaaacauagauuuccacaggauggugggugggugg

SEQ ID NO: 6708 - RNA, 76 nt, Homo sapiens
ccugguuuuguguguggguagggggcaacauugggugaaguuuugauaguugcccccuauagauuuuaagaccugg

SEQ ID NO: 6709 - RNA, 84 nt, Homo sapiens
ucucacuguccucuggaguggucuuucucucaacuccuagaaaaacuaaaagcacagagaagccacuuucagagaaacagugga

SEQ ID NO: 6710 - RNA, 96 nt, Homo sapiens
acugggcaccagguuaagcacucuacacagauugucuauucuauucucucauuaauaacagauuaucuguguagaacacuuaacucagugccucgu

SEQ ID NO: 6711 - RNA, 55 nt, Homo sapiens
acuuccggccccgccgcggaagcaaaggaggccaguuccgccgcgcgccggaugu

SEQ ID NO: 6712 - RNA, 72 nt, Homo sapiens
gcugccaggccaggcccucaggcaagggcucugaagucagggucaccugcuugccagggccgaucuuggugc

SEQ ID NO: 6713 - RNA, 72 nt, Homo sapiens; identical to SEQ ID NO: 6712

SEQ ID NO: 6714 - RNA, 72 nt, Homo sapiens; identical to SEQ ID NO: 6712

SEQ ID NO: 6715 - RNA, 100 nt, Homo sapiens
gcucacaguccaccaaaugaauggcuagcauuuaaaaucgaccugaauuaaaugaagcaguugauuauaaaugcuagacacucaauuuagaaacuguggc

SEQ ID NO: 6716 - RNA, 73 nt, Homo sapiens
ccuggcacugagaacugaauuccauaggcugugagcucuagcaaugcccuguggacucaguucuggugcccgg

SEQ ID NO: 6717 - RNA, 125 nt, Homo sapiens
gauaagagauguacugagauacagccauagacacaguucacaaaaccuuggccuugugacuagcuguuccacuggccagaauuuugugaacaguugugauggcgcuaucccagugccucucuuuc

SEQ ID NO: 6718 - RNA, 79 nt, Homo sapiens
gcucuuccuuccccaggaauuuccugggcugggaugcuuucaucaccaugccuggggaagacuguugggugaggaaggc

SEQ ID NO: 6719 - RNA, 93 nt, Homo sapiens
ugugcacccagcacuuaggacagcugguuuaccaacugggaagauucagcuucauuuguggugagccagcuuccuugacacucugcggugcca

SEQ ID NO: 6720 - RNA, 74 nt, Homo sapiens
gguguugucuuucaggggaaagacuggguuuaauaagccuuuauucuuacucauuuucucuggggguacagccc

SEQ ID NO: 6721 - RNA, 59 nt, Homo sapiens
gguagggcacgggacuaagggagaccuggugacaguuguuccccgguccuggguucucu

SEQ ID NO: 6722 - RNA, 131 nt, Homo sapiens
ggucuccuacacugcccccaccccagugcaacaggacugaaaggcaaaggcagccacaucacuggccuuccuucuguggcuuccuauugccuugagaaccuuaagcacugccucuggggcccugaggagcu

SEQ ID NO: 6723 - RNA, 106 nt, Homo sapiens
uguggcugacauucaguccuucuuccuucucagggcuuuguuuuaccuuuucccauuugagccacaaaacagcccugaaaggcuggaguaggagucagcagcccca

SEQ ID NO: 6724 - RNA, 56 nt, Homo sapiens
gauggaagaggccauauguggccaugucaaaacuuggcuacaaggcucuuucccuc

SEQ ID NO: 6725 - RNA, 73 nt, Homo sapiens
ccugcugccuuuauaucauuaacauaaaugcaggugcaaauagcauuuauguacuuugauagaaagcaguugg

SEQ ID NO: 6726 - RNA, 66 nt, Homo sapiens
gguggauggagaaaggcugccacuucacaugacauucucauguaaggggccucuuucucauucucu

SEQ ID NO: 6727 - RNA, 81 nt, Homo sapiens
ccuggccuguuuggcauuaggggugggaguuggccaaucccugcuuugauguugcuucugcuccagaugccaggggucugg

SEQ ID NO: 6728 - RNA, 64 nt, Homo sapiens
gguggaugugcuggccucuauggcaaccaucaaacagcaagcucauaaagccggcccaucuucc

SEQ ID NO: 6729 - RNA, 125 nt, Homo sapiens
uguguagaugacugaaucuaugcaguggaguauauauauauguguguguguguauacauauaauauguauauagauuuaaauacguauguauuuaugcgccagcaugggcaacaugucucuacca

SEQ ID NO: 6730 - RNA, 55 nt, Homo sapiens
ugugccagucuugcuggcagccucgcagcugugagaaacuuggugagucuggcca

SEQ ID NO: 6731 - RNA, 65 nt, Homo sapiens
cauaagaagaagggugaauggcccaggcuuuagcugggaccuugggugagucacccuccucuuug

SEQ ID NO: 6732 - RNA, 81 nt, Homo sapiens
ugucaguaagugaugaauuaacucagcuccaaggcuguuccaguugacagugagagcugauuuaacucauuucucacugca

SEQ ID NO: 6733 - RNA, 105 nt, Homo sapiens
gaucauuaaagaauguuccuguuuacuucccuccccauaacccagucacaguggcauacaauucagggauauggggagaggagugaacaggaauagagaauguuc

SEQ ID NO: 6734 - RNA, 111 nt, Homo sapiens
gauccagauagaugauauguuucuacuagugguugauggccucuuucagcuccaucgcuauggaggcgagguucaucaauaacucagagaaacuuguguccagaguugguc

SEQ ID NO: 6735 - RNA, 69 nt, Homo sapiens
gauuggccacugggguguugaguuuagagaaauagguaugagccucauaaucucaacccccagccacuc

SEQ ID NO: 6736 - RNA, 69 nt, Homo sapiens; identical to SEQ ID NO: 6735

SEQ ID NO: 6737 - RNA, 129 nt, Homo sapiens
agugcugccgggagacaggguggcugggcucugggaugcuggcugagggacacaggcucccuccuguccuccggggccaguggacccuggggcagcccccaugccugcuguccuguccccacacagccu

SEQ ID NO: 6738 - RNA, 142 nt, Homo sapiens
uguggaugucacucagcuuccccucagcucuugauuugagagaagggccagggaucaugcuuaggaccaaacuggcuccacagcaccccucucuuuacuuaagggacugagggggagaacaacaccugucagaaaaauccca

SEQ ID NO: 6739 - RNA, 122 nt, Homo sapiens
ugugucaguugaggcauuagagaucaagugacuugcucaaggucucacauagcuaugacaguauuugcuauuacaugaaaccuugagcaaguuacuugacuucuaaugccucaguuggcuca

SEQ ID NO: 6740 - RNA, 68 nt, Homo sapiens
gguccauuguggcggccucugacaucacagcagggggcagcgugaugucacagggccccauuguggcu

SEQ ID NO: 6741 - RNA, 65 nt, Homo sapiens
gaucuuuuggggaaguuugggaucuggcugggcgucugcauaauccauagaaaucccugagaguc

SEQ ID NO: 6742 - RNA, 92 nt, Homo sapiens
ggucuccacuccugggacuacugaagaagcaugcuguuugguaacugccuguugagcacaugcuucucuggugucccaagagugccugagcc

SEQ ID NO: 6743 - RNA, 83 nt, Homo sapiens
gauccuagagguuucagaaaguuuugccuuuuaauugugaaaugugaagcccuuccaagaugacuuucugaaaucucagguuc

SEQ ID NO: 6744 - RNA, 65 nt, Homo sapiens
agucacacaagauaggcuuuugggcuuucagggaggugugggggcuucuugccugucuuggugcu

SEQ ID NO: 6745 - RNA, 91 nt, Homo sapiens
gaugugauuuaccccugacucuugcugugccuguagauuuuacaaucuaagucaaucccacucacaguaggggccauugguaaaguacuuc

SEQ ID NO: 6746 - RNA, 77 nt, Homo sapiens
ucuacaaugguggggaaauggguucucuugauuauaucauaaaauaaccagaagauuuccuuuaacuaccauguuga

SEQ ID NO: 6747 - RNA, 75 nt, Homo sapiens
gaugucagccucugugaauugaagagcccaaguccaaaagggaaugaagcugucuuuaugcacagggggagauuc

SEQ ID NO: 6748 - RNA, 74 nt, Homo sapiens
gcuagucagagacagaccuaggggaaaaaaaugagagaaacacagauucucacuugggcucugucucuaacugc

SEQ ID NO: 6749 - RNA, 106 nt, Homo sapiens
gguuagcuagugugaggucacagagcuaguagguaguagaguugggaauuaaacccagguuuuucugucuaccuguaaagucuguguucuugaccacuauuuaccc

SEQ ID NO: 6750 - RNA, 83 nt, Homo sapiens
ugugagcugauggccacgugcugcgaagugcccugaacccaguaguuagggauauacuucaugggccuguggccaugucucca

SEQ ID NO: 6751 - RNA, 92 nt, Homo sapiens
uauggugcagcacugauguauguuuuauuuuuguuuaugaaauguuguagggauguagaggaaaaugaaacuagcaucagugcuggacuuua

SEQ ID NO: 6752 - RNA, 86 nt, Homo sapiens
uguagcguguguauucacaaaacucauagagugcucuacagugcuacaaagcacucugugaguguggugaauacauaaaggcucca

SEQ ID NO: 6753 - RNA, 76 nt, Homo sapiens
gcugaggcccugugacaguuaaggcaaaugugagaagucccugcucguuuuugccuuaucagucagagacacuugc

SEQ ID NO: 6754 - RNA, 107 nt, Homo sapiens
gauggugcuaacuguggcauuugcuaaaacacugacaaaucuguuaaaagcguugagcuuuguugaaauggauuuagucggcuuuuagugagugucauaauaaccuc

SEQ ID NO: 6755 - RNA, 138 nt, Homo sapiens
ggugggugcuggaauaacaaaugcuacaaauggcacuggggguguuggccaggcucugggggcacaggagcucugcccaugcccacaguuggccugugcugaccucccuccgucaagcugaguggcaccagcccuucc

SEQ ID NO: 6756 - RNA, 61 nt, Homo sapiens
gcugaguaccgccaugucuguugggcauccacagucucccaccaggcauuguggucuccgc

SEQ ID NO: 6757 - RNA, 99 nt, Homo sapiens
guuguacuggggcuucagggagguggaggggagcaggauuuggaaauguaugaaaacaacuaagucccugucccugaccuugagagguucccagacuac

SEQ ID NO: 6758 - RNA, 91 nt, Homo sapiens
guuccaaagugaaugugacugguacuuuugugguaaucuccuugugacuuaaaaguagguugccauaguuaccaaucaucuuugcuggcac

SEQ ID NO: 6759 - RNA, 61 nt, Homo sapiens
cuuggaucaggaugaaugguagcucagaugaaugcauuugugccauuuuucuuggccccag

SEQ ID NO: 6760 - RNA, 93 nt, Homo sapiens
ccuucccaacauccaaacacaacagaguuggagagaaagguuagggggaaaccuuucucuccaaacucuguuguacuugcaguugaacgaugg

SEQ ID NO: 6761 - RNA, 79 nt, Homo sapiens
uguguguguuuaagcucuggggaagaagccuuauuuuuuccagggauuagggcuucacucacugcuuaaauuauaacca

SEQ ID NO: 6762 - RNA, 81 nt, Homo sapiens
cauguguugggggugccuuucagagucaccuuccugaaaccuguaaagaauucauggcucugaaagguuccuccuuagcug

SEQ ID NO: 6763 - RNA, 110 nt, Homo sapiens
gcuuuucccuuugcaucggccuggggcccuggggccugauuugcagcaucaacagcuuuuccacugcugugugucagcccaagggccuugucacugugagaggguaacgu

SEQ ID NO: 6764 - RNA, 118 nt, Homo sapiens
cuuacucaguagacuugaugccauaccccggcucuuuuaguuguccaugucugugcuggcagccucagucagggacuagcuagagacuggaaaucaugguuucaggacuacugguuag

SEQ ID NO: 6765 - RNA, 84 nt, Homo sapiens
ccuuguccucacgguccaguuuucccaggaaucccuuagaugcuaagauggggauuccuggaaauacuguucuugaggucaugg

SEQ ID NO: 6766 - RNA, 81 nt, Homo sapiens
caugcugugacccucuagagggaagcgcuuucuguugucugaaagaaaagaaagugcauccuuuuagagguuuacuguuug

SEQ ID NO: 6767 - RNA, 106 nt, Homo sapiens
ggucauuuaacacuccauuuagucacccuugauaauguucuucuuuccagagguguagugagagaagcagcuuucaaggugauuucucugcauggagguuaugucc

SEQ ID NO: 6768 - RNA, 153 nt, Homo sapiens
agugauggaaauagucuugugucgauuuccaaggcgcaaugugggaggcacugugugugcacaaaucccguuauuuguuaauaggauuuguccacauacccucugcccaaucuguccaaugcuuugaaauauugcagcugcuuuucauuuccu

SEQ ID NO: 6769 - RNA, 101 nt, Homo sapiens
ccuuccuuuucucugccuuccuucccagcacugcuaagcaaagcugucacucccugugucuugcuuagcagugcuaggaaggaaaggaggaaaaggacugg

SEQ ID NO: 6770 - RNA, 82 nt, Homo sapiens
guugaaccaagccaagcucagccuuaaagauccugguuugguuuguucccaaaauaggguugagcuuauggcugguucuuac

SEQ ID NO: 6771 - RNA, 66 nt, Homo sapiens
ucuguucugauugacacaggauggacagguggaggugaccauccaucagugucaggaaggaccuga

SEQ ID NO: 6772 - RNA, 102 nt, Homo sapiens
caugccauaauucagucucuguguccuguuguuguucauaaaccaacaagcuuuggugguuuaugucaucagcagaaaaccugaaagugaauuauagccuug

SEQ ID NO: 6773 - RNA, 63 nt, Homo sapiens
guuagugcuacagaacauuauucugguccucaagugcaaggauaaauuuuguggcacuuuuac

SEQ ID NO: 6774 - RNA, 76 nt, Homo sapiens
gcuggaccaguuggaaaggggguuugggacucuggccucuuuccggcccucaccccagcuuuccaauuuccuuugc

SEQ ID NO: 6775 - RNA, 72 nt, Homo sapiens
guuauguauguauuuaugcacaucgugacuuguuccagaaaggauuaaaugugaccaaaauacauacacggc

SEQ ID NO: 6776 - RNA, 67 nt, Homo sapiens
gcuaaaagcugagacaaugaaagcccuggcagccucccuuggcagccgcuuuuucucagcuuucggc

SEQ ID NO: 6777 - RNA, 92 nt, Homo sapiens
ucuaacccaaccaaucagccaggcaucccaauuaggauuauaagauuuucugauaauucuaauugggaugccuagcugauugguugggcuga

SEQ ID NO: 6778 - RNA, 111 nt, Homo sapiens
acuaaaaauaaauauugagcacuaguuaaugauauacaugcuuaaguauuuauagguuguuaacguuucagcaugcauaucauuaacuagaauuuaauauuuguuuacugu

SEQ ID NO: 6779 - RNA, 73 nt, Homo sapiens
gguaacaguugccacuauggccuccucccugcauuuuccaagcauggaggaggacaagugagcaccugccucc

SEQ ID NO: 6780 - RNA, 78 nt, Homo sapiens
gauaaaggucacacucccagagcugaggcuacgugagucuaagcuguuaccucaguuaugggaguguggcuggaacuc

SEQ ID NO: 6781 - RNA, 81 nt, Homo sapiens
acuccauuucccagaaggccuuguaucccgugcauggccguuuccaggcaggaaggcgaagggccuucugggaggugaggu

SEQ ID NO: 6782 - RNA, 122 nt, Homo sapiens
uauccacaauaucccaaagggucugacuucuggagggagauauaaacucccuccagagcauuuuauagagguaauguuuauauuucccuucagaaguugaaccuauugggauauuguguuua

SEQ ID NO: 6783 - RNA, 63 nt, Homo sapiens
ggucuuggccagggcacacuguuuccagcaaaauccugccuuuuuaaugcccuggccagagcc

SEQ ID NO: 6784 - RNA, 66 nt, Homo sapiens
ugucagcaggccuuagugauuauaguggcgcccacucccucuacuguaguuaaaggucuguuagca

SEQ ID NO: 6785 - RNA, 68 nt, Homo sapiens
cguccugccuccucuccuggucuaagcuggggaggaaaaacccaucuuggccagcagggggcggugug

SEQ ID NO: 6786 - RNA, 63 nt, Homo sapiens
ucuccucccccaaccuccugcccaccccuggggggaguugggcaagagggaugggggagagga

SEQ ID NO: 6787 - RNA, 73 nt, Homo sapiens
gcuccccacagccuuaguggaagcccugauauuuuaauagggcagggguuuccuggaaaguucuguggguggc

SEQ ID NO: 6788 - RNA, 117 nt, Homo sapiens
gcucucccugcuggaggaccgccauccuuauugaauguauuuccaagaaagcaguugacgggcuuggcugugcuauuucuggaaauguucaauaggccaucuucuggcagggaccgc

SEQ ID NO: 6789 - RNA, 165 nt, Homo sapiens
ugucugagugaugagauguuguucucuauaugugauagcccauuuaagcaggccccacuuaacuugaaagccaaauaacaagcucgguuucaaguuaaauggggucuuucuucaauaggccaccccauauagagacuuugcagagacauuuuguguauuuaagca

SEQ ID NO: 6790 - RNA, 56 nt, Homo sapiens
cuucccuuucugaccccuccuccccucacacugggagagggguggggugaggaugg

SEQ ID NO: 6791 - RNA, 89 nt, Homo sapiens
gcucgggcagccguggccaucuuacugggcagcauuggauggagucaggucucuaauacugccugguaaugaugacggcggagcccugc

SEQ ID NO: 6792 - RNA, 79 nt, Homo sapiens
gcucugccuacaggagcaggugggaccccagagccugcauggacagucaguggggucccagccugcccugcuggcaugc

SEQ ID NO: 6793 - RNA, 88 nt, Homo sapiens
ccucccacaggugugucuacagugccuggucaccaacucuuggguguugagaaguggugauggggcaucagccgcaucugauggcugg

SEQ ID NO: 6794 - RNA, 87 nt, Homo sapiens
ccucccccagggaaagaccagagacagccaucaccccacugggccgaggccugcacgcggcugcucugguucuuuucugagggccgg

SEQ ID NO: 6795 - RNA, 76 nt, Homo sapiens
ggucccuucguaaugaagcggcuucuuaauuaucaaaaaagguaagguuguuuagccagcuucauuaacaggcccc

SEQ ID NO: 6796 - RNA, 85 nt, Homo sapiens
ucucccucugcuagacugggaaugacuugaggaugggaacaauaucuuauucauaguuauguucccaguaccuagcagggccuga

SEQ ID NO: 6797 - RNA, 83 nt, Homo sapiens
ggucccacugagucucagauguaaaggauucaaagauguccgcagacaugaauagagucgauacaucuugauucagugagucc

SEQ ID NO: 6798 - RNA, 68 nt, Homo sapiens
ucuccacugccucuuccuccuguagcacuagcauucaaagugggucuugcugggacggaggggcagga

SEQ ID NO: 6799 - RNA, 72 nt, Homo sapiens
ugucccauuagaguucaggagaauaagauucacuuaugaacugagucguauuuuucugucucuuaaaauuca

SEQ ID NO: 6800 - RNA, 73 nt, Homo sapiens
ggucuggauucuggggcuaacaggaggaucuggaaacagaaagucgguuucuuggcagccucaguuucccccc

SEQ ID NO: 6801 - RNA, 77 nt, Homo sapiens
ccucuuuuguggauacaaauauuuccucuacuggauuguaguuccucugaggguuuaauuuguaucccaaugccugg

SEQ ID NO: 6802 - RNA, 68 nt, Homo sapiens
uuuggaguuaggcccaagaaccaggguuugaagucuucuggucucagggcuuugggccuggcuuugga

SEQ ID NO: 6803 - RNA, 55 nt, Homo sapiens
auugccuguguucucuucucuuuugauagccagccaagaagagggaacgcagggu

SEQ ID NO: 6804 - RNA, 65 nt, Homo sapiens
ccuggggagcuuugcuaguucagccuaagcuuucagugaaggugcaagcaacagagcuuccuggg

SEQ ID NO: 6805 - RNA, 72 nt, Homo sapiens
ugugguccaggacuggugguacccuucacucugcaaagccccuguaagggagacccaccguccuggacugca

SEQ ID NO: 6806 - RNA, 65 nt, Homo sapiens
gauggcccaggugcacccagaggccccagcccuuuggcugccuuuggguugugacuuggguuguc

SEQ ID NO: 6807 - RNA, 66 nt, Homo sapiens
ucugcccggaggugagaugaauaaccaaucucuaaagguguugggcguuucuugucuuugggugga

SEQ ID NO: 6808 - RNA, 67 nt, Homo sapiens
cgugguggggaagaagugggggcagccacagagccaggcugucccuggcuucuccuucuccacugug

SEQ ID NO: 6809 - RNA, 89 nt, Homo sapiens
cuuggaguggaggaagacgagguuuuccuuuauauucuacuuagaagacaaguagaaaguggaacggagcccugucccccugcucugag

SEQ ID NO: 6810 - RNA, 128 nt, Homo sapiens
gcugggcugccgcuggagguggcugcgcugcgggagcggugggcgcgcaccugccuccugcauggcgaggccugggggcggggcgcggagcuugacccgcagcuggcgccgcugcagcgcggccuggc

SEQ ID NO: 6811 - RNA, 72 nt, Homo sapiens
uuuggcugaucugcauacauauuuuuaagcucuuugaaauucaagggaaaugugaagugugagucagcugaa

SEQ ID NO: 6812 - RNA, 103 nt, Homo sapiens
ccuguaaaauauguccucacacaugcaagugagucauuuuacuugcaaauuauuguuucgcauaugcaauuacuugcuugcaucuggauauacauuuuguggg

SEQ ID NO: 6813 - RNA, 73 nt, Homo sapiens
gguggaagggcuugggguggagcacaggcccuugacaugcaguagguagcucugugccccaacaccuucugcc

SEQ ID NO: 6814 - RNA, 60 nt, Homo sapiens
acugccugacaauugucacuguauaagaaaguccccuuugcagggacaaugacagguggu

SEQ ID NO: 6815 - RNA, 56 nt, Homo sapiens
uuuggggaaguuugggaucuggcagggcaucugcauaauccauagaaaucccugag

SEQ ID NO: 6816 - RNA, 56 nt, Homo sapiens
acuguugucuagaccaugccugugcguaggcgcguaggcagcgucuacacagaugu

SEQ ID NO: 6817 - RNA, 105 nt, Homo sapiens
cuuggggcguagcacaugaccuggugcucaauaagugcucagugggugaaaacauagccccaagagcugcacuuauugagcgccaacucugugccaagcccuggg

SEQ ID NO: 6818 - RNA, 79 nt, Homo sapiens
uuugaacaaguuuuccuuuauugaguaccaacccauguaaugguaaccuggacuuuaauaaaagggaaaugaguuugaa

SEQ ID NO: 6819 - RNA, 82 nt, Homo sapiens
gcugaguguucccugacuccuucuccaggagcuguguucagacuuucgcagcucuuggcuuggagcuccuggagggcuuggc

SEQ ID NO: 6820 - RNA, 118 nt, Homo sapiens
ccugggggaggcacuggcaggccugcccgacacucuuucccuguugcacuacuauaggccgcugggaagcagugcaaugaugaaagggcaucggucagguccagccugcuacccuggg

SEQ ID NO: 6821 - RNA, 65 nt, Homo sapiens
uuuggugagaggguucuuucccccuucuuguuucugagggacugauuggagcgcucucgacugaa

SEQ ID NO: 6822 - RNA, 70 nt, Homo sapiens
ccugcagaacauaguggacuuuggcaaaaaugucauggaguuuuugggggagaacuauguucauuguggg

SEQ ID NO: 6823 - RNA, 69 nt, Homo sapiens
ccugcauauaagaagugaagaagaguuaaaaugaaaauuuggcuguuucuuugauuucuuguuuguggg

SEQ ID NO: 6824 - RNA, 56 nt, Homo sapiens
ccugcuuccugucgucccugucagcacccugggugggggagggaccagguaguggg

SEQ ID NO: 6825 - RNA, 97 nt, Homo sapiens
ggugauuagccauaucauggcacugagggaauuucugugcguuagucuuuggcaauuaaaccuuaugcuguuccccagugcugugaguggcauugcc

SEQ ID NO: 6826 - RNA, 56 nt, Homo sapiens
ccugcgcuuccucuugcacuucccgcuccguuuccggggggcgggaggaagauugg

SEQ ID NO: 6827 - RNA, 69 nt, Homo sapiens
gcuggacuacagcuguguguuuaugugcagugcacaccugcaggggccugacaaauagcuguaguaugc

SEQ ID NO: 6828 - RNA, 85 nt, Homo sapiens
guuuuuuccauggucuauuacucacaccuuauuuaccuucugcuagacuuugaaggugcaaggaugaguaggcuguggaaauuac

SEQ ID NO: 6829 - RNA, 74 nt, Homo sapiens
uuuucuuuuccuuguuuauguccuuggcccuacuguuagguauagaggcuugggaggugaugaggagaagggag

SEQ ID NO: 6830 - RNA, 85 nt, Homo sapiens
gcuugaagagucacuuggcucaugucuugauaucccagaaaucucaaaggcaucuggggagggcugagccaaguacuuuuucugc

SEQ ID NO: 6831 - RNA, 72 nt, Homo sapiens
gauuaagcaucuugagaugggaacuuauccuauguugccugugggcccagugucccaucacagugcuuuuuu

SEQ ID NO: 6832 - RNA, 80 nt, Homo sapiens
gcuuccccacgugcuguuucacucacaucuuuauccaggucuggcccuugugagggugugcagugugcgguguggggugc

SEQ ID NO: 6833 - RNA, 87 nt, Homo sapiens
ucuuucaggcuacuuggacaguauuuaguauucuauauuaguacuacacuaauaauuuacugagugcuaccuaagugaccugauuga

SEQ ID NO: 6834 - RNA, 96 nt, Homo sapiens
gauuggggacuaggcaggaagccagagcaggggagguucccucaggccagcuugaccugcuccuugaccucuuuggcuccuggcuucuccuccuuc

SEQ ID NO: 6835 - RNA, 73 nt, Homo sapiens
guuugagccggggcuuccagucugcucucuggccacacucucagggcuggacuggacagcccaaggcucuuac

SEQ ID NO: 6836 - RNA, 55 nt, Homo sapiens
cuuugucauuuuguuucucggcagcucuuucugcugccuggaaaggacguggcgg

SEQ ID NO: 6837 - RNA, 92 nt, Homo sapiens
cuuuaaguuuuaggguacaugugcacaacaugcagguuuguuacauauguauacauaugccauguuggugugcugcacccaucaacuuuugg

SEQ ID NO: 6838 - RNA, 129 nt, Homo sapiens
guuucauccuuugaggccacauauugggucuccugcauucuaucuguuuacucucuauaagauuuaaaacagagagaguaaauagacagaaggcagaggacccaacuauguggccucaaaagauguggc

SEQ ID NO: 6839 - RNA, 56 nt, Homo sapiens
auuugagguaagacugccauguggagaugggucuccaucugguggcuuccuuuugu

SEQ ID NO: 6840 - RNA, 68 nt, Homo sapiens
gguuuguaguuaccguguguauguguaugugcacacacaaguucacacauauauaggaacagcacucc

SEQ ID NO: 6841 - RNA, 111 nt, Homo sapiens
cuuugggacuauuuugagcaagggcauuuguuggaaguagaagaaggaaaagucugaggaauuuuaacuucuccuuggacaggugcccuugcuuuuagaauuggcucuuag

SEQ ID NO: 6842 - RNA, 80 nt, Homo sapiens
gauuggaauuugggugcagccuccuggcacgugcucauccuguucuuccaauuucuggaggcugugccuacgugccuuuu

SEQ ID NO: 6843 - RNA, 125 nt, Homo sapiens
aguuauuugucuuaaccaugugcugucauguuuugcuucuuaacuuuaucaaacaaaaccagccuuugggagaguguuuggucaggguuauagcuuagcucagcaugggugcagacagauuuucu

SEQ ID NO: 6844 - RNA, 85 nt, Homo sapiens
guuuugagcgggggucaagagcaauaacgaaaaauguuugucauaaaccguuuuucauuauugcuccugaccuccucucauuugc

SEQ ID NO: 6845 - RNA, 91 nt, Homo sapiens
acuuaaaaguuaauacaaugcuugguaugaaugucacucaauuuuaaaucaugugacacucauaccaggcauugaauuaacuuuuuucugu

SEQ ID NO: 6846 - RNA, 114 nt, Homo sapiens
gcuuaaguucugggaccucagccaaacuuucagagaggagcccuuucuucuuuguuuauaauaggauauguguccugcaagggagaaaggcucucuccugcccaggacccuugc

SEQ ID NO: 6847 - RNA, 117 nt, Homo sapiens
gcuucuguugcagaaccugagugugcaucguggucaaaugcucagacuccugugguggcugcucaugcaccacggauguuugagcaugugcuacggugucuacuuuugcuacauugc

SEQ ID NO: 6848 - RNA, 72 nt, Homo sapiens
gauucugaggagccagggaagcagguggccccagagcuggggaguggccuccuuccugccgcucuuccccuc

SEQ ID NO: 6849 - RNA, 131 nt, Homo sapiens
guuuucuaccaguugcugaagcuuggaugucucugaugccugggcugaguccaagagccccccagaaggaaacuuggccuugaacugcuuggacaugagaggcaacaaaggguuggugaaggugguagugc

SEQ ID NO: 6850 - RNA, 85 nt, Homo sapiens
guuuucuucugggucccuuugcuguugaugaugugauacagacaguugcuguggacgucauuaaagcaguggacaagaagccugc

SEQ ID NO: 6851 - RNA, 175 nt, Homo sapiens
uuuuucucugugcuggacugcucugaccuuuucaauauucuauaauuugacuggcuggccauuucaguucucuccuuuuuacagccuuauuaacuugugggaaagaggugacaugaacaaccaaucagaauacauaauauugcaaaggucagcguaguccuguacaguaucauaa

SEQ ID NO: 6852 - RNA, 65 nt, Homo sapiens
uguggcugccuggggagcugucugcucaucauccuccuucccaggucccuccccugcagcuacug

SEQ ID NO: 6853 - RNA, 56 nt, Homo sapiens
agacuuuccagguccugggcuaugaugaaauuauagcuggaggcuuguaaagucgu

SEQ ID NO: 6854 - RNA, 101 nt, Homo sapiens
ucccuuccuuacuggugugugcacauguguaugcaugcaugcauguguaauagcacaugcauuuauguguguacauugcauguguggugugguggagggca

SEQ ID NO: 6855 - RNA, 56 nt, Homo sapiens
uggggcaagggguuugucuggauugcagaucgcauugcacagaccccuggcucuga

SEQ ID NO: 6856 - RNA, 55 nt, Homo sapiens
cgucccagcgccgaccggagaggaggccuguccugaguccgucggcgcggggcug

SEQ ID NO: 6857 - RNA, 56 nt, Homo sapiens
cccaccucccacuccaggcaucacgugacggcugccgaguugggguggggguggcg

SEQ ID NO: 6858 - RNA, 70 nt, Homo sapiens
cggaagcagagggggcgggggaguggccggcuuugaauauccuguugaccccaguuuccucugcccccag

SEQ ID NO: 6859 - RNA, 92 nt, Homo sapiens
uguuguuuuuuuuuuuuuccaucuccguucucuuucuagcgugcaaugaugcgcuucucagaguuggagaugaaagaaagagaagguggcca

SEQ ID NO: 6860 - RNA, 124 nt, Homo sapiens
uauuauucgauaaaacuguaaaacuauuguguagucagcucauaaauuauaagcaaauggauacugcuaaaauagauuuuaugggcugauuacacaagagucuuaaaacuugucgaauaguuug

SEQ ID NO: 6861 - RNA, 56 nt, Homo sapiens
cucuuggcuguggggccucagcuccaaagagcagugcaggccucaggcuagggcug

SEQ ID NO: 6862 - RNA, 57 nt, Homo sapiens
ggucaggagagggggcaggcacuggcuggcuggugacugcuuucacuccuggcuguc

SEQ ID NO: 6863 - RNA, 56 nt, Homo sapiens
auccacgcuuagguggagcgagggggcguuccuuggcuuucuaggcuggacuuucu

SEQ ID NO: 6864 - RNA, 70 nt, Homo sapiens
gagaugagccacugucauggagacguuguguauuuggaugcccaugacaguccucauuuuaaacuaacac

SEQ ID NO: 6865 - RNA, 65 nt, Homo sapiens
augguuugcaagcugaaggagaaaaaauccaccucccacagcuguugcagccaacuuuccaaccu

SEQ ID NO: 6866 - RNA, 76 nt, Homo sapiens
gaauugaugaccagcugggguuaauggcccuuggcugcacugugggcuaucaacucccccagcuggucauuaaucc

SEQ ID NO: 6867 - RNA, 76 nt, Homo sapiens
aaggcccaggagcagcugaccucaguaguuucuacccugagccuggaagagaauggucaggccugaccugggcugu

SEQ ID NO: 6868 - RNA, 79 nt, Homo sapiens
cauuugaggugaaguucuguuauacacucaggcuguggcucucugaaagucagugcaucacagaacuuugucucgaaag

SEQ ID NO: 6869 - RNA, 56 nt, Homo sapiens
uacauggaccaggcauagugagauuuggaaauaaucucaugcauuugauccaugga

SEQ ID NO: 6870 - RNA, 55 nt, Homo sapiens
uaggcaguguaguuagcugauugcuaauaguaccaaucacuaaccacacggccag

SEQ ID NO: 6871 - RNA, 58 nt, Homo sapiens
caugggagcugagcuugucccaggacucaagggaguggggacgagcauaucugccagg

SEQ ID NO: 6872 - RNA, 56 nt, Homo sapiens
cauggugcccacucacaaguuggcuggauucuugcccuuaguguguaggugccagg

SEQ ID NO: 6873 - RNA, 57 nt, Homo sapiens
gacgagggacagaggggggggcggagagccgccgccucugccccccgcucgccccgc

SEQ ID NO: 6874 - RNA, 71 nt, Homo sapiens
aacagggaagagaaauggggcagcagcacuuuagagugacuuacuucucucuuguuuucuccucccugaau

SEQ ID NO: 6875 - RNA, 58 nt, Homo sapiens
gacugggccaagagcgggggcacuacgggcaucgaggcuuucgccuuugggucagggc

SEQ ID NO: 6876 - RNA, 73 nt, Homo sapiens
cagggcuuccuggagcaggugugggcucuuccagcacagagcaugggcugcaccagcuucggggugcaccgcg

SEQ ID NO: 6877 - RNA, 56 nt, Homo sapiens
aaccagcuuguuggccauguuacuuucccuaggggugaaugccaauuagccgggcu

SEQ ID NO: 6878 - RNA, 56 nt, Homo sapiens
aaaugugacaaugggcuauuauuucucuccccauaauagcauguugucacaucucu

SEQ ID NO: 6879 - RNA, 60 nt, Homo sapiens
aaucuccuuggucucguuccaggccccccagcccugggccucagggucugaggagaccgu

SEQ ID NO: 6880 - RNA, 57 nt, Homo sapiens
gacugggagggggccagagacccuccaggcagagcuccuggcccccaacccagcagc

SEQ ID NO: 6881 - RNA, 62 nt, Homo sapiens
gaacacuacccccaggaagugucauucagugacagaacugaugcccuuggaggguagugggu

SEQ ID NO: 6882 - RNA, 89 nt, Homo sapiens
uaacugcccucaaggagcuuacaaucuagcuggggguaaaugacuugcacaugaacacaacuagacugugagcuucuagagggcaggga

SEQ ID NO: 6883 - RNA, 73 nt, Homo sapiens
gaaaaugagggacuuuugggggcagauguguuuccauuccacuaucauaaugccccuaaaaauccuuauugcu

SEQ ID NO: 6884 - RNA, 56 nt, Homo sapiens
caaaggcuuugcugggcuuuguuccacuguguagggauuaggccuggcggucugag

SEQ ID NO: 6885 - RNA, 60 nt, Homo sapiens
caaguuuaccugcauggucuggcugcaugaaugcuguuguggccauguggggaaacaggg

SEQ ID NO: 6886 - RNA, 70 nt, Homo sapiens
gaaaccaggcuguuggcuccaggguucuuguuuuuagcagugugggcucuggagucugcugucuuggacu

SEQ ID NO: 6887 - RNA, 76 nt, Homo sapiens
gaaaacaccuacguccucuuccacagcucugcagagcacagcucgucagcugugguggaguugaugaggauaagac

SEQ ID NO: 6888 - RNA, 101 nt, Homo sapiens
aaaacaaaaaguauucccuuggccccuggauucuuagaacucuuagcagaccagaaaggagggucugggagacagaugggguugaggggaaacuugagagu

SEQ ID NO: 6889 - RNA, 80 nt, Homo sapiens
gaaauuugucuccucuguguguguccugcacuaaaugcccaaaccccagcaugggacauaaugcagagagggacacaggc

SEQ ID NO: 6890 - RNA, 83 nt, Homo sapiens
aaaucaacuacaggucccagcaugcagugcucuaaucugaaguuaagcaaaaacugcaaugcauacugggacuuguaguaagu

SEQ ID NO: 6891 - RNA, 64 nt, Homo sapiens
caauuaaggaccaccuagggugggggugaagcugaagguggcucugacccuaggaggucuacag

SEQ ID NO: 6892 - RNA, 76 nt, Homo sapiens
gaccugaugucccugaguguauguggugaaccugaauuugccuuggguuuccucauauucauucaggagugucagu

SEQ ID NO: 6893 - RNA, 69 nt, Homo sapiens
uaccuaccugagacccgguccaggagugucuaaggacacccagugcuucugggcugggcuggggccuag

SEQ ID NO: 6894 - RNA, 67 nt, Homo sapiens
aacugacacuuuugccucuggugaaauuaugaaauuuuaugaauuugccacaggcaaaguuugcugu

SEQ ID NO: 6895 - RNA, 90 nt, Homo sapiens
aagucccugacacccuucuuuccugugugccuuaggugguagucggccacaacacaaccgccagccaggaaaaggccagggugcggggau

SEQ ID NO: 6896 - RNA, 77 nt, Homo sapiens
uagccuuuguacauaaugcagaacacagaaaggacagcuuuugauaaacacuugugguucuguauaauguaaggaaa

SEQ ID NO: 6897 - RNA, 69 nt, Homo sapiens
cagaaccuguucagaucccuuagguacccuggagucacuuggggauacacgaggggcaggagcaaaggg

SEQ ID NO: 6898 - RNA, 59 nt, Homo sapiens
caggccagcccgcucuucucauguaaagcagcuuuuugucugggggagccagggcuggg

SEQ ID NO: 6899 - RNA, 96 nt, Homo sapiens
caggggcauuuucugcccaugauugccuuguuuuagugacaugcaucugucaguuagauauuaaaacagaguaauaaugggaagauaauaugcugg

SEQ ID NO: 6900 - RNA, 68 nt, Homo sapiens
uaggaauuuagagagacagaccacuucagacaagauuggucuggaauggugugcuuuuuacugggcgg

SEQ ID NO: 6901 - RNA, 87 nt, Homo sapiens
gaguuucuaagcacaacccucuucgcccguggggccccagucaggucauccagaugggucuggugggguuggagagggugugugugu

SEQ ID NO: 6902 - RNA, 60 nt, Homo sapiens
aauggguuuucggaaaugaaagcugggcucaaacagagcccacuuucaagggggccuggu

SEQ ID NO: 6903 - RNA, 68 nt, Homo sapiens
cauagcugccaagggaacuaaaagguuucuuuuaaaugaauucuccuuugguuuucucuuggcggaag

SEQ ID NO: 6904 - RNA, 99 nt, Homo sapiens
gcaagcaauuugugcgguguuucccaucuaucuucuaccuugaaaaggugauuagcacuuugguggggagaggggagggaaugucucacaaauugcuuc

SEQ ID NO: 6905 - RNA, 56 nt, Homo sapiens
acggcuggcugauggaugcaggcgcuuagacacccuguaugacagcagccagcucu

SEQ ID NO: 6906 - RNA, 83 nt, Homo sapiens
ccauguaaauacagauuuaauuaacauuugcaaccugugaagaugcaaaacuuuaaguguuaauuaaaccucuauuuacauag

SEQ ID NO: 6907 - RNA, 74 nt, Homo sapiens
ccaggccugaaugcuauuccuuggcgauaccaugauuauaucuccaucgaguccggggaagccucucaggccug

SEQ ID NO: 6908 - RNA, 57 nt, Homo sapiens
ucugccuccacugccaccauggcgcccgugaaaaagcuuguggugaaagggggcaaa

SEQ ID NO: 6909 - RNA, 84 nt, Homo sapiens
ucuggagaccugggugugggucaagcaaccagguaaucugaguuuuggcacuuuggaaagcuugaucugacgcuccuuuucuaa

SEQ ID NO: 6910 - RNA, 57 nt, Homo sapiens
ucauuuggcuccagaccuuggcacuacgaaggucagccaaggucggggcucaaguaa

SEQ ID NO: 6911 - RNA, 55 nt, Homo sapiens
ccuucccagcggcagcgcugcacgugugccugcuggugccuugcugcaagggaag

SEQ ID NO: 6912 - RNA, 84 nt, Homo sapiens
ccaauuauauucagcaauauuguucccccagccuguugggucacguaacagccugagagaacaaugaugcugaauuaacgauug

SEQ ID NO: 6913 - RNA, 74 nt, Homo sapiens
ccucaugguuugucggaacugcaucuuaucuagcuuguauagcuuagugaggcaguucugggccugcaaugaag

SEQ ID NO: 6914 - RNA, 62 nt, Homo sapiens
ccgugccuacugagcugaaacacaguugguuuguguacacuggcucaguucagcaggaacag

SEQ ID NO: 6915 - RNA, 57 nt, Homo sapiens
uccuuccugacacugauggauggucaccuccaccuguccauccugugucaaucagaa

SEQ ID NO: 6916 - RNA, 126 nt, Homo sapiens
ucgguauacaaagaauuuccuguagauuaauaugaagcuggaaggaguugauagauuucagcagugauuugggcuauuaauccaagccagucauucauuaacccucaggaaguuuucugugccaaa

SEQ ID NO: 6917 - RNA, 58 nt, Homo sapiens
gcccucguugucccgggaauaaacccgcaacguguaugucaucccgggauagaggucu

SEQ ID NO: 6918 - RNA, 89 nt, Homo sapiens
gcauuucaagauuguuucuuugcuucccaucuucucuuggguucuauaaaaaagaaaaaggguagcacaggaagcuuguuuugaaaauc

SEQ ID NO: 6919 - RNA, 58 nt, Homo sapiens
ccaugaucacaguaauguucuuuggagauauaaucaucaaagagcaucccuugguuag

SEQ ID NO: 6920 - RNA, 78 nt, Homo sapiens
ucauucagaccacagggguacuauuuuaauaaauugccacuucaaugugcaaaauaaugccccaauggacuggaagcg

SEQ ID NO: 6921 - RNA, 73 nt, Homo sapiens
ccagcugggggucccgccaagccucacugugguucagaggcuggaguaugagcuugugggccuccagcaagag

SEQ ID NO: 6922 - RNA, 58 nt, Homo sapiens
acaagaugcggguuaagggccagaggcaaaacccagggcccuuaaacuagccaaucau

SEQ ID NO: 6923 - RNA, 75 nt, Homo sapiens
gcauggucaaugucagaagagaauuggaaugaagguggggguccuuaccuauaauucccucugacauugacuuac

SEQ ID NO: 6924 - RNA, 109 nt, Homo sapiens
ccauagagggugcacugagggccgggcggugcggggaugaggcaccuccagagggacucggucuugaugguucccgcauccccuugggccaucaguacagccaggaaag

SEQ ID NO: 6925 - RNA, 58 nt, Homo sapiens
cccuuucuguguggaggccacguggcaaacuccaggugcaucugucauacagaaauug

SEQ ID NO: 6926 - RNA, 66 nt, Homo sapiens
ucuguguguguauguguauauauugauaaauggguauaauuaaauauauauacaaacacauacuua

SEQ ID NO: 6927 - RNA, 142 nt, Homo sapiens
ucuuugaucagguuuaugcaguaggaaguuauguuucaguggcugugauugggcccagggcauagcuaagucuauaauuacuagcugguuaaaucagagcucuucuggaauuuagcagccauuuguguaaacugccucaaua

SEQ ID NO: 6928 - RNA, 80 nt, Homo sapiens
gcucugcagugaugggcucgguugcaaggcugguguggaagacccaggucugccugaguuuugcaaagcccacacugcac

SEQ ID NO: 6929 - RNA, 61 nt, Homo sapiens
ucuggagucuccugcuaccuaugccugaugcuggcagauguggguuggcugagggcucaug

SEQ ID NO: 6930 - RNA, 56 nt, Homo sapiens
ugcuuguuuuguggcuucagcuguguggauacagagcaggaaggcuagaagcagga

SEQ ID NO: 6931 - RNA, 56 nt, Homo sapiens; identical to SEQ ID NO: 6930

SEQ ID NO: 6932 - RNA, 56 nt, Homo sapiens
uguccuccugaccccgaucagguugucugcgggagcuggagugggauuuggaggaa

SEQ ID NO: 6933 - RNA, 67 nt, Homo sapiens
ugagggcaaggacuggagucucauucaucuuugaaucuacaauaauggacccagugcuugcuucuag

SEQ ID NO: 6934 - RNA, 56 nt, Homo sapiens
ugccuacugagcugaaacacaguugguuuguguacacuggcucaguucagcaggaa

SEQ ID NO: 6935 - RNA, 84 nt, Homo sapiens
agcgacgcccucugccccgcaggaggagaagaaggucccuccgccgauaccaaagaagccccugcggggccggggcgugccggu

SEQ ID NO: 6936 - RNA, 121 nt, Homo sapiens
aguggauggagccaggaugagaccaggagugacagagugacauuuucugaugugagcuggcccuauauugcugcuagaggauggcucuggucuucucuaguucuuucuggcucuauguggu

SEQ ID NO: 6937 - RNA, 57 nt, Homo sapiens
agucccaggcagcccuuggucuugcuuuuacuguaggacugugggggagcaggagau

SEQ ID NO: 6938 - RNA, 87 nt, Homo sapiens
gggcaggcagggaggaggaggcucagggaccuagccaggggcauuccauuccccaucucugggccucagucuccccuucugcagcac

SEQ ID NO: 6939 - RNA, 79 nt, Homo sapiens
ugacaugcaugauccgggucuggucugcagcacucaggauacuuccgggcuguggagauggaaccugggucaugcaugg

SEQ ID NO: 6940 - RNA, 58 nt, Homo sapiens
agauccugcccuaagauguuauauuuagaucugugaaaauauuuuagggccaggagau

SEQ ID NO: 6941 - RNA, 68 nt, Homo sapiens
ggaaucaucucucugcccacaguuucauuccagggaccugaagggaugggggugggguggagcagaac

SEQ ID NO: 6942 - RNA, 67 nt, Homo sapiens
ggauguggagaugaaaggcagcuuccugggacaaugaacaguccuggugaagcuguuggucuccaac

SEQ ID NO: 6943 - RNA, 63 nt, Homo sapiens
ugcagggauggaggggauggggccuggaccacuaguuagagccaucccguccgccccuuucag

SEQ ID NO: 6944 - RNA, 67 nt, Homo sapiens
agucucauggcuucugucuuggaaacuuuaccuuuaaaagauuauuuaagacaggaaccaggagguu

SEQ ID NO: 6945 - RNA, 60 nt, Homo sapiens
aguacuugucagcuucuuggaugagcugaaggaagcugcuaacuagggaccuggcgaggu

SEQ ID NO: 6946 - RNA, 57 nt, Homo sapiens
cugguggugucuuccucuggccgccgcguggagugcucggagcagaaggcgccgccg

SEQ ID NO: 6947 - RNA, 84 nt, Homo sapiens
guuagggaccagcuccaggggaagggagacuggaaggagagccacagccuuccccugaccuucugccuguagaugguuccugcc

SEQ ID NO: 6948 - RNA, 83 nt, Homo sapiens
cuggccucuguucuuucagaugacuuugggaaaguuacuuugcuucucugggccucagucucaucaggaaagcacagaggucg

SEQ ID NO: 6949 - RNA, 55 nt, Homo sapiens
auuucagcccuugacauuccaggaaauagcuccauaaugucauuugggcugggcu

SEQ ID NO: 6950 - RNA, 58 nt, Homo sapiens
uugcuuuuucucuuuggggacaaaacucaggaggguugccccuuggugaacaaggcua

SEQ ID NO: 6951 - RNA, 58 nt, Homo sapiens
gugucuccuugaaaguaacggcaugugauugcuuacuccauuacuuucaaugggacuc

SEQ ID NO: 6952 - RNA, 55 nt, Homo sapiens
cucccaacuccccuucugccuccuuugacguggcaggggugagcgggagcugggg

SEQ ID NO: 6953 - RNA, 73 nt, Homo sapiens
cugcuucccugccacucagcuccugauggauaagaaaaggugguuagacgggagagggagguggcggggagcg

SEQ ID NO: 6954 - RNA, 56 nt, Homo sapiens
cuuggcccaggucccagagagucugguugguguguacuuggggcuugggcuggaug

SEQ ID NO: 6955 - RNA, 58 nt, Homo sapiens
gugggagguuuccuuuuggaucuguuuugagacuguuccagaaagaaggcuuccuuuc

SEQ ID NO: 6956 - RNA, 63 nt, Homo sapiens
auaacuggcacauauggagguggaauagcacaauuugauauuuucucaugugccagauuuuuu

SEQ ID NO: 6957 - RNA, 56 nt, Homo sapiens
cucuacucggguggcgugucuugcaauuacaaugcaagacaucuaucauagugaug

SEQ ID NO: 6958 - RNA, 65 nt, Homo sapiens
cucaaaaagcugcucagauucuuuuaagcacugagugauucagagaaacugagcagcaccgcaug

SEQ ID NO: 6959 - RNA, 62 nt, Homo sapiens
guccgugauuggcucagccacuuuaaugugaccucugcaaaaguggcugagacaccaauuuc

SEQ ID NO: 6960 - RNA, 70 nt, Homo sapiens
augaggaagagggaauggacuuagcugugugcuuggcuucucacuagcugccaccuucccuccucuuguu

SEQ ID NO: 6961 - RNA, 132 nt, Homo sapiens
uuggcuaguggagauguuaaucugggagguggcuggguccugaaagcaugcacgggaaggaaucguuccuccaucaggaaguaagcuaaucaggacuccagucuuaauggaaaugaaucuuccgcaagcagg

SEQ ID NO: 6962 - RNA, 111 nt, Homo sapiens
cugaaaugcaccauaugcgcucugauaccuaugcacaauagggugcagguuuaaugacuuucuuauugugccccuguuguaauuagguauuaaaggacauaugguaugcug

SEQ ID NO: 6963 - RNA, 88 nt, Homo sapiens
gugguagcuggcugaggugaggaggguuagccuguguuguauacugacuucuaagugaauccuccugauuucagccugucagcuaauu

SEQ ID NO: 6964 - RNA, 77 nt, Homo sapiens
guuucuucccugguguuaaaucaacacuucccacuacaucuaguuuuugacugcugaguuuaacacugggaggaggu

SEQ ID NO: 6965 - RNA, 88 nt, Homo sapiens
auuagcauuugaggugaaguucuguuauacacucaggcuguggcucucugaaagucagugcaucacagaacuuugucucgaaagcuuu

SEQ ID NO: 6966 - RNA, 62 nt, Homo sapiens
uuuaaggugaaauugcuaugugaggauuuuguuaaccugacguuuugugguuucgccucaua

SEQ ID NO: 6967 - RNA, 95 nt, Homo sapiens
auuccuaaggcccuuggcugagccccuucucucucuccagguacccaaggaaggcaguucuuagauggaguaggggcugggcugcauggggucuu

SEQ ID NO: 6968 - RNA, 57 nt, Homo sapiens
uuuuugcgauguguuccuaauaugcacuauaaauauauugggaacauuuugcaugua

SEQ ID NO: 6969 - RNA, 22 nt, Homo sapiens
caucuauaaggaccccaugcag

SEQ ID NO: 6970 - RNA, 22 nt, Homo sapiens
uguauggggucuuuauggaugc

SEQ ID NO: 6971 - RNA, 22 nt, Homo sapiens
uaggacugugcuuggcacauag

SEQ ID NO: 6972 - RNA, 22 nt, Homo sapiens
ugugugccaagcauaguccugu

SEQ ID NO: 6973 - RNA, 22 nt, Homo sapiens
uucucacucacagaaguagauu

SEQ ID NO: 6974 - RNA, 22 nt, Homo sapiens
ucuacuucugugggugagaauu

SEQ ID NO: 6975 - RNA, 22 nt, Homo sapiens
uguauaaucuuaauuugcuuuc

SEQ ID NO: 6976 - RNA, 22 nt, Homo sapiens
agacaaaauaggaauauaugga

SEQ ID NO: 6977 - RNA, 22 nt, Homo sapiens
uggguucugcaaaaugcagauu

SEQ ID NO: 6978 - RNA, 22 nt, Homo sapiens
ucugcauuuuguagaacccaug

SEQ ID NO: 6979 - RNA, 22 nt, Homo sapiens
uaguaccaguaccuuguguuca

SEQ ID NO: 6980 - RNA, 22 nt, Homo sapiens
cacaagguauugguauuaccuu

SEQ ID NO: 6981 - RNA, 22 nt, Homo sapiens
ucaugaaugaccaaagcaaaau

SEQ ID NO: 6982 - RNA, 22 nt, Homo sapiens
uuugcuuuggucguucaugagu

SEQ ID NO: 6983 - RNA, 22 nt, Homo sapiens
uaggggagggccucugacaccc

SEQ ID NO: 6984 - RNA, 22 nt, Homo sapiens
guaucagaggcccuccucuaug

SEQ ID NO: 6985 - RNA, 22 nt, Homo sapiens
ucuccaguguccaggagaauuc

SEQ ID NO: 6986 - RNA, 22 nt, Homo sapiens
auucuccugggcacuggagagc

SEQ ID NO: 6987 - RNA, 22 nt, Homo sapiens
uugucauagaaguaaaugaaaa

SEQ ID NO: 6988 - RNA, 22 nt, Homo sapiens
ucauuugcuucugugauaacau

SEQ ID NO: 6989 - RNA, 22 nt, Homo sapiens
ucuuacauucugcagacuacuc

SEQ ID NO: 6990 - RNA, 22 nt, Homo sapiens
uggccucuggaauauaagaaau

SEQ ID NO: 6991 - RNA, 22 nt, Homo sapiens
ugugugacccuaugggaaaauu

SEQ ID NO: 6992 - RNA, 22 nt, Homo sapiens
aaucccauaggguuacacagga

SEQ ID NO: 6993 - RNA, 22 nt, Homo sapiens
uagguaaacuaccaaaucucau

SEQ ID NO: 6994 - RNA, 22 nt, Homo sapiens
ugagauuuggugguuuaccuga

SEQ ID NO: 6995 - RNA, 22 nt, Homo sapiens
uagguaaacuaccaaaucucau

SEQ ID NO: 6996 - RNA, 22 nt, Homo sapiens
ugagauuuggugguuuaccuga

SEQ ID NO: 6997 - RNA, 22 nt, Homo sapiens
uagguaaacugccaaaucucau

SEQ ID NO: 6998 - RNA, 22 nt, Homo sapiens
ugagauuuggcgguuuaccuga

SEQ ID NO: 6999 - RNA, 22 nt, Homo sapiens
uacuucagaaucuccaggagua

SEQ ID NO: 7000 - RNA, 22 nt, Homo sapiens
uccuggagauucuaaaguauaa

SEQ ID NO: 7001 - RNA, 22 nt, Homo sapiens
ucaaucauaauguuacaugaua

SEQ ID NO: 7002 - RNA, 22 nt, Homo sapiens
auuuaacauuaugauuggggau

SEQ ID NO: 7003 - RNA, 22 nt, Homo sapiens
uuguaacuaagcaguuacuuug

SEQ ID NO: 7004 - RNA, 22 nt, Homo sapiens
aaguaacugguuaguuacaagu

SEQ ID NO: 7005 - RNA, 22 nt, Homo sapiens
uacuucuggagguaaaucuuag

SEQ ID NO: 7006 - RNA, 22 nt, Homo sapiens
uaaaaaggcuuaccuccagcag

SEQ ID NO: 7007 - RNA, 22 nt, Homo sapiens
uagacaguaaccauuuuaugaa

SEQ ID NO: 7008 - RNA, 22 nt, Homo sapiens
uacaaaaugauuacuguuuacu

SEQ ID NO: 7009 - RNA, 22 nt, Homo sapiens
uauuuauugauucugggagugu

SEQ ID NO: 7010 - RNA, 22 nt, Homo sapiens
ccugaucuagaaucaauaaaug

SEQ ID NO: 7011 - RNA, 22 nt, Homo sapiens
gagcuuugugucauggucauau

SEQ ID NO: 7012 - RNA, 22 nt, Homo sapiens
gucaccauaacacgaagcucug

SEQ ID NO: 7013 - RNA, 22 nt, Homo sapiens
cagaucugugauuaugucaggg

SEQ ID NO: 7014 - RNA, 22 nt, Homo sapiens
cugacauggugacagaucuguu

SEQ ID NO: 7015 - RNA, 22 nt, Homo sapiens
gauguuuucuuucgccuuucuc

SEQ ID NO: 7016 - RNA, 22 nt, Homo sapiens
gaaagaggaaagaaaauaucuu

SEQ ID NO: 7017 - RNA, 22 nt, Homo sapiens
ugaagccuaucucuuuuuaauu

SEQ ID NO: 7018 - RNA, 22 nt, Homo sapiens
aauuaauagagauaggcuucga

SEQ ID NO: 7019 - RNA, 22 nt, Homo sapiens
ugaagccuaucucuuuuuaauu

SEQ ID NO: 7020 - RNA, 22 nt, Homo sapiens
aauuaauagagauaggcuucga

SEQ ID NO: 7021 - RNA, 22 nt, Homo sapiens
uuucauucauuuacuccuccuu

SEQ ID NO: 7022 - RNA, 22 nt, Homo sapiens
ggagagugaaugggugaaagag

SEQ ID NO: 7023 - RNA, 22 nt, Homo sapiens
uaaugugucaggaguaaacagc

SEQ ID NO: 7024 - RNA, 22 nt, Homo sapiens
uguugcuucuggcauguuauga

SEQ ID NO: 7025 - RNA, 22 nt, Homo sapiens
uguauuguagauugaauaauaa

SEQ ID NO: 7026 - RNA, 22 nt, Homo sapiens
uguaaauuaaucuauaguauag

SEQ ID NO: 7027 - RNA, 22 nt, Homo sapiens
uaaugaugcuauuuacuuuuug

SEQ ID NO: 7028 - RNA, 22 nt, Homo sapiens
uaaaaauuaauagcaucauugc

SEQ ID NO: 7029 - RNA, 22 nt, Homo sapiens
ugccuucuucacaucauucaug

SEQ ID NO: 7030 - RNA, 22 nt, Homo sapiens
augaaugauguaaaugaggcag

SEQ ID NO: 7031 - RNA, 22 nt, Homo sapiens
gaugagcucauuguaauaugag

SEQ ID NO: 7032 - RNA, 22 nt, Homo sapiens
ucauauuaccauuagcucaucu

SEQ ID NO: 7033 - RNA, 22 nt, Homo sapiens
ugcuugaugccaagcauccuga

SEQ ID NO: 7034 - RNA, 22 nt, Homo sapiens
agauguuuggcaucaggcagac

SEQ ID NO: 7035 - RNA, 22 nt, Homo sapiens
aaucuguaacaugccacaggca

SEQ ID NO: 7036 - RNA, 22 nt, Homo sapiens
cuguggaauguuacggauugca

SEQ ID NO: 7037 - RNA, 22 nt, Homo sapiens
uaauacauauaaaaaggcacuu

SEQ ID NO: 7038 - RNA, 22 nt, Homo sapiens
ugucuuuuuauauguaugaaau

SEQ ID NO: 7039 - RNA, 22 nt, Homo sapiens
gcaaguaaaucuucaacuauac

SEQ ID NO: 7040 - RNA, 22 nt, Homo sapiens
uauauuguugaaacuacuuguu

SEQ ID NO: 7041 - RNA, 22 nt, Homo sapiens
ccaggucacuccauucauauau

SEQ ID NO: 7042 - RNA, 22 nt, Homo sapiens
acaugaauagagcagccuggug

SEQ ID NO: 7043 - RNA, 22 nt, Homo sapiens
gcaggaaaccacuucagucccu

SEQ ID NO: 7044 - RNA, 22 nt, Homo sapiens
gacugaagugcuuuccucaaug

SEQ ID NO: 7045 - RNA, 22 nt, Homo sapiens
uuuggcuuuuaaaacuagaagu

SEQ ID NO: 7046 - RNA, 18 nt, Homo sapiens
uugguuuuaaaagccaaa

SEQ ID NO: 7047 - RNA, 22 nt, Homo sapiens
uaaugaaauauaaaacaaagau

SEQ ID NO: 7048 - RNA, 22 nt, Homo sapiens
uccuuguuuucuauuuuauuga

SEQ ID NO: 7049 - RNA, 22 nt, Homo sapiens
ugcuaauuggaacucuacuaag

SEQ ID NO: 7050 - RNA, 22 nt, Homo sapiens
uaguagaauuccaauauagcgu

SEQ ID NO: 7051 - RNA, 22 nt, Homo sapiens
aacggccggugaccucaccggg

SEQ ID NO: 7052 - RNA, 22 nt, Homo sapiens
cagagugaagucaccgcuguug

SEQ ID NO: 7053 - RNA, 22 nt, Homo sapiens
agcuuguaaauguguguguggu

SEQ ID NO: 7054 - RNA, 22 nt, Homo sapiens
uacacacaaauucacaagcuuu

SEQ ID NO: 7055 - RNA, 22 nt, Homo sapiens
uuuuuuuugguaacagggaaca

SEQ ID NO: 7056 - RNA, 19 nt, Homo sapiens
ucccuguugcuaagaaaga

SEQ ID NO: 7057 - RNA, 22 nt, Homo sapiens
caucacuuccucucugagccuc

SEQ ID NO: 7058 - RNA, 22 nt, Homo sapiens
gcagugggggggaggugaugug

SEQ ID NO: 7059 - RNA, 22 nt, Homo sapiens
uucucgaggaaagaagcacuuu

SEQ ID NO: 7060 - RNA, 18 nt, Homo sapiens
ugcuuccuuucagagggu

SEQ ID NO: 7061 - RNA, 22 nt, Homo sapiens
uggucccauugaaucccaacag

SEQ ID NO: 7062 - RNA, 22 nt, Homo sapiens
uugggauucagcaggaccauuc

SEQ ID NO: 7063 - RNA, 22 nt, Homo sapiens
uagcuauuuuggggacacuauu

SEQ ID NO: 7064 - RNA, 22 nt, Homo sapiens
aaauaucuucaaaguagcuaug

SEQ ID NO: 7065 - RNA, 22 nt, Homo sapiens
cuucugucuauuuacucucucu

SEQ ID NO: 7066 - RNA, 22 nt, Homo sapiens
agaguaaacagauagaaugcag

SEQ ID NO: 7067 - RNA, 22 nt, Homo sapiens
uguuuuccaggaugggguccuu

SEQ ID NO: 7068 - RNA, 22 nt, Homo sapiens
gaagccuuuuggaaaaugugau

SEQ ID NO: 7069 - RNA, 22 nt, Homo sapiens
cauauucagcucuuggauguga

SEQ ID NO: 7070 - RNA, 17 nt, Homo sapiens
uucaggggcugaaugug

SEQ ID NO: 7071 - RNA, 22 nt, Homo sapiens
cagaaagguuguuuaugguugu

SEQ ID NO: 7072 - RNA, 20 nt, Homo sapiens
uacuguaaauaaucuuuuug

SEQ ID NO: 7073 - RNA, 22 nt, Homo sapiens
uuuucuaggaaaugacagggca

SEQ ID NO: 7074 - RNA, 22 nt, Homo sapiens
uccuucucauauucuuggaaaa

SEQ ID NO: 7075 - RNA, 22 nt, Homo sapiens
ugcuguuuuagauuuuauuugu

SEQ ID NO: 7076 - RNA, 22 nt, Homo sapiens
auaaaaucuaaaacauugcauu

SEQ ID NO: 7077 - RNA, 22 nt, Homo sapiens
gccccuaagguacaguuuagua

SEQ ID NO: 7078 - RNA, 22 nt, Homo sapiens
cuaaaugauacccuaggggccu

SEQ ID NO: 7079 - RNA, 22 nt, Homo sapiens
gauuggaggagucugauuuguu

SEQ ID NO: 7080 - RNA, 22 nt, Homo sapiens
caaaucagaccccuccaaucuu

SEQ ID NO: 7081 - RNA, 21 nt, Homo sapiens
uagguaguuucauguuguugg

SEQ ID NO: 7082 - RNA, 22 nt, Homo sapiens
ucggcaacaagaaacugccuga

SEQ ID NO: 7083 - RNA, 22 nt, Homo sapiens
uggaauucaaacauaauuuuga

SEQ ID NO: 7084 - RNA, 22 nt, Homo sapiens
ucaaauuacauuugaacucugu

SEQ ID NO: 7085 - RNA, 22 nt, Homo sapiens
aaugauuauuucucagaguaga

SEQ ID NO: 7086 - RNA, 22 nt, Homo sapiens
uggcuugagagguaauuauuuu

SEQ ID NO: 7087 - RNA, 22 nt, Homo sapiens
gcagccccuucucccucucagg

SEQ ID NO: 7088 - RNA, 20 nt, Homo sapiens
ccagagggggagggggcugc

SEQ ID NO: 7089 - RNA, 22 nt, Homo sapiens
uagcuacuguauuuggaggagg

SEQ ID NO: 7090 - RNA, 22 nt, Homo sapiens
cuucaucuauaguagcuauuca

SEQ ID NO: 7091 - RNA, 22 nt, Homo sapiens
uuccuaaaucaccucccuccag

SEQ ID NO: 7092 - RNA, 22 nt, Homo sapiens
agggaggugguuuaggcagaag

SEQ ID NO: 7093 - RNA, 22 nt, Homo sapiens
ugugugugcaccugugucuguc

SEQ ID NO: 7094 - RNA, 22 nt, Homo sapiens
gacagacgcagguacacacaga

SEQ ID NO: 7095 - RNA, 22 nt, Homo sapiens
uuacagucuaguaaguaaauaa

SEQ ID NO: 7096 - RNA, 22 nt, Homo sapiens
uuuacccaauaggcuguaacag

SEQ ID NO: 7097 - RNA, 22 nt, Homo sapiens
agauucucaacuuacguaauuc

SEQ ID NO: 7098 - RNA, 22 nt, Homo sapiens
guuauauugguugagaauuugg

SEQ ID NO: 7099 - RNA, 22 nt, Homo sapiens
aagcuugaagagacuuaauuau

SEQ ID NO: 7100 - RNA, 22 nt, Homo sapiens
uaauuaaaucucuucaagcuuu

SEQ ID NO: 7101 - RNA, 22 nt, Homo sapiens
uuucuuuuacaguuucaggucu

SEQ ID NO: 7102 - RNA, 22 nt, Homo sapiens
uagaagaaacuguacaagagaa

SEQ ID NO: 7103 - RNA, 22 nt, Homo sapiens
gcuggagucagggagaccacua

SEQ ID NO: 7104 - RNA, 22 nt, Homo sapiens
gcuggauuuuucucucugacuu

SEQ ID NO: 7105 - RNA, 22 nt, Homo sapiens
gggguagaaaugaaagagcuau

SEQ ID NO: 7106 - RNA, 22 nt, Homo sapiens
uagcacacucauaaucuuucau

SEQ ID NO: 7107 - RNA, 22 nt, Homo sapiens
uuuuaauguaugguucugcaaa

SEQ ID NO: 7108 - RNA, 22 nt, Homo sapiens
uuuguagaaccaaacaaaacaa

SEQ ID NO: 7109 - RNA, 22 nt, Homo sapiens
uacaguacugugauaacugaag

SEQ ID NO: 7110 - RNA, 22 nt, Homo sapiens
uuuucgguuaucaugguaccga

SEQ ID NO: 7111 - RNA, 22 nt, Homo sapiens
uaaaggauauagaagguuuucc

SEQ ID NO: 7112 - RNA, 22 nt, Homo sapiens
aaccuucuguauccuuuauuuu

SEQ ID NO: 7113 - RNA, 22 nt, Homo sapiens
ucaucuaaaaggggaaucccuu

SEQ ID NO: 7114 - RNA, 22 nt, Homo sapiens
gggauucuccuuuuauauggca

SEQ ID NO: 7115 - RNA, 22 nt, Homo sapiens
uuauuccacagcucagaauuuu

SEQ ID NO: 7116 - RNA, 22 nt, Homo sapiens
aguaaucucaauugugaaauag

SEQ ID NO: 7117 - RNA, 22 nt, Homo sapiens
agggaauagucuuaaaagaaua

SEQ ID NO: 7118 - RNA, 22 nt, Homo sapiens
uugcuuuuaugauuauuuccau

SEQ ID NO: 7119 - RNA, 22 nt, Homo sapiens
uugaagcuucucccgcgugucg

SEQ ID NO: 7120 - RNA, 22 nt, Homo sapiens
accugcagagaagcuucagggg

SEQ ID NO: 7121 - RNA, 22 nt, Homo sapiens
uugaagcuucucccgcgugucg

SEQ ID NO: 7122 - RNA, 22 nt, Homo sapiens
accugcagagaagcuucagggg

SEQ ID NO: 7123 - RNA, 22 nt, Homo sapiens
uuagaccucauuaccuagccag

SEQ ID NO: 7124 - RNA, 22 nt, Homo sapiens
cugcacauaaugaggucugauu

SEQ ID NO: 7125 - RNA, 22 nt, Homo sapiens
uugggacuuguaccuuugcuuu

SEQ ID NO: 7126 - RNA, 22 nt, Homo sapiens
guggagagugcuucuucuagug

SEQ ID NO: 7127 - RNA, 22 nt, Homo sapiens
aagguagaggucaccggcacau

SEQ ID NO: 7128 - RNA, 22 nt, Homo sapiens
uaugcugaugacaucuaucuuc

SEQ ID NO: 7129 - RNA, 22 nt, Homo sapiens
uauaaugauuucuuaugcucau

SEQ ID NO: 7130 - RNA, 22 nt, Homo sapiens
gaggaaaugaggaaucauuaug

SEQ ID NO: 7131 - RNA, 22 nt, Homo sapiens
uaacuaggauguuggggaauug

SEQ ID NO: 7132 - RNA, 22 nt, Homo sapiens
cauuuggaaacguccuaguuau

SEQ ID NO: 7133 - RNA, 22 nt, Homo sapiens
uuuuaauugcaauuaugguccc

SEQ ID NO: 7134 - RNA, 20 nt, Homo sapiens
gggcaugauugcaauuaaaa

SEQ ID NO: 7135 - RNA, 22 nt, Homo sapiens
ucucuccccugccugccuccuu

SEQ ID NO: 7136 - RNA, 21 nt, Homo sapiens
gguuggcgggcgggggagggg

SEQ ID NO: 7137 - RNA, 22 nt, Homo sapiens
uagauacgguccgagaacuccu

SEQ ID NO: 7138 - RNA, 22 nt, Homo sapiens
aguaaguugccuuguauuugua

SEQ ID NO: 7139 - RNA, 22 nt, Homo sapiens
ugggcaucaaccaugacuaauu

SEQ ID NO: 7140 - RNA, 22 nt, Homo sapiens
uuagugcaugguuggugcucaa

SEQ ID NO: 7141 - RNA, 22 nt, Homo sapiens
gacacucuuugcuguggguuuu

SEQ ID NO: 7142 - RNA, 18 nt, Homo sapiens
ugugcagcagaggguguc

SEQ ID NO: 7143 - RNA, 23 nt, Homo sapiens
ugugcaaauccaugcaaaacuga

SEQ ID NO: 7144 - RNA, 22 nt, Homo sapiens
uuuugcagguuugcauuucagc

SEQ ID NO: 7145 - RNA, 22 nt, Homo sapiens
ucugaguagugguccccagccc

SEQ ID NO: 7146 - RNA, 22 nt, Homo sapiens
uuggcgaucacuacuuagauga

SEQ ID NO: 7147 - RNA, 22 nt, Homo sapiens
aaauuucugccuggaaucccug

SEQ ID NO: 7148 - RNA, 21 nt, Homo sapiens
aauaauuccagguaggaauuu

SEQ ID NO: 7149 - RNA, 22 nt, Homo sapiens
ugccccucccugguggcauccu

SEQ ID NO: 7150 - RNA, 22 nt, Homo sapiens
gaugaaaccagggaagggcaua

SEQ ID NO: 7151 - RNA, 22 nt, Homo sapiens
acuggagagcaaucaguuguuc

SEQ ID NO: 7152 - RNA, 22 nt, Homo sapiens
agaauuuauuguacuguggucu

SEQ ID NO: 7153 - RNA, 22 nt, Homo sapiens
caaaucuauauguccgguccaa

SEQ ID NO: 7154 - RNA, 22 nt, Homo sapiens
gucugggcauacagauuuggga

SEQ ID NO: 7155 - RNA, 22 nt, Homo sapiens
ucuucaguuuugauucuugagg

SEQ ID NO: 7156 - RNA, 22 nt, Homo sapiens
uggugaaucaaaacugagagaa

SEQ ID NO: 7157 - RNA, 22 nt, Homo sapiens
ucaggugcucaaaaggugcuua

SEQ ID NO: 7158 - RNA, 22 nt, Homo sapiens
gcuccuauugaguaccugauau

SEQ ID NO: 7159 - RNA, 22 nt, Homo sapiens
cgggcugggaggcggaggcuga

SEQ ID NO: 7160 - RNA, 22 nt, Homo sapiens
ugaccggccuccccccagccug

SEQ ID NO: 7161 - RNA, 22 nt, Homo sapiens
ugacuagagaggguuaaugggc

SEQ ID NO: 7162 - RNA, 22 nt, Homo sapiens
ucaucaacuuuuccagcuaguc

SEQ ID NO: 7163 - RNA, 22 nt, Homo sapiens
ucaugaaauaauuacacuccug

SEQ ID NO: 7164 - RNA, 22 nt, Homo sapiens
ggagugugauuaucccaugaua

SEQ ID NO: 7165 - RNA, 22 nt, Homo sapiens
acccuuucucuugccuuucuca

SEQ ID NO: 7166 - RNA, 22 nt, Homo sapiens
gaaaagggcaagagagagggca

SEQ ID NO: 7167 - RNA, 22 nt, Homo sapiens
ucuauuaccuggauuuaauaaa

SEQ ID NO: 7168 - RNA, 22 nt, Homo sapiens
uguaaagccaggcaauaagagg

SEQ ID NO: 7169 - RNA, 22 nt, Homo sapiens
agauuggaaacgcagaugaggu

SEQ ID NO: 7170 - RNA, 22 nt, Homo sapiens
cuacuauaucugaaaauuucaa

SEQ ID NO: 7171 - RNA, 22 nt, Homo sapiens
uuagcugaagguccugguuguc

SEQ ID NO: 7172 - RNA, 22 nt, Homo sapiens
aaccaggacugucagcuaauua

SEQ ID NO: 7173 - RNA, 22 nt, Homo sapiens
uaaugugccuaaugacugcuag

SEQ ID NO: 7174 - RNA, 22 nt, Homo sapiens
uagcaaucauuagacauauuag

SEQ ID NO: 7175 - RNA, 22 nt, Homo sapiens
uucauucaacuaacaaauauuu

SEQ ID NO: 7176 - RNA, 22 nt, Homo sapiens
auauguguugguugaacgaacc

SEQ ID NO: 7177 - RNA, 22 nt, Homo sapiens
ugacugauugcacuacauacug

SEQ ID NO: 7178 - RNA, 22 nt, Homo sapiens
aauauguaauguaaucagucag

SEQ ID NO: 7179 - RNA, 22 nt, Homo sapiens
uccagauguguauuuuuagugc

SEQ ID NO: 7180 - RNA, 22 nt, Homo sapiens
acugaaaagacacaucugaaau

SEQ ID NO: 7181 - RNA, 22 nt, Homo sapiens
uucuccuuuaggcuucuuuguu

SEQ ID NO: 7182 - RNA, 22 nt, Homo sapiens
aaagaagccuacagaagaauga

SEQ ID NO: 7183 - RNA, 22 nt, Homo sapiens
uucucucccaaauccccaaaug

SEQ ID NO: 7184 - RNA, 22 nt, Homo sapiens
ucauuuucaugaggaacugggg

SEQ ID NO: 7185 - RNA, 22 nt, Homo sapiens
auguagggcuaaaagccauggg

SEQ ID NO: 7186 - RNA, 22 nt, Homo sapiens
uauggcuuuucauuccuaugug

SEQ ID NO: 7187 - RNA, 23 nt, Homo sapiens
uauggcuuuucauuccuauguga

SEQ ID NO: 7188 - RNA, 22 nt, Homo sapiens
agucccugccauggcugcugcu

SEQ ID NO: 7189 - RNA, 22 nt, Homo sapiens
gcucuugcagccccagggacuc

SEQ ID NO: 7190 - RNA, 22 nt, Homo sapiens
gccuuuccaacgaagacuuccu

SEQ ID NO: 7191 - RNA, 22 nt, Homo sapiens
gcaaaaucuucguuggaagggc

SEQ ID NO: 7192 - RNA, 22 nt, Homo sapiens
ugaaaugucauuucuggaaguc

SEQ ID NO: 7193 - RNA, 20 nt, Homo sapiens
uuugggaagugacauuuuaa

SEQ ID NO: 7194 - RNA, 22 nt, Homo sapiens
ggcgugagcgagcagggaagag

SEQ ID NO: 7195 - RNA, 19 nt, Homo sapiens
cugcuugcucgcucgcgcc

SEQ ID NO: 7196 - RNA, 22 nt, Homo sapiens
auuugaaugguuuugacuagcc

SEQ ID NO: 7197 - RNA, 22 nt, Homo sapiens
ugguuugaaccauucuugguug

SEQ ID NO: 7198 - RNA, 23 nt, Homo sapiens
caaagaauucuccuuuugggcuu

SEQ ID NO: 7199 - RNA, 22 nt, Homo sapiens
gcccaaaggugaauuuuuuggg

SEQ ID NO: 7200 - RNA, 22 nt, Homo sapiens
ugauacugugcccauaaauaug

SEQ ID NO: 7201 - RNA, 22 nt, Homo sapiens
uaaauaugggcacagugccaac

SEQ ID NO: 7202 - RNA, 22 nt, Homo sapiens
uggguuuaagagguuuaugaau

SEQ ID NO: 7203 - RNA, 22 nt, Homo sapiens
uuuaugagaccucuccccauaa

SEQ ID NO: 7204 - RNA, 22 nt, Homo sapiens
uugggugaaaacagucucugau

SEQ ID NO: 7205 - RNA, 22 nt, Homo sapiens
agcggguguuuaucauuuaaaa

SEQ ID NO: 7206 - RNA, 22 nt, Homo sapiens
uggugcauguuugagcaaacaa

SEQ ID NO: 7207 - RNA, 19 nt, Homo sapiens
ugcaucaaauauguaccac

SEQ ID NO: 7208 - RNA, 22 nt, Homo sapiens
cucuucccaggaugcugaguga

SEQ ID NO: 7209 - RNA, 22 nt, Homo sapiens
uagucggccuggggcaguugag

SEQ ID NO: 7210 - RNA, 22 nt, Homo sapiens
uauuuuguuucuucuuuaagag

SEQ ID NO: 7211 - RNA, 22 nt, Homo sapiens
ucuuaaagaagaaauaagauac

SEQ ID NO: 7212 - RNA, 22 nt, Homo sapiens
uaaguauuaacucuaugaggua

SEQ ID NO: 7213 - RNA, 22 nt, Homo sapiens
ucucauggaguuaauacuggga

SEQ ID NO: 7214 - RNA, 22 nt, Homo sapiens
gucuuucuucagagcuuggacu

SEQ ID NO: 7215 - RNA, 22 nt, Homo sapiens
uuaagcccugaagaaagagcug

SEQ ID NO: 7216 - RNA, 22 nt, Homo sapiens
ccaggaagccugagaaugaauc

SEQ ID NO: 7217 - RNA, 22 nt, Homo sapiens
gcuuugucccaggcuuucuggu

SEQ ID NO: 7218 - RNA, 22 nt, Homo sapiens
agagaguuauaaagaaaucauu

SEQ ID NO: 7219 - RNA, 22 nt, Homo sapiens
aaugaccuauauaauucuuucu

SEQ ID NO: 7220 - RNA, 22 nt, Homo sapiens
gaguaauaaauagcuguugaau

SEQ ID NO: 7221 - RNA, 22 nt, Homo sapiens
ucagcaguugggaguuauuuuu

SEQ ID NO: 7222 - RNA, 22 nt, Homo sapiens
gcaccaggggaucauuuagcac

SEQ ID NO: 7223 - RNA, 22 nt, Homo sapiens
cucuaugguucucugguguccu

SEQ ID NO: 7224 - RNA, 22 nt, Homo sapiens
gacuacaacucccaagguacau

SEQ ID NO: 7225 - RNA, 22 nt, Homo sapiens
ugcacacugggaguuguagucc

SEQ ID NO: 7226 - RNA, 22 nt, Homo sapiens
acaucugcauuuuuagcagagu

SEQ ID NO: 7227 - RNA, 21 nt, Homo sapiens
aacuugaaaaaugcagauguu

SEQ ID NO: 7228 - RNA, 22 nt, Homo sapiens
uuagagcccuaaaguauucaga

SEQ ID NO: 7229 - RNA, 22 nt, Homo sapiens
uuaauacuuuaaggcucuaaag

SEQ ID NO: 7230 - RNA, 22 nt, Homo sapiens
uccagucacaugugucuuggag

SEQ ID NO: 7231 - RNA, 22 nt, Homo sapiens
uccaagacacauaggagcugaa

SEQ ID NO: 7232 - RNA, 22 nt, Homo sapiens
gauuuucugcucuaucagcuca

SEQ ID NO: 7233 - RNA, 21 nt, Homo sapiens
aagcuuauggagcagaggauu

SEQ ID NO: 7234 - RNA, 22 nt, Homo sapiens
cauuuugaguccuuuuaaaugu

SEQ ID NO: 7235 - RNA, 22 nt, Homo sapiens
aauuaaaaagucagauucagaa

SEQ ID NO: 7236 - RNA, 22 nt, Homo sapiens
caacagcaugggcuccuccuuc

SEQ ID NO: 7237 - RNA, 22 nt, Homo sapiens
auggggggcuggugcuccgacg

SEQ ID NO: 7238 - RNA, 22 nt, Homo sapiens
uuagccugguccaagggucucc

SEQ ID NO: 7239 - RNA, 22 nt, Homo sapiens
gauccuggaggcuagguuggcc

SEQ ID NO: 7240 - RNA, 22 nt, Homo sapiens
uuagccugguccaagggucucc

SEQ ID NO: 7241 - RNA, 22 nt, Homo sapiens
gauccuggaggcuagguuggcc

SEQ ID NO: 7242 - RNA, 22 nt, Homo sapiens
ugucuaucagccacucccaguu

SEQ ID NO: 7243 - RNA, 22 nt, Homo sapiens
auugggaguuugguggauacgu

SEQ ID NO: 7244 - RNA, 22 nt, Homo sapiens
uuuggcagcugcuccagaugcu

SEQ ID NO: 7245 - RNA, 22 nt, Homo sapiens
gcuuauuggcaguugucaaggu

SEQ ID NO: 7246 - RNA, 22 nt, Homo sapiens
gaccaaccuguguuaggcucag

SEQ ID NO: 7247 - RNA, 22 nt, Homo sapiens
agccuaagcacagguuggucuu

SEQ ID NO: 7248 - RNA, 22 nt, Homo sapiens
ucagaguugacuccugcuccug

SEQ ID NO: 7249 - RNA, 22 nt, Homo sapiens
guuagagaaaguuaacucugag

SEQ ID NO: 7250 - RNA, 22 nt, Homo sapiens
ugggagagagaaaaugugugug

SEQ ID NO: 7251 - RNA, 22 nt, Homo sapiens
uauacacauuuuaucucuccuc

SEQ ID NO: 7252 - RNA, 22 nt, Homo sapiens
uguggaauccaucauuuuauua

SEQ ID NO: 7253 - RNA, 22 nt, Homo sapiens
auacaauaauggguucaacaaa

SEQ ID NO: 7254 - RNA, 22 nt, Homo sapiens
ucaggugccagagagucuagac

SEQ ID NO: 7255 - RNA, 21 nt, Homo sapiens
caugggucuuugguaucugau

SEQ ID NO: 7256 - RNA, 22 nt, Homo sapiens
acagaguuccccagcaucaauc

SEQ ID NO: 7257 - RNA, 22 nt, Homo sapiens
uugaugcuuaggaaaucugugg

SEQ ID NO: 7258 - RNA, 22 nt, Homo sapiens
ucccaggaggcuucgcggugag

SEQ ID NO: 7259 - RNA, 22 nt, Homo sapiens
ucucuuuaccgcgaggaaagcu

SEQ ID NO: 7260 - RNA, 22 nt, Homo sapiens
acuguacucuuauagccaucug

SEQ ID NO: 7261 - RNA, 20 nt, Homo sapiens
gauuguguaaggguacaguu

SEQ ID NO: 7262 - RNA, 22 nt, Homo sapiens
uguggcccugguuuccaggaca

SEQ ID NO: 7263 - RNA, 22 nt, Homo sapiens
ucugugacaaagggccacgccu

SEQ ID NO: 7264 - RNA, 22 nt, Homo sapiens
ucaggucuucauuugacuuacu

SEQ ID NO: 7265 - RNA, 22 nt, Homo sapiens
uaagucaagugaagaccugacu

SEQ ID NO: 7266 - RNA, 22 nt, Homo sapiens
uuuucuuguaucauacugccua

SEQ ID NO: 7267 - RNA, 22 nt, Homo sapiens
gcaguauguuacaaguaaauau

SEQ ID NO: 7268 - RNA, 22 nt, Homo sapiens
gaacaaauaaaaugauuaugug

SEQ ID NO: 7269 - RNA, 22 nt, Homo sapiens
caaaacuauuuucuuugcuuuu

SEQ ID NO: 7270 - RNA, 22 nt, Homo sapiens
uuuuuuguuguuacaaaacacc

SEQ ID NO: 7271 - RNA, 22 nt, Homo sapiens
uauuuugagccuacaaaaaguu

SEQ ID NO: 7272 - RNA, 22 nt, Homo sapiens
uccuucaguuuuuauuuuucag

SEQ ID NO: 7273 - RNA, 22 nt, Homo sapiens
cuuggugaaucaaaacugagag

SEQ ID NO: 7274 - RNA, 22 nt, Homo sapiens
cauaccauagauaccuguucuu

SEQ ID NO: 7275 - RNA, 22 nt, Homo sapiens
gagcaaguaucugugauuuggg

SEQ ID NO: 7276 - RNA, 22 nt, Homo sapiens
ugguuuguuuuccugcuuugaa

SEQ ID NO: 7277 - RNA, 22 nt, Homo sapiens
ucagagauggaaagcagaccac

SEQ ID NO: 7278 - RNA, 22 nt, Homo sapiens
agugacaaagauucuccuuguu

SEQ ID NO: 7279 - RNA, 20 nt, Homo sapiens
aaggaugaaucuuuguuacu

SEQ ID NO: 7280 - RNA, 22 nt, Homo sapiens
acuaccuuauacaaaauguagg

SEQ ID NO: 7281 - RNA, 21 nt, Homo sapiens
ugcauucuuguguaagguagu

SEQ ID NO: 7282 - RNA, 22 nt, Homo sapiens
uugucugcaggcagugaaguga

SEQ ID NO: 7283 - RNA, 22 nt, Homo sapiens
gcucaaggccugcauacaggaa

SEQ ID NO: 7284 - RNA, 22 nt, Homo sapiens
uugucugcaggaggugaaguga

SEQ ID NO: 7285 - RNA, 22 nt, Homo sapiens
gcucaaggccugcauacaggaa

SEQ ID NO: 7286 - RNA, 22 nt, Homo sapiens
gggcaggucuaggucugguuug

SEQ ID NO: 7287 - RNA, 19 nt, Homo sapiens
ugagugccuggacuugccc

SEQ ID NO: 7288 - RNA, 22 nt, Homo sapiens
gaaauuggcaagaagagcagag

SEQ ID NO: 7289 - RNA, 22 nt, Homo sapiens
uucucauucugggucucuuucc

SEQ ID NO: 7290 - RNA, 22 nt, Homo sapiens
aguuguaguuucggaugcguuc

SEQ ID NO: 7291 - RNA, 22 nt, Homo sapiens
ggcggucguggacuacaacucc

SEQ ID NO: 7292 - RNA, 22 nt, Homo sapiens
uuaguuuuagcucccuauucuc

SEQ ID NO: 7293 - RNA, 22 nt, Homo sapiens
ggagggggcuaauucuugggua

SEQ ID NO: 7294 - RNA, 22 nt, Homo sapiens
ugguccuaguuuguuauuguag

SEQ ID NO: 7295 - RNA, 22 nt, Homo sapiens
uuacaaugaaacuuuuggcugg

SEQ ID NO: 7296 - RNA, 22 nt, Homo sapiens
uagggaaagggaauaggcacug

SEQ ID NO: 7297 - RNA, 22 nt, Homo sapiens
guguuuugaauucuuuuucucu

SEQ ID NO: 7298 - RNA, 22 nt, Homo sapiens
uuuauugguugagaaucaguac

SEQ ID NO: 7299 - RNA, 22 nt, Homo sapiens
uacacaauucuuaacauaugua

SEQ ID NO: 7300 - RNA, 22 nt, Homo sapiens
aauuauucccaggcagagagcc

SEQ ID NO: 7301 - RNA, 22 nt, Homo sapiens
ucucugccuggggauaauuucu

SEQ ID NO: 7302 - RNA, 22 nt, Homo sapiens
uccaugugaacucacuuuucac

SEQ ID NO: 7303 - RNA, 22 nt, Homo sapiens
ugaaaaguggguucauagggaa

SEQ ID NO: 7304 - RNA, 22 nt, Homo sapiens
uuaaaaggaagaggcaucccag

SEQ ID NO: 7305 - RNA, 22 nt, Homo sapiens
uggagugccuuuuccuucuauu

SEQ ID NO: 7306 - RNA, 22 nt, Homo sapiens
gaugagcuaaugguaauaugaa

SEQ ID NO: 7307 - RNA, 22 nt, Homo sapiens
auauuacaaugagcucaucuuu

SEQ ID NO: 7308 - RNA, 22 nt, Homo sapiens
uauaauagacaugaucaaauaa

SEQ ID NO: 7309 - RNA, 22 nt, Homo sapiens
uauugaucacgucaauuauagc

SEQ ID NO: 7310 - RNA, 22 nt, Homo sapiens
uaccaggcgaauccuacugggu

SEQ ID NO: 7311 - RNA, 22 nt, Homo sapiens
uaugugggguauguuugguauc

SEQ ID NO: 7312 - RNA, 22 nt, Homo sapiens
uucucuguuucggccaugugug

SEQ ID NO: 7313 - RNA, 22 nt, Homo sapiens
cacauggccaaaacagagaaga

SEQ ID NO: 7314 - RNA, 22 nt, Homo sapiens
agggggaaaaaaucuccagcuu

SEQ ID NO: 7315 - RNA, 22 nt, Homo sapiens
ggaagagacuuuuuccuuuuug

SEQ ID NO: 7316 - RNA, 22 nt, Homo sapiens
ggaggagggcgcaaaguccuuu

SEQ ID NO: 7317 - RNA, 21 nt, Homo sapiens
agcgacauuguguuuucuucc

SEQ ID NO: 7318 - RNA, 22 nt, Homo sapiens
ugcagguaaaauacuuagcaca

SEQ ID NO: 7319 - RNA, 22 nt, Homo sapiens
uguuaagcauauuaccugcauu

SEQ ID NO: 7320 - RNA, 22 nt, Homo sapiens
acuguacucuuacagccaucug

SEQ ID NO: 7321 - RNA, 20 nt, Homo sapiens
gauuguguaaggguacaguu

SEQ ID NO: 7322 - RNA, 22 nt, Homo sapiens
acuguacucuuacagccaucug

SEQ ID NO: 7323 - RNA, 20 nt, Homo sapiens
gauuguguaaggguacaguu

SEQ ID NO: 7324 - RNA, 22 nt, Homo sapiens
acuguacucuuacagccaucug

SEQ ID NO: 7325 - RNA, 20 nt, Homo sapiens
gauuguguaaggguacaguu

SEQ ID NO: 7326 - RNA, 22 nt, Homo sapiens
ggauucauacagugauuucaug

SEQ ID NO: 7327 - RNA, 22 nt, Homo sapiens
ugaaacauugcacuguaugaau

SEQ ID NO: 7328 - RNA, 22 nt, Homo sapiens
ucauacauggaagcagaucuga

SEQ ID NO: 7329 - RNA, 22 nt, Homo sapiens
uuaggccuucuucccuguugcu

SEQ ID NO: 7330 - RNA, 22 nt, Homo sapiens
uacauggaagcagaucugagaa

SEQ ID NO: 7331 - RNA, 22 nt, Homo sapiens
uuaggccuucuucccuguugcu

SEQ ID NO: 7332 - RNA, 22 nt, Homo sapiens
aaacucuagaagauguggucug

SEQ ID NO: 7333 - RNA, 22 nt, Homo sapiens
gcuacuuuucaccuaggguuuc

SEQ ID NO: 7334 - RNA, 22 nt, Homo sapiens
ugguuuccuuugauaaaaaguu

SEQ ID NO: 7335 - RNA, 18 nt, Homo sapiens
cuuagucagaggaggcca

SEQ ID NO: 7336 - RNA, 22 nt, Homo sapiens
ugauagacacugguucuaggug

SEQ ID NO: 7337 - RNA, 22 nt, Homo sapiens
accuagaaccaugucugacgca

SEQ ID NO: 7338 - RNA, 22 nt, Homo sapiens
uggaggcuccaaggaauguuaa

SEQ ID NO: 7339 - RNA, 22 nt, Homo sapiens
uauucauuaaggggcuuucauu

SEQ ID NO: 7340 - RNA, 22 nt, Homo sapiens
cacuuguuuagauaauaggaac

SEQ ID NO: 7341 - RNA, 20 nt, Homo sapiens
uccacggucuaaauaggugu

SEQ ID NO: 7342 - RNA, 22 nt, Homo sapiens
acugucaucugagucucugcag

SEQ ID NO: 7343 - RNA, 22 nt, Homo sapiens
ugcaugaccuggaugacaacga

SEQ ID NO: 7344 - RNA, 22 nt, Homo sapiens
uccuugagggcauaauuaguca

SEQ ID NO: 7345 - RNA, 22 nt, Homo sapiens
cuaauuguacccccaagugaga

SEQ ID NO: 7346 - RNA, 22 nt, Homo sapiens
ucagggccugagcugggaggug

SEQ ID NO: 7347 - RNA, 22 nt, Homo sapiens
ccccagaaggcagguccugggg

SEQ ID NO: 7348 - RNA, 22 nt, Homo sapiens
aagcuuugguuaagugaaaaag

SEQ ID NO: 7349 - RNA, 22 nt, Homo sapiens
uaguuuucuaauuagggcuucc

SEQ ID NO: 7350 - RNA, 22 nt, Homo sapiens
uauaaaguaaaaugagacugau

SEQ ID NO: 7351 - RNA, 22 nt, Homo sapiens
aaaugucucuuuacuuugugau

SEQ ID NO: 7352 - RNA, 22 nt, Homo sapiens
gcaaugccuuaucuaugguucu

SEQ ID NO: 7353 - RNA, 22 nt, Homo sapiens
aggcaugaaaaagguauugcug

SEQ ID NO: 7354 - RNA, 22 nt, Homo sapiens
caaguguuuuucaugacccuca

SEQ ID NO: 7355 - RNA, 22 nt, Homo sapiens
aacugguaacagaagagcacuu

SEQ ID NO: 7356 - RNA, 22 nt, Homo sapiens
uagcauuugccaaccaguggca

SEQ ID NO: 7357 - RNA, 22 nt, Homo sapiens
cacugguugguaaauacuauga

SEQ ID NO: 7358 - RNA, 22 nt, Homo sapiens
cacccacagggugaacaggaaa

SEQ ID NO: 7359 - RNA, 22 nt, Homo sapiens
uccugcucacccuguggguauc

SEQ ID NO: 7360 - RNA, 22 nt, Homo sapiens
agauuccugggucccaccccca

SEQ ID NO: 7361 - RNA, 22 nt, Homo sapiens
ugaguaggaccuaagggucugc

SEQ ID NO: 7362 - RNA, 20 nt, Homo sapiens
aucgugcaucccuuuagagu

SEQ ID NO: 7363 - RNA, 22 nt, Homo sapiens
aucgugcaucccuuuagagugu

SEQ ID NO: 7364 - RNA, 23 nt, Homo sapiens
aucgugcaucccuuuagaguguu

SEQ ID NO: 7365 - RNA, 22 nt, Homo sapiens
ccucuagauggaagcacugucu

SEQ ID NO: 7366 - RNA, 22 nt, Homo sapiens
ucgugcaucccuuuagaguguu

SEQ ID NO: 7367 - RNA, 22 nt, Homo sapiens
uuuauugguccauuaauauagg

SEQ ID NO: 7368 - RNA, 22 nt, Homo sapiens
uguauuaaugaaccaauaaaac

SEQ ID NO: 7369 - RNA, 22 nt, Homo sapiens
uuuuccuuagcuucucugcgag

SEQ ID NO: 7370 - RNA, 21 nt, Homo sapiens
cucagaaaagcuaaggagaaa

SEQ ID NO: 7371 - RNA, 22 nt, Homo sapiens
uccuguaugcaggccuugagcg

SEQ ID NO: 7372 - RNA, 22 nt, Homo sapiens
cacuucacugccugcagacaag

SEQ ID NO: 7373 - RNA, 22 nt, Homo sapiens
aaaggucucaaaggauucacac

SEQ ID NO: 7374 - RNA, 22 nt, Homo sapiens
ugugaaucuucugaaaccuuuu

SEQ ID NO: 7375 - RNA, 22 nt, Homo sapiens
aaaugcggccuaugaauagagc

SEQ ID NO: 7376 - RNA, 22 nt, Homo sapiens
uccauucgugggcugcauuuuc

SEQ ID NO: 7377 - RNA, 22 nt, Homo sapiens
ugucugucuguccacacucacc

SEQ ID NO: 7378 - RNA, 20 nt, Homo sapiens
gggggauggauagacagaca

SEQ ID NO: 7379 - RNA, 22 nt, Homo sapiens
cccuuuccugcagcucuugucu

SEQ ID NO: 7380 - RNA, 22 nt, Homo sapiens
caagaaauccaggaaagggcug

SEQ ID NO: 7381 - RNA, 22 nt, Homo sapiens
uaaacuggcagagugcaaacaa

SEQ ID NO: 7382 - RNA, 22 nt, Homo sapiens
uguuugcacuggcuguuuaaac

SEQ ID NO: 7383 - RNA, 22 nt, Homo sapiens
ugacugacaagccuuucgcuga

SEQ ID NO: 7384 - RNA, 22 nt, Homo sapiens
aaugguuuaaacuuguuaguca

SEQ ID NO: 7385 - RNA, 22 nt, Homo sapiens
cuguucuccauuacuuggcucg

SEQ ID NO: 7386 - RNA, 22 nt, Homo sapiens
uucaaguaauucaggauagguu

SEQ ID NO: 7387 - RNA, 22 nt, Homo sapiens
uaguuuccucccgcgugggugc

SEQ ID NO: 7388 - RNA, 22 nt, Homo sapiens
uggacucacagaggaagcugga

SEQ ID NO: 7389 - RNA, 22 nt, Homo sapiens
uucuuugaggcaaauauugacc

SEQ ID NO: 7390 - RNA, 22 nt, Homo sapiens
ucaauauuuaccucucagguca

SEQ ID NO: 7391 - RNA, 22 nt, Homo sapiens
uuuuuacaggaguuuauuaugu

SEQ ID NO: 7392 - RNA, 22 nt, Homo sapiens
auaacaaacaccuguaaaacag

SEQ ID NO: 7393 - RNA, 22 nt, Homo sapiens
aaaauguagauuucugugcucc

SEQ ID NO: 7394 - RNA, 21 nt, Homo sapiens
gacguacgaaucugcauuuuu

SEQ ID NO: 7395 - RNA, 22 nt, Homo sapiens
gggguucagaucuccuacuuga

SEQ ID NO: 7396 - RNA, 20 nt, Homo sapiens
gccucugagaucugagcccc

SEQ ID NO: 7397 - RNA, 22 nt, Homo sapiens
ucaggauuuuuuaguucugagu

SEQ ID NO: 7398 - RNA, 22 nt, Homo sapiens
aucacacuagaaaauccuggau

SEQ ID NO: 7399 - RNA, 22 nt, Homo sapiens
ugaugcucaguuguguguagau

SEQ ID NO: 7400 - RNA, 22 nt, Homo sapiens
uacacacaacugaggaucauag

SEQ ID NO: 7401 - RNA, 22 nt, Homo sapiens
ugaucccuaaugugcacaggaa

SEQ ID NO: 7402 - RNA, 22 nt, Homo sapiens
uccuaugcacauuagcaaucgc

SEQ ID NO: 7403 - RNA, 22 nt, Homo sapiens
uuucagguaaacaaugauugag

SEQ ID NO: 7404 - RNA, 22 nt, Homo sapiens
uagucaaaauuuaucuugaaag

SEQ ID NO: 7405 - RNA, 22 nt, Homo sapiens
caccccaaguguguugugaggc

SEQ ID NO: 7406 - RNA, 22 nt, Homo sapiens
cuucuaaaccucuaggggugug

SEQ ID NO: 7407 - RNA, 22 nt, Homo sapiens
uuuucaggagaugugguuauac

SEQ ID NO: 7408 - RNA, 22 nt, Homo sapiens
uagccacaucuucugaaaauuc

SEQ ID NO: 7409 - RNA, 22 nt, Homo sapiens
uuggcuggcacagaaauuuauu

SEQ ID NO: 7410 - RNA, 22 nt, Homo sapiens
uaaacuaaugugucagccaaga

SEQ ID NO: 7411 - RNA, 22 nt, Homo sapiens
cccuuuccuggauuucuuguca

SEQ ID NO: 7412 - RNA, 22 nt, Homo sapiens
caagagcugcaggaaagggcug

SEQ ID NO: 7413 - RNA, 22 nt, Homo sapiens
uuugcugggcaccaccuugugu

SEQ ID NO: 7414 - RNA, 22 nt, Homo sapiens
agcacggguggucuggcaggga

SEQ ID NO: 7415 - RNA, 22 nt, Homo sapiens
uuaaggaggugcuuacucucaa

SEQ ID NO: 7416 - RNA, 22 nt, Homo sapiens
ugcauaugaaugccuccuuaaa

SEQ ID NO: 7417 - RNA, 22 nt, Homo sapiens
acuguacucuuauagccaucug

SEQ ID NO: 7418 - RNA, 19 nt, Homo sapiens
gauuguguaaggguacagu

SEQ ID NO: 7419 - RNA, 22 nt, Homo sapiens
cccauuggcauccuugccugga

SEQ ID NO: 7420 - RNA, 22 nt, Homo sapiens
aggguggggaguggaggugggg

SEQ ID NO: 7421 - RNA, 22 nt, Homo sapiens
ugcuguucucuuccuacaaugg

SEQ ID NO: 7422 - RNA, 22 nt, Homo sapiens
acuuguaggaagagaacugcaa

SEQ ID NO: 7423 - RNA, 22 nt, Homo sapiens
ucucuaucugaucucuuuugug

SEQ ID NO: 7424 - RNA, 22 nt, Homo sapiens
gcugggaguuggguagagagug

SEQ ID NO: 7425 - RNA, 22 nt, Homo sapiens
agccaauguauuauacauaauu

SEQ ID NO: 7426 - RNA, 22 nt, Homo sapiens
agugauauauaaugcauggucc

SEQ ID NO: 7427 - RNA, 22 nt, Homo sapiens
acagcugcaaguguugccuccu

SEQ ID NO: 7428 - RNA, 18 nt, Homo sapiens
guuugcauuugcagcugu

SEQ ID NO: 7429 - RNA, 22 nt, Homo sapiens
ggugagcaggcuucuacuguua

SEQ ID NO: 7430 - RNA, 17 nt, Homo sapiens
caggaggccugcucauc

SEQ ID NO: 7431 - RNA, 22 nt, Homo sapiens
ccggaagcccuuaccccaaaaa

SEQ ID NO: 7432 - RNA, 21 nt, Homo sapiens
cuuuuugcggucugggcuugc

SEQ ID NO: 7433 - RNA, 20 nt, Homo sapiens
aagcccuuaccccaaaaagc

SEQ ID NO: 7434 - RNA, 22 nt, Homo sapiens
aagcccuuaccccaaaaagcau

SEQ ID NO: 7435 - RNA, 22 nt, Homo sapiens
uuuauucccaagguucuguuuc

SEQ ID NO: 7436 - RNA, 22 nt, Homo sapiens
gcuagcuuuuugauugaauuac

SEQ ID NO: 7437 - RNA, 22 nt, Homo sapiens
cagccuacucauuuauuuuugg

SEQ ID NO: 7438 - RNA, 21 nt, Homo sapiens
gugaauacaaugagugggcug

SEQ ID NO: 7439 - RNA, 22 nt, Homo sapiens
uugauagucauggaacauuaug

SEQ ID NO: 7440 - RNA, 22 nt, Homo sapiens
auggaguccauuggcugucagg

SEQ ID NO: 7441 - RNA, 22 nt, Homo sapiens
ucagguaacagcuaugucucuc

SEQ ID NO: 7442 - RNA, 22 nt, Homo sapiens
gagacagaacuguuuaccugau

SEQ ID NO: 7443 - RNA, 21 nt, Homo sapiens
aaagcgcuucccuuugcugga

SEQ ID NO: 7444 - RNA, 24 nt, Homo sapiens
aagcgcuucccuuugcuggauuac

SEQ ID NO: 7445 - RNA, 21 nt, Homo sapiens
cugcaaagggaagcccuuucu

SEQ ID NO: 7446 - RNA, 21 nt, Homo sapiens
gaaagcgcuucccuuugcugg

SEQ ID NO: 7447 - RNA, 22 nt, Homo sapiens
ucccuuuaugcaccaaguuccc

SEQ ID NO: 7448 - RNA, 21 nt, Homo sapiens
gccuauguguguaugaaggga

SEQ ID NO: 7449 - RNA, 22 nt, Homo sapiens
ugcgguaggugguuauuuuguu

SEQ ID NO: 7450 - RNA, 22 nt, Homo sapiens
caagaaacugcacacacgcaag

SEQ ID NO: 7451 - RNA, 22 nt, Homo sapiens
aggcagaagggauggugagggg

SEQ ID NO: 7452 - RNA, 22 nt, Homo sapiens
ugucagccccacuucugccugc

SEQ ID NO: 7453 - RNA, 22 nt, Homo sapiens
aauggggucuacauugcauucu

SEQ ID NO: 7454 - RNA, 17 nt, Homo sapiens
aaucuguagaccucauu

SEQ ID NO: 7455 - RNA, 22 nt, Homo sapiens
ugggaggggcagggauagaagc

SEQ ID NO: 7456 - RNA, 22 nt, Homo sapiens
cucuaauuccuucugcuccuuc

SEQ ID NO: 7457 - RNA, 22 nt, Homo sapiens
gagggagggggaacgguguucg

SEQ ID NO: 7458 - RNA, 22 nt, Homo sapiens
agucaucgaucuuccuuuuccu

SEQ ID NO: 7459 - RNA, 22 nt, Homo sapiens
ggggugaaaauaaagacugacu

SEQ ID NO: 7460 - RNA, 22 nt, Homo sapiens
gucacucuucauuuauucaucc

SEQ ID NO: 7461 - RNA, 22 nt, Homo sapiens
gcagaaaaauguugagguuuca

SEQ ID NO: 7462 - RNA, 22 nt, Homo sapiens
ugaaacaugacucuuuuuucug

SEQ ID NO: 7463 - RNA, 22 nt, Homo sapiens
aguugaugacaauauuguagau

SEQ ID NO: 7464 - RNA, 18 nt, Homo sapiens
uacagguugucaucaauu

SEQ ID NO: 7465 - RNA, 22 nt, Homo sapiens
ccucaccucucuggggcccuau

SEQ ID NO: 7466 - RNA, 22 nt, Homo sapiens
ggcaguuccuagaggagggggg

SEQ ID NO: 7467 - RNA, 22 nt, Homo sapiens
ugaauagcuggguggaguuaau

SEQ ID NO: 7468 - RNA, 22 nt, Homo sapiens
ccauuaaccucaguuggucacu

SEQ ID NO: 7469 - RNA, 22 nt, Homo sapiens
uaacuaauaguauguauuagua

SEQ ID NO: 7470 - RNA, 22 nt, Homo sapiens
ugcugauacuacugcuaguacu

SEQ ID NO: 7471 - RNA, 23 nt, Homo sapiens
aacauucaacgcugucggugagu

SEQ ID NO: 7472 - RNA, 22 nt, Homo sapiens
ccacugaccguugacuguaccu

SEQ ID NO: 7473 - RNA, 21 nt, Homo sapiens
accacugaccguugacuguac

SEQ ID NO: 7474 - RNA, 22 nt, Homo sapiens
accacugaccguugacuguacc

SEQ ID NO: 7475 - RNA, 22 nt, Homo sapiens
ugcuauuugcaaauauauuucu

SEQ ID NO: 7476 - RNA, 22 nt, Homo sapiens
guaauuuauaugcaaauagcag

SEQ ID NO: 7477 - RNA, 22 nt, Homo sapiens
ugggagaauaagguaguguggu

SEQ ID NO: 7478 - RNA, 22 nt, Homo sapiens
cacugaagccucaguuuucuca

SEQ ID NO: 7479 - RNA, 22 nt, Homo sapiens
uggaaaugguaaacauuuuaau

SEQ ID NO: 7480 - RNA, 22 nt, Homo sapiens
acuuaugcauuacuauuuccag

SEQ ID NO: 7481 - RNA, 22 nt, Homo sapiens
ggagagccccagccccuccggg

SEQ ID NO: 7482 - RNA, 22 nt, Homo sapiens
cagucugggggcgccggggcuu

SEQ ID NO: 7483 - RNA, 22 nt, Homo sapiens
uuuggggggcuacacggcccuu

SEQ ID NO: 7484 - RNA, 22 nt, Homo sapiens
gcauuugugauaggcucuccag

SEQ ID NO: 7485 - RNA, 22 nt, Homo sapiens
aauggucacuagggaaggggcg

SEQ ID NO: 7486 - RNA, 22 nt, Homo sapiens
ccucugacccuuuuggucgcua

SEQ ID NO: 7487 - RNA, 22 nt, Homo sapiens
aguggagagagccacagccagg

SEQ ID NO: 7488 - RNA, 17 nt, Homo sapiens
uucagguuuuuuccacu

SEQ ID NO: 7489 - RNA, 22 nt, Homo sapiens
cccccaccuggaauuugcacac

SEQ ID NO: 7490 - RNA, 22 nt, Homo sapiens
uguacauuuuucugggugggaa

SEQ ID NO: 7491 - RNA, 22 nt, Homo sapiens
uuuuagauaggccaguuuggac

SEQ ID NO: 7492 - RNA, 18 nt, Homo sapiens
aacaaggccugucuaaaa

SEQ ID NO: 7493 - RNA, 22 nt, Homo sapiens
uuaagcaauaaguuagauguca

SEQ ID NO: 7494 - RNA, 22 nt, Homo sapiens
ugaaggucaaagcuugcuuaau

SEQ ID NO: 7495 - RNA, 22 nt, Homo sapiens
gcagcuuuaauaaacagcucca

SEQ ID NO: 7496 - RNA, 22 nt, Homo sapiens
gugagcuggucuggggcugcug

SEQ ID NO: 7497 - RNA, 22 nt, Homo sapiens
ucucauauggaaauauugacag

SEQ ID NO: 7498 - RNA, 22 nt, Homo sapiens
ucaucauuuucauaugagaugu

SEQ ID NO: 7499 - RNA, 22 nt, Homo sapiens
ugacuggauguuuacucaaaua

SEQ ID NO: 7500 - RNA, 22 nt, Homo sapiens
uuugaauaaacauccggucacu

SEQ ID NO: 7501 - RNA, 22 nt, Homo sapiens
aaauuuucagggcuacugaaca

SEQ ID NO: 7502 - RNA, 22 nt, Homo sapiens
gcucaauggcccuaaaaauuuc

SEQ ID NO: 7503 - RNA, 22 nt, Homo sapiens
ugcuuggcaccuagcaagcacu

SEQ ID NO: 7504 - RNA, 22 nt, Homo sapiens
gugccugcuaugugccaggcau

SEQ ID NO: 7505 - RNA, 22 nt, Homo sapiens
uaauaccugcucuacagcuggg

SEQ ID NO: 7506 - RNA, 22 nt, Homo sapiens
cagcuguaggcagcuguuagua

SEQ ID NO: 7507 - RNA, 22 nt, Homo sapiens
uuuuaauugcaaucaugcccuc

SEQ ID NO: 7508 - RNA, 21 nt, Homo sapiens
ggaccauaauugcaauuaaaa

SEQ ID NO: 7509 - RNA, 22 nt, Homo sapiens
gggagguggugaugguacuggg

SEQ ID NO: 7510 - RNA, 22 nt, Homo sapiens
caguggccagcauggcucuccc

SEQ ID NO: 7511 - RNA, 22 nt, Homo sapiens
ccccucgcgacgauguagcaac

SEQ ID NO: 7512 - RNA, 22 nt, Homo sapiens
cgucgcaacgcuccgaggggcg

SEQ ID NO: 7513 - RNA, 22 nt, Homo sapiens
cagaugcucaauaaacauuugc

SEQ ID NO: 7514 - RNA, 22 nt, Homo sapiens
uaacguuuacugagcacuuacu

SEQ ID NO: 7515 - RNA, 22 nt, Homo sapiens
ggucggugcggacacggcggua

SEQ ID NO: 7516 - RNA, 22 nt, Homo sapiens
cgccccucccccaccggcccgg

SEQ ID NO: 7517 - RNA, 22 nt, Homo sapiens
uugguucaaaugacuugggcca

SEQ ID NO: 7518 - RNA, 22 nt, Homo sapiens
guccaaucauuuauggccaggg

SEQ ID NO: 7519 - RNA, 22 nt, Homo sapiens
cauggaccuuuuucugguccaa

SEQ ID NO: 7520 - RNA, 22 nt, Homo sapiens
gcaccagaaaaggguccacaug

SEQ ID NO: 7521 - RNA, 22 nt, Homo sapiens
aaagugcuguucgugcagguag

SEQ ID NO: 7522 - RNA, 22 nt, Homo sapiens
cugcugagcuagcacuucccga

SEQ ID NO: 7523 - RNA, 22 nt, Homo sapiens
uugaggggcuccccauuucuau

SEQ ID NO: 7524 - RNA, 20 nt, Homo sapiens
aaggcaugggagcccuucaa

SEQ ID NO: 7525 - RNA, 22 nt, Homo sapiens
uagggagaggagccggcugucc

SEQ ID NO: 7526 - RNA, 21 nt, Homo sapiens
cucagccucuuuucuucuuga

SEQ ID NO: 7527 - RNA, 22 nt, Homo sapiens
ccagggcagggaggcuuucugg

SEQ ID NO: 7528 - RNA, 22 nt, Homo sapiens
ccagaggcuccagucucuauuu

SEQ ID NO: 7529 - RNA, 22 nt, Homo sapiens
aguugccauagagccacuuccc

SEQ ID NO: 7530 - RNA, 15 nt, Homo sapiens
gucucuauggcaauu

SEQ ID NO: 7531 - RNA, 23 nt, Homo sapiens
ccuaguagguguccaguaagugu

SEQ ID NO: 7532 - RNA, 22 nt, Homo sapiens
uauugaggaccuccuaucaauc

SEQ ID NO: 7533 - RNA, 22 nt, Homo sapiens
ccccgggccaaucugucaaaga

SEQ ID NO: 7534 - RNA, 22 nt, Homo sapiens
uaugacauauuugccagcggcu

SEQ ID NO: 7535 - RNA, 22 nt, Homo sapiens
uucucuuccuaacgccagucug

SEQ ID NO: 7536 - RNA, 20 nt, Homo sapiens
ggcuggauuggggagaggga

SEQ ID NO: 7537 - RNA, 22 nt, Homo sapiens
ucccaggcccgggauuaggcac

SEQ ID NO: 7538 - RNA, 22 nt, Homo sapiens
gaccaugaucuggucugggaug

SEQ ID NO: 7539 - RNA, 22 nt, Homo sapiens
uuuauuuuucuaaggagaccag

SEQ ID NO: 7540 - RNA, 22 nt, Homo sapiens
guguuuucuuuugaaaaugagc

SEQ ID NO: 7541 - RNA, 22 nt, Homo sapiens
ucgcugucuuagaaucacaugu

SEQ ID NO: 7542 - RNA, 22 nt, Homo sapiens
uaugcgauucuaagagacugag

SEQ ID NO: 7543 - RNA, 22 nt, Homo sapiens
aaagugcuucccuuuggugaau

SEQ ID NO: 7544 - RNA, 21 nt, Homo sapiens
cugcaaagggaagcccuuucu

SEQ ID NO: 7545 - RNA, 22 nt, Homo sapiens
ucuacuucuaccuguguuauca

SEQ ID NO: 7546 - RNA, 22 nt, Homo sapiens
augauacagguggagguagaaa

SEQ ID NO: 7547 - RNA, 22 nt, Homo sapiens
uuaaaagcagcauuaacaaaug

SEQ ID NO: 7548 - RNA, 22 nt, Homo sapiens
uuugucaauguugcuuugagaa

SEQ ID NO: 7549 - RNA, 21 nt, Homo sapiens
aaagcgcuucccuuugcugga

SEQ ID NO: 7550 - RNA, 24 nt, Homo sapiens
aagcgcuucccuuugcuggauuac

SEQ ID NO: 7551 - RNA, 21 nt, Homo sapiens
cugcaaagggaagcccuuucu

SEQ ID NO: 7552 - RNA, 21 nt, Homo sapiens
gaaagcgcuucccuuugcugg

SEQ ID NO: 7553 - RNA, 20 nt, Homo sapiens
ucugcaaagggaagcccuuu

SEQ ID NO: 7554 - RNA, 22 nt, Homo sapiens
ucagagagcacagcauaucggg

SEQ ID NO: 7555 - RNA, 22 nt, Homo sapiens
ccagugugcugggcugucugac

SEQ ID NO: 7556 - RNA, 22 nt, Homo sapiens
gacaggccugagacaucugaga

SEQ ID NO: 7557 - RNA, 22 nt, Homo sapiens
ucucagcccuggggcuugucuc

SEQ ID NO: 7558 - RNA, 20 nt, Homo sapiens
aaagugcuucucuuuggugg

SEQ ID NO: 7559 - RNA, 21 nt, Homo sapiens
aaagugcuucucuuugguggg

SEQ ID NO: 7560 - RNA, 22 nt, Homo sapiens
aaagugcuucucuuuggugggu

SEQ ID NO: 7561 - RNA, 23 nt, Homo sapiens
aaagugcuucucuuugguggguu

SEQ ID NO: 7562 - RNA, 20 nt, Homo sapiens
cuacaaagggaagcccuuuc

SEQ ID NO: 7563 - RNA, 21 nt, Homo sapiens
cuacaaagggaagcccuuucu

SEQ ID NO: 7564 - RNA, 23 nt, Homo sapiens
ucuacaaagggaagcccuuucug

SEQ ID NO: 7565 - RNA, 22 nt, Homo sapiens
ucagcaguggucagcccaggag

SEQ ID NO: 7566 - RNA, 22 nt, Homo sapiens
uguauugaaaaugcugcugggg

SEQ ID NO: 7567 - RNA, 22 nt, Homo sapiens
uuccauuuuuccugacagucau

SEQ ID NO: 7568 - RNA, 20 nt, Homo sapiens
gagugggaggaaagauggga

SEQ ID NO: 7569 - RNA, 22 nt, Homo sapiens
cacaugcaugcuugaauaucug

SEQ ID NO: 7570 - RNA, 22 nt, Homo sapiens
gauaucuaugaauguaugugca

SEQ ID NO: 7571 - RNA, 22 nt, Homo sapiens
ugugauguuuauuuuaucccau

SEQ ID NO: 7572 - RNA, 22 nt, Homo sapiens
ugaggacuaaaugaaucauacu

SEQ ID NO: 7573 - RNA, 22 nt, Homo sapiens
uuccagguagacaggccugcag

SEQ ID NO: 7574 - RNA, 22 nt, Homo sapiens
caagccccucugucuggaauag

SEQ ID NO: 7575 - RNA, 22 nt, Homo sapiens
ucuacaaaggaaagcgcuuucu

SEQ ID NO: 7576 - RNA, 22 nt, Homo sapiens
aaaucgcuucccuuuggagugu

SEQ ID NO: 7577 - RNA, 22 nt, Homo sapiens
ugaugaauucaagguauucaca

SEQ ID NO: 7578 - RNA, 22 nt, Homo sapiens
ugaguaucuugaauucaucucu

SEQ ID NO: 7579 - RNA, 22 nt, Homo sapiens
uuucuagauggacuuucaaguc

SEQ ID NO: 7580 - RNA, 22 nt, Homo sapiens
uugagagcucguguagaaagcc

SEQ ID NO: 7581 - RNA, 22 nt, Homo sapiens
uaauaguaacuaccucacaggg

SEQ ID NO: 7582 - RNA, 22 nt, Homo sapiens
uacugucuuugggguuguuauu

SEQ ID NO: 7583 - RNA, 22 nt, Homo sapiens
gcugggucuuugcgggcgagau

SEQ ID NO: 7584 - RNA, 22 nt, Homo sapiens
cuggccuacaaagucccaguuc

SEQ ID NO: 7585 - RNA, 22 nt, Homo sapiens
cacaguggcccgguggccucac

SEQ ID NO: 7586 - RNA, 22 nt, Homo sapiens
gggcagggcgggguccugugcu

SEQ ID NO: 7587 - RNA, 22 nt, Homo sapiens
uuuaaagagucucuugucugcc

SEQ ID NO: 7588 - RNA, 22 nt, Homo sapiens
ggcagcuagagcucuuuaaagu

SEQ ID NO: 7589 - RNA, 22 nt, Homo sapiens
uuauuacuuagaagcauguaag

SEQ ID NO: 7590 - RNA, 22 nt, Homo sapiens
uacuccugcauuugguaaugau

SEQ ID NO: 7591 - RNA, 19 nt, Homo sapiens
cuccagagggaugcacuuu

SEQ ID NO: 7592 - RNA, 20 nt, Homo sapiens
cuccagagggaugcacuuuc

SEQ ID NO: 7593 - RNA, 21 nt, Homo sapiens
cuccagagggaugcacuuucu

SEQ ID NO: 7594 - RNA, 21 nt, Homo sapiens
gaaggcgcuucccuuuagagc

SEQ ID NO: 7595 - RNA, 22 nt, Homo sapiens
gccaucuauuuuuuucucagag

SEQ ID NO: 7596 - RNA, 22 nt, Homo sapiens
uuugaguaaguauagaugguuu

SEQ ID NO: 7597 - RNA, 22 nt, Homo sapiens
uaugugguuuugaaucggaugu

SEQ ID NO: 7598 - RNA, 22 nt, Homo sapiens
cuacuugagcuaaacuucugca

SEQ ID NO: 7599 - RNA, 22 nt, Homo sapiens
uaugugguuuugaaucggaugu

SEQ ID NO: 7600 - RNA, 22 nt, Homo sapiens
cuacuugagcuaaacuucugca

SEQ ID NO: 7601 - RNA, 22 nt, Homo sapiens
ccaggcugauguagacuggcag

SEQ ID NO: 7602 - RNA, 22 nt, Homo sapiens
gcugguaugcaggcagccugcc

SEQ ID NO: 7603 - RNA, 22 nt, Homo sapiens
uuauucuaugggagcugacuuu

SEQ ID NO: 7604 - RNA, 22 nt, Homo sapiens
auguagugggcucugaguaagc

SEQ ID NO: 7605 - RNA, 22 nt, Homo sapiens
cacaccaugauaaagaguuuug

SEQ ID NO: 7606 - RNA, 22 nt, Homo sapiens
caaugaacuuauugugguguuu

SEQ ID NO: 7607 - RNA, 22 nt, Homo sapiens
uaguuggccuuccuugaguggc

SEQ ID NO: 7608 - RNA, 22 nt, Homo sapiens
cugcucauuaggcuaauuagua

SEQ ID NO: 7609 - RNA, 22 nt, Homo sapiens
ugcuuacucaagucacacuccu

SEQ ID NO: 7610 - RNA, 22 nt, Homo sapiens
agugugguguaaguaagaucug

SEQ ID NO: 7611 - RNA, 22 nt, Homo sapiens
aggccuccaggugcugccacca

SEQ ID NO: 7612 - RNA, 22 nt, Homo sapiens
ugggagagugucuggaggccug

SEQ ID NO: 7613 - RNA, 22 nt, Homo sapiens
uaucuuuccuuugugugugaug

SEQ ID NO: 7614 - RNA, 21 nt, Homo sapiens
uccauguguagaggaaagaua

SEQ ID NO: 7615 - RNA, 22 nt, Homo sapiens
cagcagauucaugguguccggc

SEQ ID NO: 7616 - RNA, 21 nt, Homo sapiens
uaggcagcuggguuuguugcu

SEQ ID NO: 7617 - RNA, 22 nt, Homo sapiens
uuagaauucccuuauuccauuu

SEQ ID NO: 7618 - RNA, 22 nt, Homo sapiens
gaggacagggggcuuuuuaauu

SEQ ID NO: 7619 - RNA, 22 nt, Homo sapiens
uaguuuucagaauuggagccuc

SEQ ID NO: 7620 - RNA, 22 nt, Homo sapiens
uaguaagccuuuugggaacugu

SEQ ID NO: 7621 - RNA, 22 nt, Homo sapiens
uggguucuuuuuauaguuucaa

SEQ ID NO: 7622 - RNA, 22 nt, Homo sapiens
gauucugcaauuagaacucagc

SEQ ID NO: 7623 - RNA, 22 nt, Homo sapiens
gagauuuagcugcuuaacuccu

SEQ ID NO: 7624 - RNA, 20 nt, Homo sapiens
gagucauguggcuaaaucuc

SEQ ID NO: 7625 - RNA, 22 nt, Homo sapiens
ugccagaggcuguugccagagg

SEQ ID NO: 7626 - RNA, 19 nt, Homo sapiens
uccuuuuggccucuggcag

SEQ ID NO: 7627 - RNA, 22 nt, Homo sapiens
acccugguccccuggccucugu

SEQ ID NO: 7628 - RNA, 22 nt, Homo sapiens
aguggcaggagauggggguggg

SEQ ID NO: 7629 - RNA, 22 nt, Homo sapiens
agaaugcuuccuuugaaacuga

SEQ ID NO: 7630 - RNA, 22 nt, Homo sapiens
guuucagcccaaaggugagcau

SEQ ID NO: 7631 - RNA, 22 nt, Homo sapiens
gccccuuccccuccugaagggc

SEQ ID NO: 7632 - RNA, 19 nt, Homo sapiens
ugcaggugggggagggggc

SEQ ID NO: 7633 - RNA, 22 nt, Homo sapiens
gggagcccggaccgaaagcuca

SEQ ID NO: 7634 - RNA, 22 nt, Homo sapiens
gcgcuugggccccggcguuccc

SEQ ID NO: 7635 - RNA, 22 nt, Homo sapiens
cacucauugucugugccugaca

SEQ ID NO: 7636 - RNA, 22 nt, Homo sapiens
ucaggcacaguugaugaguguu

SEQ ID NO: 7637 - RNA, 22 nt, Homo sapiens
ugcugggccuugggugcacuca

SEQ ID NO: 7638 - RNA, 22 nt, Homo sapiens
ugaugcucacaggugcccggca

SEQ ID NO: 7639 - RNA, 22 nt, Homo sapiens
gacagucuggcuggcuuuguca

SEQ ID NO: 7640 - RNA, 22 nt, Homo sapiens
cagugcucaguucagacugucc

SEQ ID NO: 7641 - RNA, 22 nt, Homo sapiens
uugauaguuucccucuuguugc

SEQ ID NO: 7642 - RNA, 22 nt, Homo sapiens
acaggagguaagagagucaauc

SEQ ID NO: 7643 - RNA, 22 nt, Homo sapiens
ugcauuuugcuaacagccuguc

SEQ ID NO: 7644 - RNA, 22 nt, Homo sapiens
acuagggaguuagggaaagugc

SEQ ID NO: 7645 - RNA, 22 nt, Homo sapiens
uucccucucggugggagucaag

SEQ ID NO: 7646 - RNA, 22 nt, Homo sapiens
ugaaucccgagacggggggaug

SEQ ID NO: 7647 - RNA, 22 nt, Homo sapiens
cccuuucuaaacaaaaggacuc

SEQ ID NO: 7648 - RNA, 22 nt, Homo sapiens
gucuuuguguuuugaggagggg

SEQ ID NO: 7649 - RNA, 22 nt, Homo sapiens
aagaugacaaugcuaaugauga

SEQ ID NO: 7650 - RNA, 22 nt, Homo sapiens
auuagauaaagcagauugucau

SEQ ID NO: 7651 - RNA, 22 nt, Homo sapiens
ugguuucugacuaccgcuuagg

SEQ ID NO: 7652 - RNA, 22 nt, Homo sapiens
uagcggaauguccuggaaacua

SEQ ID NO: 7653 - RNA, 22 nt, Homo sapiens
aucuccccaccugcucccucag

SEQ ID NO: 7654 - RNA, 22 nt, Homo sapiens
gcagggaggaggcggguggagg

SEQ ID NO: 7655 - RNA, 22 nt, Homo sapiens
aaugcagcccacgaauggagua

SEQ ID NO: 7656 - RNA, 22 nt, Homo sapiens
ucuauucauaggccgcauuuuu

SEQ ID NO: 7657 - RNA, 22 nt, Homo sapiens
uuuaaauggccacucuggcuuc

SEQ ID NO: 7658 - RNA, 20 nt, Homo sapiens
gucagggaggccauuuagga

SEQ ID NO: 7659 - RNA, 22 nt, Homo sapiens
uuuugucuucuacacuuaaaaa

SEQ ID NO: 7660 - RNA, 22 nt, Homo sapiens
uucgguguuagaagaugaaauu

SEQ ID NO: 7661 - RNA, 22 nt, Homo sapiens
uuaggagaagaacaagccuucu

SEQ ID NO: 7662 - RNA, 22 nt, Homo sapiens
aagaaaauguucucuucuagau

SEQ ID NO: 7663 - RNA, 22 nt, Homo sapiens
ucaggaugggcagccaaacuag

SEQ ID NO: 7664 - RNA, 22 nt, Homo sapiens
ugguuuggcugacuuagccuga

SEQ ID NO: 7665 - RNA, 22 nt, Homo sapiens
ucauguguuucuuacauaauug

SEQ ID NO: 7666 - RNA, 22 nt, Homo sapiens
acaauguaagagacaugugaaa

SEQ ID NO: 7667 - RNA, 22 nt, Homo sapiens
uauggacaggaaaguaacauua

SEQ ID NO: 7668 - RNA, 22 nt, Homo sapiens
uguugcuuucuuuucuauacag

SEQ ID NO: 7669 - RNA, 22 nt, Homo sapiens
agcagggagcacugaggguggc

SEQ ID NO: 7670 - RNA, 22 nt, Homo sapiens
cacacguccagggcugucugca

SEQ ID NO: 7671 - RNA, 22 nt, Homo sapiens
uuuagccaguagcuuuucuauu

SEQ ID NO: 7672 - RNA, 22 nt, Homo sapiens
uagaaaagcuaguugcuaaaaa

SEQ ID NO: 7673 - RNA, 22 nt, Homo sapiens
ucacugcgcugacugcuacgau

SEQ ID NO: 7674 - RNA, 20 nt, Homo sapiens
ugcacaggcaguguaguggc

SEQ ID NO: 7675 - RNA, 22 nt, Homo sapiens
uuuccccaaggugugguguggu

SEQ ID NO: 7676 - RNA, 22 nt, Homo sapiens
cacgcugcagccuggggaaggc

SEQ ID NO: 7677 - RNA, 22 nt, Homo sapiens
aagaagaauuggccuacucagg

SEQ ID NO: 7678 - RNA, 22 nt, Homo sapiens
ugaauaggucaauuccccucac

SEQ ID NO: 7679 - RNA, 22 nt, Homo sapiens
cguggcuggaggaccucguguc

SEQ ID NO: 7680 - RNA, 22 nt, Homo sapiens
acggccgacugccagccauggg

SEQ ID NO: 7681 - RNA, 22 nt, Homo sapiens
uucucuuauagacuaugugaga

SEQ ID NO: 7682 - RNA, 22 nt, Homo sapiens
ucacauaggucuauaagaagac

SEQ ID NO: 7683 - RNA, 22 nt, Homo sapiens
uaaaucacagaagguugcauua

SEQ ID NO: 7684 - RNA, 22 nt, Homo sapiens
auaagugcaauuauggauuugu

SEQ ID NO: 7685 - RNA, 22 nt, Homo sapiens
agcugauugggaauggaagcag

SEQ ID NO: 7686 - RNA, 22 nt, Homo sapiens
cuuugauuucuaaugugccuuc

SEQ ID NO: 7687 - RNA, 22 nt, Homo sapiens
ggcuuuugugguauuaaacacc

SEQ ID NO: 7688 - RNA, 22 nt, Homo sapiens
gcauuuagcaaaccacaaaagc

SEQ ID NO: 7689 - RNA, 22 nt, Homo sapiens
gcagccuugacuagugacuuag

SEQ ID NO: 7690 - RNA, 22 nt, Homo sapiens
ugaguggcuggugagguuagcc

SEQ ID NO: 7691 - RNA, 22 nt, Homo sapiens
uacauggaagcaguucugagaa

SEQ ID NO: 7692 - RNA, 22 nt, Homo sapiens
uuaggccuucuucccuguugcu

SEQ ID NO: 7693 - RNA, 22 nt, Homo sapiens
uccuguuccuuaaaaucucugg

SEQ ID NO: 7694 - RNA, 22 nt, Homo sapiens
uccuggggacaagggacaggac

SEQ ID NO: 7695 - RNA, 22 nt, Homo sapiens
ucaucggagaaacucccugcga

SEQ ID NO: 7696 - RNA, 22 nt, Homo sapiens
ggacagggaacuuuuugaugag

SEQ ID NO: 7697 - RNA, 22 nt, Homo sapiens
uuugacagcauuuuaauuauag

SEQ ID NO: 7698 - RNA, 22 nt, Homo sapiens
uaauagugaaaaugcugucagc

SEQ ID NO: 7699 - RNA, 22 nt, Homo sapiens
ucaagugaaaauuaauggcaaa

SEQ ID NO: 7700 - RNA, 22 nt, Homo sapiens
agccauugucguucauuugaaa

SEQ ID NO: 7701 - RNA, 22 nt, Homo sapiens
cugaaacaaauuaaagccucuu

SEQ ID NO: 7702 - RNA, 22 nt, Homo sapiens
aggcuuuccuuuguguuauugu

SEQ ID NO: 7703 - RNA, 22 nt, Homo sapiens
uuccagacagaggggcuuguag

SEQ ID NO: 7704 - RNA, 22 nt, Homo sapiens
caggccugucuaccuggaauag

SEQ ID NO: 7705 - RNA, 22 nt, Homo sapiens
uuccagacagaggggcuuguag

SEQ ID NO: 7706 - RNA, 22 nt, Homo sapiens
caggccugucuaccuggaauag

SEQ ID NO: 7707 - RNA, 22 nt, Homo sapiens
ccaggacucuagacauucagga

SEQ ID NO: 7708 - RNA, 16 nt, Homo sapiens
ugaacugggguccugg

SEQ ID NO: 7709 - RNA, 22 nt, Homo sapiens
gggacuggugaauugcaagugu

SEQ ID NO: 7710 - RNA, 22 nt, Homo sapiens
ugguuucuuaguuuugcugucu

SEQ ID NO: 7711 - RNA, 22 nt, Homo sapiens
uaguccaugagcaagauggauu

SEQ ID NO: 7712 - RNA, 22 nt, Homo sapiens
ucagcuuguccauggacugugu

SEQ ID NO: 7713 - RNA, 22 nt, Homo sapiens
uggggggugagcagccccucgg

SEQ ID NO: 7714 - RNA, 22 nt, Homo sapiens
cugagguuugacugccccccac

SEQ ID NO: 7715 - RNA, 22 nt, Homo sapiens
cacaugguagguauugaguaug

SEQ ID NO: 7716 - RNA, 22 nt, Homo sapiens
uacuuuagauaaauuaugugca

SEQ ID NO: 7717 - RNA, 22 nt, Homo sapiens
uagggaggaagcuuguuuugcu

SEQ ID NO: 7718 - RNA, 22 nt, Homo sapiens
caaaaccuuguccuuccugccc

SEQ ID NO: 7719 - RNA, 22 nt, Homo sapiens
uguaaauaucauuguacugggc

SEQ ID NO: 7720 - RNA, 22 nt, Homo sapiens
ugaacagcacaguggcuuacgu

SEQ ID NO: 7721 - RNA, 22 nt, Homo sapiens
cagccuuauuaguccugccuga

SEQ ID NO: 7722 - RNA, 22 nt, Homo sapiens
auuggcugaugaggaagguugg

SEQ ID NO: 7723 - RNA, 22 nt, Homo sapiens
ucaggauguggucaaguguugu

SEQ ID NO: 7724 - RNA, 22 nt, Homo sapiens
caauacuugaccacauuuugaa

SEQ ID NO: 7725 - RNA, 22 nt, Homo sapiens
ugacuaggacagaaccuaggaa

SEQ ID NO: 7726 - RNA, 22 nt, Homo sapiens
cuagguucuguucuaaucacug

SEQ ID NO: 7727 - RNA, 22 nt, Homo sapiens
uauagacuacuuuucuuucuac

SEQ ID NO: 7728 - RNA, 22 nt, Homo sapiens
aaagaaagguagccuaugguug

SEQ ID NO: 7729 - RNA, 22 nt, Homo sapiens
ugggcagaguucuacuuaacac

SEQ ID NO: 7730 - RNA, 22 nt, Homo sapiens
uuaaguagaacccugcccauca

SEQ ID NO: 7731 - RNA, 22 nt, Homo sapiens
ugaacugagauacagaguuauu

SEQ ID NO: 7732 - RNA, 22 nt, Homo sapiens
uagcuuuguaccucaguucccu

SEQ ID NO: 7733 - RNA, 22 nt, Homo sapiens
gacugggaaccgcuauccugug

SEQ ID NO: 7734 - RNA, 22 nt, Homo sapiens
cggaauagcaguucccaaucug

SEQ ID NO: 7735 - RNA, 22 nt, Homo sapiens
uccaacaauauccuggugcuga

SEQ ID NO: 7736 - RNA, 23 nt, Homo sapiens
uccagcaucagugauuuuguuga

SEQ ID NO: 7737 - RNA, 21 nt, Homo sapiens
aacaauauccuggugcugagu

SEQ ID NO: 7738 - RNA, 22 nt, Homo sapiens
gguccucaauaaguauuuguug

SEQ ID NO: 7739 - RNA, 22 nt, Homo sapiens
acaagucuuauuugagcaccug

SEQ ID NO: 7740 - RNA, 22 nt, Homo sapiens
cgggugugugcccggccccagg

SEQ ID NO: 7741 - RNA, 22 nt, Homo sapiens
ccccagugcagggccuggcacg

SEQ ID NO: 7742 - RNA, 22 nt, Homo sapiens
ugcuugccuagguuacagugaa

SEQ ID NO: 7743 - RNA, 22 nt, Homo sapiens
acugugcucucuagauaggcau

SEQ ID NO: 7744 - RNA, 22 nt, Homo sapiens
ggccugggccaccacaggggaa

SEQ ID NO: 7745 - RNA, 22 nt, Homo sapiens
cacagaccugggugcccgggcc

SEQ ID NO: 7746 - RNA, 22 nt, Homo sapiens
aaagacagaugauuucuuggag

SEQ ID NO: 7747 - RNA, 22 nt, Homo sapiens
ucuagguuuuuuuuuuuuuugg

SEQ ID NO: 7748 - RNA, 22 nt, Homo sapiens
ucccugccccuccuccuuggcu

SEQ ID NO: 7749 - RNA, 22 nt, Homo sapiens
ccucagagcaguggagggcagg

SEQ ID NO: 7750 - RNA, 22 nt, Homo sapiens
uuccucauccuccugaggccug

SEQ ID NO: 7751 - RNA, 19 nt, Homo sapiens
ccaaacagaggaugaggag

SEQ ID NO: 7752 - RNA, 22 nt, Homo sapiens
uaaaugccucccaaugauugcu

SEQ ID NO: 7753 - RNA, 22 nt, Homo sapiens
aaugguuggggacauuuggcaa

SEQ ID NO: 7754 - RNA, 22 nt, Homo sapiens
uggccauuuccuccccuccaga

SEQ ID NO: 7755 - RNA, 22 nt, Homo sapiens
ucgaggaggaagagugucccag

SEQ ID NO: 7756 - RNA, 22 nt, Homo sapiens
uaauuauccagguaauuuaggg

SEQ ID NO: 7757 - RNA, 22 nt, Homo sapiens
ugaauuauucagauaauuaccu

SEQ ID NO: 7758 - RNA, 22 nt, Homo sapiens
uaugcaacagggaaggcuaugu

SEQ ID NO: 7759 - RNA, 22 nt, Homo sapiens
aaagccuuccccuuugcauaug

SEQ ID NO: 7760 - RNA, 22 nt, Homo sapiens
uaugcaacagggaaggcuaugu

SEQ ID NO: 7761 - RNA, 22 nt, Homo sapiens
aaagccuuccccuuugcauaug

SEQ ID NO: 7762 - RNA, 22 nt, Homo sapiens
ucagaggccaucuggggagcag

SEQ ID NO: 7763 - RNA, 22 nt, Homo sapiens
cagggcccccuccaggcugccu

SEQ ID NO: 7764 - RNA, 22 nt, Homo sapiens
gggauuuggcagcauggcccca

SEQ ID NO: 7765 - RNA, 21 nt, Homo sapiens
ggaguuagucugcuaaauccc

SEQ ID NO: 7766 - RNA, 22 nt, Homo sapiens
ugguauaggggcaggcucaugg

SEQ ID NO: 7767 - RNA, 21 nt, Homo sapiens
cauuggccaccccugugccgc

SEQ ID NO: 7768 - RNA, 22 nt, Homo sapiens
acuucaccaacacuggcucccu

SEQ ID NO: 7769 - RNA, 22 nt, Homo sapiens
gggcccgugugagugaaguguu

SEQ ID NO: 7770 - RNA, 22 nt, Homo sapiens
uuucagcuuuuccuaaaaggau

SEQ ID NO: 7771 - RNA, 22 nt, Homo sapiens
ugcuuaaggaagagugaugaag

SEQ ID NO: 7772 - RNA, 22 nt, Homo sapiens
gaggaggcagaaaugguagcug

SEQ ID NO: 7773 - RNA, 22 nt, Homo sapiens
gcuauaaccauuuuucugcccu

SEQ ID NO: 7774 - RNA, 22 nt, Homo sapiens
ugcugauuacacagaagaacau

SEQ ID NO: 7775 - RNA, 20 nt, Homo sapiens
aauaucuuuguaaucagcag

SEQ ID NO: 7776 - RNA, 22 nt, Homo sapiens
aggccucagugucauggacucu

SEQ ID NO: 7777 - RNA, 22 nt, Homo sapiens
agguuaugaccagcugaggccu

SEQ ID NO: 7778 - RNA, 22 nt, Homo sapiens
uugcauugugguugcagucaau

SEQ ID NO: 7779 - RNA, 22 nt, Homo sapiens
ugauugcagcugcauggcuauu

SEQ ID NO: 7780 - RNA, 22 nt, Homo sapiens
acaugcccuggaacuaggaaca

SEQ ID NO: 7781 - RNA, 22 nt, Homo sapiens
uuguuuucuuagucuguguguu

SEQ ID NO: 7782 - RNA, 22 nt, Homo sapiens
agcugagaaauucuagcucugc

SEQ ID NO: 7783 - RNA, 22 nt, Homo sapiens
cagagcuaggauugcuuuuuuu

SEQ ID NO: 7784 - RNA, 22 nt, Homo sapiens
acuguacucuucuagccaucug

SEQ ID NO: 7785 - RNA, 20 nt, Homo sapiens
gauuguguaaggguacaguu

SEQ ID NO: 7786 - RNA, 22 nt, Homo sapiens
acuguacucuucuagccaucug

SEQ ID NO: 7787 - RNA, 20 nt, Homo sapiens
gauuguguaaggguacaguu

SEQ ID NO: 7788 - RNA, 22 nt, Homo sapiens
acuguacucuucuagccaucug

SEQ ID NO: 7789 - RNA, 20 nt, Homo sapiens
gauuguguaaggguacaguu

SEQ ID NO: 7790 - RNA, 22 nt, Homo sapiens
acuguacucuucuagccaucug

SEQ ID NO: 7791 - RNA, 20 nt, Homo sapiens
gauuguguaaggguacaguu

SEQ ID NO: 7792 - RNA, 22 nt, Homo sapiens
ugcuugugggaucucccuguug

SEQ ID NO: 7793 - RNA, 22 nt, Homo sapiens
guggcgggccauccuacaagua

SEQ ID NO: 7794 - RNA, 22 nt, Homo sapiens
aagacuucagccuuagaugaua

SEQ ID NO: 7795 - RNA, 21 nt, Homo sapiens
gagcuaucugcuggaguuuuu

SEQ ID NO: 7796 - RNA, 22 nt, Homo sapiens
ucuccagcuuggugcuggcucu

SEQ ID NO: 7797 - RNA, 22 nt, Homo sapiens
agccacgcccucuuggagaucg

SEQ ID NO: 7798 - RNA, 22 nt, Homo sapiens
ugggcaggguucuacuuaacaa

SEQ ID NO: 7799 - RNA, 22 nt, Homo sapiens
uuaaguagaacucugcccauga

SEQ ID NO: 7800 - RNA, 22 nt, Homo sapiens
ucuggccuggggccugcucccu

SEQ ID NO: 7801 - RNA, 20 nt, Homo sapiens
gaguagggcccaggcuaggg

SEQ ID NO: 7802 - RNA, 22 nt, Homo sapiens
ucuggccuggggccugcucccu

SEQ ID NO: 7803 - RNA, 20 nt, Homo sapiens
gaguagggcccaggcuaggg

SEQ ID NO: 7804 - RNA, 22 nt, Homo sapiens
ucuggccuggggccugcucccu

SEQ ID NO: 7805 - RNA, 20 nt, Homo sapiens
gaguagggcccaggcuaggg

SEQ ID NO: 7806 - RNA, 22 nt, Homo sapiens
caggaaggaggugguucacauu

SEQ ID NO: 7807 - RNA, 18 nt, Homo sapiens
uggaugaccuccuuccug

SEQ ID NO: 7808 - RNA, 22 nt, Homo sapiens
cagugcucuguucauucccaca

SEQ ID NO: 7809 - RNA, 22 nt, Homo sapiens
ucagggaauguuagaggauugg

SEQ ID NO: 7810 - RNA, 22 nt, Homo sapiens
gcuaauucauuucgaaagcacc

SEQ ID NO: 7811 - RNA, 22 nt, Homo sapiens
cuuuugaaaugauuuagacuca

SEQ ID NO: 7812 - RNA, 22 nt, Homo sapiens
cagcaggauggccaauugccau

SEQ ID NO: 7813 - RNA, 22 nt, Homo sapiens
uggcaucuuggcaucuugcugc

SEQ ID NO: 7814 - RNA, 22 nt, Homo sapiens
gguuuuugucucaagcagacau

SEQ ID NO: 7815 - RNA, 22 nt, Homo sapiens
uguuggcuagaugagaaaggcu

SEQ ID NO: 7816 - RNA, 22 nt, Homo sapiens
augagauuggggugagggguaa

SEQ ID NO: 7817 - RNA, 22 nt, Homo sapiens
uucuuuacuauguuucaaagcu

SEQ ID NO: 7818 - RNA, 22 nt, Homo sapiens
gauucuuuuuucgcuuuuacca

SEQ ID NO: 7819 - RNA, 19 nt, Homo sapiens
aagaaaagaaaaagggauc

SEQ ID NO: 7820 - RNA, 22 nt, Homo sapiens
cauuuaucaucagaccuuuuaa

SEQ ID NO: 7821 - RNA, 22 nt, Homo sapiens
uaaaacggacauggugauagau

SEQ ID NO: 7822 - RNA, 22 nt, Homo sapiens
gguaguuaucuugagguaggug

SEQ ID NO: 7823 - RNA, 21 nt, Homo sapiens
agauaaauaaagaugauuacc

SEQ ID NO: 7824 - RNA, 22 nt, Homo sapiens
ugcuuucaguuucuuuugaaaa

SEQ ID NO: 7825 - RNA, 22 nt, Homo sapiens
uucuauggaaacuaaaagccua

SEQ ID NO: 7826 - RNA, 22 nt, Homo sapiens
gagggguaggcaggagccaggc

SEQ ID NO: 7827 - RNA, 22 nt, Homo sapiens
ucugguaaccuuuaucccuccu

SEQ ID NO: 7828 - RNA, 22 nt, Homo sapiens
aagaugcuggcuggguuuggaa

SEQ ID NO: 7829 - RNA, 22 nt, Homo sapiens
caggacccaauagguagagaga

SEQ ID NO: 7830 - RNA, 22 nt, Homo sapiens
ucucuuugaaggucggcugcca

SEQ ID NO: 7831 - RNA, 20 nt, Homo sapiens
cagcuggacuucaaaggggg

SEQ ID NO: 7832 - RNA, 22 nt, Homo sapiens
ugagucuguguguggguuucua

SEQ ID NO: 7833 - RNA, 22 nt, Homo sapiens
uugcagugaucccacacaguua

SEQ ID NO: 7834 - RNA, 22 nt, Homo sapiens
uuccagguagacaggccugcag

SEQ ID NO: 7835 - RNA, 22 nt, Homo sapiens
caagccccucugucuggaauag

SEQ ID NO: 7836 - RNA, 22 nt, Homo sapiens
uggcuccuuaagguuuguacuc

SEQ ID NO: 7837 - RNA, 22 nt, Homo sapiens
guugcaauaauacuuaaggagu

SEQ ID NO: 7838 - RNA, 22 nt, Homo sapiens
uguuggaaaaacagacaaaugu

SEQ ID NO: 7839 - RNA, 22 nt, Homo sapiens
uauuugucuguuuuucucauac

SEQ ID NO: 7840 - RNA, 22 nt, Homo sapiens
ugauaaauauuuuggcugacug

SEQ ID NO: 7841 - RNA, 22 nt, Homo sapiens
auuuagccaacauauuuguuaa

SEQ ID NO: 7842 - RNA, 22 nt, Homo sapiens
uucugguuccucugccuuugug

SEQ ID NO: 7843 - RNA, 22 nt, Homo sapiens
aauguucagguagggagccgga

SEQ ID NO: 7844 - RNA, 22 nt, Homo sapiens
cacauaagcauguuuuauuugc

SEQ ID NO: 7845 - RNA, 22 nt, Homo sapiens
uaaaagaauuugcuuaugugcu

SEQ ID NO: 7846 - RNA, 22 nt, Homo sapiens
gcgcccccggccugccccagag

SEQ ID NO: 7847 - RNA, 20 nt, Homo sapiens
gagggggcggcugggggcgc

SEQ ID NO: 7848 - RNA, 22 nt, Homo sapiens
uucuaccuccaccuguaucauc

SEQ ID NO: 7849 - RNA, 22 nt, Homo sapiens
auaacacagguagaaguagaca

SEQ ID NO: 7850 - RNA, 22 nt, Homo sapiens
ucccaucuuacauugaacaaag

SEQ ID NO: 7851 - RNA, 22 nt, Homo sapiens
uugaucaaugcaagaugggaag

SEQ ID NO: 7852 - RNA, 22 nt, Homo sapiens
ugcuucuuauuagcaguaauuc

SEQ ID NO: 7853 - RNA, 22 nt, Homo sapiens
aauuacugcuagcaagacgcaa

SEQ ID NO: 7854 - RNA, 22 nt, Homo sapiens
ucuaaaucauuucaaaagcauc

SEQ ID NO: 7855 - RNA, 22 nt, Homo sapiens
ugcuuucgaaaugaauuagccu

SEQ ID NO: 7856 - RNA, 22 nt, Homo sapiens
cagugucccuagugucaaggcu

SEQ ID NO: 7857 - RNA, 22 nt, Homo sapiens
uguugacauuggggacauuauc

SEQ ID NO: 7858 - RNA, 22 nt, Homo sapiens
ugaugcuucucuugcuggguca

SEQ ID NO: 7859 - RNA, 22 nt, Homo sapiens
ugugaccugcagaaaagcuuca

SEQ ID NO: 7860 - RNA, 22 nt, Homo sapiens
uauauuucuucuuuggcaguuc

SEQ ID NO: 7861 - RNA, 22 nt, Homo sapiens
uugcugaaaaagaaauauaaaa

SEQ ID NO: 7862 - RNA, 22 nt, Homo sapiens
ggggaggguggcggaggccggg

SEQ ID NO: 7863 - RNA, 22 nt, Homo sapiens
ccgguccucgcucucucccccu

SEQ ID NO: 7864 - RNA, 22 nt, Homo sapiens
aggcaugucaucuuguuuggaa

SEQ ID NO: 7865 - RNA, 22 nt, Homo sapiens
uccaguucaucagaucagguug

SEQ ID NO: 7866 - RNA, 22 nt, Homo sapiens
aggggugggaucugaaugugug

SEQ ID NO: 7867 - RNA, 22 nt, Homo sapiens
uauaagcagagcucuccccuuu

SEQ ID NO: 7868 - RNA, 22 nt, Homo sapiens
uugaggccuccaggauguaguc

SEQ ID NO: 7869 - RNA, 22 nt, Homo sapiens
cuauauuggcaggccuagauuc

SEQ ID NO: 7870 - RNA, 22 nt, Homo sapiens
ucugauuauugacagggagcuu

SEQ ID NO: 7871 - RNA, 22 nt, Homo sapiens
ccucuguuuguguuucagaugg

SEQ ID NO: 7872 - RNA, 22 nt, Homo sapiens
uuggaaugugucuugggauaua

SEQ ID NO: 7873 - RNA, 22 nt, Homo sapiens
ucuuccaagaaaaacucaucua

SEQ ID NO: 7874 - RNA, 22 nt, Homo sapiens
aggaagguauacagaauuguaa

SEQ ID NO: 7875 - RNA, 22 nt, Homo sapiens
uauauucuugauuacuuucuuc

SEQ ID NO: 7876 - RNA, 22 nt, Homo sapiens
ugaugacagcuagcuggcuuuu

SEQ ID NO: 7877 - RNA, 22 nt, Homo sapiens
aguauucuggcagucauucagu

SEQ ID NO: 7878 - RNA, 22 nt, Homo sapiens
cagugaggugcccagccugcuc

SEQ ID NO: 7879 - RNA, 22 nt, Homo sapiens
gcuuuugaggauacuucauuug

SEQ ID NO: 7880 - RNA, 22 nt, Homo sapiens
uguaccacaguuauggaggcug

SEQ ID NO: 7881 - RNA, 18 nt, Homo sapiens
cucuccacugugguacag

SEQ ID NO: 7882 - RNA, 22 nt, Homo sapiens
gguguuuuauuccuauggcuua

SEQ ID NO: 7883 - RNA, 22 nt, Homo sapiens
gcucuggaguagugauaagaca

SEQ ID NO: 7884 - RNA, 22 nt, Homo sapiens
ucagcuucuuuaauuuggugga

SEQ ID NO: 7885 - RNA, 22 nt, Homo sapiens
ucuccaagguaaacuagcugag

SEQ ID NO: 7886 - RNA, 22 nt, Homo sapiens
uucacagggaggugucauuuau

SEQ ID NO: 7887 - RNA, 22 nt, Homo sapiens
ggggugugguagauaauuaggu

SEQ ID NO: 7888 - RNA, 22 nt, Homo sapiens
ccuaugauuuauguuaccccca

SEQ ID NO: 7889 - RNA, 22 nt, Homo sapiens
aaauaacuugcuggguucggca

SEQ ID NO: 7890 - RNA, 22 nt, Homo sapiens
ucugacaagguggguuauuuuu

SEQ ID NO: 7891 - RNA, 22 nt, Homo sapiens
aggucaggguggccaugaguua

SEQ ID NO: 7892 - RNA, 22 nt, Homo sapiens
aguuggaggcguucccugaccu

SEQ ID NO: 7893 - RNA, 22 nt, Homo sapiens
ugugagcuguugaaagaaccug

SEQ ID NO: 7894 - RNA, 22 nt, Homo sapiens
guccagcaaauugcuuacguuc

SEQ ID NO: 7895 - RNA, 22 nt, Homo sapiens
uuuuuggcagacaccaaagcau

SEQ ID NO: 7896 - RNA, 22 nt, Homo sapiens
cugugguuuauucaaggguuau

SEQ ID NO: 7897 - RNA, 22 nt, Homo sapiens
ugggggcaggauuugaccccag

SEQ ID NO: 7898 - RNA, 22 nt, Homo sapiens
cuuggguuuaauccuauccauc

SEQ ID NO: 7899 - RNA, 22 nt, Homo sapiens
ugaugaauggauguguaggaag

SEQ ID NO: 7900 - RNA, 20 nt, Homo sapiens
uuagcuguuccauucaucag

SEQ ID NO: 7901 - RNA, 22 nt, Homo sapiens
uguggccuggaguuugauguag

SEQ ID NO: 7902 - RNA, 21 nt, Homo sapiens
uccuugcaccucuaggccaca

SEQ ID NO: 7903 - RNA, 22 nt, Homo sapiens
uugguuucuuuugugcuuucua

SEQ ID NO: 7904 - RNA, 22 nt, Homo sapiens
uagauugccaggaaaucagauu

SEQ ID NO: 7905 - RNA, 22 nt, Homo sapiens
ugaggcuccuagagauuggcau

SEQ ID NO: 7906 - RNA, 22 nt, Homo sapiens
gucaaauuuuagagcuuaagcc

SEQ ID NO: 7907 - RNA, 22 nt, Homo sapiens
ggcuuuugugguuugcuaaaug

SEQ ID NO: 7908 - RNA, 20 nt, Homo sapiens
uguuuaauaccacaaaagcc

SEQ ID NO: 7909 - RNA, 22 nt, Homo sapiens
gccucugggggguuuugaugga

SEQ ID NO: 7910 - RNA, 21 nt, Homo sapiens
ugcuucauuucucccagaggu

SEQ ID NO: 7911 - RNA, 22 nt, Homo sapiens
agcucaggagaggagauaggug

SEQ ID NO: 7912 - RNA, 19 nt, Homo sapiens
caucuccuuuuucugaguu

SEQ ID NO: 7913 - RNA, 22 nt, Homo sapiens
aaggguucccucugggccccaa

SEQ ID NO: 7914 - RNA, 22 nt, Homo sapiens
ucauugcccggaagggaauucu

SEQ ID NO: 7915 - RNA, 22 nt, Homo sapiens
uccccaaagcugucauauuaag

SEQ ID NO: 7916 - RNA, 21 nt, Homo sapiens
uucuguggcuggcuuugggga

SEQ ID NO: 7917 - RNA, 22 nt, Homo sapiens
ucugucucuuggccuguguccu

SEQ ID NO: 7918 - RNA, 22 nt, Homo sapiens
gcugcccaugguccaggaagac

SEQ ID NO: 7919 - RNA, 22 nt, Homo sapiens
agacucuauauucugucuguau

SEQ ID NO: 7920 - RNA, 22 nt, Homo sapiens
uauaguaggauuauauaguagu

SEQ ID NO: 7921 - RNA, 22 nt, Homo sapiens
aaacaaagcccuuuaucaagaa

SEQ ID NO: 7922 - RNA, 22 nt, Homo sapiens
uuuggagaggugcuuuguuucu

SEQ ID NO: 7923 - RNA, 22 nt, Homo sapiens
ucuggggaccacucaggcaggc

SEQ ID NO: 7924 - RNA, 22 nt, Homo sapiens
ugucguguguucccugaggggu

SEQ ID NO: 7925 - RNA, 22 nt, Homo sapiens
uaucucuggucuuacguaaauu

SEQ ID NO: 7926 - RNA, 22 nt, Homo sapiens
uuacauaagacaagggaauaua

SEQ ID NO: 7927 - RNA, 22 nt, Homo sapiens
agcugugaaauggugucccugc

SEQ ID NO: 7928 - RNA, 20 nt, Homo sapiens
gggcugccaauuucacaguu

SEQ ID NO: 7929 - RNA, 22 nt, Homo sapiens
cgcgcguggggcuggcgcgccg

SEQ ID NO: 7930 - RNA, 22 nt, Homo sapiens
gcuucccgcaguccccacgcgc

SEQ ID NO: 7931 - RNA, 22 nt, Homo sapiens
ugggagggaggggccagggaua

SEQ ID NO: 7932 - RNA, 22 nt, Homo sapiens
ccccgccgcacuuacuucccag

SEQ ID NO: 7933 - RNA, 22 nt, Homo sapiens
gaccugucugucccuuaucugu

SEQ ID NO: 7934 - RNA, 22 nt, Homo sapiens
uagaaggggaggggaggucuuc

SEQ ID NO: 7935 - RNA, 22 nt, Homo sapiens
ucccgcccuccgcucaugcuca

SEQ ID NO: 7936 - RNA, 22 nt, Homo sapiens
cgugggcgauguugcagggagc

SEQ ID NO: 7937 - RNA, 22 nt, Homo sapiens
cauaauaggaauuuuggcuucu

SEQ ID NO: 7938 - RNA, 20 nt, Homo sapiens
gccagaaguuuucuauuaug

SEQ ID NO: 7939 - RNA, 22 nt, Homo sapiens
ggcagagagguuggauuggaug

SEQ ID NO: 7940 - RNA, 22 nt, Homo sapiens
uccaguucaaaacuucucuguu

SEQ ID NO: 7941 - RNA, 22 nt, Homo sapiens
uucuggcaccugguaucuuggg

SEQ ID NO: 7942 - RNA, 22 nt, Homo sapiens
aaguaccaggaaugucggaguu

SEQ ID NO: 7943 - RNA, 22 nt, Homo sapiens
ucuuguuugugauaucgcaauc

SEQ ID NO: 7944 - RNA, 22 nt, Homo sapiens
ugugauucaacaaauugaggau

SEQ ID NO: 7945 - RNA, 23 nt, Homo sapiens
gcaaagcacacggccugcagaga

SEQ ID NO: 7946 - RNA, 22 nt, Homo sapiens
ucugggccugugucuuaggcuc

SEQ ID NO: 7947 - RNA, 22 nt, Homo sapiens
ucccuuuacuccaguuagaacu

SEQ ID NO: 7948 - RNA, 22 nt, Homo sapiens
guugaauuuuugacggagccug

SEQ ID NO: 7949 - RNA, 22 nt, Homo sapiens
caccuuacucccagguguucgu

SEQ ID NO: 7950 - RNA, 22 nt, Homo sapiens
ugagucaucuguggacacaggu

SEQ ID NO: 7951 - RNA, 22 nt, Homo sapiens
ccugugaggaguuggguucggc

SEQ ID NO: 7952 - RNA, 22 nt, Homo sapiens
cuugcccacaucccaucacagg

SEQ ID NO: 7953 - RNA, 22 nt, Homo sapiens
uccagggaguuaggcucugugg

SEQ ID NO: 7954 - RNA, 22 nt, Homo sapiens
ugcggaggagaacuucccagag

SEQ ID NO: 7955 - RNA, 22 nt, Homo sapiens
ucauucugugcauguguuucag

SEQ ID NO: 7956 - RNA, 22 nt, Homo sapiens
uggagcaugcaaggcagggugg

SEQ ID NO: 7957 - RNA, 22 nt, Homo sapiens
ucccugcacagaggcugugcau

SEQ ID NO: 7958 - RNA, 22 nt, Homo sapiens
cacucuagcugucugggcugca

SEQ ID NO: 7959 - RNA, 22 nt, Homo sapiens
uuucaguuuuaauucuuccgga

SEQ ID NO: 7960 - RNA, 22 nt, Homo sapiens
cugaugaaucugaacugagagg

SEQ ID NO: 7961 - RNA, 22 nt, Homo sapiens
ggcuguucagagucagauccua

SEQ ID NO: 7962 - RNA, 22 nt, Homo sapiens
gggcucugacguucggacagca

SEQ ID NO: 7963 - RNA, 22 nt, Homo sapiens
gaacugggacagaaaucggaag

SEQ ID NO: 7964 - RNA, 22 nt, Homo sapiens
ucugaucccugugcucccaguu

SEQ ID NO: 7965 - RNA, 22 nt, Homo sapiens
cccugugcuguguccuggggua

SEQ ID NO: 7966 - RNA, 22 nt, Homo sapiens
cccagaguacagcauaguacuc

SEQ ID NO: 7967 - RNA, 22 nt, Homo sapiens
aauaauccagaauuccuugugg

SEQ ID NO: 7968 - RNA, 22 nt, Homo sapiens
acaaggggucagaucuggauua

SEQ ID NO: 7969 - RNA, 22 nt, Homo sapiens
agacuagauuggcagguugggg

SEQ ID NO: 7970 - RNA, 22 nt, Homo sapiens
uucaauaccaugcaaaauaauu

SEQ ID NO: 7971 - RNA, 22 nt, Homo sapiens
ugagugacauuugcaccagcug

SEQ ID NO: 7972 - RNA, 22 nt, Homo sapiens
gcuuuggugaaaugucaccggc

SEQ ID NO: 7973 - RNA, 22 nt, Homo sapiens
uccuucuguggggaaugugucc

SEQ ID NO: 7974 - RNA, 22 nt, Homo sapiens
uacaaccuccaggaggcaaaag

SEQ ID NO: 7975 - RNA, 22 nt, Homo sapiens
uauucuccagucaaguuugcau

SEQ ID NO: 7976 - RNA, 22 nt, Homo sapiens
ugcuaacuugacuggagaaaua

SEQ ID NO: 7977 - RNA, 22 nt, Homo sapiens
uggaaaaaacuggugugugcuu

SEQ ID NO: 7978 - RNA, 22 nt, Homo sapiens
agcauacaucaguuuuuuccaa

SEQ ID NO: 7979 - RNA, 22 nt, Homo sapiens
uauuucuaccauauguuuaggc

SEQ ID NO: 7980 - RNA, 22 nt, Homo sapiens
caaacauaugguggaaauaauc

SEQ ID NO: 7981 - RNA, 22 nt, Homo sapiens
ucuugccuacauuauugggacg

SEQ ID NO: 7982 - RNA, 22 nt, Homo sapiens
ugugcaaugaucuaggcaagag

SEQ ID NO: 7983 - RNA, 22 nt, Homo sapiens
uauacugccauggugacucuag

SEQ ID NO: 7984 - RNA, 22 nt, Homo sapiens
gagucaccaugacaguauagcu

SEQ ID NO: 7985 - RNA, 22 nt, Homo sapiens
ugcauugcacuaauaugcucuc

SEQ ID NO: 7986 - RNA, 22 nt, Homo sapiens
gauguauuagagcaauguauca

SEQ ID NO: 7987 - RNA, 22 nt, Homo sapiens
uguuaucgcaugguaagcuuuc

SEQ ID NO: 7988 - RNA, 22 nt, Homo sapiens
uggagcuuggaugugaagcagg

SEQ ID NO: 7989 - RNA, 22 nt, Homo sapiens
uacauaaaauuucuauaacugu

SEQ ID NO: 7990 - RNA, 22 nt, Homo sapiens
uuauugaaauuuugauguagau

SEQ ID NO: 7991 - RNA, 22 nt, Homo sapiens
uuuguucugcaggugaugggau

SEQ ID NO: 7992 - RNA, 22 nt, Homo sapiens
uccaucacauuuagaauaaaau

SEQ ID NO: 7993 - RNA, 22 nt, Homo sapiens
agccgggaugggaaggcuggga

SEQ ID NO: 7994 - RNA, 22 nt, Homo sapiens
ccugguucuguguccaccuggc

SEQ ID NO: 7995 - RNA, 22 nt, Homo sapiens
cuucacaauuccuaugguaacc

SEQ ID NO: 7996 - RNA, 22 nt, Homo sapiens
ugccauggggacuagugaagcc

SEQ ID NO: 7997 - RNA, 22 nt, Homo sapiens
aagaauuuacuucugguuuaua

SEQ ID NO: 7998 - RNA, 22 nt, Homo sapiens
uauauaucaggaguaagaucua

SEQ ID NO: 7999 - RNA, 22 nt, Homo sapiens
uggggagucuauggggaaaauu

SEQ ID NO: 8000 - RNA, 22 nt, Homo sapiens
uuuccccauagcauccccuugg

SEQ ID NO: 8001 - RNA, 22 nt, Homo sapiens
ggaugcuuaggaucuugcccuu

SEQ ID NO: 8002 - RNA, 22 nt, Homo sapiens
gggcaggcuccaagcauccuau

SEQ ID NO: 8003 - RNA, 22 nt, Homo sapiens
ugcccugccuuccagcucuggg

SEQ ID NO: 8004 - RNA, 22 nt, Homo sapiens
ugggggcaggagggacaggggu

SEQ ID NO: 8005 - RNA, 22 nt, Homo sapiens
acaaauguagcauuuguagauu

SEQ ID NO: 8006 - RNA, 22 nt, Homo sapiens
ucugcauaggugcugaaucugu

SEQ ID NO: 8007 - RNA, 22 nt, Homo sapiens
uauuuaggaggaaacugagguu

SEQ ID NO: 8008 - RNA, 22 nt, Homo sapiens
cgaaguuucuuccuaaaccagc

SEQ ID NO: 8009 - RNA, 22 nt, Homo sapiens
uggcaguuucuggcaucagcuu

SEQ ID NO: 8010 - RNA, 22 nt, Homo sapiens
agcuggcaggaaacuuuccaau

SEQ ID NO: 8011 - RNA, 22 nt, Homo sapiens
uaguuucaaaacuaauuauucu

SEQ ID NO: 8012 - RNA, 22 nt, Homo sapiens
auaauuaguugggaaacuauaa

SEQ ID NO: 8013 - RNA, 22 nt, Homo sapiens
uuuggccuuaaaauaagacagg

SEQ ID NO: 8014 - RNA, 22 nt, Homo sapiens
uaucuuauggcuaaggucgggg

SEQ ID NO: 8015 - RNA, 22 nt, Homo sapiens
ugaccggauguuuauucaaaua

SEQ ID NO: 8016 - RNA, 22 nt, Homo sapiens
uuugaguaaacauccagucacu

SEQ ID NO: 8017 - RNA, 22 nt, Homo sapiens
uaugggagacuagguugugauu

SEQ ID NO: 8018 - RNA, 22 nt, Homo sapiens
uucaacuuauaccuucuauacc

SEQ ID NO: 8019 - RNA, 22 nt, Homo sapiens
uuccugaugacuucucucucuc

SEQ ID NO: 8020 - RNA, 22 nt, Homo sapiens
uggaaggaggugggugggaaga

SEQ ID NO: 8021 - RNA, 22 nt, Homo sapiens
cccagcuguucuuucuguuuuu

SEQ ID NO: 8022 - RNA, 22 nt, Homo sapiens
cuaugguugggagcguuggguc

SEQ ID NO: 8023 - RNA, 22 nt, Homo sapiens
uguaggggccccccgggguugg

SEQ ID NO: 8024 - RNA, 22 nt, Homo sapiens
agcccuggggugcccccucgcg

SEQ ID NO: 8025 - RNA, 22 nt, Homo sapiens
uuucuugcuagggugcuuucuu

SEQ ID NO: 8026 - RNA, 21 nt, Homo sapiens
aagguuuuuaggcaggagagc

SEQ ID NO: 8027 - RNA, 22 nt, Homo sapiens
ugggaaaagaugaguuuuggua

SEQ ID NO: 8028 - RNA, 22 nt, Homo sapiens
ugccaaaucaguauuucccagg

SEQ ID NO: 8029 - RNA, 22 nt, Homo sapiens
uggcuggggcagagauggggga

SEQ ID NO: 8030 - RNA, 21 nt, Homo sapiens
ggccucuguggccccagcuga

SEQ ID NO: 8031 - RNA, 22 nt, Homo sapiens
uuuguaucaucugugggcucug

SEQ ID NO: 8032 - RNA, 22 nt, Homo sapiens
gguuucagaugcuggcaggcau

SEQ ID NO: 8033 - RNA, 22 nt, Homo sapiens
uuuuuugauuucccuuugauag

SEQ ID NO: 8034 - RNA, 22 nt, Homo sapiens
ucaaaggguagcccagggaaga

SEQ ID NO: 8035 - RNA, 22 nt, Homo sapiens
gacucuuauaacgacucacuag

SEQ ID NO: 8036 - RNA, 22 nt, Homo sapiens
uaguggguuguugugggaucuu

SEQ ID NO: 8037 - RNA, 22 nt, Homo sapiens
uauuuggcuaucuaaugcaaga

SEQ ID NO: 8038 - RNA, 22 nt, Homo sapiens
ugcauuagacaaccaaauaggg

SEQ ID NO: 8039 - RNA, 22 nt, Homo sapiens
uccuuguuccagagauucugac

SEQ ID NO: 8040 - RNA, 22 nt, Homo sapiens
ugaggggaguuggagggggaug

SEQ ID NO: 8041 - RNA, 22 nt, Homo sapiens
aggcgcgagggccgggggucgu

SEQ ID NO: 8042 - RNA, 22 nt, Homo sapiens
agccccgcugccuucacgucug

SEQ ID NO: 8043 - RNA, 22 nt, Homo sapiens
uuucccugauuaacagccauuu

SEQ ID NO: 8044 - RNA, 22 nt, Homo sapiens
uggccacaaaucagagaaaugu

SEQ ID NO: 8045 - RNA, 22 nt, Homo sapiens
accccuggggcauugcaaguca

SEQ ID NO: 8046 - RNA, 22 nt, Homo sapiens
uguuuuuaaccucccaagggug

SEQ ID NO: 8047 - RNA, 22 nt, Homo sapiens
agcccugacugucauggaagcu

SEQ ID NO: 8048 - RNA, 22 nt, Homo sapiens
uucuggggugggagccagggcg

SEQ ID NO: 8049 - RNA, 22 nt, Homo sapiens
ugggguugaacucuagucagua

SEQ ID NO: 8050 - RNA, 22 nt, Homo sapiens
agacuuggaguuaaaguucaau

SEQ ID NO: 8051 - RNA, 22 nt, Homo sapiens
ggcccccuggggucuccuugug

SEQ ID NO: 8052 - RNA, 22 nt, Homo sapiens
ugcaggggucugcagguggccu

SEQ ID NO: 8053 - RNA, 22 nt, Homo sapiens
cagguugggaucgguugcaaug

SEQ ID NO: 8054 - RNA, 21 nt, Homo sapiens
uauugcacuugucccggccug

SEQ ID NO: 8055 - RNA, 22 nt, Homo sapiens
uggggccaggcccuucaggcug

SEQ ID NO: 8056 - RNA, 22 nt, Homo sapiens
guaugaagggcacguugccccc

SEQ ID NO: 8057 - RNA, 22 nt, Homo sapiens
uuccacauuugcuaggcuguau

SEQ ID NO: 8058 - RNA, 22 nt, Homo sapiens
gcagccugggacaucuggaggg

SEQ ID NO: 8059 - RNA, 22 nt, Homo sapiens
uuauuuucugccauuuaccuuc

SEQ ID NO: 8060 - RNA, 18 nt, Homo sapiens
agguaaagcagaaaguga

SEQ ID NO: 8061 - RNA, 22 nt, Homo sapiens
uagagugauuggagggauugga

SEQ ID NO: 8062 - RNA, 22 nt, Homo sapiens
auuucuccaaucacucuauugg

SEQ ID NO: 8063 - RNA, 22 nt, Homo sapiens
agcccccuccucuccuccucug

SEQ ID NO: 8064 - RNA, 22 nt, Homo sapiens
auggggccagggaggggagcca

SEQ ID NO: 8065 - RNA, 22 nt, Homo sapiens
uugccuuccaaaaccccuaucu

SEQ ID NO: 8066 - RNA, 22 nt, Homo sapiens
acuggggguccgaaggcagggc

SEQ ID NO: 8067 - RNA, 22 nt, Homo sapiens
ugaggggccucagaccgagcuu

SEQ ID NO: 8068 - RNA, 22 nt, Homo sapiens
gucucgcucucugccccucagc

SEQ ID NO: 8069 - RNA, 22 nt, Homo sapiens
uuauuuaaaagacuuaauugga

SEQ ID NO: 8070 - RNA, 22 nt, Homo sapiens
caauuaggcuuuuuaauuaaaa

SEQ ID NO: 8071 - RNA, 22 nt, Homo sapiens
ugcuguggagaauacaggugcu

SEQ ID NO: 8072 - RNA, 22 nt, Homo sapiens
gugcuacguauccuccauagca

SEQ ID NO: 8073 - RNA, 22 nt, Homo sapiens
aggugagcaguaaauauuuguu

SEQ ID NO: 8074 - RNA, 22 nt, Homo sapiens
aaauacuuacugcuugccugcu

SEQ ID NO: 8075 - RNA, 22 nt, Homo sapiens
uuuucuguccccagaauguggc

SEQ ID NO: 8076 - RNA, 20 nt, Homo sapiens
acauucacaggacagaagga

SEQ ID NO: 8077 - RNA, 22 nt, Homo sapiens
ucaucaacaugcagccugugaa

SEQ ID NO: 8078 - RNA, 22 nt, Homo sapiens
auugguugcguaauuugauuuu

SEQ ID NO: 8079 - RNA, 22 nt, Homo sapiens
gaggugggcguggggcugaagg

SEQ ID NO: 8080 - RNA, 22 nt, Homo sapiens
uuucugcucuccuucccauuuc

SEQ ID NO: 8081 - RNA, 22 nt, Homo sapiens
aaucuggggccagcuguagauc

SEQ ID NO: 8082 - RNA, 22 nt, Homo sapiens
auaagcagcuggcccccguuua

SEQ ID NO: 8083 - RNA, 22 nt, Homo sapiens
uggcugggugagugucacugug

SEQ ID NO: 8084 - RNA, 22 nt, Homo sapiens
cugugacacagacaccuucaga

SEQ ID NO: 8085 - RNA, 22 nt, Homo sapiens
uaauacugccggguaaugaugg

SEQ ID NO: 8086 - RNA, 22 nt, Homo sapiens
ucgucuuacccagcaguguuug

SEQ ID NO: 8087 - RNA, 22 nt, Homo sapiens
cacucaaacugugggggcacuu

SEQ ID NO: 8088 - RNA, 21 nt, Homo sapiens
gugccgccaucuuuugagugu

SEQ ID NO: 8089 - RNA, 22 nt, Homo sapiens
ucugguucuaaaugcuccagug

SEQ ID NO: 8090 - RNA, 22 nt, Homo sapiens
auaggguuuucaaaucagaauu

SEQ ID NO: 8091 - RNA, 22 nt, Homo sapiens
uuuucuuccuggaaugcucugg

SEQ ID NO: 8092 - RNA, 22 nt, Homo sapiens
aguucauuccuuuggagaaaag

SEQ ID NO: 8093 - RNA, 22 nt, Homo sapiens
ugaaguuuaugcuuuucggguc

SEQ ID NO: 8094 - RNA, 22 nt, Homo sapiens
ccccgagaguuggacuccagag

SEQ ID NO: 8095 - RNA, 22 nt, Homo sapiens
uaauuuccuguuaauaccaaua

SEQ ID NO: 8096 - RNA, 22 nt, Homo sapiens
uugguauuaaugggaaauuaac

SEQ ID NO: 8097 - RNA, 22 nt, Homo sapiens
aggucaggggcaugggguaugg

SEQ ID NO: 8098 - RNA, 21 nt, Homo sapiens
uugccucaugucuuggcuucu

SEQ ID NO: 8099 - RNA, 22 nt, Homo sapiens
ucccuuugugaggggaaaaaaa

SEQ ID NO: 8100 - RNA, 22 nt, Homo sapiens
uaauuuccucuggcagagggag

SEQ ID NO: 8101 - RNA, 22 nt, Homo sapiens
ucggggccuucuuuugguuuua

SEQ ID NO: 8102 - RNA, 22 nt, Homo sapiens
aguaacagaaaggcucaggugc

SEQ ID NO: 8103 - RNA, 22 nt, Homo sapiens
ucccuucguucccccccacccc

SEQ ID NO: 8104 - RNA, 22 nt, Homo sapiens
gagugggaggacgucggggggu

SEQ ID NO: 8105 - RNA, 22 nt, Homo sapiens
ugagggguucugggaauacuau

SEQ ID NO: 8106 - RNA, 22 nt, Homo sapiens
gagucaccagaaacccucaaug

SEQ ID NO: 8107 - RNA, 22 nt, Homo sapiens
acgcagcagaagguaaugcuuu

SEQ ID NO: 8108 - RNA, 22 nt, Homo sapiens
gcuaaaaauugcguucugcugu

SEQ ID NO: 8109 - RNA, 22 nt, Homo sapiens
uggggcaggaggacauuagcuu

SEQ ID NO: 8110 - RNA, 20 nt, Homo sapiens
gcagaaugucucuugccuca

SEQ ID NO: 8111 - RNA, 22 nt, Homo sapiens
ggaacggcuucauacaggaguu

SEQ ID NO: 8112 - RNA, 23 nt, Homo sapiens
uccagcuccuauaugaugccuuu

SEQ ID NO: 8113 - RNA, 22 nt, Homo sapiens
ccauggccccggaccuuggcaa

SEQ ID NO: 8114 - RNA, 22 nt, Homo sapiens
gucaacgucacagggcgugggg

SEQ ID NO: 8115 - RNA, 22 nt, Homo sapiens
ugggagaugggcagauaaucuu

SEQ ID NO: 8116 - RNA, 22 nt, Homo sapiens
auuauuugugcauaucccaucc

SEQ ID NO: 8117 - RNA, 22 nt, Homo sapiens
guuaguuaugcagguaauuucc

SEQ ID NO: 8118 - RNA, 22 nt, Homo sapiens
aguuaucugcgaaaugggaguc

SEQ ID NO: 8119 - RNA, 22 nt, Homo sapiens
ucagagaggagagggugcgggg

SEQ ID NO: 8120 - RNA, 22 nt, Homo sapiens
ccgcucagcugcucucugacag

SEQ ID NO: 8121 - RNA, 22 nt, Homo sapiens
gugauuauuuacaguuuaggug

SEQ ID NO: 8122 - RNA, 22 nt, Homo sapiens
aacuagacuguaaguuccauga

SEQ ID NO: 8123 - RNA, 22 nt, Homo sapiens
ccagcccagcuccuacccgccg

SEQ ID NO: 8124 - RNA, 22 nt, Homo sapiens
caggccggcaggcugggcuggu

SEQ ID NO: 8125 - RNA, 22 nt, Homo sapiens
ucuucuguuggccccucauguu

SEQ ID NO: 8126 - RNA, 22 nt, Homo sapiens
caagaauggcauuugauggaag

SEQ ID NO: 8127 - RNA, 22 nt, Homo sapiens
ggaggcagggggaggaaggaau

SEQ ID NO: 8128 - RNA, 21 nt, Homo sapiens
ccccacccauccccugccucu

SEQ ID NO: 8129 - RNA, 22 nt, Homo sapiens
uaaguuuugacuagcucauaau

SEQ ID NO: 8130 - RNA, 22 nt, Homo sapiens
uuugaguuagucaaaacuuuag

SEQ ID NO: 8131 - RNA, 22 nt, Homo sapiens
ggccuccuccugauucuccagc

SEQ ID NO: 8132 - RNA, 22 nt, Homo sapiens
uggggagagcagggaggggguu

SEQ ID NO: 8133 - RNA, 22 nt, Homo sapiens
uugggcuuguggucaccucaca

SEQ ID NO: 8134 - RNA, 22 nt, Homo sapiens
uauagguaacccacagacauua

SEQ ID NO: 8135 - RNA, 22 nt, Homo sapiens
gagcaucccagggaaacuccaa

SEQ ID NO: 8136 - RNA, 22 nt, Homo sapiens
gugggguucuuuagggucucuu

SEQ ID NO: 8137 - RNA, 22 nt, Homo sapiens
accacucuaugccucaguuucc

SEQ ID NO: 8138 - RNA, 20 nt, Homo sapiens
ggggacugaauggggugguc

SEQ ID NO: 8139 - RNA, 22 nt, Homo sapiens
uucuguuggugacaugauaauc

SEQ ID NO: 8140 - RNA, 22 nt, Homo sapiens
uuaugaugucacaaagagguaa

SEQ ID NO: 8141 - RNA, 22 nt, Homo sapiens
uggcagacagugauaauuucuu

SEQ ID NO: 8142 - RNA, 22 nt, Homo sapiens
aagaaggcaauugucugacaua

SEQ ID NO: 8143 - RNA, 22 nt, Homo sapiens
ggaggggcaagccgugagcccu

SEQ ID NO: 8144 - RNA, 22 nt, Homo sapiens
ggcuuccggccuugcacucucu

SEQ ID NO: 8145 - RNA, 22 nt, Homo sapiens
ugggagggggaggagggggcca

SEQ ID NO: 8146 - RNA, 22 nt, Homo sapiens
ccccggcuuuacuucccacucu

SEQ ID NO: 8147 - RNA, 22 nt, Homo sapiens
ggagguggcagggaacauaauu

SEQ ID NO: 8148 - RNA, 22 nt, Homo sapiens
aguucuuuuguuuucugcuacc

SEQ ID NO: 8149 - RNA, 22 nt, Homo sapiens
aaugggcuguauuccaaaaauu

SEQ ID NO: 8150 - RNA, 22 nt, Homo sapiens
uguuuggaaugcagaacacauu

SEQ ID NO: 8151 - RNA, 22 nt, Homo sapiens
uccucauugggcccuggccagg

SEQ ID NO: 8152 - RNA, 22 nt, Homo sapiens
ugggcugggcccuauuaggaca

SEQ ID NO: 8153 - RNA, 22 nt, Homo sapiens
uuuugguuccucugucuuuaaa

SEQ ID NO: 8154 - RNA, 22 nt, Homo sapiens
agaaggcaggggaugcagggag

SEQ ID NO: 8155 - RNA, 22 nt, Homo sapiens
uugcuuaugccaggugagagag

SEQ ID NO: 8156 - RNA, 22 nt, Homo sapiens
ucucaccugacauaagcaacuc

SEQ ID NO: 8157 - RNA, 22 nt, Homo sapiens
uaaaacaguuacacagagagcc

SEQ ID NO: 8158 - RNA, 22 nt, Homo sapiens
auucauguauagcuguuucaga

SEQ ID NO: 8159 - RNA, 22 nt, Homo sapiens
gacuguuuguacuuccagauua

SEQ ID NO: 8160 - RNA, 22 nt, Homo sapiens
uuuucugggagaggauagucug

SEQ ID NO: 8161 - RNA, 22 nt, Homo sapiens
uauguauauguuuaaaaaauaa

SEQ ID NO: 8162 - RNA, 22 nt, Homo sapiens
uauuuuuuuaaacauuaauauu

SEQ ID NO: 8163 - RNA, 22 nt, Homo sapiens
gcuuaagaaacacuuccugggu

SEQ ID NO: 8164 - RNA, 22 nt, Homo sapiens
caagagguguccuaggagcuuu

SEQ ID NO: 8165 - RNA, 22 nt, Homo sapiens
uuuuccguuuuuggucuucaag

SEQ ID NO: 8166 - RNA, 22 nt, Homo sapiens
agucaggagccacguggaagag

SEQ ID NO: 8167 - RNA, 22 nt, Homo sapiens
uaaaugagagcuccuuuuucuc

SEQ ID NO: 8168 - RNA, 19 nt, Homo sapiens
aaaaagguguuuuuauuua

SEQ ID NO: 8169 - RNA, 22 nt, Homo sapiens
ugaaaugaaugugauucgauag

SEQ ID NO: 8170 - RNA, 18 nt, Homo sapiens
ugaaucccauucauuuua

SEQ ID NO: 8171 - RNA, 22 nt, Homo sapiens
uuuuuaguuauuccuaaagggu

SEQ ID NO: 8172 - RNA, 22 nt, Homo sapiens
ucuuuucaaaauaauuaaaacc

SEQ ID NO: 8173 - RNA, 22 nt, Homo sapiens
ugguuguugucggcaucuuucc

SEQ ID NO: 8174 - RNA, 22 nt, Homo sapiens
uggaauguugccagcagccaga

SEQ ID NO: 8175 - RNA, 22 nt, Homo sapiens
acucaugccaagaaaugauccu

SEQ ID NO: 8176 - RNA, 22 nt, Homo sapiens
gacugaugguuucuggucugag

SEQ ID NO: 8177 - RNA, 22 nt, Homo sapiens
uggacugugcugccacaguggg

SEQ ID NO: 8178 - RNA, 22 nt, Homo sapiens
ucacaguggcgugacagccaug

SEQ ID NO: 8179 - RNA, 22 nt, Homo sapiens
ugcaauauauuuuuacaaugug

SEQ ID NO: 8180 - RNA, 22 nt, Homo sapiens
uaugcugugacuauaugugugc

SEQ ID NO: 8181 - RNA, 22 nt, Homo sapiens
ccuugagugcaucguggguguc

SEQ ID NO: 8182 - RNA, 20 nt, Homo sapiens
cccggauguuguacucgagg

SEQ ID NO: 8183 - RNA, 22 nt, Homo sapiens
ucauuaacugguuaauaacuau

SEQ ID NO: 8184 - RNA, 21 nt, Homo sapiens
uaguuucuacccaguuaaugg

SEQ ID NO: 8185 - RNA, 22 nt, Homo sapiens
cauguccguauauuuuggggac

SEQ ID NO: 8186 - RNA, 22 nt, Homo sapiens
cccaaaauacauggacgugucc

SEQ ID NO: 8187 - RNA, 22 nt, Homo sapiens
aggaaagaguguauccaucaau

SEQ ID NO: 8188 - RNA, 18 nt, Homo sapiens
augaguuuacucuuuucu

SEQ ID NO: 8189 - RNA, 22 nt, Homo sapiens
uguccuuccuugcuugcaguuu

SEQ ID NO: 8190 - RNA, 22 nt, Homo sapiens
uuccugcgguugguaggauauu

SEQ ID NO: 8191 - RNA, 22 nt, Homo sapiens
ccuaaaacaagugcaagacuag

SEQ ID NO: 8192 - RNA, 22 nt, Homo sapiens
uacucuugcuucuuguuuuagg

SEQ ID NO: 8193 - RNA, 22 nt, Homo sapiens
agggaccagaauggggccuccu

SEQ ID NO: 8194 - RNA, 21 nt, Homo sapiens
gugcuuuuucuuuugguuccu

SEQ ID NO: 8195 - RNA, 22 nt, Homo sapiens
uucacagggaggugucauuuau

SEQ ID NO: 8196 - RNA, 22 nt, Homo sapiens
gagaguguaauuauguucauag

SEQ ID NO: 8197 - RNA, 22 nt, Homo sapiens
uuauggaauaaucauucuccgg

SEQ ID NO: 8198 - RNA, 22 nt, Homo sapiens
gggagcuuaguguacuuccgcu

SEQ ID NO: 8199 - RNA, 22 nt, Homo sapiens
uggggaaaauacaugguuuccc

SEQ ID NO: 8200 - RNA, 22 nt, Homo sapiens
gguagaauuagaccucggggcc

SEQ ID NO: 8201 - RNA, 22 nt, Homo sapiens
ucagaggucccguuccucccuc

SEQ ID NO: 8202 - RNA, 22 nt, Homo sapiens
gacagcucuuuuaaaagcaggc

SEQ ID NO: 8203 - RNA, 20 nt, Homo sapiens
aggcagcuugaggagcuguu

SEQ ID NO: 8204 - RNA, 22 nt, Homo sapiens
uggagucuccuuuuuucaugca

SEQ ID NO: 8205 - RNA, 22 nt, Homo sapiens
uguaggaguaagaggggcggcu

SEQ ID NO: 8206 - RNA, 22 nt, Homo sapiens
gcgcggcgcuucgggccuugua

SEQ ID NO: 8207 - RNA, 21 nt, Homo sapiens
cgaggcccauggugccgugcg

SEQ ID NO: 8208 - RNA, 22 nt, Homo sapiens
uccuucuggcagcuucuuggca

SEQ ID NO: 8209 - RNA, 22 nt, Homo sapiens
cugaagagcuguuuuggagccu

SEQ ID NO: 8210 - RNA, 22 nt, Homo sapiens
uucaggggaucagagacuaggc

SEQ ID NO: 8211 - RNA, 22 nt, Homo sapiens
ccucaguuuccuccuuugaagc

SEQ ID NO: 8212 - RNA, 22 nt, Homo sapiens
uucuuuaggugcugagccuucu

SEQ ID NO: 8213 - RNA, 22 nt, Homo sapiens
gguucagcaccccgaaaguguc

SEQ ID NO: 8214 - RNA, 22 nt, Homo sapiens
gcgggugugcagaugaaggcug

SEQ ID NO: 8215 - RNA, 22 nt, Homo sapiens
ccaucccaacugugugcuugcc

SEQ ID NO: 8216 - RNA, 22 nt, Homo sapiens
uauugcuuaagaauacgcguag

SEQ ID NO: 8217 - RNA, 22 nt, Homo sapiens
ugacggguauucuuggguggau

SEQ ID NO: 8218 - RNA, 22 nt, Homo sapiens
gaugguguugaguuugguacuc

SEQ ID NO: 8219 - RNA, 22 nt, Homo sapiens
guuauucauguacuuggcaucg

SEQ ID NO: 8220 - RNA, 22 nt, Homo sapiens
uaaggaauggagaaguucuuca

SEQ ID NO: 8221 - RNA, 22 nt, Homo sapiens
gagcuugucauuucuuugcacu

SEQ ID NO: 8222 - RNA, 22 nt, Homo sapiens
aagugacaucacagugaccaga

SEQ ID NO: 8223 - RNA, 22 nt, Homo sapiens
uggagcaguuaugaugucauuc

SEQ ID NO: 8224 - RNA, 22 nt, Homo sapiens
uuuucauggcgaggcuucaugg

SEQ ID NO: 8225 - RNA, 22 nt, Homo sapiens
ugaugagcgccugccagagcug

SEQ ID NO: 8226 - RNA, 22 nt, Homo sapiens
uucuaaaggaggcaguauagau

SEQ ID NO: 8227 - RNA, 22 nt, Homo sapiens
aacuagcugccugccuugaggu

SEQ ID NO: 8228 - RNA, 22 nt, Homo sapiens
gaacuucuucuuuaagagacuc

SEQ ID NO: 8229 - RNA, 16 nt, Homo sapiens
gucuuaggagaaguuu

SEQ ID NO: 8230 - RNA, 22 nt, Homo sapiens
ugaagucguuuucagaaagaca

SEQ ID NO: 8231 - RNA, 20 nt, Homo sapiens
uuuuuccacaugacuucauc

SEQ ID NO: 8232 - RNA, 22 nt, Homo sapiens
ucauuaccugccagcuggccuc

SEQ ID NO: 8233 - RNA, 18 nt, Homo sapiens
aguuggcggggugauggg

SEQ ID NO: 8234 - RNA, 22 nt, Homo sapiens
agggcugggaggggcagugggu

SEQ ID NO: 8235 - RNA, 22 nt, Homo sapiens
caccugucccugcccagcucug

SEQ ID NO: 8236 - RNA, 22 nt, Homo sapiens
uucuuccagggccugaaugucc

SEQ ID NO: 8237 - RNA, 22 nt, Homo sapiens
auuucauuccugggcagggucu

SEQ ID NO: 8238 - RNA, 22 nt, Homo sapiens
ucaguacguggcuucauaaagc

SEQ ID NO: 8239 - RNA, 21 nt, Homo sapiens
uuuggaagccaaugugcugau

SEQ ID NO: 8240 - RNA, 22 nt, Homo sapiens
cccacuucuacuucuguuaucg

SEQ ID NO: 8241 - RNA, 22 nt, Homo sapiens
uuaagagagguaagaagugggu

SEQ ID NO: 8242 - RNA, 22 nt, Homo sapiens
uucugcaagugaggaaugccug

SEQ ID NO: 8243 - RNA, 22 nt, Homo sapiens
gggauuccucacccucagggca

SEQ ID NO: 8244 - RNA, 22 nt, Homo sapiens
uccuguggccauguguggucau

SEQ ID NO: 8245 - RNA, 22 nt, Homo sapiens
gccacacccaauggaucauagg

SEQ ID NO: 8246 - RNA, 22 nt, Homo sapiens
aaacacaagagcaaggugcuga

SEQ ID NO: 8247 - RNA, 22 nt, Homo sapiens
gguagcuuuuucuguguguuuu

SEQ ID NO: 8248 - RNA, 22 nt, Homo sapiens
gaagcugggggcaacaccugaa

SEQ ID NO: 8249 - RNA, 20 nt, Homo sapiens
gguaccugcacuccagcuuc

SEQ ID NO: 8250 - RNA, 22 nt, Homo sapiens
ugugcucaugaccacugggugg

SEQ ID NO: 8251 - RNA, 22 nt, Homo sapiens
cccguggucccagagucacagg

SEQ ID NO: 8252 - RNA, 22 nt, Homo sapiens
ucacaugugacacaugugauua

SEQ ID NO: 8253 - RNA, 22 nt, Homo sapiens
uaaucacgugucacauaugacu

SEQ ID NO: 8254 - RNA, 22 nt, Homo sapiens
ucuguguccuauauacuauaug

SEQ ID NO: 8255 - RNA, 22 nt, Homo sapiens
uacaguaacacauaggacaugg

SEQ ID NO: 8256 - RNA, 22 nt, Homo sapiens
uggaggaugggguuggcaugag

SEQ ID NO: 8257 - RNA, 22 nt, Homo sapiens
agauuaacccuaccauccaucc

SEQ ID NO: 8258 - RNA, 22 nt, Homo sapiens
uugcugaaugcugugucuccaa

SEQ ID NO: 8259 - RNA, 22 nt, Homo sapiens
uggugcacaguagacgugugaa

SEQ ID NO: 8260 - RNA, 22 nt, Homo sapiens
uacugaaucagugaaugguuuu

SEQ ID NO: 8261 - RNA, 22 nt, Homo sapiens
acuggccauuggauuucaguau

SEQ ID NO: 8262 - RNA, 22 nt, Homo sapiens
uguauaccuuuuaaaacaagcc

SEQ ID NO: 8263 - RNA, 22 nt, Homo sapiens
gcuuguuuucaaagguguagga

SEQ ID NO: 8264 - RNA, 22 nt, Homo sapiens
uagccuuuguucugccucucac

SEQ ID NO: 8265 - RNA, 22 nt, Homo sapiens
cagugauguagaauaaagcagg

SEQ ID NO: 8266 - RNA, 22 nt, Homo sapiens
ucaguuugcaaguuuguugggu

SEQ ID NO: 8267 - RNA, 22 nt, Homo sapiens
ugaaucagacucauguacugau

SEQ ID NO: 8268 - RNA, 22 nt, Homo sapiens
gcuccaggcagccaggucuucc

SEQ ID NO: 8269 - RNA, 17 nt, Homo sapiens
uuggcccugucuggggc

SEQ ID NO: 8270 - RNA, 22 nt, Homo sapiens
uucaagccauggcucaggacag

SEQ ID NO: 8271 - RNA, 22 nt, Homo sapiens
uccuuccaugauguuuggggga

SEQ ID NO: 8272 - RNA, 22 nt, Homo sapiens
ugccgccagccucacucaucac

SEQ ID NO: 8273 - RNA, 22 nt, Homo sapiens
guaugugagugcuguggcaugg

SEQ ID NO: 8274 - RNA, 22 nt, Homo sapiens
uccuccuuguguauuggcaggg

SEQ ID NO: 8275 - RNA, 22 nt, Homo sapiens
uugccaaagcacugagggagga

SEQ ID NO: 8276 - RNA, 22 nt, Homo sapiens
uggguagguagguaguugugug

SEQ ID NO: 8277 - RNA, 22 nt, Homo sapiens
cugcuauucuuaaccugccuac

SEQ ID NO: 8278 - RNA, 22 nt, Homo sapiens
ggagguaggaaggagcccugca

SEQ ID NO: 8279 - RNA, 22 nt, Homo sapiens
caugggcccuauuccugccucc

SEQ ID NO: 8280 - RNA, 22 nt, Homo sapiens
ucaccucccugagccaugcugc

SEQ ID NO: 8281 - RNA, 22 nt, Homo sapiens
uguggcucagggagaugagaug

SEQ ID NO: 8282 - RNA, 22 nt, Homo sapiens
gaaugucugugcagccuuggaa

SEQ ID NO: 8283 - RNA, 22 nt, Homo sapiens
cuaggcugcuccauggauauuc

SEQ ID NO: 8284 - RNA, 22 nt, Homo sapiens
cguguauuguguguuuauauag

SEQ ID NO: 8285 - RNA, 22 nt, Homo sapiens
uauauaugcacacauauauacu

SEQ ID NO: 8286 - RNA, 22 nt, Homo sapiens
gcguguauuguguguuuauaua

SEQ ID NO: 8287 - RNA, 22 nt, Homo sapiens
uauaugcacacauauauacuug

SEQ ID NO: 8288 - RNA, 22 nt, Homo sapiens
uuccucucucccaccugaagcc

SEQ ID NO: 8289 - RNA, 22 nt, Homo sapiens
guugagggugggagugggaaac

SEQ ID NO: 8290 - RNA, 22 nt, Homo sapiens
ucccagcagugccaucugguug

SEQ ID NO: 8291 - RNA, 19 nt, Homo sapiens
gcuggccuggcugcuggga

SEQ ID NO: 8292 - RNA, 22 nt, Homo sapiens
uuucuugugggcagauggggcc

SEQ ID NO: 8293 - RNA, 22 nt, Homo sapiens
caggcuucugccacgagaggga

SEQ ID NO: 8294 - RNA, 22 nt, Homo sapiens
gugugauuuauucugggauuua

SEQ ID NO: 8295 - RNA, 22 nt, Homo sapiens
aucccaggaagaguagacaggc

SEQ ID NO: 8296 - RNA, 22 nt, Homo sapiens
uuuuccaagcacuaaagggucu

SEQ ID NO: 8297 - RNA, 22 nt, Homo sapiens
cucacagguguauggaaaagua

SEQ ID NO: 8298 - RNA, 22 nt, Homo sapiens
ccuucuucucucagcucuuuug

SEQ ID NO: 8299 - RNA, 22 nt, Homo sapiens
ucugggggcgaggaaggaggag

SEQ ID NO: 8300 - RNA, 22 nt, Homo sapiens
agauuggaggggucugauuugu

SEQ ID NO: 8301 - RNA, 22 nt, Homo sapiens
caaaucagacuccuccaauccu

SEQ ID NO: 8302 - RNA, 22 nt, Homo sapiens
ucuagagcagugaagaagaaca

SEQ ID NO: 8303 - RNA, 22 nt, Homo sapiens
ucuucuucacuacucuagaugu

SEQ ID NO: 8304 - RNA, 22 nt, Homo sapiens
uaagacaugaagauuuacagcu

SEQ ID NO: 8305 - RNA, 22 nt, Homo sapiens
gagguaggucuucagucuugag

SEQ ID NO: 8306 - RNA, 22 nt, Homo sapiens
uaguuaauauagcuucaccuaa

SEQ ID NO: 8307 - RNA, 22 nt, Homo sapiens
uaagugaagcuaugauaacuag

SEQ ID NO: 8308 - RNA, 22 nt, Homo sapiens
ucagugcacauggucuacacca

SEQ ID NO: 8309 - RNA, 22 nt, Homo sapiens
guguagacaaugugcacggacc

SEQ ID NO: 8310 - RNA, 22 nt, Homo sapiens
ucauuaggaggaggcugucaga

SEQ ID NO: 8311 - RNA, 22 nt, Homo sapiens
uggugggucauuccuccaauga

SEQ ID NO: 8312 - RNA, 22 nt, Homo sapiens
agggggcagcucuaacccuaaa

SEQ ID NO: 8313 - RNA, 22 nt, Homo sapiens
gaaugggccuggauggcucccc

SEQ ID NO: 8314 - RNA, 22 nt, Homo sapiens
ggacuaugcuuggcacacagua

SEQ ID NO: 8315 - RNA, 22 nt, Homo sapiens
cuaugugccaagcacaguccua

SEQ ID NO: 8316 - RNA, 22 nt, Homo sapiens
uuuuuugggucuguuugauugc

SEQ ID NO: 8317 - RNA, 22 nt, Homo sapiens
guuuaacaggggacuagaaaaa

SEQ ID NO: 8318 - RNA, 22 nt, Homo sapiens
ugggcuggccauuucaacuucc

SEQ ID NO: 8319 - RNA, 22 nt, Homo sapiens
gggagaauggccaguuaaucag

SEQ ID NO: 8320 - RNA, 22 nt, Homo sapiens
uucugggagcaaagacuaaacu

SEQ ID NO: 8321 - RNA, 22 nt, Homo sapiens
uucagccugugcucccagaaug

SEQ ID NO: 8322 - RNA, 22 nt, Homo sapiens
uccacccccaagccucuuggua

SEQ ID NO: 8323 - RNA, 21 nt, Homo sapiens
uuuaaugaggcugggggugga

SEQ ID NO: 8324 - RNA, 22 nt, Homo sapiens
uucuggggacacucccuggucc

SEQ ID NO: 8325 - RNA, 19 nt, Homo sapiens
agaaggagaguccucagga

SEQ ID NO: 8326 - RNA, 22 nt, Homo sapiens
ugacuggguaacaguauuagag

SEQ ID NO: 8327 - RNA, 22 nt, Homo sapiens
ucuaauaccuauacccagucau

SEQ ID NO: 8328 - RNA, 22 nt, Homo sapiens
acaguacaagucagugaggcaa

SEQ ID NO: 8329 - RNA, 22 nt, Homo sapiens
cucucauugauuuucacugccc

SEQ ID NO: 8330 - RNA, 22 nt, Homo sapiens
ugccaggccuuuguccuggcgu

SEQ ID NO: 8331 - RNA, 22 nt, Homo sapiens
ugggcuccaggacagggugcgg

SEQ ID NO: 8332 - RNA, 22 nt, Homo sapiens
ucacauacaagagaugguggau

SEQ ID NO: 8333 - RNA, 21 nt, Homo sapiens
uaccacuucuuugugugugag

SEQ ID NO: 8334 - RNA, 22 nt, Homo sapiens
uacuuguuauagaauuucaggu

SEQ ID NO: 8335 - RNA, 21 nt, Homo sapiens
cucguuuauucauaacaagug

SEQ ID NO: 8336 - RNA, 22 nt, Homo sapiens
ggucugggauuccaguucacgg

SEQ ID NO: 8337 - RNA, 22 nt, Homo sapiens
cauggguggacagaggcccaga

SEQ ID NO: 8338 - RNA, 22 nt, Homo sapiens
ugccuggcacauagcaggcacu

SEQ ID NO: 8339 - RNA, 22 nt, Homo sapiens
gugcuugcuaggugccaagcac

SEQ ID NO: 8340 - RNA, 22 nt, Homo sapiens
cagaagcaagggccaaagucuu

SEQ ID NO: 8341 - RNA, 22 nt, Homo sapiens
auggacuuggacucuggcucug

SEQ ID NO: 8342 - RNA, 22 nt, Homo sapiens
uuucagcauugcuaauccacau

SEQ ID NO: 8343 - RNA, 22 nt, Homo sapiens
uguggauuaacaaugacggaaa

SEQ ID NO: 8344 - RNA, 20 nt, Homo sapiens
aaagugcacccaguuuuggg

SEQ ID NO: 8345 - RNA, 21 nt, Homo sapiens
ucaaaacugaggggcauuuuc

SEQ ID NO: 8346 - RNA, 22 nt, Homo sapiens
ucaaaacugaggggcauuuucu

SEQ ID NO: 8347 - RNA, 22 nt, Homo sapiens
uggauggggaggggcccaggcu

SEQ ID NO: 8348 - RNA, 21 nt, Homo sapiens
ccuggagugccccccauccaa

SEQ ID NO: 8349 - RNA, 22 nt, Homo sapiens
ugcuugauuuccccucgucugu

SEQ ID NO: 8350 - RNA, 22 nt, Homo sapiens
uagaccagguugaccagguagg

SEQ ID NO: 8351 - RNA, 22 nt, Homo sapiens
agaaauaggucauuaacaguag

SEQ ID NO: 8352 - RNA, 22 nt, Homo sapiens
uaugguaaugacugauuucuuu

SEQ ID NO: 8353 - RNA, 22 nt, Homo sapiens
ugcccuucucugagguucuugu

SEQ ID NO: 8354 - RNA, 22 nt, Homo sapiens
ugagacaccugagaugaaggca

SEQ ID NO: 8355 - RNA, 22 nt, Homo sapiens
ugaggaaagauuucagucagcu

SEQ ID NO: 8356 - RNA, 22 nt, Homo sapiens
gcagaguggaacuugucucuuu

SEQ ID NO: 8357 - RNA, 22 nt, Homo sapiens
gcuuguccguauucccucuucu

SEQ ID NO: 8358 - RNA, 22 nt, Homo sapiens
aauggggaguuggguagggcug

SEQ ID NO: 8359 - RNA, 22 nt, Homo sapiens
uaaguagaaaugcagaaccuga

SEQ ID NO: 8360 - RNA, 22 nt, Homo sapiens
agguucuacaauucuaccaggu

SEQ ID NO: 8361 - RNA, 22 nt, Homo sapiens
ugaucucaacuuuucacugggg

SEQ ID NO: 8362 - RNA, 22 nt, Homo sapiens
uuucagaagaaaagaccgggau

SEQ ID NO: 8363 - RNA, 22 nt, Homo sapiens
aaaacaugcaaauuguuugaaa

SEQ ID NO: 8364 - RNA, 22 nt, Homo sapiens
ucagacaguuugcaagcgucaa

SEQ ID NO: 8365 - RNA, 22 nt, Homo sapiens
aaaucaugcugacagcauuuuc

SEQ ID NO: 8366 - RNA, 22 nt, Homo sapiens
aaugcugucaaagugauuugag

SEQ ID NO: 8367 - RNA, 22 nt, Homo sapiens
uacucugaucuuacugcuuauu

SEQ ID NO: 8368 - RNA, 22 nt, Homo sapiens
auaagaugagaauagagaugau

SEQ ID NO: 8369 - RNA, 22 nt, Homo sapiens
acagcuuagcuucugcagagcu

SEQ ID NO: 8370 - RNA, 22 nt, Homo sapiens
uuuugcagagguuaaggcugag

SEQ ID NO: 8371 - RNA, 22 nt, Homo sapiens
ucucuuuuaauauaguaaugug

SEQ ID NO: 8372 - RNA, 22 nt, Homo sapiens
uagcgguauuaggaaugagggc

SEQ ID NO: 8373 - RNA, 22 nt, Homo sapiens
aaauaaccuuguaauuaaacug

SEQ ID NO: 8374 - RNA, 22 nt, Homo sapiens
gaguaauuacaugguuauucgu

SEQ ID NO: 8375 - RNA, 22 nt, Homo sapiens
aggcauaaugucaaaguaaaaa

SEQ ID NO: 8376 - RNA, 22 nt, Homo sapiens
uuauuuuggcauuaugccauca

SEQ ID NO: 8377 - RNA, 22 nt, Homo sapiens
gauggguguguauucggggauc

SEQ ID NO: 8378 - RNA, 22 nt, Homo sapiens
uccccgaaucccagccuguuuu

SEQ ID NO: 8379 - RNA, 22 nt, Homo sapiens
ugauguauggaccaaaugaugu

SEQ ID NO: 8380 - RNA, 17 nt, Homo sapiens
ucauuucccauauauca

SEQ ID NO: 8381 - RNA, 22 nt, Homo sapiens
uacuacagguuguuggaguacu

SEQ ID NO: 8382 - RNA, 22 nt, Homo sapiens
aguagccagcaauaaguagugc

SEQ ID NO: 8383 - RNA, 22 nt, Homo sapiens
ggucuuagauagcuuguccugg

SEQ ID NO: 8384 - RNA, 22 nt, Homo sapiens
ggggagagcugugcggggcuug

SEQ ID NO: 8385 - RNA, 22 nt, Homo sapiens
acaugcauccuuucagaggguu

SEQ ID NO: 8386 - RNA, 21 nt, Homo sapiens
cucuagagggaagcacuuucu

SEQ ID NO: 8387 - RNA, 20 nt, Homo sapiens
ucuagagggaagcacuuucu

SEQ ID NO: 8388 - RNA, 21 nt, Homo sapiens
ucuagagggaagcacuuucug

SEQ ID NO: 8389 - RNA, 22 nt, Homo sapiens
uaugcagaugugaaacagauaa

SEQ ID NO: 8390 - RNA, 22 nt, Homo sapiens
ugauucuguugacauggcaugu

SEQ ID NO: 8391 - RNA, 22 nt, Homo sapiens
agagguugagagcauggauucu

SEQ ID NO: 8392 - RNA, 17 nt, Homo sapiens
guccugacucagccuuu

SEQ ID NO: 8393 - RNA, 22 nt, Homo sapiens
agagcccaguucgugucagggg

SEQ ID NO: 8394 - RNA, 22 nt, Homo sapiens
ccggcauagaaacugggccgag

SEQ ID NO: 8395 - RNA, 22 nt, Homo sapiens
agagcccaguucgugucagggg

SEQ ID NO: 8396 - RNA, 22 nt, Homo sapiens
ccggcauagaaacugggccgag

SEQ ID NO: 8397 - RNA, 22 nt, Homo sapiens
caucaagagaguggggagcaga

SEQ ID NO: 8398 - RNA, 22 nt, Homo sapiens
ugcucugcacucaacugauggu

SEQ ID NO: 8399 - RNA, 22 nt, Homo sapiens
gggagcagcuagaggggguccu

SEQ ID NO: 8400 - RNA, 20 nt, Homo sapiens
ggccucccggagcugcuccc

SEQ ID NO: 8401 - RNA, 22 nt, Homo sapiens
gggcuccucccuggggcccagc

SEQ ID NO: 8402 - RNA, 22 nt, Homo sapiens
gggagucucagagagccaagcc

SEQ ID NO: 8403 - RNA, 22 nt, Homo sapiens
gaucucagacagguggacaggg

SEQ ID NO: 8404 - RNA, 20 nt, Homo sapiens
uacuguuugggucugagguc

SEQ ID NO: 8405 - RNA, 22 nt, Homo sapiens
uaggccccaagucugggggguc

SEQ ID NO: 8406 - RNA, 22 nt, Homo sapiens
gagcuccugggccugguggagc

SEQ ID NO: 8407 - RNA, 22 nt, Homo sapiens
ucagucaaugggaaaugaugca

SEQ ID NO: 8408 - RNA, 22 nt, Homo sapiens
ucacacuucauuucccaucaau

SEQ ID NO: 8409 - RNA, 22 nt, Homo sapiens
cagcuguaguuugcuggugcuc

SEQ ID NO: 8410 - RNA, 22 nt, Homo sapiens
guacauuagcacugaugguugc

SEQ ID NO: 8411 - RNA, 22 nt, Homo sapiens
aguggagagauaagacugguaa

SEQ ID NO: 8412 - RNA, 21 nt, Homo sapiens
gcuggucuucccuuuccacug

SEQ ID NO: 8413 - RNA, 22 nt, Homo sapiens
uucccuuucauguggcugccug

SEQ ID NO: 8414 - RNA, 21 nt, Homo sapiens
gcggcucugccgaaggggggu

SEQ ID NO: 8415 - RNA, 22 nt, Homo sapiens
uggagggucauguucaggauca

SEQ ID NO: 8416 - RNA, 22 nt, Homo sapiens
ucugugcagaaugauccuuucc

SEQ ID NO: 8417 - RNA, 22 nt, Homo sapiens
aaugcucacuaacaguccaacg

SEQ ID NO: 8418 - RNA, 22 nt, Homo sapiens
uuggacugcagugugcauucag

SEQ ID NO: 8419 - RNA, 22 nt, Homo sapiens
uuguuuuauuugaggaacagac

SEQ ID NO: 8420 - RNA, 22 nt, Homo sapiens
uguuuuccuugcaagacaaggg

SEQ ID NO: 8421 - RNA, 22 nt, Homo sapiens
ucuagaguagugaagaagaacu

SEQ ID NO: 8422 - RNA, 22 nt, Homo sapiens
ucuucuucacugcucuagaugu

SEQ ID NO: 8423 - RNA, 22 nt, Homo sapiens
uuuucuauaugaacucuauuua

SEQ ID NO: 8424 - RNA, 22 nt, Homo sapiens
auggcguucuuauagaagaaug

SEQ ID NO: 8425 - RNA, 22 nt, Homo sapiens
aagggcaggaggguuggacaug

SEQ ID NO: 8426 - RNA, 22 nt, Homo sapiens
ggguuccuccuucuucucuuuu

SEQ ID NO: 8427 - RNA, 22 nt, Homo sapiens
ucgucuucccugcccaaggcug

SEQ ID NO: 8428 - RNA, 21 nt, Homo sapiens
ugucugggcaagggagauggc

SEQ ID NO: 8429 - RNA, 22 nt, Homo sapiens
aaguguccuuuugggggaccuu

SEQ ID NO: 8430 - RNA, 22 nt, Homo sapiens
agacccucaaaaggacucuccu

SEQ ID NO: 8431 - RNA, 22 nt, Homo sapiens
ugaaggagugauauuuguuguu

SEQ ID NO: 8432 - RNA, 22 nt, Homo sapiens
ccacaaacaugucccuuugaga

SEQ ID NO: 8433 - RNA, 22 nt, Homo sapiens
gggguacaauuagccucuggcg

SEQ ID NO: 8434 - RNA, 22 nt, Homo sapiens
cuggugacuaauuaugcccuca

SEQ ID NO: 8435 - RNA, 22 nt, Homo sapiens
agaacucccuauaucccagauu

SEQ ID NO: 8436 - RNA, 22 nt, Homo sapiens
uugggguauggggagaucuuuu

SEQ ID NO: 8437 - RNA, 22 nt, Homo sapiens
caagaaagcacuuuugccucau

SEQ ID NO: 8438 - RNA, 22 nt, Homo sapiens
cggugaauguggguuuuuaguc

SEQ ID NO: 8439 - RNA, 22 nt, Homo sapiens
ccgccucuguuauuauaaguug

SEQ ID NO: 8440 - RNA, 22 nt, Homo sapiens
cuuacgagaccagagccggcag

SEQ ID NO: 8441 - RNA, 22 nt, Homo sapiens
ugcaucaaucaauagggcuuuu

SEQ ID NO: 8442 - RNA, 22 nt, Homo sapiens
gcccugaagauugauguggaag

SEQ ID NO: 8443 - RNA, 22 nt, Homo sapiens
cagaccuggcaucuugaaaguc

SEQ ID NO: 8444 - RNA, 22 nt, Homo sapiens
gucuguuuucuuguguuaguuu

SEQ ID NO: 8445 - RNA, 22 nt, Homo sapiens
uagguaugcagccuauuugcca

SEQ ID NO: 8446 - RNA, 22 nt, Homo sapiens
uuagaguuugguuauauaccua

SEQ ID NO: 8447 - RNA, 22 nt, Homo sapiens
uuacuucuucagggcuuccauu

SEQ ID NO: 8448 - RNA, 22 nt, Homo sapiens
aguacaaggaaggcugagaaaa

SEQ ID NO: 8449 - RNA, 22 nt, Homo sapiens
ggaaggccagaggaggggaagg

SEQ ID NO: 8450 - RNA, 22 nt, Homo sapiens
uccuuucuccugcccuuuccca

SEQ ID NO: 8451 - RNA, 22 nt, Homo sapiens
ugagagccuauauucauuaaag

SEQ ID NO: 8452 - RNA, 22 nt, Homo sapiens
aggauaaugaguaauaggugau

SEQ ID NO: 8453 - RNA, 22 nt, Homo sapiens
ucccagaucccagccugcagaa

SEQ ID NO: 8454 - RNA, 22 nt, Homo sapiens
ugacagguugggauauggaaug

SEQ ID NO: 8455 - RNA, 22 nt, Homo sapiens
uaauuccuaggcaauauuuaga

SEQ ID NO: 8456 - RNA, 22 nt, Homo sapiens
uuuagaauuggcugagaauuau

SEQ ID NO: 8457 - RNA, 22 nt, Homo sapiens
uucaaaugaagaguucagugau

SEQ ID NO: 8458 - RNA, 22 nt, Homo sapiens
uacugaccucauccuugaaacc

SEQ ID NO: 8459 - RNA, 22 nt, Homo sapiens
aaggcgauggggaaauguaggc

SEQ ID NO: 8460 - RNA, 22 nt, Homo sapiens
cgcugcuguuucugcaccuccc

SEQ ID NO: 8461 - RNA, 22 nt, Homo sapiens
cucagcagggugaaggggauuu

SEQ ID NO: 8462 - RNA, 22 nt, Homo sapiens
ucuccuuccucugccacgacuu

SEQ ID NO: 8463 - RNA, 22 nt, Homo sapiens
agcucagggaggcauuugucau

SEQ ID NO: 8464 - RNA, 22 nt, Homo sapiens
ugagaugcucugcccugaguac

SEQ ID NO: 8465 - RNA, 22 nt, Homo sapiens
gccccccuuccccgguguacau

SEQ ID NO: 8466 - RNA, 22 nt, Homo sapiens
uauauuccagaggguagggccg

SEQ ID NO: 8467 - RNA, 22 nt, Homo sapiens
gucuuagcccugaaccucucac

SEQ ID NO: 8468 - RNA, 22 nt, Homo sapiens
gcuagagaggugggggaagaga

SEQ ID NO: 8469 - RNA, 22 nt, Homo sapiens
gagaugagacuaacaaucguug

SEQ ID NO: 8470 - RNA, 22 nt, Homo sapiens
acaugacuguugucugucuuua

SEQ ID NO: 8471 - RNA, 22 nt, Homo sapiens
gccugguuuccccuuuuuuugu

SEQ ID NO: 8472 - RNA, 22 nt, Homo sapiens
auggaagaggggaggcucagga

SEQ ID NO: 8473 - RNA, 22 nt, Homo sapiens
cagaggggccuggcacugagcu

SEQ ID NO: 8474 - RNA, 22 nt, Homo sapiens
ccugcuggcccaggccccuugc

SEQ ID NO: 8475 - RNA, 22 nt, Homo sapiens
uucacaggugaguuuguguucc

SEQ ID NO: 8476 - RNA, 22 nt, Homo sapiens
acaugagcucccugaaagagaa

SEQ ID NO: 8477 - RNA, 22 nt, Homo sapiens
ugugugauugcaggagaugugg

SEQ ID NO: 8478 - RNA, 22 nt, Homo sapiens
cugccuccccaucaguuauaca

SEQ ID NO: 8479 - RNA, 22 nt, Homo sapiens
ugacaauaauaauagaugagug

SEQ ID NO: 8480 - RNA, 22 nt, Homo sapiens
uacagguuuaucauuaauauua

SEQ ID NO: 8481 - RNA, 22 nt, Homo sapiens
uuuucaaucagcucaauggaau

SEQ ID NO: 8482 - RNA, 22 nt, Homo sapiens
auucauugauugaaaagagcag

SEQ ID NO: 8483 - RNA, 22 nt, Homo sapiens
uuccuucuaaaagcugaaggcu

SEQ ID NO: 8484 - RNA, 22 nt, Homo sapiens
uucaacuuuuagaaggaaucag

SEQ ID NO: 8485 - RNA, 22 nt, Homo sapiens
uuuuucaauauucugaaauaga

SEQ ID NO: 8486 - RNA, 22 nt, Homo sapiens
gacuaauuucagaguuaaagag

SEQ ID NO: 8487 - RNA, 22 nt, Homo sapiens
uuacaauuuaaaagcauaggug

SEQ ID NO: 8488 - RNA, 22 nt, Homo sapiens
ccuaugccuuuugaccauaauc

SEQ ID NO: 8489 - RNA, 22 nt, Homo sapiens
ugauggagccaguuuugaggca

SEQ ID NO: 8490 - RNA, 22 nt, Homo sapiens
uuuuaaauugaaucuuccagcu

SEQ ID NO: 8491 - RNA, 22 nt, Homo sapiens
aauccugaagcuuaauuuuugc

SEQ ID NO: 8492 - RNA, 22 nt, Homo sapiens
cagaaauuggcucucacauucc

SEQ ID NO: 8493 - RNA, 22 nt, Homo sapiens
aaacguggauauuccuucuaug

SEQ ID NO: 8494 - RNA, 22 nt, Homo sapiens
uagaggaaaauccauguuuuca

SEQ ID NO: 8495 - RNA, 22 nt, Homo sapiens
cauccuccccacuccucccacc

SEQ ID NO: 8496 - RNA, 22 nt, Homo sapiens
ugggaagguagggaggagagac

SEQ ID NO: 8497 - RNA, 22 nt, Homo sapiens
gcuccaaagucggggcggguug

SEQ ID NO: 8498 - RNA, 22 nt, Homo sapiens
cccugcucuggacuccuggcuc

SEQ ID NO: 8499 - RNA, 22 nt, Homo sapiens
ugcucuauaccuggguuuguuc

SEQ ID NO: 8500 - RNA, 16 nt, Homo sapiens
aaaccuuauaggguag

SEQ ID NO: 8501 - RNA, 22 nt, Homo sapiens
guugcuuugagauuuacauuag

SEQ ID NO: 8502 - RNA, 22 nt, Homo sapiens
uaaguaaaaucucagagugugc

SEQ ID NO: 8503 - RNA, 22 nt, Homo sapiens
ugcuuccuccccuuagaaaguc

SEQ ID NO: 8504 - RNA, 20 nt, Homo sapiens
uuuucccuaaggaggaagca

SEQ ID NO: 8505 - RNA, 22 nt, Homo sapiens
gccugauuucccuuagggcccc

SEQ ID NO: 8506 - RNA, 20 nt, Homo sapiens
gaucugccuagaagucaggc

SEQ ID NO: 8507 - RNA, 22 nt, Homo sapiens
uuccggggcccgguagaggcgc

SEQ ID NO: 8508 - RNA, 16 nt, Homo sapiens
ugcggcggcccuggaa

SEQ ID NO: 8509 - RNA, 22 nt, Homo sapiens
uguuugccgcgacguacugagu

SEQ ID NO: 8510 - RNA, 22 nt, Homo sapiens
uggaguaugucagcagacauuc

SEQ ID NO: 8511 - RNA, 22 nt, Homo sapiens
uaugugcccacuuauaugcugc

SEQ ID NO: 8512 - RNA, 17 nt, Homo sapiens
auguacuuggguauaua

SEQ ID NO: 8513 - RNA, 22 nt, Homo sapiens
ggagccgcugcuguggaaugac

SEQ ID NO: 8514 - RNA, 15 nt, Homo sapiens
uccaccaguggcucu

SEQ ID NO: 8515 - RNA, 22 nt, Homo sapiens
cccugggcgcucagcaguucug

SEQ ID NO: 8516 - RNA, 22 nt, Homo sapiens
aggagcugggcagccugagggu

SEQ ID NO: 8517 - RNA, 22 nt, Homo sapiens
aauucuucaacucugugaugaa

SEQ ID NO: 8518 - RNA, 22 nt, Homo sapiens
aucacuuacuaggauugaagaa

SEQ ID NO: 8519 - RNA, 22 nt, Homo sapiens
ccuggucaaacuucaagcuucc

SEQ ID NO: 8520 - RNA, 20 nt, Homo sapiens
gaaacggauauuuggccagg

SEQ ID NO: 8521 - RNA, 22 nt, Homo sapiens
uuagauuacaggguaccuaaga

SEQ ID NO: 8522 - RNA, 22 nt, Homo sapiens
cacuagguaccuaguaauuuaa

SEQ ID NO: 8523 - RNA, 22 nt, Homo sapiens
aauacaguuugauacauaauag

SEQ ID NO: 8524 - RNA, 22 nt, Homo sapiens
ugcuaugugccagccuguguuc

SEQ ID NO: 8525 - RNA, 22 nt, Homo sapiens
uccuuugccaccaguguucuca

SEQ ID NO: 8526 - RNA, 22 nt, Homo sapiens
gagaagaucagaggugaagggu

SEQ ID NO: 8527 - RNA, 22 nt, Homo sapiens
ucacugcugaguagaaaucuuu

SEQ ID NO: 8528 - RNA, 22 nt, Homo sapiens
gaccucugcuauagcacuguca

SEQ ID NO: 8529 - RNA, 22 nt, Homo sapiens
ccugggacucugaauccagcug

SEQ ID NO: 8530 - RNA, 22 nt, Homo sapiens
gcuagaucacacucccagggcu

SEQ ID NO: 8531 - RNA, 22 nt, Homo sapiens
uuauggugacucugguguguua

SEQ ID NO: 8532 - RNA, 21 nt, Homo sapiens
acacccauaucucaccaugac

SEQ ID NO: 8533 - RNA, 22 nt, Homo sapiens
cugauaugaguguggagauucc

SEQ ID NO: 8534 - RNA, 22 nt, Homo sapiens
agcuucacgcuuggaucuucuc

SEQ ID NO: 8535 - RNA, 22 nt, Homo sapiens
aguucuucuccuuaggucccuu

SEQ ID NO: 8536 - RNA, 20 nt, Homo sapiens
aaggcuaccugggaagagcu

SEQ ID NO: 8537 - RNA, 22 nt, Homo sapiens
gagcccgcacgcugcucccggg

SEQ ID NO: 8538 - RNA, 19 nt, Homo sapiens
cgggagcaggugugggcuc

SEQ ID NO: 8539 - RNA, 22 nt, Homo sapiens
uagggauaagguucugaugugc

SEQ ID NO: 8540 - RNA, 22 nt, Homo sapiens
auagugaccguuagagacuuau

SEQ ID NO: 8541 - RNA, 22 nt, Homo sapiens
gggacugggggauggugggaag

SEQ ID NO: 8542 - RNA, 19 nt, Homo sapiens
ucccgccauccccaguccc

SEQ ID NO: 8543 - RNA, 22 nt, Homo sapiens
uguuccucagcauucucuguaa

SEQ ID NO: 8544 - RNA, 22 nt, Homo sapiens
augggagugcuugaggaugaaa

SEQ ID NO: 8545 - RNA, 17 nt, Homo sapiens
agcugguguugugaauc

SEQ ID NO: 8546 - RNA, 22 nt, Homo sapiens
ggcuacuucacaacaccagggc

SEQ ID NO: 8547 - RNA, 21 nt, Homo sapiens
gcuacuucacaacaccagggc

SEQ ID NO: 8548 - RNA, 22 nt, Homo sapiens
ucucuugcacucuggagacuga

SEQ ID NO: 8549 - RNA, 22 nt, Homo sapiens
gucuucggcaauggaggagaug

SEQ ID NO: 8550 - RNA, 22 nt, Homo sapiens
agccagggccaguccugagggu

SEQ ID NO: 8551 - RNA, 22 nt, Homo sapiens
cccagguacuccgggccugguc

SEQ ID NO: 8552 - RNA, 22 nt, Homo sapiens
gggguccucaguuuccccaucc

SEQ ID NO: 8553 - RNA, 19 nt, Homo sapiens
uggguugggugaggaucuc

SEQ ID NO: 8554 - RNA, 22 nt, Homo sapiens
uuauugguuuaauuauagaaag

SEQ ID NO: 8555 - RNA, 22 nt, Homo sapiens
ucuuuaauugagcauggauaau

SEQ ID NO: 8556 - RNA, 22 nt, Homo sapiens
aggagguagggaggggucuguc

SEQ ID NO: 8557 - RNA, 21 nt, Homo sapiens
caagaucucggcuugcuuccu

SEQ ID NO: 8558 - RNA, 22 nt, Homo sapiens
uacucugauuucggacuucagu

SEQ ID NO: 8559 - RNA, 22 nt, Homo sapiens
ugaagucccaaacuggagugga

SEQ ID NO: 8560 - RNA, 22 nt, Homo sapiens
uuugaggucaccaagguaccau

SEQ ID NO: 8561 - RNA, 22 nt, Homo sapiens
ugguaccuaguagccaggaaga

SEQ ID NO: 8562 - RNA, 22 nt, Homo sapiens
ccucuccucagucgggaaggau

SEQ ID NO: 8563 - RNA, 22 nt, Homo sapiens
uuuuccacuugagaagaggcug

SEQ ID NO: 8564 - RNA, 22 nt, Homo sapiens
cggccaaggagaaggggggugu

SEQ ID NO: 8565 - RNA, 22 nt, Homo sapiens
ccccccuuccccagggcccuag

SEQ ID NO: 8566 - RNA, 22 nt, Homo sapiens
uccggcuugcgugaucacugcc

SEQ ID NO: 8567 - RNA, 22 nt, Homo sapiens
aaguggggagugggcaagcggg

SEQ ID NO: 8568 - RNA, 22 nt, Homo sapiens
agccccugcccaccgcacacug

SEQ ID NO: 8569 - RNA, 22 nt, Homo sapiens
cugugcgugugacagcggcuga

SEQ ID NO: 8570 - RNA, 22 nt, Homo sapiens
ggagguuuacaauguauaguuu

SEQ ID NO: 8571 - RNA, 22 nt, Homo sapiens
cuaaauauugugaacauuuucu

SEQ ID NO: 8572 - RNA, 22 nt, Homo sapiens
uaagauggaugaaauaaccaua

SEQ ID NO: 8573 - RNA, 22 nt, Homo sapiens
ugguuauuucaguaaucuuaau

SEQ ID NO: 8574 - RNA, 22 nt, Homo sapiens
uccuuaucacugggccucacuu

SEQ ID NO: 8575 - RNA, 22 nt, Homo sapiens
uugggcuccaguccuaaggaaa

SEQ ID NO: 8576 - RNA, 22 nt, Homo sapiens
ugaaugggaucaaaaaggcuca

SEQ ID NO: 8577 - RNA, 22 nt, Homo sapiens
ugagucuuucugaucccauucc

SEQ ID NO: 8578 - RNA, 22 nt, Homo sapiens
aggacacgggccugagggcuga

SEQ ID NO: 8579 - RNA, 22 nt, Homo sapiens
ugaggcuggagccugugucccc

SEQ ID NO: 8580 - RNA, 22 nt, Homo sapiens
gguggccaggugcauaucuugg

SEQ ID NO: 8581 - RNA, 22 nt, Homo sapiens
ugggaaugccuacugguuaccu

SEQ ID NO: 8582 - RNA, 22 nt, Homo sapiens
gguggccaggugcauaucuugg

SEQ ID NO: 8583 - RNA, 22 nt, Homo sapiens
ugggaaugccuacugguuaccu

SEQ ID NO: 8584 - RNA, 22 nt, Homo sapiens
uuuccacuguaaauucaggcug

SEQ ID NO: 8585 - RNA, 20 nt, Homo sapiens
ucugggugcaaguggagggu

SEQ ID NO: 8586 - RNA, 22 nt, Homo sapiens
uagcuggguguagggggcuuuu

SEQ ID NO: 8587 - RNA, 22 nt, Homo sapiens
ucugcccccuggucuagcuauc

SEQ ID NO: 8588 - RNA, 22 nt, Homo sapiens
uucagucucaguauuauugaca

SEQ ID NO: 8589 - RNA, 22 nt, Homo sapiens
ugaauaguguugagauugagaa

SEQ ID NO: 8590 - RNA, 22 nt, Homo sapiens
uggagggagggaggaagggccu

SEQ ID NO: 8591 - RNA, 22 nt, Homo sapiens
ggccccuccuccugggcccucc

SEQ ID NO: 8592 - RNA, 22 nt, Homo sapiens
cacaauaaauguuugcugauga

SEQ ID NO: 8593 - RNA, 22 nt, Homo sapiens
aucuaauaaacauuuacugagg

SEQ ID NO: 8594 - RNA, 22 nt, Homo sapiens
ugagcguggguuggggacuggg

SEQ ID NO: 8595 - RNA, 20 nt, Homo sapiens
cagauuccugccaugcuugc

SEQ ID NO: 8596 - RNA, 22 nt, Homo sapiens
uuaaguacuauuguucaguuua

SEQ ID NO: 8597 - RNA, 22 nt, Homo sapiens
gcuaaacaauaguacuugacau

SEQ ID NO: 8598 - RNA, 22 nt, Homo sapiens
acuauacaacuuacuacuuucc

SEQ ID NO: 8599 - RNA, 22 nt, Homo sapiens
ugagguaguaaguuguauuguu

SEQ ID NO: 8600 - RNA, 22 nt, Homo sapiens
ucaaauuaaaucaagacuauuu

SEQ ID NO: 8601 - RNA, 22 nt, Homo sapiens
aagaaucuugauuuguuugaga

SEQ ID NO: 8602 - RNA, 22 nt, Homo sapiens
uucaguacuuaugggcauguuu

SEQ ID NO: 8603 - RNA, 22 nt, Homo sapiens
auaugucuggaguuacugagcu

SEQ ID NO: 8604 - RNA, 22 nt, Homo sapiens
ucuguucauuugccucggcucu

SEQ ID NO: 8605 - RNA, 22 nt, Homo sapiens
aguggaaggaaaaagagcagau

SEQ ID NO: 8606 - RNA, 22 nt, Homo sapiens
uaggcugggcuggggcugcacu

SEQ ID NO: 8607 - RNA, 20 nt, Homo sapiens
uuuagucucuguccagccug

SEQ ID NO: 8608 - RNA, 22 nt, Homo sapiens
uccucucugggcacuggccuau

SEQ ID NO: 8609 - RNA, 22 nt, Homo sapiens
ccuccagugugcuagggugggg

SEQ ID NO: 8610 - RNA, 22 nt, Homo sapiens
gaggggucucugccucuaccca

SEQ ID NO: 8611 - RNA, 15 nt, Homo sapiens
aggcugaggccccuc

SEQ ID NO: 8612 - RNA, 22 nt, Homo sapiens
ggcugccuccaccacaaucaga

SEQ ID NO: 8613 - RNA, 22 nt, Homo sapiens
ucucaucaugguggggcagccc

SEQ ID NO: 8614 - RNA, 22 nt, Homo sapiens
uuaauuuuaucuauuuaugaau

SEQ ID NO: 8615 - RNA, 22 nt, Homo sapiens
uauaaauaguaaugcuaacugu

SEQ ID NO: 8616 - RNA, 22 nt, Homo sapiens
ugaagccgagaguugaguggcc

SEQ ID NO: 8617 - RNA, 22 nt, Homo sapiens
uugcucauaccuuguuucuuuc

SEQ ID NO: 8618 - RNA, 22 nt, Homo sapiens
ugcugccgaggcuucuagcagg

SEQ ID NO: 8619 - RNA, 22 nt, Homo sapiens
gccugaaggcugcggccgcgga

SEQ ID NO: 8620 - RNA, 22 nt, Homo sapiens
uuggaggucucugugguggugg

SEQ ID NO: 8621 - RNA, 22 nt, Homo sapiens
ucagccaaagaguccuucagcu

SEQ ID NO: 8622 - RNA, 22 nt, Homo sapiens
uagacuacgcucacacuagacc

SEQ ID NO: 8623 - RNA, 22 nt, Homo sapiens
gcccugugugaagguagcucuu

SEQ ID NO: 8624 - RNA, 22 nt, Homo sapiens
gaggguagguucuguugguuga

SEQ ID NO: 8625 - RNA, 19 nt, Homo sapiens
cuaauuaguaccuacccuu

SEQ ID NO: 8626 - RNA, 22 nt, Homo sapiens
gagugaaggaagucaaaggaau

SEQ ID NO: 8627 - RNA, 22 nt, Homo sapiens
uucauuuaauaucucuccuccc

SEQ ID NO: 8628 - RNA, 22 nt, Homo sapiens
cagaagaaugcggacugaagaa

SEQ ID NO: 8629 - RNA, 22 nt, Homo sapiens
uuuuucccccgcuuccuccuau

SEQ ID NO: 8630 - RNA, 22 nt, Homo sapiens
gaggcaggugcgagaugagccc

SEQ ID NO: 8631 - RNA, 22 nt, Homo sapiens
gcacucaucuggcucugucucu

SEQ ID NO: 8632 - RNA, 22 nt, Homo sapiens
ugagcugggggugggcagaggc

SEQ ID NO: 8633 - RNA, 22 nt, Homo sapiens
uggggcgcccgccuugagguuu

SEQ ID NO: 8634 - RNA, 22 nt, Homo sapiens
uuguuuccauggugacagcagc

SEQ ID NO: 8635 - RNA, 19 nt, Homo sapiens
ugguugcuuuggaaacgag

SEQ ID NO: 8636 - RNA, 22 nt, Homo sapiens
uauaaugaaugugaaaaucagc

SEQ ID NO: 8637 - RNA, 22 nt, Homo sapiens
uacaugguacaaucacuuuguu

SEQ ID NO: 8638 - RNA, 22 nt, Homo sapiens
ucagagauuucaaagggaggca

SEQ ID NO: 8639 - RNA, 22 nt, Homo sapiens
ucucuucuuuggaccuuucuga

SEQ ID NO: 8640 - RNA, 22 nt, Homo sapiens
gccggaggugccauugacccug

SEQ ID NO: 8641 - RNA, 22 nt, Homo sapiens
gucugauggcuuccucuggccg

SEQ ID NO: 8642 - RNA, 22 nt, Homo sapiens
ccauucuuuuggaguugcuuaa

SEQ ID NO: 8643 - RNA, 22 nt, Homo sapiens
gucagcaaguucagagaagguu

SEQ ID NO: 8644 - RNA, 22 nt, Homo sapiens
ggggggaggcuggaaauguucu

SEQ ID NO: 8645 - RNA, 22 nt, Homo sapiens
agcagcuuccuuugucucccuc

SEQ ID NO: 8646 - RNA, 22 nt, Homo sapiens
uuaagauuacugaaauaaccag

SEQ ID NO: 8647 - RNA, 22 nt, Homo sapiens
guuauuucauccaucuuaauga

SEQ ID NO: 8648 - RNA, 22 nt, Homo sapiens
ucugucaaauaucaugcucuuu

SEQ ID NO: 8649 - RNA, 22 nt, Homo sapiens
agcauuauguuugaacagaugg

SEQ ID NO: 8650 - RNA, 22 nt, Homo sapiens
ggggagguucuagagggacagg

SEQ ID NO: 8651 - RNA, 20 nt, Homo sapiens
uccuguuccugaaccuuccc

SEQ ID NO: 8652 - RNA, 22 nt, Homo sapiens
uguucuccuaggucccacugaa

SEQ ID NO: 8653 - RNA, 22 nt, Homo sapiens
acggcgguguggaggagaauau

SEQ ID NO: 8654 - RNA, 22 nt, Homo sapiens
ugaggcagaggugggaaucaca

SEQ ID NO: 8655 - RNA, 22 nt, Homo sapiens
uaugguuucuacuuuucucuuu

SEQ ID NO: 8656 - RNA, 22 nt, Homo sapiens
uuucacuuuucagccaccuccu

SEQ ID NO: 8657 - RNA, 17 nt, Homo sapiens
guugguuaaagugaaag

SEQ ID NO: 8658 - RNA, 22 nt, Homo sapiens
ugguugcaucuguuuugauguu

SEQ ID NO: 8659 - RNA, 22 nt, Homo sapiens
cauaaucaaauacaagugcagc

SEQ ID NO: 8660 - RNA, 22 nt, Homo sapiens
ugugugccauguauguguguga

SEQ ID NO: 8661 - RNA, 22 nt, Homo sapiens
uuacaugcaugccugccacaug

SEQ ID NO: 8662 - RNA, 22 nt, Homo sapiens
ggauucagagaaggaauggaua

SEQ ID NO: 8663 - RNA, 22 nt, Homo sapiens
ucuuuauucuuucauuauucuc

SEQ ID NO: 8664 - RNA, 22 nt, Homo sapiens
uacuccuuccuuccucaccaug

SEQ ID NO: 8665 - RNA, 22 nt, Homo sapiens
ccugugcugggaacuaggggua

SEQ ID NO: 8666 - RNA, 22 nt, Homo sapiens
acggauguuugagcaugugcua

SEQ ID NO: 8667 - RNA, 20 nt, Homo sapiens
ucaaaugcucagacuccugu

SEQ ID NO: 8668 - RNA, 22 nt, Homo sapiens
ggggaugggaggguggcgcgug

SEQ ID NO: 8669 - RNA, 22 nt, Homo sapiens
gccuggcgcccucuuuccccac

SEQ ID NO: 8670 - RNA, 22 nt, Homo sapiens
ugauguauauaagacaucuagu

SEQ ID NO: 8671 - RNA, 22 nt, Homo sapiens
uagcugguaucauauauguguc

SEQ ID NO: 8672 - RNA, 22 nt, Homo sapiens
uaugcaagauucccuucuaccu

SEQ ID NO: 8673 - RNA, 23 nt, Homo sapiens
aguggggaacccuuccaugagga

SEQ ID NO: 8674 - RNA, 22 nt, Homo sapiens
cauccuugccccgguacaaugu

SEQ ID NO: 8675 - RNA, 22 nt, Homo sapiens
cccugaacucaugggguggggg

SEQ ID NO: 8676 - RNA, 22 nt, Homo sapiens
ggcugaggcugcaguacccacc

SEQ ID NO: 8677 - RNA, 21 nt, Homo sapiens
ggagggagcuggcuucggcuc

SEQ ID NO: 8678 - RNA, 22 nt, Homo sapiens
gcucugagaauaaagugaggga

SEQ ID NO: 8679 - RNA, 22 nt, Homo sapiens
ucacccucauuuuuuggaguca

SEQ ID NO: 8680 - RNA, 22 nt, Homo sapiens
aauggaagguuggugguggagg

SEQ ID NO: 8681 - RNA, 19 nt, Homo sapiens
uugcugcugauuuuucauu

SEQ ID NO: 8682 - RNA, 22 nt, Homo sapiens
uggaucaguggccaccacggag

SEQ ID NO: 8683 - RNA, 22 nt, Homo sapiens
uagcuguagcaucugauccacu

SEQ ID NO: 8684 - RNA, 22 nt, Homo sapiens
ggcuucagauugcuuaaugcuc

SEQ ID NO: 8685 - RNA, 17 nt, Homo sapiens
ucuagugaucugaaguc

SEQ ID NO: 8686 - RNA, 22 nt, Homo sapiens
ugaccagcuaggaggaguugau

SEQ ID NO: 8687 - RNA, 22 nt, Homo sapiens
ccauuaacucuagccagucauu

SEQ ID NO: 8688 - RNA, 22 nt, Homo sapiens
acaguuucuuuucuuuugucgu

SEQ ID NO: 8689 - RNA, 21 nt, Homo sapiens
cuugggaaggggagaagcugu

SEQ ID NO: 8690 - RNA, 22 nt, Homo sapiens
ucccccuuugguuucuccuagc

SEQ ID NO: 8691 - RNA, 22 nt, Homo sapiens
cugggagggcuguugggggagg

SEQ ID NO: 8692 - RNA, 22 nt, Homo sapiens
uuccaguuucucuuacugauau

SEQ ID NO: 8693 - RNA, 22 nt, Homo sapiens
uauuagagaugguuacuguuaa

SEQ ID NO: 8694 - RNA, 22 nt, Homo sapiens
uuguuucuauugaaugcauuuc

SEQ ID NO: 8695 - RNA, 22 nt, Homo sapiens
aagggcauuccuauaggacuuu

SEQ ID NO: 8696 - RNA, 22 nt, Homo sapiens
gggauuagggucugggcuggaa

SEQ ID NO: 8697 - RNA, 20 nt, Homo sapiens
caguucagacucuugauccc

SEQ ID NO: 8698 - RNA, 22 nt, Homo sapiens
ucuuguucucuggaaauccccu

SEQ ID NO: 8699 - RNA, 17 nt, Homo sapiens
uuucuagcagggcagga

SEQ ID NO: 8700 - RNA, 22 nt, Homo sapiens
uuuuguucaguccgucaucauu

SEQ ID NO: 8701 - RNA, 22 nt, Homo sapiens
aaugcugagcugagcaaugagg

SEQ ID NO: 8702 - RNA, 22 nt, Homo sapiens
gauaggcuuaauuuuccuguca

SEQ ID NO: 8703 - RNA, 17 nt, Homo sapiens
gaaaguucaagcuuguc

SEQ ID NO: 8704 - RNA, 22 nt, Homo sapiens
uuucuuccuuuuucuuuuuggc

SEQ ID NO: 8705 - RNA, 22 nt, Homo sapiens
cagugaccugaagaagauggga

SEQ ID NO: 8706 - RNA, 22 nt, Homo sapiens
uguguucagguucagaggucug

SEQ ID NO: 8707 - RNA, 22 nt, Homo sapiens
ggucuuugcccuggauauuaga

SEQ ID NO: 8708 - RNA, 22 nt, Homo sapiens
ucacucuccuuucucccaucuc

SEQ ID NO: 8709 - RNA, 22 nt, Homo sapiens
gaaugaagagaggcagaguggg

SEQ ID NO: 8710 - RNA, 22 nt, Homo sapiens
ucuugaccuccugggacaguuc

SEQ ID NO: 8711 - RNA, 22 nt, Homo sapiens
caggggucaggcaggaggcuca

SEQ ID NO: 8712 - RNA, 22 nt, Homo sapiens
gagagggccuuaugccgcugua

SEQ ID NO: 8713 - RNA, 22 nt, Homo sapiens
uaaugguccagggucacuuuuu

SEQ ID NO: 8714 - RNA, 22 nt, Homo sapiens
uagauuugcaugcuuauaacau

SEQ ID NO: 8715 - RNA, 22 nt, Homo sapiens
cuuauaauauguauaaucuacu

SEQ ID NO: 8716 - RNA, 22 nt, Homo sapiens
cauaagcuagccugccugcaca

SEQ ID NO: 8717 - RNA, 22 nt, Homo sapiens
cagaaaggcuggccuauaugca

SEQ ID NO: 8718 - RNA, 22 nt, Homo sapiens
caauccuguacuuugaaaugau

SEQ ID NO: 8719 - RNA, 22 nt, Homo sapiens
aacauucaaagcaggaugugug

SEQ ID NO: 8720 - RNA, 22 nt, Homo sapiens
ucuguguuuucuuaccacugug

SEQ ID NO: 8721 - RNA, 22 nt, Homo sapiens
aauggcugggacacacuaggca

SEQ ID NO: 8722 - RNA, 22 nt, Homo sapiens
uaacacccuaagccauuagguc

SEQ ID NO: 8723 - RNA, 20 nt, Homo sapiens
cuaaaggcuucaggguguua

SEQ ID NO: 8724 - RNA, 22 nt, Homo sapiens
ugccagguggggagaggccagg

SEQ ID NO: 8725 - RNA, 22 nt, Homo sapiens
ccugccugccccgcccuggcag

SEQ ID NO: 8726 - RNA, 22 nt, Homo sapiens
uuucugcaugcacuggguguca

SEQ ID NO: 8727 - RNA, 22 nt, Homo sapiens
ugccucaugugcugugcuggga

SEQ ID NO: 8728 - RNA, 22 nt, Homo sapiens
cgcccgaugaagaagaucccag

SEQ ID NO: 8729 - RNA, 22 nt, Homo sapiens
uggaucucuuggguaucggggu

SEQ ID NO: 8730 - RNA, 22 nt, Homo sapiens
cgcccgaugaagaagaucccag

SEQ ID NO: 8731 - RNA, 22 nt, Homo sapiens
uggaucucuuggguaucggggu

SEQ ID NO: 8732 - RNA, 22 nt, Homo sapiens
cgcccgaugaagaagaucccag

SEQ ID NO: 8733 - RNA, 22 nt, Homo sapiens
uggaucucuuggguaucggggu

SEQ ID NO: 8734 - RNA, 22 nt, Homo sapiens
cgcccgaugaagaagaucccag

SEQ ID NO: 8735 - RNA, 22 nt, Homo sapiens
uggaucucuuggguaucggggu

SEQ ID NO: 8736 - RNA, 22 nt, Homo sapiens
cgcccgaugaagaagaucccag

SEQ ID NO: 8737 - RNA, 22 nt, Homo sapiens
uggaucucuuggguaucggggu

SEQ ID NO: 8738 - RNA, 22 nt, Homo sapiens
cgcccgaugaagaagaucccag

SEQ ID NO: 8739 - RNA, 22 nt, Homo sapiens
uggaucucuuggguaucggggu

SEQ ID NO: 8740 - RNA, 22 nt, Homo sapiens
cgcccgaugaagaagaucccag

SEQ ID NO: 8741 - RNA, 22 nt, Homo sapiens
uggaucucuuggguaucggggu

SEQ ID NO: 8742 - RNA, 22 nt, Homo sapiens
cgcccgaugaagaagaucccag

SEQ ID NO: 8743 - RNA, 22 nt, Homo sapiens
uggaucucuuggguaucggggu

SEQ ID NO: 8744 - RNA, 22 nt, Homo sapiens
cgcccgaugaagaagaucccag

SEQ ID NO: 8745 - RNA, 22 nt, Homo sapiens
uggaucucuuggguaucggggu

SEQ ID NO: 8746 - RNA, 22 nt, Homo sapiens
cgcccgaugaagaagaucccag

SEQ ID NO: 8747 - RNA, 22 nt, Homo sapiens
uggaucucuuggguaucggggu

SEQ ID NO: 8748 - RNA, 22 nt, Homo sapiens
cgcccgaugaagaagaucccag

SEQ ID NO: 8749 - RNA, 22 nt, Homo sapiens
uggaucucuuggguaucggggu

SEQ ID NO: 8750 - RNA, 22 nt, Homo sapiens
cgcccgaugaagaagaucccag

SEQ ID NO: 8751 - RNA, 22 nt, Homo sapiens
uggaucucuuggguaucggggu

SEQ ID NO: 8752 - RNA, 22 nt, Homo sapiens
cgcccgaugaagaagaucccag

SEQ ID NO: 8753 - RNA, 22 nt, Homo sapiens
uggaucucuuggguaucggggu

SEQ ID NO: 8754 - RNA, 22 nt, Homo sapiens
cgcccgaugaagaagaucccag

SEQ ID NO: 8755 - RNA, 22 nt, Homo sapiens
uggaucucuuggguaucggggu

SEQ ID NO: 8756 - RNA, 22 nt, Homo sapiens
cgcccgaugaagaagaucccag

SEQ ID NO: 8757 - RNA, 22 nt, Homo sapiens
uggaucucuuggguaucggggu

SEQ ID NO: 8758 - RNA, 22 nt, Homo sapiens
ggauaagugugccuggcuguuc

SEQ ID NO: 8759 - RNA, 22 nt, Homo sapiens
acaguacagugugcgcauaucu

SEQ ID NO: 8760 - RNA, 22 nt, Homo sapiens
caggccacuccauucauguaua

SEQ ID NO: 8761 - RNA, 22 nt, Homo sapiens
caugaauagagcagccucgugc

SEQ ID NO: 8762 - RNA, 22 nt, Homo sapiens
ucaguuugcagcuugucccuga

SEQ ID NO: 8763 - RNA, 22 nt, Homo sapiens
gggagggucucaggccugggag

SEQ ID NO: 8764 - RNA, 22 nt, Homo sapiens
uccauguuucagcaucuauguc

SEQ ID NO: 8765 - RNA, 22 nt, Homo sapiens
aguggauuaaaaacaauggagg

SEQ ID NO: 8766 - RNA, 22 nt, Homo sapiens
aggcuugggucagaaggcuugu

SEQ ID NO: 8767 - RNA, 21 nt, Homo sapiens
aaguaaaugacaccaggccug

SEQ ID NO: 8768 - RNA, 22 nt, Homo sapiens
uuauuauucuugaagauaagua

SEQ ID NO: 8769 - RNA, 22 nt, Homo sapiens
uuuaucucaugagucgauaaau

SEQ ID NO: 8770 - RNA, 22 nt, Homo sapiens
ggcucuaaguguggcccaugag

SEQ ID NO: 8771 - RNA, 22 nt, Homo sapiens
uagggcccggucacuguggggu

SEQ ID NO: 8772 - RNA, 22 nt, Homo sapiens
ggagaaggcuuggaguguucca

SEQ ID NO: 8773 - RNA, 22 nt, Homo sapiens
aguguucugagccuuucucuuu

SEQ ID NO: 8774 - RNA, 22 nt, Homo sapiens
aggucaagaacuaugacaccac

SEQ ID NO: 8775 - RNA, 22 nt, Homo sapiens
gugucuuggauaucuauggcuu

SEQ ID NO: 8776 - RNA, 22 nt, Homo sapiens
ugguguggugucgagcuaggaa

SEQ ID NO: 8777 - RNA, 22 nt, Homo sapiens
guaucgucucacauucacacca

SEQ ID NO: 8778 - RNA, 22 nt, Homo sapiens
ucccuccuccuucccacugugc

SEQ ID NO: 8779 - RNA, 17 nt, Homo sapiens
ugucaagugaggaggga

SEQ ID NO: 8780 - RNA, 22 nt, Homo sapiens
ugugagugauaggaaauacagg

SEQ ID NO: 8781 - RNA, 22 nt, Homo sapiens
ugauuuccuauaacuccacagc

SEQ ID NO: 8782 - RNA, 22 nt, Homo sapiens
ugaugagggccugguggcugug

SEQ ID NO: 8783 - RNA, 22 nt, Homo sapiens
agggcaugggcccugucugcag

SEQ ID NO: 8784 - RNA, 22 nt, Homo sapiens
gacugggguggggagcgaggag

SEQ ID NO: 8785 - RNA, 22 nt, Homo sapiens
uuuccuucacacuuccagucuu

SEQ ID NO: 8786 - RNA, 22 nt, Homo sapiens
ugguaugcaaccucaaauaugg

SEQ ID NO: 8787 - RNA, 22 nt, Homo sapiens
uacuuuuaugguguguauacca

SEQ ID NO: 8788 - RNA, 22 nt, Homo sapiens
ugguggggcuggagggcgcgcc

SEQ ID NO: 8789 - RNA, 22 nt, Homo sapiens
gcuucaccaagugcuucaguuu

SEQ ID NO: 8790 - RNA, 22 nt, Homo sapiens
agcccuuccugauggcuuccug

SEQ ID NO: 8791 - RNA, 22 nt, Homo sapiens
auggggugaugagaggagagca

SEQ ID NO: 8792 - RNA, 22 nt, Homo sapiens
gagaaguggagagguugaucua

SEQ ID NO: 8793 - RNA, 21 nt, Homo sapiens
ggucauaggcuuccauuucuu

SEQ ID NO: 8794 - RNA, 22 nt, Homo sapiens
uggggggggccagugaggcagg

SEQ ID NO: 8795 - RNA, 22 nt, Homo sapiens
ucugccagcuugcuccucccca

SEQ ID NO: 8796 - RNA, 22 nt, Homo sapiens
ucccgcccuccgcucaugcuca

SEQ ID NO: 8797 - RNA, 22 nt, Homo sapiens
cgugggcgauguugcagggagc

SEQ ID NO: 8798 - RNA, 22 nt, Homo sapiens
ucccgcccuccgcucaugcuca

SEQ ID NO: 8799 - RNA, 22 nt, Homo sapiens
cgugggcgauguugcagggagc

SEQ ID NO: 8800 - RNA, 22 nt, Homo sapiens
ucccgcccuccgcucaugcuca

SEQ ID NO: 8801 - RNA, 22 nt, Homo sapiens
cgugggcgauguugcagggagc

SEQ ID NO: 8802 - RNA, 22 nt, Homo sapiens
ucccgcccuccgcucaugcuca

SEQ ID NO: 8803 - RNA, 22 nt, Homo sapiens
cgugggcgauguugcagggagc

SEQ ID NO: 8804 - RNA, 22 nt, Homo sapiens
ucccgcccuccgcucaugcuca

SEQ ID NO: 8805 - RNA, 22 nt, Homo sapiens
cgugggcgauguugcagggagc

SEQ ID NO: 8806 - RNA, 20 nt, Homo sapiens
uagcaccauuugaaaucggu

SEQ ID NO: 8807 - RNA, 22 nt, Homo sapiens
ugaccgauuucuccugguguuc

SEQ ID NO: 8808 - RNA, 21 nt, Homo sapiens
uagcaccauuugaaaucgguu

SEQ ID NO: 8809 - RNA, 22 nt, Homo sapiens
uagcaccauuugaaaucgguua

SEQ ID NO: 8810 - RNA, 22 nt, Homo sapiens
cugagauugcguuccuuacaca

SEQ ID NO: 8811 - RNA, 22 nt, Homo sapiens
uguacgaguacauccucaucau

SEQ ID NO: 8812 - RNA, 22 nt, Homo sapiens
gccccuucgugugccuaccugg

SEQ ID NO: 8813 - RNA, 22 nt, Homo sapiens
auguggguaccucugaaagggg

SEQ ID NO: 8814 - RNA, 22 nt, Homo sapiens
uucugcccucaauuaugcacau

SEQ ID NO: 8815 - RNA, 22 nt, Homo sapiens
cacauaacugaggguagaguuu

SEQ ID NO: 8816 - RNA, 22 nt, Homo sapiens
ugaggguggggcuggcucagug

SEQ ID NO: 8817 - RNA, 22 nt, Homo sapiens
ugaaggaccagcuccuuacccu

SEQ ID NO: 8818 - RNA, 22 nt, Homo sapiens
uuugcggguggacgagggucua

SEQ ID NO: 8819 - RNA, 22 nt, Homo sapiens
gcccuccuuugcccgugaaugg

SEQ ID NO: 8820 - RNA, 22 nt, Homo sapiens
uccacuggugggcuguuuauuu

SEQ ID NO: 8821 - RNA, 22 nt, Homo sapiens
aaaaaacauuggcucauaccag

SEQ ID NO: 8822 - RNA, 22 nt, Homo sapiens
ucgucauuaugcagccugugaa

SEQ ID NO: 8823 - RNA, 22 nt, Homo sapiens
auugguugcauaauuugaucug

SEQ ID NO: 8824 - RNA, 22 nt, Homo sapiens
ucgucaauaugcagccugugaa

SEQ ID NO: 8825 - RNA, 22 nt, Homo sapiens
auugguugcguaauuugauuug

SEQ ID NO: 8826 - RNA, 22 nt, Homo sapiens
ucugggccugugucuuaggcuc

SEQ ID NO: 8827 - RNA, 22 nt, Homo sapiens
caaagcacacggccugcagaga

SEQ ID NO: 8828 - RNA, 21 nt, Homo sapiens
ucucugggccugugucuuagg

SEQ ID NO: 8829 - RNA, 22 nt, Homo sapiens
ucucugggccugugucuuaggc

SEQ ID NO: 8830 - RNA, 22 nt, Homo sapiens
gcucccgguguccugcacacgu

SEQ ID NO: 8831 - RNA, 22 nt, Homo sapiens
ucugugugugugggauggggcu

SEQ ID NO: 8832 - RNA, 22 nt, Homo sapiens
ccaggcggcccaggagauggcc

SEQ ID NO: 8833 - RNA, 20 nt, Homo sapiens
caucuucggcagccgccugg

SEQ ID NO: 8834 - RNA, 22 nt, Homo sapiens
cccggaucauugccacgauaga

SEQ ID NO: 8835 - RNA, 22 nt, Homo sapiens
uaucgugucaauguguauuugg

SEQ ID NO: 8836 - RNA, 22 nt, Homo sapiens
ugagccaagaguuaugguggca

SEQ ID NO: 8837 - RNA, 22 nt, Homo sapiens
cagcugugagcucucucuggcu

SEQ ID NO: 8838 - RNA, 22 nt, Homo sapiens
uccuuuucauccuucccugaac

SEQ ID NO: 8839 - RNA, 19 nt, Homo sapiens
ggugggaacauggaaagga

SEQ ID NO: 8840 - RNA, 22 nt, Homo sapiens
gggcuggggaggcuggagggga

SEQ ID NO: 8841 - RNA, 22 nt, Homo sapiens
caccucucccucacccccagcc

SEQ ID NO: 8842 - RNA, 22 nt, Homo sapiens
ggggcccugguagaagcugccu

SEQ ID NO: 8843 - RNA, 22 nt, Homo sapiens
gcagccuuuucucagagcggcc

SEQ ID NO: 8844 - RNA, 22 nt, Homo sapiens
ggggcccugguagaagcugccu

SEQ ID NO: 8845 - RNA, 22 nt, Homo sapiens
gcagccuuuucucagagcggcc

SEQ ID NO: 8846 - RNA, 22 nt, Homo sapiens
cccuguggggccuggccacccc

SEQ ID NO: 8847 - RNA, 22 nt, Homo sapiens
ggccggacaggcggaccccaca

SEQ ID NO: 8848 - RNA, 22 nt, Homo sapiens
ugugaggauuaaauguucuaaa

SEQ ID NO: 8849 - RNA, 22 nt, Homo sapiens
uagaacauuuuaucuucaccac

SEQ ID NO: 8850 - RNA, 22 nt, Homo sapiens
uuuuucucuccuugauuucgug

SEQ ID NO: 8851 - RNA, 22 nt, Homo sapiens
uagugaaauuaaagaggaaaau

SEQ ID NO: 8852 - RNA, 22 nt, Homo sapiens
cgcccugcuaaggcuuggugua

SEQ ID NO: 8853 - RNA, 22 nt, Homo sapiens
acagggucacagcagggcuggg

SEQ ID NO: 8854 - RNA, 22 nt, Homo sapiens
gagggaaggaauggggagagag

SEQ ID NO: 8855 - RNA, 22 nt, Homo sapiens
uuucugccuguccucccuccug

SEQ ID NO: 8856 - RNA, 22 nt, Homo sapiens
ucaaagaguugcuaaaggcuuu

SEQ ID NO: 8857 - RNA, 22 nt, Homo sapiens
ggagcugaugauucuuugaucu

SEQ ID NO: 8858 - RNA, 22 nt, Homo sapiens
gccaguggagagcuuaagggac

SEQ ID NO: 8859 - RNA, 22 nt, Homo sapiens
uccucuuccuucugaguuccuc

SEQ ID NO: 8860 - RNA, 22 nt, Homo sapiens
uccaucgcacucuuuuuuuucu

SEQ ID NO: 8861 - RNA, 22 nt, Homo sapiens
ggggaaggagaaagugaaggga

SEQ ID NO: 8862 - RNA, 22 nt, Homo sapiens
gagaaggggucaaaggaaagca

SEQ ID NO: 8863 - RNA, 22 nt, Homo sapiens
ugaauucuuuggcuuuucuuuu

SEQ ID NO: 8864 - RNA, 22 nt, Homo sapiens
aaggagcucacagucuauugag

SEQ ID NO: 8865 - RNA, 22 nt, Homo sapiens
acuagauugugagcuccuggag

SEQ ID NO: 8866 - RNA, 22 nt, Homo sapiens
gacuaaacuguaggcucuucuc

SEQ ID NO: 8867 - RNA, 22 nt, Homo sapiens
gaagagcccacaguuuaguuug

SEQ ID NO: 8868 - RNA, 22 nt, Homo sapiens
cacgugaugaucuggcuaggau

SEQ ID NO: 8869 - RNA, 22 nt, Homo sapiens
uaaagcacagaucacaugugug

SEQ ID NO: 8870 - RNA, 22 nt, Homo sapiens
ugcuaggcacucucauccauac

SEQ ID NO: 8871 - RNA, 20 nt, Homo sapiens
uguaugagagagccuagcac

SEQ ID NO: 8872 - RNA, 22 nt, Homo sapiens
ugugauuuccaacauugcaaug

SEQ ID NO: 8873 - RNA, 22 nt, Homo sapiens
agauggaauuuggagacuacag

SEQ ID NO: 8874 - RNA, 22 nt, Homo sapiens
aaaauuaacugggacagugcag

SEQ ID NO: 8875 - RNA, 22 nt, Homo sapiens
uauacucuccucauugauuucu

SEQ ID NO: 8876 - RNA, 22 nt, Homo sapiens
ccuguuuucauccuacuuuuaa

SEQ ID NO: 8877 - RNA, 22 nt, Homo sapiens
uggcauuagugggaggggagca

SEQ ID NO: 8878 - RNA, 22 nt, Homo sapiens
ucuagggcagaccugggcauug

SEQ ID NO: 8879 - RNA, 22 nt, Homo sapiens
ugccugggaccugcccaagaca

SEQ ID NO: 8880 - RNA, 22 nt, Homo sapiens
aagucaaaggcaugcugaggaa

SEQ ID NO: 8881 - RNA, 22 nt, Homo sapiens
ucacaguguguccuugacagca

SEQ ID NO: 8882 - RNA, 22 nt, Homo sapiens
uucaguuuuccuggaauugagg

SEQ ID NO: 8883 - RNA, 22 nt, Homo sapiens
agugacucaagaaaauggaagc

SEQ ID NO: 8884 - RNA, 22 nt, Homo sapiens
gucuccaccgacuugcaacaca

SEQ ID NO: 8885 - RNA, 22 nt, Homo sapiens
uugcaagucaguagagagguac

SEQ ID NO: 8886 - RNA, 22 nt, Homo sapiens
uauaguuuuguggucauuacug

SEQ ID NO: 8887 - RNA, 22 nt, Homo sapiens
gcagugaccuuaaaaccaugca

SEQ ID NO: 8888 - RNA, 22 nt, Homo sapiens
uuuuuuauuccacuguucaucc

SEQ ID NO: 8889 - RNA, 22 nt, Homo sapiens
gaaacagcugggacaggaaaac

SEQ ID NO: 8890 - RNA, 22 nt, Homo sapiens
uaucaaaacaauugguugauug

SEQ ID NO: 8891 - RNA, 22 nt, Homo sapiens
ugaguugacuguuuugacaucu

SEQ ID NO: 8892 - RNA, 22 nt, Homo sapiens
agacgugaaggcagcggggcuc

SEQ ID NO: 8893 - RNA, 22 nt, Homo sapiens
acccccggcccucgcgccugcc

SEQ ID NO: 8894 - RNA, 22 nt, Homo sapiens
uugagaugugccuaguucugua

SEQ ID NO: 8895 - RNA, 22 nt, Homo sapiens
uuugaguucuagcgcauuuaau

SEQ ID NO: 8896 - RNA, 22 nt, Homo sapiens
acugguuucugagauggaacuu

SEQ ID NO: 8897 - RNA, 22 nt, Homo sapiens
ucccucucagaaauccagguuu

SEQ ID NO: 8898 - RNA, 22 nt, Homo sapiens
ucuuugccccaucgugguugca

SEQ ID NO: 8899 - RNA, 22 nt, Homo sapiens
caaccauggggauaaagcagga

SEQ ID NO: 8900 - RNA, 22 nt, Homo sapiens
uaaauaguaauguuugcugagc

SEQ ID NO: 8901 - RNA, 22 nt, Homo sapiens
ucaggaaacauugcuauuuagu

SEQ ID NO: 8902 - RNA, 22 nt, Homo sapiens
uaugauccucaguuguguguaa

SEQ ID NO: 8903 - RNA, 22 nt, Homo sapiens
cacacaacugagcaucacagcc

SEQ ID NO: 8904 - RNA, 22 nt, Homo sapiens
ucuuuuuaaagcuacuacuaaa

SEQ ID NO: 8905 - RNA, 22 nt, Homo sapiens
uaguaguagcuugaaaaaacuc

SEQ ID NO: 8906 - RNA, 22 nt, Homo sapiens
ugagauagaguguagugucugg

SEQ ID NO: 8907 - RNA, 22 nt, Homo sapiens
uggggaaugcaaucuacucauu

SEQ ID NO: 8908 - RNA, 22 nt, Homo sapiens
ugaugccauuuaucuuuugaag

SEQ ID NO: 8909 - RNA, 22 nt, Homo sapiens
ucaaaggauauugggggucaua

SEQ ID NO: 8910 - RNA, 22 nt, Homo sapiens
ugacagcccgggcuguggcagu

SEQ ID NO: 8911 - RNA, 22 nt, Homo sapiens
ucccacaagcucagggccugcg

SEQ ID NO: 8912 - RNA, 22 nt, Homo sapiens
uaugucaguuauaaaagacaga

SEQ ID NO: 8913 - RNA, 22 nt, Homo sapiens
ucucucguggaacugacaucca

SEQ ID NO: 8914 - RNA, 22 nt, Homo sapiens
uagggagagaguuuugagucuu

SEQ ID NO: 8915 - RNA, 22 nt, Homo sapiens
aaaacuuugggcuuuucuuugg

SEQ ID NO: 8916 - RNA, 22 nt, Homo sapiens
uggagacauggaacaguguggu

SEQ ID NO: 8917 - RNA, 22 nt, Homo sapiens
ccagacuacccagguuucuauc

SEQ ID NO: 8918 - RNA, 22 nt, Homo sapiens
aggcagggugcaggagccuugg

SEQ ID NO: 8919 - RNA, 22 nt, Homo sapiens
ugggguuccugugccaagggcu

SEQ ID NO: 8920 - RNA, 22 nt, Homo sapiens
ucaaauaagaaccacacagagg

SEQ ID NO: 8921 - RNA, 20 nt, Homo sapiens
uguguauuuuguauuugagu

SEQ ID NO: 8922 - RNA, 22 nt, Homo sapiens
gacuaucuauugucuucuucau

SEQ ID NO: 8923 - RNA, 22 nt, Homo sapiens
ugaagaaguaauagguggugau

SEQ ID NO: 8924 - RNA, 22 nt, Homo sapiens
uucaaacugccuuuccuguuga

SEQ ID NO: 8925 - RNA, 22 nt, Homo sapiens
cuugacagaugguguuagaagu

SEQ ID NO: 8926 - RNA, 22 nt, Homo sapiens
acuccaagcauuaccaccuuug

SEQ ID NO: 8927 - RNA, 22 nt, Homo sapiens
caggcggucauugcuggagugg

SEQ ID NO: 8928 - RNA, 22 nt, Homo sapiens
uguucuaacacaaauucaccug

SEQ ID NO: 8929 - RNA, 22 nt, Homo sapiens
gcgaauuuauguuagaacacau

SEQ ID NO: 8930 - RNA, 22 nt, Homo sapiens
uuagcugacaguccugguuguc

SEQ ID NO: 8931 - RNA, 22 nt, Homo sapiens
aaccaggaccuucagcuaagua

SEQ ID NO: 8932 - RNA, 22 nt, Homo sapiens
ugugucauguccugacuuguuu

SEQ ID NO: 8933 - RNA, 22 nt, Homo sapiens
aagucagcgugugugugcaugc

SEQ ID NO: 8934 - RNA, 22 nt, Homo sapiens
uacacucagcccaggaggagca

SEQ ID NO: 8935 - RNA, 22 nt, Homo sapiens
ugucugcuccugcccugcucgg

SEQ ID NO: 8936 - RNA, 22 nt, Homo sapiens
agccuagcuuggguuuacuggu

SEQ ID NO: 8937 - RNA, 22 nt, Homo sapiens
acugguuccuaugccaggcugu

SEQ ID NO: 8938 - RNA, 22 nt, Homo sapiens
aacuugucugaucguagaacuc

SEQ ID NO: 8939 - RNA, 22 nt, Homo sapiens
auuuugaugaucaagcacguau

SEQ ID NO: 8940 - RNA, 22 nt, Homo sapiens
uacauauuugaugcaauaaaua

SEQ ID NO: 8941 - RNA, 22 nt, Homo sapiens
uuuguuugcucaaacgugcacc

SEQ ID NO: 8942 - RNA, 22 nt, Homo sapiens
gaacuuugcagcggagacuucu

SEQ ID NO: 8943 - RNA, 22 nt, Homo sapiens
gucuccguggucaggugauguc

SEQ ID NO: 8944 - RNA, 22 nt, Homo sapiens
uuaauugcaagugguccuuguu

SEQ ID NO: 8945 - RNA, 19 nt, Homo sapiens
caagguucuagcaauuaau

SEQ ID NO: 8946 - RNA, 22 nt, Homo sapiens
agacccaaggagcaagcugggg

SEQ ID NO: 8947 - RNA, 22 nt, Homo sapiens
cccuugcuucuuggguuccugg

SEQ ID NO: 8948 - RNA, 22 nt, Homo sapiens
aaaggaggaaagccaggguguu

SEQ ID NO: 8949 - RNA, 22 nt, Homo sapiens
gcucagcuuccuuccuuaagga

SEQ ID NO: 8950 - RNA, 24 nt, Homo sapiens
gugguuguaguccgugcgagaaua

SEQ ID NO: 8951 - RNA, 22 nt, Homo sapiens
uagcaccaagguaaggucggcu

SEQ ID NO: 8952 - RNA, 22 nt, Homo sapiens
ccugcuaugccugagguguuau

SEQ ID NO: 8953 - RNA, 22 nt, Homo sapiens
uaccagcgcguuuucaguuuca

SEQ ID NO: 8954 - RNA, 22 nt, Homo sapiens
ugaaacuggagcgccuggagga

SEQ ID NO: 8955 - RNA, 22 nt, Homo sapiens
ugcugcccaccagaggacgggg

SEQ ID NO: 8956 - RNA, 22 nt, Homo sapiens
cucccucuggguggggcagcag

SEQ ID NO: 8957 - RNA, 22 nt, Homo sapiens
ucucccuucaaaugggucucgu

SEQ ID NO: 8958 - RNA, 22 nt, Homo sapiens
cuaauccauuacagaggggagg

SEQ ID NO: 8959 - RNA, 22 nt, Homo sapiens
ccaaguccccucaucuuucuga

SEQ ID NO: 8960 - RNA, 22 nt, Homo sapiens
uagaaaaaugaagggacuugcc

SEQ ID NO: 8961 - RNA, 22 nt, Homo sapiens
uuucagaauaugggaaaggggu

SEQ ID NO: 8962 - RNA, 22 nt, Homo sapiens
ucuuucugauguagauugagaa

SEQ ID NO: 8963 - RNA, 22 nt, Homo sapiens
ugccuguggguuuaccacuuau

SEQ ID NO: 8964 - RNA, 22 nt, Homo sapiens
uuuaggugguugcacaggcagg

SEQ ID NO: 8965 - RNA, 22 nt, Homo sapiens
agcaguauaucauuucauggag

SEQ ID NO: 8966 - RNA, 22 nt, Homo sapiens
ccaugaaaaaugcuauguugua

SEQ ID NO: 8967 - RNA, 22 nt, Homo sapiens
ugcaggagcaggugggaccccc

SEQ ID NO: 8968 - RNA, 22 nt, Homo sapiens
gggugccagccugcccugcuag

SEQ ID NO: 8969 - RNA, 22 nt, Homo sapiens
ggcagugucaacaguuucuaaa

SEQ ID NO: 8970 - RNA, 21 nt, Homo sapiens
aagugaaacugagacacuguu

SEQ ID NO: 8971 - RNA, 22 nt, Homo sapiens
ugggaaaugaggggugaggcuu

SEQ ID NO: 8972 - RNA, 22 nt, Homo sapiens
ucaggcuccccucagauuccac

SEQ ID NO: 8973 - RNA, 22 nt, Homo sapiens
caagagaacccugccucuccug

SEQ ID NO: 8974 - RNA, 22 nt, Homo sapiens
gugagaguccuugggguucuuu

SEQ ID NO: 8975 - RNA, 22 nt, Homo sapiens
ugcuccaguaaggucuccagga

SEQ ID NO: 8976 - RNA, 16 nt, Homo sapiens
gagcaccacuggggua

SEQ ID NO: 8977 - RNA, 22 nt, Homo sapiens
gaagggaggaaggccucucuac

SEQ ID NO: 8978 - RNA, 21 nt, Homo sapiens
gcguggaguuccccuccuuuc

SEQ ID NO: 8979 - RNA, 22 nt, Homo sapiens
ucuuguaaauaagcugacagua

SEQ ID NO: 8980 - RNA, 22 nt, Homo sapiens
cuguccagcuuagcauauaggg

SEQ ID NO: 8981 - RNA, 22 nt, Homo sapiens
gagccauuaaaggaguggagca

SEQ ID NO: 8982 - RNA, 22 nt, Homo sapiens
gacuuccuuccugccaguggcu

SEQ ID NO: 8983 - RNA, 22 nt, Homo sapiens
agugaaaaaaauuuggagggga

SEQ ID NO: 8984 - RNA, 22 nt, Homo sapiens
cauccaaaugaaguuuucauuc

SEQ ID NO: 8985 - RNA, 22 nt, Homo sapiens
agugaaaaaaauuuggagggga

SEQ ID NO: 8986 - RNA, 22 nt, Homo sapiens
cauccaaaugaaguuuucauuc

SEQ ID NO: 8987 - RNA, 22 nt, Homo sapiens
ucuaaaugguuaaaugagcaua

SEQ ID NO: 8988 - RNA, 22 nt, Homo sapiens
ugcucacuuaaccacucagaua

SEQ ID NO: 8989 - RNA, 21 nt, Homo sapiens
augaccuaugaauugacagac

SEQ ID NO: 8990 - RNA, 22 nt, Homo sapiens
ucugucauuucuuuaggccaau

SEQ ID NO: 8991 - RNA, 22 nt, Homo sapiens
agcuaacauugcugaagugcuc

SEQ ID NO: 8992 - RNA, 22 nt, Homo sapiens
agcacucgacaaauguuagcca

SEQ ID NO: 8993 - RNA, 22 nt, Homo sapiens
uagaacucuauggcuuugacgu

SEQ ID NO: 8994 - RNA, 22 nt, Homo sapiens
ucugaagccaugguuguuggaa

SEQ ID NO: 8995 - RNA, 22 nt, Homo sapiens
ccccuuucauaugcccagaucu

SEQ ID NO: 8996 - RNA, 22 nt, Homo sapiens
ggcuggguaaugaaggcacacu

SEQ ID NO: 8997 - RNA, 22 nt, Homo sapiens
aacugaauuacuucuuccaugg

SEQ ID NO: 8998 - RNA, 19 nt, Homo sapiens
ugggagagugaauucaguu

SEQ ID NO: 8999 - RNA, 22 nt, Homo sapiens
ggucuuuggacucucucuccuu

SEQ ID NO: 9000 - RNA, 20 nt, Homo sapiens
ggcagagaggaccagagacu

SEQ ID NO: 9001 - RNA, 22 nt, Homo sapiens
cgcuggucauuguaguccaguc

SEQ ID NO: 9002 - RNA, 22 nt, Homo sapiens
uggacuacaacucccggcaggc

SEQ ID NO: 9003 - RNA, 22 nt, Homo sapiens
uauuuacaucuugagguauggg

SEQ ID NO: 9004 - RNA, 22 nt, Homo sapiens
auucaucaagacacaaauauac

SEQ ID NO: 9005 - RNA, 22 nt, Homo sapiens
uuucucaucacaacccuagggu

SEQ ID NO: 9006 - RNA, 21 nt, Homo sapiens
gaguugggggacgaugggaga

SEQ ID NO: 9007 - RNA, 22 nt, Homo sapiens
aaagacagagugugugugcuga

SEQ ID NO: 9008 - RNA, 22 nt, Homo sapiens
ucagcuacgcaugcuauuuuca

SEQ ID NO: 9009 - RNA, 22 nt, Homo sapiens
cauggaggcagacagacguggg

SEQ ID NO: 9010 - RNA, 22 nt, Homo sapiens
cacguucgucugucccauguua

SEQ ID NO: 9011 - RNA, 22 nt, Homo sapiens
uuccugucaccuugcucuccua

SEQ ID NO: 9012 - RNA, 20 nt, Homo sapiens
gggcagcagaagauaggaag

SEQ ID NO: 9013 - RNA, 22 nt, Homo sapiens
agagagaggcucagaguggguu

SEQ ID NO: 9014 - RNA, 22 nt, Homo sapiens
uaaauucuugagccuucuucuu

SEQ ID NO: 9015 - RNA, 22 nt, Homo sapiens
uggaagggagaaaacuuguggc

SEQ ID NO: 9016 - RNA, 22 nt, Homo sapiens
ccauguguuauuuucuucucuc

SEQ ID NO: 9017 - RNA, 22 nt, Homo sapiens
gagaggguagauuuuggaagua

SEQ ID NO: 9018 - RNA, 22 nt, Homo sapiens
aguuccugguguaccuccuccc

SEQ ID NO: 9019 - RNA, 22 nt, Homo sapiens
gauguguaucauauauauguau

SEQ ID NO: 9020 - RNA, 22 nt, Homo sapiens
uacguauguaucacacaguuac

SEQ ID NO: 9021 - RNA, 22 nt, Homo sapiens
uucucucccagcucuggucuaa

SEQ ID NO: 9022 - RNA, 20 nt, Homo sapiens
ugaagggcagagggagggaa

SEQ ID NO: 9023 - RNA, 22 nt, Homo sapiens
uugcaaauugauguguaaaugu

SEQ ID NO: 9024 - RNA, 22 nt, Homo sapiens
uauuuacuaucaaaaugcaaau

SEQ ID NO: 9025 - RNA, 22 nt, Homo sapiens
ucaagcugacagcuaugagcaa

SEQ ID NO: 9026 - RNA, 22 nt, Homo sapiens
ugcuuguggcuauucuuaugac

SEQ ID NO: 9027 - RNA, 22 nt, Homo sapiens
uuaguguaccagaguaugccau

SEQ ID NO: 9028 - RNA, 22 nt, Homo sapiens
gaugagcucagguacuuagaga

SEQ ID NO: 9029 - RNA, 22 nt, Homo sapiens
ugaagugucucuuguaaaagau

SEQ ID NO: 9030 - RNA, 22 nt, Homo sapiens
ucuuugacaagagaggauuagg

SEQ ID NO: 9031 - RNA, 22 nt, Homo sapiens
uuuauaauccaucuggggucuc

SEQ ID NO: 9032 - RNA, 22 nt, Homo sapiens
aaccccagauggccugugaauu

SEQ ID NO: 9033 - RNA, 22 nt, Homo sapiens
ucaggucuggccaucuguacuc

SEQ ID NO: 9034 - RNA, 22 nt, Homo sapiens
uauagucagucauaccugaguc

SEQ ID NO: 9035 - RNA, 22 nt, Homo sapiens
ucucucaucuuuuuauauuuca

SEQ ID NO: 9036 - RNA, 22 nt, Homo sapiens
ggauuauggagaggagagaugu

SEQ ID NO: 9037 - RNA, 22 nt, Homo sapiens
aguuacuugcucaagacuggaa

SEQ ID NO: 9038 - RNA, 22 nt, Homo sapiens
ucugugacuuugagcaaguuac

SEQ ID NO: 9039 - RNA, 22 nt, Homo sapiens
ugcacuacuuggcuuuacugau

SEQ ID NO: 9040 - RNA, 22 nt, Homo sapiens
aauaaagucaggcaguggagga

SEQ ID NO: 9041 - RNA, 22 nt, Homo sapiens
aacaccccaucuuuaauucaug

SEQ ID NO: 9042 - RNA, 22 nt, Homo sapiens
ugaguuaaaaagggggguguca

SEQ ID NO: 9043 - RNA, 22 nt, Homo sapiens
auuccauuugccugcugaguga

SEQ ID NO: 9044 - RNA, 22 nt, Homo sapiens
cuucagcaaggcagaagggagg

SEQ ID NO: 9045 - RNA, 22 nt, Homo sapiens
ccuauucuuauaugugcuccag

SEQ ID NO: 9046 - RNA, 22 nt, Homo sapiens
uggagcacauuuaggaauaggg

SEQ ID NO: 9047 - RNA, 22 nt, Homo sapiens
uaaagacuagacuucgcuauga

SEQ ID NO: 9048 - RNA, 22 nt, Homo sapiens
auaguaugucuagucuuuaggu

SEQ ID NO: 9049 - RNA, 22 nt, Homo sapiens
ucaauucaacuugacaaacauu

SEQ ID NO: 9050 - RNA, 20 nt, Homo sapiens
uguuuguugaauugaauuga

SEQ ID NO: 9051 - RNA, 22 nt, Homo sapiens
caguucagaaguguuccugagu

SEQ ID NO: 9052 - RNA, 22 nt, Homo sapiens
ucaggacacuucugaacuugga

SEQ ID NO: 9053 - RNA, 22 nt, Homo sapiens
aauggcuucucaguuucauaau

SEQ ID NO: 9054 - RNA, 22 nt, Homo sapiens
uuugcagagcugaggaacuguu

SEQ ID NO: 9055 - RNA, 22 nt, Homo sapiens
uccaucucuuccuagaagugcu

SEQ ID NO: 9056 - RNA, 22 nt, Homo sapiens
caugccugggagccagaugggg

SEQ ID NO: 9057 - RNA, 22 nt, Homo sapiens
ucugccauguuggaauuucaaa

SEQ ID NO: 9058 - RNA, 22 nt, Homo sapiens
uggaaggagccagcaugccaga

SEQ ID NO: 9059 - RNA, 22 nt, Homo sapiens
uuguuaaacaauuucaaaugca

SEQ ID NO: 9060 - RNA, 22 nt, Homo sapiens
uuucugaaccuguuuaauaaug

SEQ ID NO: 9061 - RNA, 22 nt, Homo sapiens
ucauuucugcuuguucugaaau

SEQ ID NO: 9062 - RNA, 22 nt, Homo sapiens
gauuuggaaacuagcagacaug

SEQ ID NO: 9063 - RNA, 22 nt, Homo sapiens
ugggccgcggcgcgcgggcucg

SEQ ID NO: 9064 - RNA, 22 nt, Homo sapiens
cuuggcacugcgugaccuuggg

SEQ ID NO: 9065 - RNA, 22 nt, Homo sapiens
cacucugcugacuuucaagauu

SEQ ID NO: 9066 - RNA, 22 nt, Homo sapiens
ucucaggaauguugcagaguga

SEQ ID NO: 9067 - RNA, 22 nt, Homo sapiens
cccucccccacucccuccagcc

SEQ ID NO: 9068 - RNA, 22 nt, Homo sapiens
gcguugcccggaugugggaggc

SEQ ID NO: 9069 - RNA, 22 nt, Homo sapiens
uaauuuuagaucuggucugcuu

SEQ ID NO: 9070 - RNA, 22 nt, Homo sapiens
cagacuugaccuacaauuagcc

SEQ ID NO: 9071 - RNA, 22 nt, Homo sapiens
aggguggacauaaauugucugu

SEQ ID NO: 9072 - RNA, 21 nt, Homo sapiens
agggcguuuauuuccaucuug

SEQ ID NO: 9073 - RNA, 22 nt, Homo sapiens
gguucugaaaugucuucaaguc

SEQ ID NO: 9074 - RNA, 22 nt, Homo sapiens
uucgggacauuuuuagaaucua

SEQ ID NO: 9075 - RNA, 22 nt, Homo sapiens
ccaucauucuagaugcaaaacu

SEQ ID NO: 9076 - RNA, 22 nt, Homo sapiens
aauuuugaguuuguuugaugag

SEQ ID NO: 9077 - RNA, 22 nt, Homo sapiens
cccuacccacucccacccuugc

SEQ ID NO: 9078 - RNA, 22 nt, Homo sapiens
cugggguagggacugggugggg

SEQ ID NO: 9079 - RNA, 22 nt, Homo sapiens
uuuccaauucuacugugaauua

SEQ ID NO: 9080 - RNA, 22 nt, Homo sapiens
aaucaugguguaauugaaggac

SEQ ID NO: 9081 - RNA, 22 nt, Homo sapiens
ugucucccucccucugucugcu

SEQ ID NO: 9082 - RNA, 22 nt, Homo sapiens
caggcaaguugggaggagaugg

SEQ ID NO: 9083 - RNA, 22 nt, Homo sapiens
ugugaggccuggguggaggccu

SEQ ID NO: 9084 - RNA, 20 nt, Homo sapiens
uggucuuuccagccucacac

SEQ ID NO: 9085 - RNA, 22 nt, Homo sapiens
cagaauggacggugccucccug

SEQ ID NO: 9086 - RNA, 21 nt, Homo sapiens
gggacagcggccuccauucug

SEQ ID NO: 9087 - RNA, 22 nt, Homo sapiens
uccuccucccuuugcuuuauuu

SEQ ID NO: 9088 - RNA, 22 nt, Homo sapiens
aaggaaaaggcgagaggagagg

SEQ ID NO: 9089 - RNA, 22 nt, Homo sapiens
uggggucagaaaguucuagaug

SEQ ID NO: 9090 - RNA, 22 nt, Homo sapiens
ccuucuuagauuaacuguuccu

SEQ ID NO: 9091 - RNA, 22 nt, Homo sapiens
uggugcugcugucaucacugcu

SEQ ID NO: 9092 - RNA, 22 nt, Homo sapiens
cagugauguauacagcaggggu

SEQ ID NO: 9093 - RNA, 22 nt, Homo sapiens
acacuugggcaagcaauggcuc

SEQ ID NO: 9094 - RNA, 22 nt, Homo sapiens
gcugcuacuuccagaagugucg

SEQ ID NO: 9095 - RNA, 22 nt, Homo sapiens
caacgaggacaagucuaaggca

SEQ ID NO: 9096 - RNA, 22 nt, Homo sapiens
ugcuuagauuugauccuuuggc

SEQ ID NO: 9097 - RNA, 22 nt, Homo sapiens
ucuccccagcagucuuugggcc

SEQ ID NO: 9098 - RNA, 22 nt, Homo sapiens
cguagacagacucuuugggaga

SEQ ID NO: 9099 - RNA, 22 nt, Homo sapiens
uuccauuccacugcucccuugg

SEQ ID NO: 9100 - RNA, 22 nt, Homo sapiens
uaccagaguauugaaauggaaa

SEQ ID NO: 9101 - RNA, 22 nt, Homo sapiens
gguggcuuccugucaguuuggu

SEQ ID NO: 9102 - RNA, 20 nt, Homo sapiens
uccaacugcaagaaguuacu

SEQ ID NO: 9103 - RNA, 22 nt, Homo sapiens
ugaagcccguuauuguucauua

SEQ ID NO: 9104 - RNA, 22 nt, Homo sapiens
augaaagacugcuggcuuuacu

SEQ ID NO: 9105 - RNA, 22 nt, Homo sapiens
uuuucuaauaagucacaucuuu

SEQ ID NO: 9106 - RNA, 22 nt, Homo sapiens
agcagugacuuauuguaagaau

SEQ ID NO: 9107 - RNA, 22 nt, Homo sapiens
ucuagucuguauaugccugugu

SEQ ID NO: 9108 - RNA, 22 nt, Homo sapiens
cuguaggacaugacucacugga

SEQ ID NO: 9109 - RNA, 22 nt, Homo sapiens
ucggcuguauagguggaugcuc

SEQ ID NO: 9110 - RNA, 22 nt, Homo sapiens
uauccgccugaaugagucaugc

SEQ ID NO: 9111 - RNA, 22 nt, Homo sapiens
ugcuggaccauggcccacccuc

SEQ ID NO: 9112 - RNA, 22 nt, Homo sapiens
gcagggccacaugacuccagca

SEQ ID NO: 9113 - RNA, 22 nt, Homo sapiens
ucucccuugagcuuugacacac

SEQ ID NO: 9114 - RNA, 22 nt, Homo sapiens
gguguguguggguggggagggu

SEQ ID NO: 9115 - RNA, 22 nt, Homo sapiens
ugucacagcuggagagugaccu

SEQ ID NO: 9116 - RNA, 22 nt, Homo sapiens
ucacuuuacagcugugugccgu

SEQ ID NO: 9117 - RNA, 22 nt, Homo sapiens
uucugccccugcugucuggugg

SEQ ID NO: 9118 - RNA, 18 nt, Homo sapiens
acgcaagaagggcggagc

SEQ ID NO: 9119 - RNA, 22 nt, Homo sapiens
ucaguaaauguuuauuagauga

SEQ ID NO: 9120 - RNA, 22 nt, Homo sapiens
ucagcaaacauuuauugugugc

SEQ ID NO: 9121 - RNA, 22 nt, Homo sapiens
ggaggggcaagcuggcagugcc

SEQ ID NO: 9122 - RNA, 22 nt, Homo sapiens
gaaaagcccugucggcucccuc

SEQ ID NO: 9123 - RNA, 22 nt, Homo sapiens
agagcccccauugugccugccc

SEQ ID NO: 9124 - RNA, 22 nt, Homo sapiens
ucccuggcacaaaggggcuuug

SEQ ID NO: 9125 - RNA, 22 nt, Homo sapiens
cacucaucaacugugccugaca

SEQ ID NO: 9126 - RNA, 22 nt, Homo sapiens
ucaggcacagacaaugagugug

SEQ ID NO: 9127 - RNA, 22 nt, Homo sapiens
caaccaggcggccugugggaga

SEQ ID NO: 9128 - RNA, 22 nt, Homo sapiens
gccugcagguccagcuguugca

SEQ ID NO: 9129 - RNA, 22 nt, Homo sapiens
aauuacacccauggcagcucag

SEQ ID NO: 9130 - RNA, 18 nt, Homo sapiens
ugauccaaagguguaauu

SEQ ID NO: 9131 - RNA, 22 nt, Homo sapiens
agggagggcaggcuggccucag

SEQ ID NO: 9132 - RNA, 22 nt, Homo sapiens
ugggcccagccuuccugccccu

SEQ ID NO: 9133 - RNA, 22 nt, Homo sapiens
aggggugcuggcggugacaugu

SEQ ID NO: 9134 - RNA, 22 nt, Homo sapiens
ugguuugucaccagaaccccca

SEQ ID NO: 9135 - RNA, 22 nt, Homo sapiens
ugacagguacagggacaaaucc

SEQ ID NO: 9136 - RNA, 22 nt, Homo sapiens
gauuugugcuuggcucugucac

SEQ ID NO: 9137 - RNA, 22 nt, Homo sapiens
ggggccaaagagggaggagauc

SEQ ID NO: 9138 - RNA, 22 nt, Homo sapiens
gcccucuccucccuuccugucc

SEQ ID NO: 9139 - RNA, 22 nt, Homo sapiens
ugagagcagcaaacaaaguugu

SEQ ID NO: 9140 - RNA, 22 nt, Homo sapiens
ugcauuguuuuguuucuuucau

SEQ ID NO: 9141 - RNA, 22 nt, Homo sapiens
ggcuugcaauuaggauggaaag

SEQ ID NO: 9142 - RNA, 22 nt, Homo sapiens
uuccauccuauuuguaugccua

SEQ ID NO: 9143 - RNA, 22 nt, Homo sapiens
uggugcaugcugggaacacagc

SEQ ID NO: 9144 - RNA, 22 nt, Homo sapiens
ugcauucccagcuuucaccacu

SEQ ID NO: 9145 - RNA, 22 nt, Homo sapiens
aaagaacaucuaggucuaaguu

SEQ ID NO: 9146 - RNA, 22 nt, Homo sapiens
uuugugaccuugcauucuuucc

SEQ ID NO: 9147 - RNA, 22 nt, Homo sapiens
gccuggugucccgccaugaacg

SEQ ID NO: 9148 - RNA, 20 nt, Homo sapiens
acuguggugaagcgccaggc

SEQ ID NO: 9149 - RNA, 22 nt, Homo sapiens
cccugagagacugggcagggcc

SEQ ID NO: 9150 - RNA, 22 nt, Homo sapiens
ugauucucucaucucccagagc

SEQ ID NO: 9151 - RNA, 22 nt, Homo sapiens
ucuaagaagcuugcccugauuc

SEQ ID NO: 9152 - RNA, 22 nt, Homo sapiens
ugagggcaggcuucgcagaaga

SEQ ID NO: 9153 - RNA, 22 nt, Homo sapiens
aggcagaaaccgcaucaaggaa

SEQ ID NO: 9154 - RNA, 18 nt, Homo sapiens
uuugugcccuuucugccu

SEQ ID NO: 9155 - RNA, 22 nt, Homo sapiens
aggcugaggcccagagagaggc

SEQ ID NO: 9156 - RNA, 22 nt, Homo sapiens
cuuuugugggccucaguuucug

SEQ ID NO: 9157 - RNA, 22 nt, Homo sapiens
uacaccuuugaaaacaagccac

SEQ ID NO: 9158 - RNA, 22 nt, Homo sapiens
gcuuguuuuaaaagguauacag

SEQ ID NO: 9159 - RNA, 22 nt, Homo sapiens
uccaaggaagucccuuauggcc

SEQ ID NO: 9160 - RNA, 22 nt, Homo sapiens
uuaaaagggcuuccuucaaagg

SEQ ID NO: 9161 - RNA, 22 nt, Homo sapiens
acaucacagcaagucugugcug

SEQ ID NO: 9162 - RNA, 21 nt, Homo sapiens
uuaagacuugcagugauguuu

SEQ ID NO: 9163 - RNA, 22 nt, Homo sapiens
uuaagacuugcagugauguuua

SEQ ID NO: 9164 - RNA, 23 nt, Homo sapiens
uuaagacuugcagugauguuuaa

SEQ ID NO: 9165 - RNA, 22 nt, Homo sapiens
ugcacguuugagcaaacaaaua

SEQ ID NO: 9166 - RNA, 22 nt, Homo sapiens
uuuauugcaucaaauauguacc

SEQ ID NO: 9167 - RNA, 22 nt, Homo sapiens
uugagccgcagaaguguccuac

SEQ ID NO: 9168 - RNA, 22 nt, Homo sapiens
ucaggacuuuugaaagcuuaau

SEQ ID NO: 9169 - RNA, 22 nt, Homo sapiens
ucuaucuccccacuuuauuuuu

SEQ ID NO: 9170 - RNA, 22 nt, Homo sapiens
aaguagggguggagggcgaaga

SEQ ID NO: 9171 - RNA, 21 nt, Homo sapiens
uaaucucagcuggcaacugug

SEQ ID NO: 9172 - RNA, 21 nt, Homo sapiens
ucacaguggucucugggauua

SEQ ID NO: 9173 - RNA, 22 nt, Homo sapiens
uuucucuuucuuuccccagacu

SEQ ID NO: 9174 - RNA, 22 nt, Homo sapiens
ugauggaaagaaccaggaaagg

SEQ ID NO: 9175 - RNA, 22 nt, Homo sapiens
uucacagcaguccauagaggcu

SEQ ID NO: 9176 - RNA, 22 nt, Homo sapiens
cccacucugauggccugcuggg

SEQ ID NO: 9177 - RNA, 22 nt, Homo sapiens
cagccucguaggaggggcuggu

SEQ ID NO: 9178 - RNA, 22 nt, Homo sapiens
gccccucacaugcagagguuuc

SEQ ID NO: 9179 - RNA, 22 nt, Homo sapiens
gagcaccuccuauauuccgggc

SEQ ID NO: 9180 - RNA, 17 nt, Homo sapiens
cugggagagagguguuu

SEQ ID NO: 9181 - RNA, 22 nt, Homo sapiens
uagggacuguggggacaggagg

SEQ ID NO: 9182 - RNA, 22 nt, Homo sapiens
ccugccugucuccaucccugcc

SEQ ID NO: 9183 - RNA, 22 nt, Homo sapiens
uacuuagcugcgugguagaaug

SEQ ID NO: 9184 - RNA, 22 nt, Homo sapiens
cacgguguuucacgguuuaagu

SEQ ID NO: 9185 - RNA, 22 nt, Homo sapiens
uucccucuuuccucuguauguu

SEQ ID NO: 9186 - RNA, 22 nt, Homo sapiens
uuacguaaggaggaagggaaca

SEQ ID NO: 9187 - RNA, 22 nt, Homo sapiens
cagccuacuuggacugagccug

SEQ ID NO: 9188 - RNA, 22 nt, Homo sapiens
gguuuaaaucccaugggcuguu

SEQ ID NO: 9189 - RNA, 22 nt, Homo sapiens
uccuucuguucuaguuagcugu

SEQ ID NO: 9190 - RNA, 21 nt, Homo sapiens
aguuaauuggagggagggaga

SEQ ID NO: 9191 - RNA, 22 nt, Homo sapiens
ugcucucuagguucuggucccu

SEQ ID NO: 9192 - RNA, 22 nt, Homo sapiens
guggacgcagccgagggagcag

SEQ ID NO: 9193 - RNA, 22 nt, Homo sapiens
ucucaagggguagcugucucau

SEQ ID NO: 9194 - RNA, 22 nt, Homo sapiens
aggcuggcuaccacuugagacu

SEQ ID NO: 9195 - RNA, 22 nt, Homo sapiens
ggagaaauggggucucaggaug

SEQ ID NO: 9196 - RNA, 22 nt, Homo sapiens
uaucugugacacuuuguuucuu

SEQ ID NO: 9197 - RNA, 22 nt, Homo sapiens
gagaggaugcuuaauuuuuuug

SEQ ID NO: 9198 - RNA, 22 nt, Homo sapiens
uaaaaaccaagcaugcuuuuug

SEQ ID NO: 9199 - RNA, 23 nt, Homo sapiens
uauggcacugguagaauucacug

SEQ ID NO: 9200 - RNA, 22 nt, Homo sapiens
ugaauuaccgaagggccauaaa

SEQ ID NO: 9201 - RNA, 22 nt, Homo sapiens
ucauccgauguacaauaauuuc

SEQ ID NO: 9202 - RNA, 22 nt, Homo sapiens
aaaauauuguauaucagaugag

SEQ ID NO: 9203 - RNA, 22 nt, Homo sapiens
gaggcagagaagggacaggaaa

SEQ ID NO: 9204 - RNA, 22 nt, Homo sapiens
ugcugugccuuugucugccucc

SEQ ID NO: 9205 - RNA, 22 nt, Homo sapiens
ccaucaaugacuaauaaaauag

SEQ ID NO: 9206 - RNA, 22 nt, Homo sapiens
uguuuuauuauucauuugaggg

SEQ ID NO: 9207 - RNA, 22 nt, Homo sapiens
uugcgggugggggagaagggag

SEQ ID NO: 9208 - RNA, 22 nt, Homo sapiens
ucccuucccccuuucccucaac

SEQ ID NO: 9209 - RNA, 22 nt, Homo sapiens
uucugcgaagccugcccucauu

SEQ ID NO: 9210 - RNA, 22 nt, Homo sapiens
ucagggcaagcuucuuagagaa

SEQ ID NO: 9211 - RNA, 22 nt, Homo sapiens
ugucauauguacuauggcugac

SEQ ID NO: 9212 - RNA, 22 nt, Homo sapiens
uguagucauguguauuaugaau

SEQ ID NO: 9213 - RNA, 22 nt, Homo sapiens
ucaggucugcauuuuagaaaga

SEQ ID NO: 9214 - RNA, 16 nt, Homo sapiens
uggguggagacuugau

SEQ ID NO: 9215 - RNA, 22 nt, Homo sapiens
ucagcacucaauaaaagcuuaa

SEQ ID NO: 9216 - RNA, 22 nt, Homo sapiens
guauucauugagugcuucuuau

SEQ ID NO: 9217 - RNA, 22 nt, Homo sapiens
uuuucuuuuguuccaugcuggc

SEQ ID NO: 9218 - RNA, 20 nt, Homo sapiens
gaaguaggaaggaaagagaa

SEQ ID NO: 9219 - RNA, 22 nt, Homo sapiens
agagcaguggcauucugagcag

SEQ ID NO: 9220 - RNA, 22 nt, Homo sapiens
cugacucaggcuggugcuuucu

SEQ ID NO: 9221 - RNA, 22 nt, Homo sapiens
gcacgcgcagugcugccggcca

SEQ ID NO: 9222 - RNA, 21 nt, Homo sapiens
gcgcuacgggcaugcgcgugc

SEQ ID NO: 9223 - RNA, 22 nt, Homo sapiens
ucuucucgccuuuuccccuuuu

SEQ ID NO: 9224 - RNA, 22 nt, Homo sapiens
uguaggagacaagggagaggag

SEQ ID NO: 9225 - RNA, 22 nt, Homo sapiens
agcccaggagaauagauaauau

SEQ ID NO: 9226 - RNA, 22 nt, Homo sapiens
uaauguguacucuucgggcuca

SEQ ID NO: 9227 - RNA, 22 nt, Homo sapiens
aguggcugaagguagaguccac

SEQ ID NO: 9228 - RNA, 22 nt, Homo sapiens
gacuugaccuuaagcacacuug

SEQ ID NO: 9229 - RNA, 22 nt, Homo sapiens
cauggcccuguuucugcugccc

SEQ ID NO: 9230 - RNA, 20 nt, Homo sapiens
gcagccaaagaggggcugug

SEQ ID NO: 9231 - RNA, 22 nt, Homo sapiens
agggccugggccagcacccuuu

SEQ ID NO: 9232 - RNA, 20 nt, Homo sapiens
acaggggagggccaggcccu

SEQ ID NO: 9233 - RNA, 22 nt, Homo sapiens
uguuguugauuuuuuuuccaaa

SEQ ID NO: 9234 - RNA, 22 nt, Homo sapiens
uggaaaacagacaaaaaacagc

SEQ ID NO: 9235 - RNA, 22 nt, Homo sapiens
uggacgaagcuuuucucacagu

SEQ ID NO: 9236 - RNA, 22 nt, Homo sapiens
acugugacucggggcuguucag

SEQ ID NO: 9237 - RNA, 22 nt, Homo sapiens
cccccagcugagggaccagcuc

SEQ ID NO: 9238 - RNA, 22 nt, Homo sapiens
guugcacagucucaggcugggg

SEQ ID NO: 9239 - RNA, 22 nt, Homo sapiens
aggagaagaagaugugcgcgga

SEQ ID NO: 9240 - RNA, 22 nt, Homo sapiens
cucgcaggucucuuucucuugc

SEQ ID NO: 9241 - RNA, 22 nt, Homo sapiens
uucuagauccauuccaaaguaa

SEQ ID NO: 9242 - RNA, 22 nt, Homo sapiens
cugauggguuggaagugggaug

SEQ ID NO: 9243 - RNA, 22 nt, Homo sapiens
uauuuggaccaauugugagagc

SEQ ID NO: 9244 - RNA, 22 nt, Homo sapiens
ucucacaaugggacggauaacu

SEQ ID NO: 9245 - RNA, 22 nt, Homo sapiens
gggucuugcaggcagagcgugg

SEQ ID NO: 9246 - RNA, 22 nt, Homo sapiens
ugcacucugcugcagacccucg

SEQ ID NO: 9247 - RNA, 22 nt, Homo sapiens
ucacucagauauauuaggguua

SEQ ID NO: 9248 - RNA, 22 nt, Homo sapiens
uaauuauauguuugugugauug

SEQ ID NO: 9249 - RNA, 22 nt, Homo sapiens
aaaugggaauguauaaaguacu

SEQ ID NO: 9250 - RNA, 22 nt, Homo sapiens
guacuuuagaaguaccauuugc

SEQ ID NO: 9251 - RNA, 22 nt, Homo sapiens
agacuucgugguggugcuaaga

SEQ ID NO: 9252 - RNA, 22 nt, Homo sapiens
uuacaccacucccaggaagaau

SEQ ID NO: 9253 - RNA, 22 nt, Homo sapiens
uuuuuauauggccagggugaua

SEQ ID NO: 9254 - RNA, 22 nt, Homo sapiens
uaaccuggcagguagagagaaa

SEQ ID NO: 9255 - RNA, 22 nt, Homo sapiens
ugggauggagcugugugcaggg

SEQ ID NO: 9256 - RNA, 22 nt, Homo sapiens
cuguacaguggcugggggccag

SEQ ID NO: 9257 - RNA, 22 nt, Homo sapiens
gggguaggugugagagacccag

SEQ ID NO: 9258 - RNA, 22 nt, Homo sapiens
cccuguccucagccaccucugg

SEQ ID NO: 9259 - RNA, 22 nt, Homo sapiens
uugaugcgccauuuggccuaag

SEQ ID NO: 9260 - RNA, 21 nt, Homo sapiens
agagccaaaugagcauuaaug

SEQ ID NO: 9261 - RNA, 22 nt, Homo sapiens
ugacauagccaaccuuuaaaaa

SEQ ID NO: 9262 - RNA, 22 nt, Homo sapiens
uuaaaagguugaaugugucaua

SEQ ID NO: 9263 - RNA, 22 nt, Homo sapiens
cagcauuuggcaucaggaagga

SEQ ID NO: 9264 - RNA, 22 nt, Homo sapiens
cucucuugcugcucaaugcuaa

SEQ ID NO: 9265 - RNA, 22 nt, Homo sapiens
uagaguugggggaacucuggca

SEQ ID NO: 9266 - RNA, 22 nt, Homo sapiens
uuuccagagucaccccuaacuc

SEQ ID NO: 9267 - RNA, 22 nt, Homo sapiens
uuuccagguaccagagucuugg

SEQ ID NO: 9268 - RNA, 22 nt, Homo sapiens
cucauucuuggugucugcaguu

SEQ ID NO: 9269 - RNA, 22 nt, Homo sapiens
ggucauuguggagaggcacuua

SEQ ID NO: 9270 - RNA, 21 nt, Homo sapiens
gugcuucuguuaaugaugacu

SEQ ID NO: 9271 - RNA, 22 nt, Homo sapiens
acuguucuucuucaaagucuuu

SEQ ID NO: 9272 - RNA, 22 nt, Homo sapiens
ggcuggaagaggagaagggacc

SEQ ID NO: 9273 - RNA, 22 nt, Homo sapiens
uucgcugaccgcggcucaguuu

SEQ ID NO: 9274 - RNA, 22 nt, Homo sapiens
aacuggggcgggaagggggaag

SEQ ID NO: 9275 - RNA, 22 nt, Homo sapiens
uucugcagaggcggcacacagu

SEQ ID NO: 9276 - RNA, 16 nt, Homo sapiens
ugugugcucugcagaa

SEQ ID NO: 9277 - RNA, 22 nt, Homo sapiens
acucaaguaagaaacagaauug

SEQ ID NO: 9278 - RNA, 22 nt, Homo sapiens
acauuuuguauuuuuugagucg

SEQ ID NO: 9279 - RNA, 22 nt, Homo sapiens
gcccuccccccucuucuuugga

SEQ ID NO: 9280 - RNA, 22 nt, Homo sapiens
gcccuggggaagggggagggaa

SEQ ID NO: 9281 - RNA, 22 nt, Homo sapiens
cccugugggguccgccuguccg

SEQ ID NO: 9282 - RNA, 20 nt, Homo sapiens
gguggccaggccccacaggg

SEQ ID NO: 9283 - RNA, 22 nt, Homo sapiens
auuacuucuaaauggaggggua

SEQ ID NO: 9284 - RNA, 22 nt, Homo sapiens
cuuuuaauuuagauuuaaagaa

SEQ ID NO: 9285 - RNA, 22 nt, Homo sapiens
gcgucagaaggucaggcugucc

SEQ ID NO: 9286 - RNA, 22 nt, Homo sapiens
cauccuagcaccgucugacauc

SEQ ID NO: 9287 - RNA, 22 nt, Homo sapiens
uggucauagcuguagaaaacaa

SEQ ID NO: 9288 - RNA, 22 nt, Homo sapiens
uuuucuauagcuaugaccguua

SEQ ID NO: 9289 - RNA, 22 nt, Homo sapiens
ugccuuugauuugaguaaaaga

SEQ ID NO: 9290 - RNA, 22 nt, Homo sapiens
ucuuuuguuagaaucaaaggca

SEQ ID NO: 9291 - RNA, 22 nt, Homo sapiens
ccuauuuaucucauuauauaga

SEQ ID NO: 9292 - RNA, 21 nt, Homo sapiens
uagguaauggguuaaguaggc

SEQ ID NO: 9293 - RNA, 22 nt, Homo sapiens
uccucuacaaaugucaccagca

SEQ ID NO: 9294 - RNA, 22 nt, Homo sapiens
uuggcaacauuuguuggggaaa

SEQ ID NO: 9295 - RNA, 22 nt, Homo sapiens
ccuaguuaccaauuuuacucgg

SEQ ID NO: 9296 - RNA, 22 nt, Homo sapiens
ccuggaacuaaguuggucauug

SEQ ID NO: 9297 - RNA, 22 nt, Homo sapiens
ggaacuguggucauugcagggu

SEQ ID NO: 9298 - RNA, 22 nt, Homo sapiens
ucauucuuuugugaugaucaug

SEQ ID NO: 9299 - RNA, 22 nt, Homo sapiens
uuauuuguagcuucccaaagcu

SEQ ID NO: 9300 - RNA, 22 nt, Homo sapiens
ggauuguaaaguugacaaauau

SEQ ID NO: 9301 - RNA, 22 nt, Homo sapiens
uuugguauguguuccuggaagg

SEQ ID NO: 9302 - RNA, 18 nt, Homo sapiens
cugggaauuuauaccaaa

SEQ ID NO: 9303 - RNA, 22 nt, Homo sapiens
uccucuguuugugacaacauaa

SEQ ID NO: 9304 - RNA, 22 nt, Homo sapiens
ugugaaguugcaaagcaaggau

SEQ ID NO: 9305 - RNA, 22 nt, Homo sapiens
uguucagaggugagagugagcc

SEQ ID NO: 9306 - RNA, 22 nt, Homo sapiens
gcuucucuagcuugugaaucug

SEQ ID NO: 9307 - RNA, 22 nt, Homo sapiens
ugucuccagggcaggugcaggu

SEQ ID NO: 9308 - RNA, 22 nt, Homo sapiens
cuuucugucauggccuggggca

SEQ ID NO: 9309 - RNA, 22 nt, Homo sapiens
acauagaggaaauuccacguuu

SEQ ID NO: 9310 - RNA, 22 nt, Homo sapiens
gguggauauuccuucuauguuu

SEQ ID NO: 9311 - RNA, 22 nt, Homo sapiens
gguagauuuuccuucuaugguu

SEQ ID NO: 9312 - RNA, 22 nt, Homo sapiens
aucauagaggaaaauccacguu

SEQ ID NO: 9313 - RNA, 22 nt, Homo sapiens
aagguagauucuccuucuauga

SEQ ID NO: 9314 - RNA, 22 nt, Homo sapiens
auagaggaaaauccacguuuuc

SEQ ID NO: 9315 - RNA, 22 nt, Homo sapiens
uagauucuccuucuaugaguac

SEQ ID NO: 9316 - RNA, 22 nt, Homo sapiens
uaaggugcaucuagugcagaua

SEQ ID NO: 9317 - RNA, 22 nt, Homo sapiens
uacugcccuaagugcuccuucu

SEQ ID NO: 9318 - RNA, 22 nt, Homo sapiens
ggguggacaggugcuaauuccu

SEQ ID NO: 9319 - RNA, 22 nt, Homo sapiens
gcaacuggcaccugcaaauccc

SEQ ID NO: 9320 - RNA, 22 nt, Homo sapiens
gaagguugcaguuggaugugac

SEQ ID NO: 9321 - RNA, 22 nt, Homo sapiens
aggacucucugcagcccuuccu

SEQ ID NO: 9322 - RNA, 22 nt, Homo sapiens
uaggcagcucacguguaggggc

SEQ ID NO: 9323 - RNA, 22 nt, Homo sapiens
ucuugauguugcugcccauaag

SEQ ID NO: 9324 - RNA, 22 nt, Homo sapiens
gggagggaguucucugaggaag

SEQ ID NO: 9325 - RNA, 20 nt, Homo sapiens
uccucacagacuuccuuucc

SEQ ID NO: 9326 - RNA, 22 nt, Homo sapiens
uggccagagggguccucagaca

SEQ ID NO: 9327 - RNA, 22 nt, Homo sapiens
uauugugggcccaccucugccu

SEQ ID NO: 9328 - RNA, 22 nt, Homo sapiens
caaugaugcuauuaauuuuuau

SEQ ID NO: 9329 - RNA, 22 nt, Homo sapiens
aaguaaauagcaucauuaccug

SEQ ID NO: 9330 - RNA, 22 nt, Homo sapiens
aaagugcuucccuuuggacugu

SEQ ID NO: 9331 - RNA, 20 nt, Homo sapiens
cuccagagggaaguacuuuc

SEQ ID NO: 9332 - RNA, 21 nt, Homo sapiens
cuccagagggaaguacuuucu

SEQ ID NO: 9333 - RNA, 20 nt, Homo sapiens
uccagagggaaguacuuucu

SEQ ID NO: 9334 - RNA, 22 nt, Homo sapiens
ugcaucuuuuuccaaguuuauu

SEQ ID NO: 9335 - RNA, 22 nt, Homo sapiens
agugaguggaaugaguuguagg

SEQ ID NO: 9336 - RNA, 22 nt, Homo sapiens
ugccgcugggucugaggaccug

SEQ ID NO: 9337 - RNA, 22 nt, Homo sapiens
gguguucaguaaguguguuggc

SEQ ID NO: 9338 - RNA, 22 nt, Homo sapiens
uagacugacuauaaaggggucu

SEQ ID NO: 9339 - RNA, 22 nt, Homo sapiens
uccucuuugauaguugguacuu

SEQ ID NO: 9340 - RNA, 22 nt, Homo sapiens
uuccuguccugcccuggcugag

SEQ ID NO: 9341 - RNA, 22 nt, Homo sapiens
ucaguuuagggugggaggaagg

SEQ ID NO: 9342 - RNA, 22 nt, Homo sapiens
uguggauuugauugcuuuuuuu

SEQ ID NO: 9343 - RNA, 21 nt, Homo sapiens
ggagggcaugcaauucacaga

SEQ ID NO: 9344 - RNA, 22 nt, Homo sapiens
ugaguuuguuuaggacuggugu

SEQ ID NO: 9345 - RNA, 22 nt, Homo sapiens
uacuaguuucuagcauucucac

SEQ ID NO: 9346 - RNA, 22 nt, Homo sapiens
uaaugggguggggaacagucaa

SEQ ID NO: 9347 - RNA, 22 nt, Homo sapiens
cugcuccucaacccaccuuccc

SEQ ID NO: 9348 - RNA, 22 nt, Homo sapiens
uggaggcugcugggugaccucg

SEQ ID NO: 9349 - RNA, 22 nt, Homo sapiens
ggcugcccugccugccuccagg

SEQ ID NO: 9350 - RNA, 22 nt, Homo sapiens
auuuucaaguguguuuuguaac

SEQ ID NO: 9351 - RNA, 22 nt, Homo sapiens
agcaaacaccuuuaugaaauuc

SEQ ID NO: 9352 - RNA, 22 nt, Homo sapiens
uagcagugaucuugcauguugg

SEQ ID NO: 9353 - RNA, 22 nt, Homo sapiens
gauaugcauagaucuuucuugc

SEQ ID NO: 9354 - RNA, 22 nt, Homo sapiens
aagcuaaggugccuguguuuau

SEQ ID NO: 9355 - RNA, 22 nt, Homo sapiens
ucaacaaaggcugccucuguuu

SEQ ID NO: 9356 - RNA, 22 nt, Homo sapiens
agagaaugaguugguacauaag

SEQ ID NO: 9357 - RNA, 22 nt, Homo sapiens
uauguacccacucauauucccc

SEQ ID NO: 9358 - RNA, 22 nt, Homo sapiens
aguguuuuguacaauuucuugu

SEQ ID NO: 9359 - RNA, 19 nt, Homo sapiens
agaaaaugggcaaaacacu

SEQ ID NO: 9360 - RNA, 22 nt, Homo sapiens
uuuucuaacaaagaagcugcau

SEQ ID NO: 9361 - RNA, 22 nt, Homo sapiens
gugcccuuuuuuggaggaggcu

SEQ ID NO: 9362 - RNA, 22 nt, Homo sapiens
uuugcauaaucauuuaucugaa

SEQ ID NO: 9363 - RNA, 22 nt, Homo sapiens
auuucagagugugaugcaaaag

SEQ ID NO: 9364 - RNA, 22 nt, Homo sapiens
uuugcauaaucauuuaucugaa

SEQ ID NO: 9365 - RNA, 22 nt, Homo sapiens
auuucagagugugaugcaaaag

SEQ ID NO: 9366 - RNA, 22 nt, Homo sapiens
uagaagagcuuuggcaccaggc

SEQ ID NO: 9367 - RNA, 22 nt, Homo sapiens
uuggcaaagagcugcuuuaagc

SEQ ID NO: 9368 - RNA, 22 nt, Homo sapiens
uauauauuaaugagacucagua

SEQ ID NO: 9369 - RNA, 22 nt, Homo sapiens
ucgucucauuacuuuauaguca

SEQ ID NO: 9370 - RNA, 22 nt, Homo sapiens
ucaaauauuaugcagcuuggau

SEQ ID NO: 9371 - RNA, 20 nt, Homo sapiens
ugagcugcuuuguauuuggc

SEQ ID NO: 9372 - RNA, 22 nt, Homo sapiens
ugacaguuuuauagagugcuuc

SEQ ID NO: 9373 - RNA, 19 nt, Homo sapiens
ggcacaucauaaacuguua

SEQ ID NO: 9374 - RNA, 22 nt, Homo sapiens
ucggcucauagaauauuuguaa

SEQ ID NO: 9375 - RNA, 22 nt, Homo sapiens
uucagauguugggggccaugcu

SEQ ID NO: 9376 - RNA, 22 nt, Homo sapiens
uccuuagugaguucugugaaau

SEQ ID NO: 9377 - RNA, 22 nt, Homo sapiens
uacagcuacucacaaaaaguau

SEQ ID NO: 9378 - RNA, 22 nt, Homo sapiens
uuuucacugggggaaggaaagg

SEQ ID NO: 9379 - RNA, 22 nt, Homo sapiens
auuuuuuauuuccuuaaaauug

SEQ ID NO: 9380 - RNA, 22 nt, Homo sapiens
ugauaggaggguaggaggcaaa

SEQ ID NO: 9381 - RNA, 22 nt, Homo sapiens
ccuccuacccucccaucaccgc

SEQ ID NO: 9382 - RNA, 22 nt, Homo sapiens
uauagggauuggagccguggcg

SEQ ID NO: 9383 - RNA, 23 nt, Homo sapiens
uauggcuuuuuauuccuauguga

SEQ ID NO: 9384 - RNA, 22 nt, Homo sapiens
gcacugaguuagaauuuggggc

SEQ ID NO: 9385 - RNA, 22 nt, Homo sapiens
ugucucagguuuucucaggcca

SEQ ID NO: 9386 - RNA, 22 nt, Homo sapiens
ugguauaauagccuaauacaca

SEQ ID NO: 9387 - RNA, 22 nt, Homo sapiens
uguaccuagguuauuguauucu

SEQ ID NO: 9388 - RNA, 22 nt, Homo sapiens
ugagcucuguaacacagugcug

SEQ ID NO: 9389 - RNA, 22 nt, Homo sapiens
uauuguguuugcagagcucugg

SEQ ID NO: 9390 - RNA, 22 nt, Homo sapiens
cagaguugggaugcgugggagg

SEQ ID NO: 9391 - RNA, 22 nt, Homo sapiens
ucccuggcaugucugacucugg

SEQ ID NO: 9392 - RNA, 22 nt, Homo sapiens
gcaggugauuauaguaaacaua

SEQ ID NO: 9393 - RNA, 22 nt, Homo sapiens
uuuguuugcucuagcuccugcu

SEQ ID NO: 9394 - RNA, 22 nt, Homo sapiens
ucagacaugugcauuccugagg

SEQ ID NO: 9395 - RNA, 22 nt, Homo sapiens
ucuuggugaauuccuuuauguu

SEQ ID NO: 9396 - RNA, 22 nt, Homo sapiens
aggaaaggcuggagugggaggu

SEQ ID NO: 9397 - RNA, 16 nt, Homo sapiens
uccugcugucuuucuu

SEQ ID NO: 9398 - RNA, 22 nt, Homo sapiens
uguguguauuuagauuacucau

SEQ ID NO: 9399 - RNA, 22 nt, Homo sapiens
aguuaaauuuagauaccucgga

SEQ ID NO: 9400 - RNA, 22 nt, Homo sapiens
ccucuauuuaauuuucugaacu

SEQ ID NO: 9401 - RNA, 22 nt, Homo sapiens
uucagugaauuggaagagguaa

SEQ ID NO: 9402 - RNA, 22 nt, Homo sapiens
uuaacugguaagauguacgugu

SEQ ID NO: 9403 - RNA, 22 nt, Homo sapiens
ugugcuuuuacaauuuuuuuuu

SEQ ID NO: 9404 - RNA, 22 nt, Homo sapiens
ucugguuuaguggaugcugaug

SEQ ID NO: 9405 - RNA, 22 nt, Homo sapiens
guccagcauugguugccaggca

SEQ ID NO: 9406 - RNA, 22 nt, Homo sapiens
caguggugggguggguggggag

SEQ ID NO: 9407 - RNA, 22 nt, Homo sapiens
ucugcugaccccaccuccuccc

SEQ ID NO: 9408 - RNA, 22 nt, Homo sapiens
uuggggcagauccuagaagcug

SEQ ID NO: 9409 - RNA, 22 nt, Homo sapiens
gcuuccugggacacugccugaa

SEQ ID NO: 9410 - RNA, 22 nt, Homo sapiens
uaacacugucugguaacgaugu

SEQ ID NO: 9411 - RNA, 22 nt, Homo sapiens
ugagcaucuuaccggacagugc

SEQ ID NO: 9412 - RNA, 22 nt, Homo sapiens
uccucgggcuccugguugcccu

SEQ ID NO: 9413 - RNA, 22 nt, Homo sapiens
gacucacugccaggagccuggg

SEQ ID NO: 9414 - RNA, 22 nt, Homo sapiens
ccagaguagcaggaucuggcag

SEQ ID NO: 9415 - RNA, 22 nt, Homo sapiens
uaacccucaaagaauccacaua

SEQ ID NO: 9416 - RNA, 22 nt, Homo sapiens
ccagaguagcaggaucuggcag

SEQ ID NO: 9417 - RNA, 22 nt, Homo sapiens
uaacccucaaagaauccacaua

SEQ ID NO: 9418 - RNA, 22 nt, Homo sapiens
ccagaguagcaggaucuggcag

SEQ ID NO: 9419 - RNA, 22 nt, Homo sapiens
uaacccucaaagaauccacaua

SEQ ID NO: 9420 - RNA, 22 nt, Homo sapiens
ccagaguagcaggaucuggcag

SEQ ID NO: 9421 - RNA, 22 nt, Homo sapiens
uaacccucaaagaauccacaua

SEQ ID NO: 9422 - RNA, 22 nt, Homo sapiens
ccagaguagcaggaucuggcag

SEQ ID NO: 9423 - RNA, 22 nt, Homo sapiens
uaacccucaaagaauccacaua

SEQ ID NO: 9424 - RNA, 22 nt, Homo sapiens
ccagaguagcaggaucuggcag

SEQ ID NO: 9425 - RNA, 22 nt, Homo sapiens
uaacccucaaagaauccacaua

SEQ ID NO: 9426 - RNA, 22 nt, Homo sapiens
ugguuuucaugccugaugaugg

SEQ ID NO: 9427 - RNA, 22 nt, Homo sapiens
ucaguaggcauugaagaccagc

SEQ ID NO: 9428 - RNA, 22 nt, Homo sapiens
uuuuggcauguggccucugggu

SEQ ID NO: 9429 - RNA, 22 nt, Homo sapiens
cagucgcccaggcuaaaagauu

SEQ ID NO: 9430 - RNA, 22 nt, Homo sapiens
gggccagaccucuucucaggga

SEQ ID NO: 9431 - RNA, 21 nt, Homo sapiens
ucagggaagaggaucuggccc

SEQ ID NO: 9432 - RNA, 22 nt, Homo sapiens
uaagagaaacaguccuaaguga

SEQ ID NO: 9433 - RNA, 22 nt, Homo sapiens
uuucaugauuguuacuuuuauc

SEQ ID NO: 9434 - RNA, 22 nt, Homo sapiens
ugaacucauuacugcucugaua

SEQ ID NO: 9435 - RNA, 22 nt, Homo sapiens
cauuguaagaaauggguugcag

SEQ ID NO: 9436 - RNA, 22 nt, Homo sapiens
gcaguuuucgguccccagggag

SEQ ID NO: 9437 - RNA, 22 nt, Homo sapiens
uccugguggacggagacuggcc

SEQ ID NO: 9438 - RNA, 22 nt, Homo sapiens
uggcuaagcuuccaaggcccuc

SEQ ID NO: 9439 - RNA, 22 nt, Homo sapiens
aaucgggccgggguuugggcca

SEQ ID NO: 9440 - RNA, 22 nt, Homo sapiens
ucuuucugauuucuuugucauu

SEQ ID NO: 9441 - RNA, 18 nt, Homo sapiens
acaggagauacagagaga

SEQ ID NO: 9442 - RNA, 22 nt, Homo sapiens
ucauccuuauuaauuauuguua

SEQ ID NO: 9443 - RNA, 22 nt, Homo sapiens
agaauauuugaugguuucugga

SEQ ID NO: 9444 - RNA, 22 nt, Homo sapiens
uugggggaaugagcaauaugug

SEQ ID NO: 9445 - RNA, 20 nt, Homo sapiens
auauggcucaucuucuucaa

SEQ ID NO: 9446 - RNA, 22 nt, Homo sapiens
cagaggcugggagucagcagca

SEQ ID NO: 9447 - RNA, 22 nt, Homo sapiens
ugcugagauuccagaucuuugg

SEQ ID NO: 9448 - RNA, 22 nt, Homo sapiens
acgccauuaucacacuaaauag

SEQ ID NO: 9449 - RNA, 23 nt, Homo sapiens
uggagugugacaaugguguuugu

SEQ ID NO: 9450 - RNA, 22 nt, Homo sapiens
ugggaauauaaugaaaacucug

SEQ ID NO: 9451 - RNA, 22 nt, Homo sapiens
gauguuuucaugcauauucccc

SEQ ID NO: 9452 - RNA, 22 nt, Homo sapiens
uugagcggcaccgccagaaacc

SEQ ID NO: 9453 - RNA, 22 nt, Homo sapiens
guugugugugguguguuuaucc

SEQ ID NO: 9454 - RNA, 22 nt, Homo sapiens
cgcccgaugaagaagaucccag

SEQ ID NO: 9455 - RNA, 22 nt, Homo sapiens
uggaucucuuggguaucggggu

SEQ ID NO: 9456 - RNA, 22 nt, Homo sapiens
aaucucucacccauggccugaa

SEQ ID NO: 9457 - RNA, 22 nt, Homo sapiens
cagaucaugggaaggagaaugu

SEQ ID NO: 9458 - RNA, 22 nt, Homo sapiens
cagggacagguaaacgcaggaa

SEQ ID NO: 9459 - RNA, 22 nt, Homo sapiens
ucccagggcgugccugguuccu

SEQ ID NO: 9460 - RNA, 22 nt, Homo sapiens
ugggucccuuaaagaggugaua

SEQ ID NO: 9461 - RNA, 22 nt, Homo sapiens
ucaucuucagaggagacccaga

SEQ ID NO: 9462 - RNA, 22 nt, Homo sapiens
ucauuaugcuccaucuugucag

SEQ ID NO: 9463 - RNA, 22 nt, Homo sapiens
ugacaugaugagcaauaauggc

SEQ ID NO: 9464 - RNA, 22 nt, Homo sapiens
uggcuguaaccugagaagcugu

SEQ ID NO: 9465 - RNA, 22 nt, Homo sapiens
gauucucaggggacaggcugac

SEQ ID NO: 9466 - RNA, 22 nt, Homo sapiens
ugcgcagacuaauugccugugg

SEQ ID NO: 9467 - RNA, 19 nt, Homo sapiens
gcaauugaguccugugugc

SEQ ID NO: 9468 - RNA, 22 nt, Homo sapiens
uggccaggcugggggggcugug

SEQ ID NO: 9469 - RNA, 22 nt, Homo sapiens
uagcucuccuccucugaccuug

SEQ ID NO: 9470 - RNA, 22 nt, Homo sapiens
uggggagaaggagcuguggugg

SEQ ID NO: 9471 - RNA, 22 nt, Homo sapiens
ccuauagcuauuuucucccucu

SEQ ID NO: 9472 - RNA, 22 nt, Homo sapiens
cggucucaccaaacgccccaaa

SEQ ID NO: 9473 - RNA, 19 nt, Homo sapiens
gggcgccuggcugaggcug

SEQ ID NO: 9474 - RNA, 22 nt, Homo sapiens
gggugggagcugagauggcugg

SEQ ID NO: 9475 - RNA, 20 nt, Homo sapiens
cuugucugagcuucccaucu

SEQ ID NO: 9476 - RNA, 22 nt, Homo sapiens
gaaacaggagcugucuccccaa

SEQ ID NO: 9477 - RNA, 22 nt, Homo sapiens
uggggaagaugugaucuguguu

SEQ ID NO: 9478 - RNA, 22 nt, Homo sapiens
uggcugagaaguucugguggga

SEQ ID NO: 9479 - RNA, 22 nt, Homo sapiens
caucuggauauccuuccucagc

SEQ ID NO: 9480 - RNA, 22 nt, Homo sapiens
cgggagguaaggagcaaggcau

SEQ ID NO: 9481 - RNA, 22 nt, Homo sapiens
acgucuugcguucccugcccgc

SEQ ID NO: 9482 - RNA, 22 nt, Homo sapiens
gggagcagcagucagucaccau

SEQ ID NO: 9483 - RNA, 21 nt, Homo sapiens
uggugaccccugucuguuccc

SEQ ID NO: 9484 - RNA, 22 nt, Homo sapiens
uggccgugcaugauauggcugc

SEQ ID NO: 9485 - RNA, 22 nt, Homo sapiens
guuguaugcagagcacugcugg

SEQ ID NO: 9486 - RNA, 22 nt, Homo sapiens
uagcagccuccucucgcgccca

SEQ ID NO: 9487 - RNA, 22 nt, Homo sapiens
ggcgugggaggaccuaggccug

SEQ ID NO: 9488 - RNA, 22 nt, Homo sapiens
uagcugugagucauggguguga

SEQ ID NO: 9489 - RNA, 22 nt, Homo sapiens
ucaggagcccaagacuguacag

SEQ ID NO: 9490 - RNA, 22 nt, Homo sapiens
ugcuaggagugugcuuccaugg

SEQ ID NO: 9491 - RNA, 22 nt, Homo sapiens
agggaagcacaauccuaguauc

SEQ ID NO: 9492 - RNA, 22 nt, Homo sapiens
ugucaggugaguccucaugcug

SEQ ID NO: 9493 - RNA, 22 nt, Homo sapiens
gcgugggucucauuucccacug

SEQ ID NO: 9494 - RNA, 22 nt, Homo sapiens
uggcggccaggagaagacauau

SEQ ID NO: 9495 - RNA, 22 nt, Homo sapiens
ugugucuaucuacuggcccucc

SEQ ID NO: 9496 - RNA, 22 nt, Homo sapiens
ugcagcccgggaaacugaggca

SEQ ID NO: 9497 - RNA, 22 nt, Homo sapiens
ugucucagagguccugggggug

SEQ ID NO: 9498 - RNA, 22 nt, Homo sapiens
uuccuagcacugcuaagcaaga

SEQ ID NO: 9499 - RNA, 22 nt, Homo sapiens
uuugcuuagcagugcugggaag

SEQ ID NO: 9500 - RNA, 22 nt, Homo sapiens
agcggguuaggcucggggaauu

SEQ ID NO: 9501 - RNA, 22 nt, Homo sapiens
aucucccgggagccagccccuc

SEQ ID NO: 9502 - RNA, 22 nt, Homo sapiens
cuguggaaaggagagaggagac

SEQ ID NO: 9503 - RNA, 22 nt, Homo sapiens
ucaucucuucauucauucaugc

SEQ ID NO: 9504 - RNA, 22 nt, Homo sapiens
ucucucucccaccuccuguaau

SEQ ID NO: 9505 - RNA, 17 nt, Homo sapiens
ggggcagguagagaggg

SEQ ID NO: 9506 - RNA, 22 nt, Homo sapiens
uugagucaggccucggucuccu

SEQ ID NO: 9507 - RNA, 22 nt, Homo sapiens
gagacggaggccugacuuaccc

SEQ ID NO: 9508 - RNA, 22 nt, Homo sapiens
uacuacagggcaacccuuuucc

SEQ ID NO: 9509 - RNA, 19 nt, Homo sapiens
aggguagaccaugugguag

SEQ ID NO: 9510 - RNA, 22 nt, Homo sapiens
agaagcagaugggcaauaccga

SEQ ID NO: 9511 - RNA, 22 nt, Homo sapiens
gauauugcccaucuguuuuccu

SEQ ID NO: 9512 - RNA, 22 nt, Homo sapiens
ccacuuacuauauaucgaugua

SEQ ID NO: 9513 - RNA, 22 nt, Homo sapiens
caaugauauacaguaaguggua

SEQ ID NO: 9514 - RNA, 22 nt, Homo sapiens
ugagggagggcaccugaccuug

SEQ ID NO: 9515 - RNA, 22 nt, Homo sapiens
uaggguggagugcuuuuccucg

SEQ ID NO: 9516 - RNA, 22 nt, Homo sapiens
uuuuauucaggagaggucacug

SEQ ID NO: 9517 - RNA, 22 nt, Homo sapiens
ugaucuggcuccugcuugaaag

SEQ ID NO: 9518 - RNA, 22 nt, Homo sapiens
uaacucucauauacugugguuc

SEQ ID NO: 9519 - RNA, 22 nt, Homo sapiens
ccacauuacgguauauggcuga

SEQ ID NO: 9520 - RNA, 22 nt, Homo sapiens
ggugguuguuaauuuuuggcgu

SEQ ID NO: 9521 - RNA, 22 nt, Homo sapiens
ccaguaucuaauuagcaaagcc

SEQ ID NO: 9522 - RNA, 22 nt, Homo sapiens
cccuuacgcacguggauuuccc

SEQ ID NO: 9523 - RNA, 20 nt, Homo sapiens
gaaucguguguacgugaggg

SEQ ID NO: 9524 - RNA, 22 nt, Homo sapiens
uaaauugucuuucuguaagugu

SEQ ID NO: 9525 - RNA, 22 nt, Homo sapiens
aagcuuacaaaagacaugauuu

SEQ ID NO: 9526 - RNA, 22 nt, Homo sapiens
uucaguguacugugaauguaua

SEQ ID NO: 9527 - RNA, 22 nt, Homo sapiens
cauuuauagcaguacaacugag

SEQ ID NO: 9528 - RNA, 22 nt, Homo sapiens
aaauggugcacucugcucugau

SEQ ID NO: 9529 - RNA, 22 nt, Homo sapiens
ucguuagcagagucaccguguu

SEQ ID NO: 9530 - RNA, 22 nt, Homo sapiens
uccaaagugaagauaaaacucc

SEQ ID NO: 9531 - RNA, 22 nt, Homo sapiens
guuuguaucuucaaagugaaag

SEQ ID NO: 9532 - RNA, 22 nt, Homo sapiens
uccaaagugaagauaaaacucc

SEQ ID NO: 9533 - RNA, 22 nt, Homo sapiens
guuuguaucuucaaagugaaag

SEQ ID NO: 9534 - RNA, 22 nt, Homo sapiens
agaaagaggcacauuucuagau

SEQ ID NO: 9535 - RNA, 22 nt, Homo sapiens
gugggaacguuacucugcuucu

SEQ ID NO: 9536 - RNA, 22 nt, Homo sapiens
acugauacuuuuaguguuagag

SEQ ID NO: 9537 - RNA, 22 nt, Homo sapiens
ucccaacacuaauuuauuaaau

SEQ ID NO: 9538 - RNA, 22 nt, Homo sapiens
cgcccuuccuccacucuuccug

SEQ ID NO: 9539 - RNA, 22 nt, Homo sapiens
ggaggagugcgggccggagggu

SEQ ID NO: 9540 - RNA, 22 nt, Homo sapiens
ugauaaagggcucucucaguuc

SEQ ID NO: 9541 - RNA, 22 nt, Homo sapiens
ggcaaagggagaucuuaaucag

SEQ ID NO: 9542 - RNA, 22 nt, Homo sapiens
cccuucauuugcucuuggcuag

SEQ ID NO: 9543 - RNA, 22 nt, Homo sapiens
gcugcagagcagucgaacgggg

SEQ ID NO: 9544 - RNA, 22 nt, Homo sapiens
ugggcccugucuggugguggcu

SEQ ID NO: 9545 - RNA, 22 nt, Homo sapiens
cacagcaccgggcaccagggcu

SEQ ID NO: 9546 - RNA, 22 nt, Homo sapiens
cucgucuccugcucucacucca

SEQ ID NO: 9547 - RNA, 22 nt, Homo sapiens
acugagggcaugggggaugagu

SEQ ID NO: 9548 - RNA, 22 nt, Homo sapiens
ggguagugggaaaggcaaggcu

SEQ ID NO: 9549 - RNA, 22 nt, Homo sapiens
ccuggccauuucccccgauuac

SEQ ID NO: 9550 - RNA, 22 nt, Homo sapiens
ggccuuguucccuucccaccca

SEQ ID NO: 9551 - RNA, 21 nt, Homo sapiens
gguagaggggcuggcaagguc

SEQ ID NO: 9552 - RNA, 22 nt, Homo sapiens
gggaggcacaggaggaugccua

SEQ ID NO: 9553 - RNA, 22 nt, Homo sapiens
gcaugcuucugagaugucuccu

SEQ ID NO: 9554 - RNA, 22 nt, Homo sapiens
gggcaggggugggguggggaga

SEQ ID NO: 9555 - RNA, 22 nt, Homo sapiens
ucuccccccacccucccugccc

SEQ ID NO: 9556 - RNA, 22 nt, Homo sapiens
gcgcugcugggcugggggauga

SEQ ID NO: 9557 - RNA, 22 nt, Homo sapiens
cuauuucugggccuccuggcag

SEQ ID NO: 9558 - RNA, 22 nt, Homo sapiens
cccucggcucgccuggcccaga

SEQ ID NO: 9559 - RNA, 22 nt, Homo sapiens
gccugggccuggcgcggggggu

SEQ ID NO: 9560 - RNA, 22 nt, Homo sapiens
uuggauauugcuuggaggcucu

SEQ ID NO: 9561 - RNA, 22 nt, Homo sapiens
aaugguuuccaagggguaugcu

SEQ ID NO: 9562 - RNA, 22 nt, Homo sapiens
ucucccguuuccuguguauggu

SEQ ID NO: 9563 - RNA, 22 nt, Homo sapiens
gccacaggagacagggccagga

SEQ ID NO: 9564 - RNA, 22 nt, Homo sapiens
ugucauuagcuguuuaagcgua

SEQ ID NO: 9565 - RNA, 22 nt, Homo sapiens
ugcuugaauaguuuuggauagc

SEQ ID NO: 9566 - RNA, 22 nt, Homo sapiens
ugcccagcccugcucaccuccc

SEQ ID NO: 9567 - RNA, 22 nt, Homo sapiens
ccugagcaggggucugggcaga

SEQ ID NO: 9568 - RNA, 22 nt, Homo sapiens
ucgggaggaaaagaaagaagac

SEQ ID NO: 9569 - RNA, 22 nt, Homo sapiens
uuuaucuuuuucuccagaugcc

SEQ ID NO: 9570 - RNA, 22 nt, Homo sapiens
ugacaugcgccacuuagagcgg

SEQ ID NO: 9571 - RNA, 22 nt, Homo sapiens
cucuaaguggcuucuguauguu

SEQ ID NO: 9572 - RNA, 22 nt, Homo sapiens
gcuggcacucucauuguuacau

SEQ ID NO: 9573 - RNA, 21 nt, Homo sapiens
acaaugggaggaagugcuagc

SEQ ID NO: 9574 - RNA, 22 nt, Homo sapiens
uccugucucugaguaacaccuu

SEQ ID NO: 9575 - RNA, 20 nt, Homo sapiens
uacucagacauuggcagggc

SEQ ID NO: 9576 - RNA, 22 nt, Homo sapiens
uuaguaggguguucaaaugugc

SEQ ID NO: 9577 - RNA, 22 nt, Homo sapiens
acauuugaggagagcccuacua

SEQ ID NO: 9578 - RNA, 22 nt, Homo sapiens
uuucucaguuuggaaagaaugc

SEQ ID NO: 9579 - RNA, 22 nt, Homo sapiens
uauuuuccacuuguggaaagag

SEQ ID NO: 9580 - RNA, 22 nt, Homo sapiens
uggccugcauuuuuuuucaugc

SEQ ID NO: 9581 - RNA, 22 nt, Homo sapiens
uauugggagaaaugagugcuau

SEQ ID NO: 9582 - RNA, 22 nt, Homo sapiens
cagaugagacagcuggggaauu

SEQ ID NO: 9583 - RNA, 22 nt, Homo sapiens
guuccugggcucucaucuuggu

SEQ ID NO: 9584 - RNA, 22 nt, Homo sapiens
agcacagcacggcugcagaggg

SEQ ID NO: 9585 - RNA, 22 nt, Homo sapiens
ucugcagcuguugcugugccug

SEQ ID NO: 9586 - RNA, 22 nt, Homo sapiens
aauuguuuuucucugaccugaa

SEQ ID NO: 9587 - RNA, 22 nt, Homo sapiens
uuugguccagagagacagcuag

SEQ ID NO: 9588 - RNA, 22 nt, Homo sapiens
agggugaggaauguaaggugga

SEQ ID NO: 9589 - RNA, 22 nt, Homo sapiens
auguugcauuccugcucaggug

SEQ ID NO: 9590 - RNA, 22 nt, Homo sapiens
accuccugugugcauggauuac

SEQ ID NO: 9591 - RNA, 23 nt, Homo sapiens
uacccauugcauaucggaguugu

SEQ ID NO: 9592 - RNA, 22 nt, Homo sapiens
uuggcacagaggcaaucagccu

SEQ ID NO: 9593 - RNA, 22 nt, Homo sapiens
cucauugucuuuucugucaauu

SEQ ID NO: 9594 - RNA, 22 nt, Homo sapiens
uaacucgcagcugugcuaacuu

SEQ ID NO: 9595 - RNA, 22 nt, Homo sapiens
aauucuagucaguuuggguuaa

SEQ ID NO: 9596 - RNA, 22 nt, Homo sapiens
uucuucugucagcaucuucuuc

SEQ ID NO: 9597 - RNA, 22 nt, Homo sapiens
ggggagaugcuggccugaagca

SEQ ID NO: 9598 - RNA, 22 nt, Homo sapiens
uuacccaaagucagcaacccuu

SEQ ID NO: 9599 - RNA, 22 nt, Homo sapiens
guuggugacuuugggcaagaga

SEQ ID NO: 9600 - RNA, 22 nt, Homo sapiens
aggcagcuuuuacuuaucuaug

SEQ ID NO: 9601 - RNA, 22 nt, Homo sapiens
uggaaaacugaaagcugaccuu

SEQ ID NO: 9602 - RNA, 22 nt, Homo sapiens
acuauauguggguguuauaagg

SEQ ID NO: 9603 - RNA, 22 nt, Homo sapiens
uaugaggcacccacauauagcc

SEQ ID NO: 9604 - RNA, 22 nt, Homo sapiens
caugauacuggaguugucccau

SEQ ID NO: 9605 - RNA, 22 nt, Homo sapiens
uggguagcucuggucuaaugcc

SEQ ID NO: 9606 - RNA, 22 nt, Homo sapiens
uaucuggagaaaagugugcuuu

SEQ ID NO: 9607 - RNA, 22 nt, Homo sapiens
aucacaaauuucucuagauauu

SEQ ID NO: 9608 - RNA, 22 nt, Homo sapiens
aacauacuucuuuauaugccca

SEQ ID NO: 9609 - RNA, 21 nt, Homo sapiens
uggaauguaaagaaguaugua

SEQ ID NO: 9610 - RNA, 22 nt, Homo sapiens
ugacuugaugaaagggcugcac

SEQ ID NO: 9611 - RNA, 22 nt, Homo sapiens
cagcccuuuugucaagucauca

SEQ ID NO: 9612 - RNA, 22 nt, Homo sapiens
uuauucucccuguuuucauccu

SEQ ID NO: 9613 - RNA, 22 nt, Homo sapiens
aaggggagcagggaggaaggag

SEQ ID NO: 9614 - RNA, 22 nt, Homo sapiens
uucugcuggagguaagccuuuu

SEQ ID NO: 9615 - RNA, 22 nt, Homo sapiens
gauuuaccuccagaaguauuuu

SEQ ID NO: 9616 - RNA, 22 nt, Homo sapiens
ugcacauaaucaacugugccug

SEQ ID NO: 9617 - RNA, 22 nt, Homo sapiens
agacacagcugaugaugugcau

SEQ ID NO: 9618 - RNA, 22 nt, Homo sapiens
ugcacauaaucaacugugccug

SEQ ID NO: 9619 - RNA, 22 nt, Homo sapiens
agacacagcugaugaugugcau

SEQ ID NO: 9620 - RNA, 22 nt, Homo sapiens
aaggggggccgauacacuguac

SEQ ID NO: 9621 - RNA, 22 nt, Homo sapiens
ucacagugaaccggucucuuuc

SEQ ID NO: 9622 - RNA, 22 nt, Homo sapiens
ucaaauaaacagaugaauauuu

SEQ ID NO: 9623 - RNA, 22 nt, Homo sapiens
aauauucaucuauuuauuugau

SEQ ID NO: 9624 - RNA, 22 nt, Homo sapiens
uaaugauuuuacgggcaguuga

SEQ ID NO: 9625 - RNA, 22 nt, Homo sapiens
cugucuguuagaguuauagugu

SEQ ID NO: 9626 - RNA, 22 nt, Homo sapiens
ugcuauggagaaauuuguuacc

SEQ ID NO: 9627 - RNA, 22 nt, Homo sapiens
uaauaaguuucuccaaagcaca

SEQ ID NO: 9628 - RNA, 22 nt, Homo sapiens
acaaauguauucuguccaagug

SEQ ID NO: 9629 - RNA, 18 nt, Homo sapiens
ucgacagaacauauuugu

SEQ ID NO: 9630 - RNA, 22 nt, Homo sapiens
uucacuaguaguucuccuuuag

SEQ ID NO: 9631 - RNA, 22 nt, Homo sapiens
uaguagagaaccuugcuagaga

SEQ ID NO: 9632 - RNA, 22 nt, Homo sapiens
ugggaggcagaagauuuuguuu

SEQ ID NO: 9633 - RNA, 22 nt, Homo sapiens
augggaucucugccccucaguu

SEQ ID NO: 9634 - RNA, 22 nt, Homo sapiens
cccacauuuuugagucuucauc

SEQ ID NO: 9635 - RNA, 22 nt, Homo sapiens
ggugaagaauaaggaguggggg

SEQ ID NO: 9636 - RNA, 22 nt, Homo sapiens
uggagcuuagggucagugaaga

SEQ ID NO: 9637 - RNA, 22 nt, Homo sapiens
acacuuagaucuauuaggugcu

SEQ ID NO: 9638 - RNA, 22 nt, Homo sapiens
ugacuugucucgcgguuacugg

SEQ ID NO: 9639 - RNA, 22 nt, Homo sapiens
cucgggggcggcacggggcggg

SEQ ID NO: 9640 - RNA, 22 nt, Homo sapiens
ucugcucacacuuccucccccu

SEQ ID NO: 9641 - RNA, 22 nt, Homo sapiens
cucggggaggagcugaacacgg

SEQ ID NO: 9642 - RNA, 22 nt, Homo sapiens
aggaaucagaggaaugugucaa

SEQ ID NO: 9643 - RNA, 22 nt, Homo sapiens
gcaugacuuuguugauuucuga

SEQ ID NO: 9644 - RNA, 22 nt, Homo sapiens
uguaguauaauauccccccaau

SEQ ID NO: 9645 - RNA, 22 nt, Homo sapiens
uggggggauaugauaucacaga

SEQ ID NO: 9646 - RNA, 22 nt, Homo sapiens
uacgcacacucaucaacugugu

SEQ ID NO: 9647 - RNA, 22 nt, Homo sapiens
acaguugaugaugugcaugugu

SEQ ID NO: 9648 - RNA, 22 nt, Homo sapiens
ugggcagcagcuccgggcaccg

SEQ ID NO: 9649 - RNA, 22 nt, Homo sapiens
ucaguuccuggagcugcucggg

SEQ ID NO: 9650 - RNA, 22 nt, Homo sapiens
cagcaaaaaauuaacaucucuu

SEQ ID NO: 9651 - RNA, 22 nt, Homo sapiens
gaagaugaaaguugcuuuucug

SEQ ID NO: 9652 - RNA, 22 nt, Homo sapiens
uugauuuuuuucccuguggccu

SEQ ID NO: 9653 - RNA, 22 nt, Homo sapiens
cauuuaggagaccagaauaaga

SEQ ID NO: 9654 - RNA, 22 nt, Homo sapiens
gcuccuucaccccccaccucau

SEQ ID NO: 9655 - RNA, 22 nt, Homo sapiens
ugaggcgucgggagggaggagg

SEQ ID NO: 9656 - RNA, 22 nt, Homo sapiens
uaguuucagacugauuucacaa

SEQ ID NO: 9657 - RNA, 22 nt, Homo sapiens
uaugaaaaguagucugaaaaac

SEQ ID NO: 9658 - RNA, 22 nt, Homo sapiens
ccuggagccacuguucucauuc

SEQ ID NO: 9659 - RNA, 22 nt, Homo sapiens
ugaacugcagcaggcacugggc

SEQ ID NO: 9660 - RNA, 22 nt, Homo sapiens
ccagcuucaccaagcccgugcu

SEQ ID NO: 9661 - RNA, 19 nt, Homo sapiens
cacggggguggggagcugg

SEQ ID NO: 9662 - RNA, 22 nt, Homo sapiens
uugcuuaugucaggugagaggg

SEQ ID NO: 9663 - RNA, 22 nt, Homo sapiens
ucucucaccuggcauaagcaau

SEQ ID NO: 9664 - RNA, 22 nt, Homo sapiens
uagucauacccaccccagaccu

SEQ ID NO: 9665 - RNA, 22 nt, Homo sapiens
auguucugggguuguggacuag

SEQ ID NO: 9666 - RNA, 22 nt, Homo sapiens
ggcacuauuucacaauugagau

SEQ ID NO: 9667 - RNA, 22 nt, Homo sapiens
ugagcuguggaauaaugccuuc

SEQ ID NO: 9668 - RNA, 22 nt, Homo sapiens
uacuauuagcacaauuguaaua

SEQ ID NO: 9669 - RNA, 22 nt, Homo sapiens
aauguuacaacugguaaaguag

SEQ ID NO: 9670 - RNA, 22 nt, Homo sapiens
uauuagaaauauaagaaugugg

SEQ ID NO: 9671 - RNA, 22 nt, Homo sapiens
acauuuucauaugacgguauag

SEQ ID NO: 9672 - RNA, 22 nt, Homo sapiens
uaagggugcugcucucugugac

SEQ ID NO: 9673 - RNA, 22 nt, Homo sapiens
aguagaggcaguuuccccuggg

SEQ ID NO: 9674 - RNA, 22 nt, Homo sapiens
uggagaaggaggucuuggaggc

SEQ ID NO: 9675 - RNA, 22 nt, Homo sapiens
uccaagccacauucuccaugac

SEQ ID NO: 9676 - RNA, 22 nt, Homo sapiens
ccagcuuuucaaaauggguccc

SEQ ID NO: 9677 - RNA, 22 nt, Homo sapiens
gacuguuuuugaaaaguugagu

SEQ ID NO: 9678 - RNA, 22 nt, Homo sapiens
ugaaucaagauguaucgacucu

SEQ ID NO: 9679 - RNA, 22 nt, Homo sapiens
aauccuuuacaucugagacuca

SEQ ID NO: 9680 - RNA, 22 nt, Homo sapiens
ggucaaaguaaacagauuauac

SEQ ID NO: 9681 - RNA, 22 nt, Homo sapiens
auccccugugaaccuugaccug

SEQ ID NO: 9682 - RNA, 22 nt, Homo sapiens
cagcauggccauccugggcuuc

SEQ ID NO: 9683 - RNA, 22 nt, Homo sapiens
gcaagggaugggcgggcugcuu

SEQ ID NO: 9684 - RNA, 22 nt, Homo sapiens
gagcuuauucauaaaagugcag

SEQ ID NO: 9685 - RNA, 22 nt, Homo sapiens
uguaauuuuauguauaagcuag

SEQ ID NO: 9686 - RNA, 22 nt, Homo sapiens
ugcaaggaauggcuaggguuac

SEQ ID NO: 9687 - RNA, 22 nt, Homo sapiens
acagcucagcuaugucugcauc

SEQ ID NO: 9688 - RNA, 22 nt, Homo sapiens
ucaccucccuccccucucaucc

SEQ ID NO: 9689 - RNA, 22 nt, Homo sapiens
gggacagggcaggggagguggg

SEQ ID NO: 9690 - RNA, 22 nt, Homo sapiens
cagucaauauuuucacuuggau

SEQ ID NO: 9691 - RNA, 22 nt, Homo sapiens
uccaagugaaaauguugacugc

SEQ ID NO: 9692 - RNA, 22 nt, Homo sapiens
ugcugcucugaguuagcuugac

SEQ ID NO: 9693 - RNA, 22 nt, Homo sapiens
ggaaagcaauucaagcagcaga

SEQ ID NO: 9694 - RNA, 22 nt, Homo sapiens
uguggacucgaguaucaggccc

SEQ ID NO: 9695 - RNA, 22 nt, Homo sapiens
cgccugaaacacggaucccagc

SEQ ID NO: 9696 - RNA, 22 nt, Homo sapiens
ugguaguuggggucggguuugu

SEQ ID NO: 9697 - RNA, 22 nt, Homo sapiens
caagcaugggcuuugacaucag

SEQ ID NO: 9698 - RNA, 22 nt, Homo sapiens
agguuuucaugccugaugaugg

SEQ ID NO: 9699 - RNA, 22 nt, Homo sapiens
ucaguaggcauugaagaccagc

SEQ ID NO: 9700 - RNA, 22 nt, Homo sapiens
agguuuucaugccugauaaugg

SEQ ID NO: 9701 - RNA, 22 nt, Homo sapiens
aguaggcauugaagaccagcag

SEQ ID NO: 9702 - RNA, 22 nt, Homo sapiens
gaaggggugaguugggaggggu

SEQ ID NO: 9703 - RNA, 22 nt, Homo sapiens
ccuuuccacuuccccugguucc

SEQ ID NO: 9704 - RNA, 22 nt, Homo sapiens
uaucaccacagcccuuguucuu

SEQ ID NO: 9705 - RNA, 22 nt, Homo sapiens
gagcagaggcugggagaucgau

SEQ ID NO: 9706 - RNA, 22 nt, Homo sapiens
ucagcaagacaauuaaugagga

SEQ ID NO: 9707 - RNA, 22 nt, Homo sapiens
uccagcuauuaauguuuuugcu

SEQ ID NO: 9708 - RNA, 22 nt, Homo sapiens
ccggcuauuuggcgggagcaga

SEQ ID NO: 9709 - RNA, 22 nt, Homo sapiens
ugcucagccugagcagccgggu

SEQ ID NO: 9710 - RNA, 22 nt, Homo sapiens
aauuagucacagcuagagccug

SEQ ID NO: 9711 - RNA, 19 nt, Homo sapiens
ucuggcugagaggcugauu

SEQ ID NO: 9712 - RNA, 22 nt, Homo sapiens
accucagagguuggugacuuac

SEQ ID NO: 9713 - RNA, 22 nt, Homo sapiens
ugugucccaacuguagcugggg

SEQ ID NO: 9714 - RNA, 22 nt, Homo sapiens
gccucggcacucucaccuucuc

SEQ ID NO: 9715 - RNA, 20 nt, Homo sapiens
gguggaagcuuggcugaggu

SEQ ID NO: 9716 - RNA, 22 nt, Homo sapiens
uaggaggucuaaccggcugcug

SEQ ID NO: 9717 - RNA, 22 nt, Homo sapiens
gaggcuggauggacuugccuac

SEQ ID NO: 9718 - RNA, 22 nt, Homo sapiens
ugugaaguuugagaugucuauu

SEQ ID NO: 9719 - RNA, 22 nt, Homo sapiens
uaggcagucagauauacaucuc

SEQ ID NO: 9720 - RNA, 22 nt, Homo sapiens
uccugaugccagaucugaucga

SEQ ID NO: 9721 - RNA, 22 nt, Homo sapiens
ugaucagauuuuaaaaucaguu

SEQ ID NO: 9722 - RNA, 22 nt, Homo sapiens
uaauacuccuaguggggggggu

SEQ ID NO: 9723 - RNA, 22 nt, Homo sapiens
ucuccccacuuuuguauuguua

SEQ ID NO: 9724 - RNA, 22 nt, Homo sapiens
uguaggcgaugccacuuugcac

SEQ ID NO: 9725 - RNA, 22 nt, Homo sapiens
ugugcaauggugucaccacaug

SEQ ID NO: 9726 - RNA, 22 nt, Homo sapiens
aaaggaggcagaguagccaagc

SEQ ID NO: 9727 - RNA, 22 nt, Homo sapiens
ccagcuguacugccugcucagg

SEQ ID NO: 9728 - RNA, 22 nt, Homo sapiens
uggcugauaaacaauaguacuu

SEQ ID NO: 9729 - RNA, 22 nt, Homo sapiens
aguuuauuuuauuguuuauuuc

SEQ ID NO: 9730 - RNA, 22 nt, Homo sapiens
ugcuuucaaucuccucccagug

SEQ ID NO: 9731 - RNA, 22 nt, Homo sapiens
cuggggcugggggcgggagagc

SEQ ID NO: 9732 - RNA, 22 nt, Homo sapiens
uggcuguaaaggcaacaagaaa

SEQ ID NO: 9733 - RNA, 22 nt, Homo sapiens
uuuguugccuuucuggccgcau

SEQ ID NO: 9734 - RNA, 22 nt, Homo sapiens
gagagggaaaggcuuuggaguc

SEQ ID NO: 9735 - RNA, 22 nt, Homo sapiens
uuuuuccacuagccccuucucu

SEQ ID NO: 9736 - RNA, 22 nt, Homo sapiens
uaggaaggcggguaagggcugg

SEQ ID NO: 9737 - RNA, 22 nt, Homo sapiens
agcccaguggcuccgccuucac

SEQ ID NO: 9738 - RNA, 22 nt, Homo sapiens
ugaacucuaccaaaucacaaau

SEQ ID NO: 9739 - RNA, 22 nt, Homo sapiens
uagugauuugguggagcucagu

SEQ ID NO: 9740 - RNA, 22 nt, Homo sapiens
ucaaaucacugggguaccauuu

SEQ ID NO: 9741 - RNA, 22 nt, Homo sapiens
auggguccccagggccuggaau

SEQ ID NO: 9742 - RNA, 22 nt, Homo sapiens
agcaaggaggaguguguggcuu

SEQ ID NO: 9743 - RNA, 22 nt, Homo sapiens
augcugcauaacuccccugagu

SEQ ID NO: 9744 - RNA, 22 nt, Homo sapiens
uaaauuuuucagcguggcuuuu

SEQ ID NO: 9745 - RNA, 22 nt, Homo sapiens
aaaggcaagacagaaaaauuua

SEQ ID NO: 9746 - RNA, 22 nt, Homo sapiens
ugggcaggcuugggaccugcca

SEQ ID NO: 9747 - RNA, 22 nt, Homo sapiens
gcaggccugggaccugcucuuu

SEQ ID NO: 9748 - RNA, 22 nt, Homo sapiens
uuuucagugggugcagauuuau

SEQ ID NO: 9749 - RNA, 22 nt, Homo sapiens
uaaucaugcaaccacuagaaaa

SEQ ID NO: 9750 - RNA, 22 nt, Homo sapiens
aauuguccaggucauuugaugg

SEQ ID NO: 9751 - RNA, 22 nt, Homo sapiens
uaucaaugaccugaagacaugg

SEQ ID NO: 9752 - RNA, 22 nt, Homo sapiens
uuuuuaguaacuugcagcaacc

SEQ ID NO: 9753 - RNA, 22 nt, Homo sapiens
gcuguugggaguugcuggaagu

SEQ ID NO: 9754 - RNA, 22 nt, Homo sapiens
uucccugaaugcuuuccuguuu

SEQ ID NO: 9755 - RNA, 20 nt, Homo sapiens
cagugaagggaacagggagc

SEQ ID NO: 9756 - RNA, 22 nt, Homo sapiens
ugcaguugguuuagaauuucua

SEQ ID NO: 9757 - RNA, 22 nt, Homo sapiens
uggagagagaggccaacugcaa

SEQ ID NO: 9758 - RNA, 22 nt, Homo sapiens
aggcugagacucugaauuuuuc

SEQ ID NO: 9759 - RNA, 22 nt, Homo sapiens
auaauuuagauuuucuuccauc

SEQ ID NO: 9760 - RNA, 22 nt, Homo sapiens
aaguuuaagguugggcuuuaaa

SEQ ID NO: 9761 - RNA, 22 nt, Homo sapiens
uugaaucccaccucuacuccua

SEQ ID NO: 9762 - RNA, 22 nt, Homo sapiens
uacagggagacggcagucccag

SEQ ID NO: 9763 - RNA, 22 nt, Homo sapiens
gggcugaccuuuccucuggccg

SEQ ID NO: 9764 - RNA, 22 nt, Homo sapiens
ggcuucagacuccuuggggcuc

SEQ ID NO: 9765 - RNA, 19 nt, Homo sapiens
auccgccaagccugaggcc

SEQ ID NO: 9766 - RNA, 22 nt, Homo sapiens
caguguggcuucugcucaggaa

SEQ ID NO: 9767 - RNA, 22 nt, Homo sapiens
uuauccaguaggaccagacugc

SEQ ID NO: 9768 - RNA, 22 nt, Homo sapiens
uacguacuuagugcucuaucug

SEQ ID NO: 9769 - RNA, 22 nt, Homo sapiens
agggaaguauuggugcggggag

SEQ ID NO: 9770 - RNA, 22 nt, Homo sapiens
uaauggcuggcugggaaaaugg

SEQ ID NO: 9771 - RNA, 22 nt, Homo sapiens
auuaagcccagccaguuauuaa

SEQ ID NO: 9772 - RNA, 22 nt, Homo sapiens
ugucugaguucccuggaguagc

SEQ ID NO: 9773 - RNA, 22 nt, Homo sapiens
uacaauuaggggaugaccuuag

SEQ ID NO: 9774 - RNA, 22 nt, Homo sapiens
acucaucuuuggcaauguggcc

SEQ ID NO: 9775 - RNA, 22 nt, Homo sapiens
gcuauuagcuaaugguggguuc

SEQ ID NO: 9776 - RNA, 22 nt, Homo sapiens
ggaagcuggaguaaauucugua

SEQ ID NO: 9777 - RNA, 22 nt, Homo sapiens
uuggcaggauaugcaccagcug

SEQ ID NO: 9778 - RNA, 22 nt, Homo sapiens
gaucuccugcaauuacacuggu

SEQ ID NO: 9779 - RNA, 22 nt, Homo sapiens
augaguguaguuguagggagcg

SEQ ID NO: 9780 - RNA, 22 nt, Homo sapiens
aaaagugacaaagauggugcau

SEQ ID NO: 9781 - RNA, 22 nt, Homo sapiens
uguaccaucuuuguaacuuuuc

SEQ ID NO: 9782 - RNA, 22 nt, Homo sapiens
uaggaugccauuuaagaucugu

SEQ ID NO: 9783 - RNA, 22 nt, Homo sapiens
aucauuuuaaauggcucuauaa

SEQ ID NO: 9784 - RNA, 22 nt, Homo sapiens
ucagaugaugucuucagggaau

SEQ ID NO: 9785 - RNA, 20 nt, Homo sapiens
ucuuugaagacccauuugag

SEQ ID NO: 9786 - RNA, 22 nt, Homo sapiens
ggaaaugccaccucugugcccu

SEQ ID NO: 9787 - RNA, 22 nt, Homo sapiens
ucaggggacaggagugcuuccu

SEQ ID NO: 9788 - RNA, 22 nt, Homo sapiens
acaaagguauucucauuuugga

SEQ ID NO: 9789 - RNA, 22 nt, Homo sapiens
ucuccaauuggcauacuuuuaa

SEQ ID NO: 9790 - RNA, 22 nt, Homo sapiens
aaguguuuauaggcaggggccc

SEQ ID NO: 9791 - RNA, 18 nt, Homo sapiens
cccagccucaggacacuu

SEQ ID NO: 9792 - RNA, 22 nt, Homo sapiens
uuugugaugccuaagccguguu

SEQ ID NO: 9793 - RNA, 22 nt, Homo sapiens
aacauggcuugcgcguuguggu

SEQ ID NO: 9794 - RNA, 22 nt, Homo sapiens
ugguaucugucaucuucugcag

SEQ ID NO: 9795 - RNA, 22 nt, Homo sapiens
uguggagauggcagaagccagc

SEQ ID NO: 9796 - RNA, 22 nt, Homo sapiens
uacagagggccagggacuuagg

SEQ ID NO: 9797 - RNA, 22 nt, Homo sapiens
uuuucccuggcucucuggcuug

SEQ ID NO: 9798 - RNA, 22 nt, Homo sapiens
gaauggauuauggaaaggucuc

SEQ ID NO: 9799 - RNA, 22 nt, Homo sapiens
gaccucuuccacaguccccucu

SEQ ID NO: 9800 - RNA, 22 nt, Homo sapiens
ucauucauuuagcagacacuuu

SEQ ID NO: 9801 - RNA, 22 nt, Homo sapiens
ccaggcacuguuauggaugaug

SEQ ID NO: 9802 - RNA, 22 nt, Homo sapiens
uucuguaaaggaagaagaggua

SEQ ID NO: 9803 - RNA, 22 nt, Homo sapiens
ucuucuuccuuugcagaguuga

SEQ ID NO: 9804 - RNA, 22 nt, Homo sapiens
uuuuagugcuggaagguugucu

SEQ ID NO: 9805 - RNA, 22 nt, Homo sapiens
acauccuccaguggugcaacuc

SEQ ID NO: 9806 - RNA, 22 nt, Homo sapiens
caaaucuguaugcccagaccag

SEQ ID NO: 9807 - RNA, 22 nt, Homo sapiens
uggaccggacauauagauuugg

SEQ ID NO: 9808 - RNA, 22 nt, Homo sapiens
caaaacucagugcagaagagcc

SEQ ID NO: 9809 - RNA, 22 nt, Homo sapiens
ucuucuacacugaguuuuuucc

SEQ ID NO: 9810 - RNA, 22 nt, Homo sapiens
uauugcacuaauauaucacugg

SEQ ID NO: 9811 - RNA, 22 nt, Homo sapiens
ugaugaucuauuaaugcaauac

SEQ ID NO: 9812 - RNA, 22 nt, Homo sapiens
uuuuuucaagcuacuacuaaag

SEQ ID NO: 9813 - RNA, 22 nt, Homo sapiens
uaguaguagcuuuaaaaagacu

SEQ ID NO: 9814 - RNA, 22 nt, Homo sapiens
cagugguucuuaacaguucaac

SEQ ID NO: 9815 - RNA, 22 nt, Homo sapiens
gugaaauguuuaggaccacuag

SEQ ID NO: 9816 - RNA, 21 nt, Homo sapiens
ugaaauguuuaggaccacuag

SEQ ID NO: 9817 - RNA, 22 nt, Homo sapiens
uaaaagguuucuaaaugauguu

SEQ ID NO: 9818 - RNA, 22 nt, Homo sapiens
accauuuaacagccuuuuaaag

SEQ ID NO: 9819 - RNA, 22 nt, Homo sapiens
caccggaggagagaaauccugu

SEQ ID NO: 9820 - RNA, 22 nt, Homo sapiens
uuucaguuucuuuguuuccagc

SEQ ID NO: 9821 - RNA, 22 nt, Homo sapiens
cccggcggccgccucccagagc

SEQ ID NO: 9822 - RNA, 22 nt, Homo sapiens
ugcgggaguuugcggucuccgg

SEQ ID NO: 9823 - RNA, 22 nt, Homo sapiens
acaaucugaaagaugacugcug

SEQ ID NO: 9824 - RNA, 22 nt, Homo sapiens
cuaagucaucuuuuagauaguc

SEQ ID NO: 9825 - RNA, 22 nt, Homo sapiens
uggagagcugagaccucugaug

SEQ ID NO: 9826 - RNA, 22 nt, Homo sapiens
aaugggagucuuaauucuucau

SEQ ID NO: 9827 - RNA, 22 nt, Homo sapiens
aguggggcugcuguuaucuggg

SEQ ID NO: 9828 - RNA, 22 nt, Homo sapiens
uguaacagcaacuccaugugga

SEQ ID NO: 9829 - RNA, 22 nt, Homo sapiens
ccuguuugcuccucugggcccc

SEQ ID NO: 9830 - RNA, 19 nt, Homo sapiens
guaaggaggaucagacagg

SEQ ID NO: 9831 - RNA, 22 nt, Homo sapiens
uggaauacaaaggaucucuagu

SEQ ID NO: 9832 - RNA, 21 nt, Homo sapiens
ugucucucuuuuuuauuucaa

SEQ ID NO: 9833 - RNA, 22 nt, Homo sapiens
aacuugcucaagguuucaugua

SEQ ID NO: 9834 - RNA, 22 nt, Homo sapiens
uaugugagaccuugagcaaguc

SEQ ID NO: 9835 - RNA, 22 nt, Homo sapiens
gauuaaacauuaaacugcagau

SEQ ID NO: 9836 - RNA, 22 nt, Homo sapiens
uagcguuauuaccaugguuuaa

SEQ ID NO: 9837 - RNA, 22 nt, Homo sapiens
gggaagggcagggucuaugcac

SEQ ID NO: 9838 - RNA, 22 nt, Homo sapiens
ugcagaaaaccuuuccuuuccc

SEQ ID NO: 9839 - RNA, 22 nt, Homo sapiens
uaaagguugcacagucuggucu

SEQ ID NO: 9840 - RNA, 22 nt, Homo sapiens
gaccuaggcucagugcagacuu

SEQ ID NO: 9841 - RNA, 22 nt, Homo sapiens
uaaagguugcacagucuggucu

SEQ ID NO: 9842 - RNA, 22 nt, Homo sapiens
gaccuaggcucagugcagacuu

SEQ ID NO: 9843 - RNA, 22 nt, Homo sapiens
cccgccauauugcuguaugaau

SEQ ID NO: 9844 - RNA, 22 nt, Homo sapiens
uaaauauauaaauauguggggg

SEQ ID NO: 9845 - RNA, 22 nt, Homo sapiens
caagcuugggaugagauuccuu

SEQ ID NO: 9846 - RNA, 22 nt, Homo sapiens
uaaugaagcucucccagcuuuc

SEQ ID NO: 9847 - RNA, 22 nt, Homo sapiens
uccuaccuuuucucaucauuuu

SEQ ID NO: 9848 - RNA, 22 nt, Homo sapiens
auaauguggaauaguggagaac

SEQ ID NO: 9849 - RNA, 22 nt, Homo sapiens
gggaggggcugaggcaguggga

SEQ ID NO: 9850 - RNA, 19 nt, Homo sapiens
ucacuggcuuaccccuccu

SEQ ID NO: 9851 - RNA, 22 nt, Homo sapiens
ugcucaccugccuauuuuaggu

SEQ ID NO: 9852 - RNA, 21 nt, Homo sapiens
acucuaauuggcaguggguag

SEQ ID NO: 9853 - RNA, 22 nt, Homo sapiens
uccauaccacacuaguuuuauu

SEQ ID NO: 9854 - RNA, 22 nt, Homo sapiens
ugaaugaacuggggugugugug

SEQ ID NO: 9855 - RNA, 22 nt, Homo sapiens
cccagggugggaugcugagagg

SEQ ID NO: 9856 - RNA, 22 nt, Homo sapiens
cugcuggcaguuugcccuggga

SEQ ID NO: 9857 - RNA, 22 nt, Homo sapiens
ucagcucggacaguuguuucag

SEQ ID NO: 9858 - RNA, 22 nt, Homo sapiens
ucagacaucuguuccugguuga

SEQ ID NO: 9859 - RNA, 22 nt, Homo sapiens
ugagggauuuuagacagaaggg

SEQ ID NO: 9860 - RNA, 22 nt, Homo sapiens
cccuuucucuggagucacucag

SEQ ID NO: 9861 - RNA, 22 nt, Homo sapiens
ccuaccccauguaaccccauuu

SEQ ID NO: 9862 - RNA, 22 nt, Homo sapiens
guaugggguuuggaguagggga

SEQ ID NO: 9863 - RNA, 22 nt, Homo sapiens
ggagggacagaaggaggcaggg

SEQ ID NO: 9864 - RNA, 20 nt, Homo sapiens
uugccccugcucuuccuccc

SEQ ID NO: 9865 - RNA, 22 nt, Homo sapiens
cguuuacauggguacuggccau

SEQ ID NO: 9866 - RNA, 22 nt, Homo sapiens
ucuguguagauucuguaaaucc

SEQ ID NO: 9867 - RNA, 22 nt, Homo sapiens
uccaacugagcuuugcuuugcu

SEQ ID NO: 9868 - RNA, 22 nt, Homo sapiens
caaagcaaggcucaguuugaac

SEQ ID NO: 9869 - RNA, 22 nt, Homo sapiens
cacccucccacugugguuucuu

SEQ ID NO: 9870 - RNA, 22 nt, Homo sapiens
ggagccaagguggcagaguggu

SEQ ID NO: 9871 - RNA, 22 nt, Homo sapiens
ugaaccuucucccuuccucaga

SEQ ID NO: 9872 - RNA, 22 nt, Homo sapiens
ugaguuaugggaaaaguuuagg

SEQ ID NO: 9873 - RNA, 22 nt, Homo sapiens
caggacccaggggucuggugac

SEQ ID NO: 9874 - RNA, 22 nt, Homo sapiens
caucaccuuuccuggcccuguc

SEQ ID NO: 9875 - RNA, 22 nt, Homo sapiens
ggagcauacaugaaggauuucu

SEQ ID NO: 9876 - RNA, 21 nt, Homo sapiens
aaaggaaaucaauugugcucc

SEQ ID NO: 9877 - RNA, 22 nt, Homo sapiens
ggcgcggguuggggaggauguu

SEQ ID NO: 9878 - RNA, 22 nt, Homo sapiens
auccuccuuaauuuacugccug

SEQ ID NO: 9879 - RNA, 22 nt, Homo sapiens
uccucaguuucauuuugacccu

SEQ ID NO: 9880 - RNA, 22 nt, Homo sapiens
aggguucaugaaauuauaggag

SEQ ID NO: 9881 - RNA, 22 nt, Homo sapiens
uccucaguuucauuuugacccu

SEQ ID NO: 9882 - RNA, 22 nt, Homo sapiens
aggguucauggaauuauaggag

SEQ ID NO: 9883 - RNA, 22 nt, Homo sapiens
uuggcugcaggggaguaguggc

SEQ ID NO: 9884 - RNA, 22 nt, Homo sapiens
ugcuacuuacuugcauuuuaag

SEQ ID NO: 9885 - RNA, 22 nt, Homo sapiens
uucaauuuauuuccuaggauau

SEQ ID NO: 9886 - RNA, 22 nt, Homo sapiens
acuuugggaaaucaaauucaaa

SEQ ID NO: 9887 - RNA, 22 nt, Homo sapiens
uucaucccccacaucccuuuuc

SEQ ID NO: 9888 - RNA, 18 nt, Homo sapiens
ggaauguguugggaugga

SEQ ID NO: 9889 - RNA, 22 nt, Homo sapiens
uucccagcgccagcccucccca

SEQ ID NO: 9890 - RNA, 22 nt, Homo sapiens
gaggggcugcgugcugagguaa

SEQ ID NO: 9891 - RNA, 22 nt, Homo sapiens
gauugcucagggagcaggagga

SEQ ID NO: 9892 - RNA, 22 nt, Homo sapiens
cugcuguuacugaccuaguuug

SEQ ID NO: 9893 - RNA, 22 nt, Homo sapiens
cuacugagaagaauggcagaau

SEQ ID NO: 9894 - RNA, 22 nt, Homo sapiens
ucuccauuuuuuucugugugca

SEQ ID NO: 9895 - RNA, 22 nt, Homo sapiens
cagaggggccuggcacugagcu

SEQ ID NO: 9896 - RNA, 22 nt, Homo sapiens
ccugcuggcccaggccccucgc

SEQ ID NO: 9897 - RNA, 22 nt, Homo sapiens
auggugcccuagugacuacaaa

SEQ ID NO: 9898 - RNA, 23 nt, Homo sapiens
caagucacuagugguuccguuua

SEQ ID NO: 9899 - RNA, 22 nt, Homo sapiens
ugagaauucccacagggaaauc

SEQ ID NO: 9900 - RNA, 22 nt, Homo sapiens
aaacuuuccuugcggaaauucu

SEQ ID NO: 9901 - RNA, 22 nt, Homo sapiens
agcuacuucuaaaccuaaacag

SEQ ID NO: 9902 - RNA, 22 nt, Homo sapiens
uggcuagaccuagaauuaguca

SEQ ID NO: 9903 - RNA, 22 nt, Homo sapiens
ucgggggcuggcugcugguacc

SEQ ID NO: 9904 - RNA, 22 nt, Homo sapiens
ggucucaguggccguucccugc

SEQ ID NO: 9905 - RNA, 22 nt, Homo sapiens
aauuggcucaauaucucccugu

SEQ ID NO: 9906 - RNA, 22 nt, Homo sapiens
ggugagauauaaauaagccaau

SEQ ID NO: 9907 - RNA, 22 nt, Homo sapiens
aacuaaacugugggcucuucuc

SEQ ID NO: 9908 - RNA, 22 nt, Homo sapiens
gaagagccuacaguuuagucuu

SEQ ID NO: 9909 - RNA, 22 nt, Homo sapiens
uguccauggauuuuguguagaa

SEQ ID NO: 9910 - RNA, 22 nt, Homo sapiens
ucuaccaacagcuauugauauc

SEQ ID NO: 9911 - RNA, 22 nt, Homo sapiens
acuugcccagggaaguuagaag

SEQ ID NO: 9912 - RNA, 22 nt, Homo sapiens
cacuggacccugggcaggcugg

SEQ ID NO: 9913 - RNA, 22 nt, Homo sapiens
uguucccuugcuccuucacucu

SEQ ID NO: 9914 - RNA, 22 nt, Homo sapiens
agaguaaggaagagggagagaa

SEQ ID NO: 9915 - RNA, 22 nt, Homo sapiens
ucagugagggauccggucuguc

SEQ ID NO: 9916 - RNA, 22 nt, Homo sapiens
auucuuggucccugcauugaga

SEQ ID NO: 9917 - RNA, 22 nt, Homo sapiens
cuuauucaggaagguguuacuu

SEQ ID NO: 9918 - RNA, 21 nt, Homo sapiens
guaaggcacccuucugaguag

SEQ ID NO: 9919 - RNA, 22 nt, Homo sapiens
guaaggcacccuucugaguaga

SEQ ID NO: 9920 - RNA, 21 nt, Homo sapiens
uaaggcacccuucugaguaga

SEQ ID NO: 9921 - RNA, 22 nt, Homo sapiens
uguaaggcacccuucugaguag

SEQ ID NO: 9922 - RNA, 22 nt, Homo sapiens
uaugccucaucuauaaaauggg

SEQ ID NO: 9923 - RNA, 22 nt, Homo sapiens
uccauaauaggagaggugugga

SEQ ID NO: 9924 - RNA, 22 nt, Homo sapiens
ccggaagauuauuucauuggca

SEQ ID NO: 9925 - RNA, 22 nt, Homo sapiens
ugcaaugaacaucuuuuuacau

SEQ ID NO: 9926 - RNA, 22 nt, Homo sapiens
cacccccacuccccagcuggug

SEQ ID NO: 9927 - RNA, 22 nt, Homo sapiens
ccgccugggauguccggguggg

SEQ ID NO: 9928 - RNA, 22 nt, Homo sapiens
ugguccagcccaacccuugucu

SEQ ID NO: 9929 - RNA, 22 nt, Homo sapiens
aaggacugggcuggguuauuau

SEQ ID NO: 9930 - RNA, 22 nt, Homo sapiens
ggguuggccaggcuguguucug

SEQ ID NO: 9931 - RNA, 22 nt, Homo sapiens
gcacacagcucccucuagcccu

SEQ ID NO: 9932 - RNA, 22 nt, Homo sapiens
aggagacugagggacagucaag

SEQ ID NO: 9933 - RNA, 22 nt, Homo sapiens
uugcuguucccuuucagucucu

SEQ ID NO: 9934 - RNA, 22 nt, Homo sapiens
ugcaggauagaucaucagaaug

SEQ ID NO: 9935 - RNA, 22 nt, Homo sapiens
ucugaugaccuuguuuuauuga

SEQ ID NO: 9936 - RNA, 22 nt, Homo sapiens
ugccuuggcuggcgccgggcua

SEQ ID NO: 9937 - RNA, 22 nt, Homo sapiens
cugucucggcccagccaguaug

SEQ ID NO: 9938 - RNA, 22 nt, Homo sapiens
cacgcaugaccccaagucuuag

SEQ ID NO: 9939 - RNA, 22 nt, Homo sapiens
aggcuugggguaauguauggca

SEQ ID NO: 9940 - RNA, 22 nt, Homo sapiens
uggguuugugugagugcccaug

SEQ ID NO: 9941 - RNA, 22 nt, Homo sapiens
ugcauguacccacacaggccca

SEQ ID NO: 9942 - RNA, 22 nt, Homo sapiens
uggcugauaaacaauaguacuu

SEQ ID NO: 9943 - RNA, 22 nt, Homo sapiens
aguuuauuuuauuguuuauuuc

SEQ ID NO: 9944 - RNA, 22 nt, Homo sapiens
uccuucccuguagccuaagucu

SEQ ID NO: 9945 - RNA, 19 nt, Homo sapiens
auuagcuacuuggaaggau

SEQ ID NO: 9946 - RNA, 22 nt, Homo sapiens
uaauggccuaauaaugcauuag

SEQ ID NO: 9947 - RNA, 22 nt, Homo sapiens
uuguagugcuuauugccauuag

SEQ ID NO: 9948 - RNA, 22 nt, Homo sapiens
cauugcucaguaaauugcugau

SEQ ID NO: 9949 - RNA, 22 nt, Homo sapiens
ucagcaauuuaggaagccaugc

SEQ ID NO: 9950 - RNA, 22 nt, Homo sapiens
ucaccacuucuucuggaggauu

SEQ ID NO: 9951 - RNA, 22 nt, Homo sapiens
aucuuucagaaggugcugauga

SEQ ID NO: 9952 - RNA, 22 nt, Homo sapiens
ugcucuucagcacugaaugaag

SEQ ID NO: 9953 - RNA, 22 nt, Homo sapiens
uuauuaagagcuaauggcaggu

SEQ ID NO: 9954 - RNA, 22 nt, Homo sapiens
gccuuuuacuaacacucuuuuc

SEQ ID NO: 9955 - RNA, 20 nt, Homo sapiens
gaggaaugugaauaaaaggc

SEQ ID NO: 9956 - RNA, 22 nt, Homo sapiens
gccccuaggguaucauuuaguu

SEQ ID NO: 9957 - RNA, 22 nt, Homo sapiens
uaaacuguaccuuaggggccug

SEQ ID NO: 9958 - RNA, 22 nt, Homo sapiens
uucuucuugaguaacaucagau

SEQ ID NO: 9959 - RNA, 22 nt, Homo sapiens
ugauucaacuuggcaggagacu

SEQ ID NO: 9960 - RNA, 22 nt, Homo sapiens
ugaagggcuggggcuagcucug

SEQ ID NO: 9961 - RNA, 22 nt, Homo sapiens
gagcuggccagguccuuccaac

SEQ ID NO: 9962 - RNA, 22 nt, Homo sapiens
caggacccaggggccuggugac

SEQ ID NO: 9963 - RNA, 22 nt, Homo sapiens
caucaccuuuccuggcccuguc

SEQ ID NO: 9964 - RNA, 22 nt, Homo sapiens
caggacccaggggccuggugac

SEQ ID NO: 9965 - RNA, 22 nt, Homo sapiens
caucaccuuuccuggcccuguc

SEQ ID NO: 9966 - RNA, 22 nt, Homo sapiens
caggacccaggggccuggugac

SEQ ID NO: 9967 - RNA, 22 nt, Homo sapiens
caucaccuuuccuggcccuguc

SEQ ID NO: 9968 - RNA, 22 nt, Homo sapiens
caggacccaggggccuggugac

SEQ ID NO: 9969 - RNA, 22 nt, Homo sapiens
caucaccuuuccuggcccuguc

SEQ ID NO: 9970 - RNA, 22 nt, Homo sapiens
caggacccaggggccuggugac

SEQ ID NO: 9971 - RNA, 22 nt, Homo sapiens
caucaccuuuccuggcccuguc

SEQ ID NO: 9972 - RNA, 22 nt, Homo sapiens
caggacccaggggccuggugac

SEQ ID NO: 9973 - RNA, 22 nt, Homo sapiens
caucaccuuuccuggcccuguc

SEQ ID NO: 9974 - RNA, 22 nt, Homo sapiens
caggacccaggggccuggugac

SEQ ID NO: 9975 - RNA, 22 nt, Homo sapiens
caucaccuuuccuggcccuguc

SEQ ID NO: 9976 - RNA, 22 nt, Homo sapiens
caggacccaggggccuggugac

SEQ ID NO: 9977 - RNA, 22 nt, Homo sapiens
caucaccuuuccuggcccuguc

SEQ ID NO: 9978 - RNA, 22 nt, Homo sapiens
caggacccaggggccuggugac

SEQ ID NO: 9979 - RNA, 22 nt, Homo sapiens
caucaccuuuccuggcccuguc

SEQ ID NO: 9980 - RNA, 22 nt, Homo sapiens
caggacccaggggccuggugac

SEQ ID NO: 9981 - RNA, 22 nt, Homo sapiens
caucaccuuuccuggcccuguc

SEQ ID NO: 9982 - RNA, 22 nt, Homo sapiens
caggacccaggggccuggugac

SEQ ID NO: 9983 - RNA, 22 nt, Homo sapiens
caucaccuuuccuggcccuguc

SEQ ID NO: 9984 - RNA, 22 nt, Homo sapiens
caggacccaggggccuggugac

SEQ ID NO: 9985 - RNA, 22 nt, Homo sapiens
caucaccuuuccuggcccuguc

SEQ ID NO: 9986 - RNA, 22 nt, Homo sapiens
caggacccaggggccuggugac

SEQ ID NO: 9987 - RNA, 22 nt, Homo sapiens
caucaccuuuccuggcccuguc

SEQ ID NO: 9988 - RNA, 22 nt, Homo sapiens
caggacccaggggucuggugac

SEQ ID NO: 9989 - RNA, 22 nt, Homo sapiens
uaucaccuuuccuggcccuguc

SEQ ID NO: 9990 - RNA, 22 nt, Homo sapiens
caggacccaggggucuggugac

SEQ ID NO: 9991 - RNA, 22 nt, Homo sapiens
caucaccuuuccuggcccuguc

SEQ ID NO: 9992 - RNA, 22 nt, Homo sapiens
uagacagauucugaguugagua

SEQ ID NO: 9993 - RNA, 22 nt, Homo sapiens
cugcuuguuguggacugucuaa

SEQ ID NO: 9994 - RNA, 22 nt, Homo sapiens
ugggacaucugugauuucaguc

SEQ ID NO: 9995 - RNA, 20 nt, Homo sapiens
ggcugggauccuguguccca

SEQ ID NO: 9996 - RNA, 22 nt, Homo sapiens
ugcaacuuaccugagucauuga

SEQ ID NO: 9997 - RNA, 22 nt, Homo sapiens
auggcacauguuuguuguuagg

SEQ ID NO: 9998 - RNA, 22 nt, Homo sapiens
uucaggucuugagaagagugug

SEQ ID NO: 9999 - RNA, 22 nt, Homo sapiens
uucuuuucucuggauggaugua

SEQ ID NO: 10000 - RNA, 22 nt, Homo sapiens
ucugucggcagccgcccugggc

SEQ ID NO: 10001 - RNA, 22 nt, Homo sapiens
cacaggcggcccugacaggcgg

SEQ ID NO: 10002 - RNA, 22 nt, Homo sapiens
gaaaggaggcgcaccuuacaag

SEQ ID NO: 10003 - RNA, 22 nt, Homo sapiens
ugaugagguccuucuuuugugc

SEQ ID NO: 10004 - RNA, 22 nt, Homo sapiens
ugcagccgguugccgggugacg

SEQ ID NO: 10005 - RNA, 22 nt, Homo sapiens
uuaccucggcaacgggcugcag

SEQ ID NO: 10006 - RNA, 22 nt, Homo sapiens
acucucauuuuagguguaaggu

SEQ ID NO: 10007 - RNA, 22 nt, Homo sapiens
uuauaccuaaaauugagggcug

SEQ ID NO: 10008 - RNA, 22 nt, Homo sapiens
gcauuuggaaaaggugaauuga

SEQ ID NO: 10009 - RNA, 22 nt, Homo sapiens
ucaaaucacauuuuucaagccu

SEQ ID NO: 10010 - RNA, 22 nt, Homo sapiens
uaaaaggccccagaaaagcauc

SEQ ID NO: 10011 - RNA, 22 nt, Homo sapiens
uguuuuucuggugcuuuuuaca

SEQ ID NO: 10012 - RNA, 22 nt, Homo sapiens
gaagccagagcuggagaggucu

SEQ ID NO: 10013 - RNA, 22 nt, Homo sapiens
ccccuuuggcuucuggcuucuc

SEQ ID NO: 10014 - RNA, 22 nt, Homo sapiens
uggggaauaugcaugaaaacau

SEQ ID NO: 10015 - RNA, 22 nt, Homo sapiens
gaguuuucauuauauucccaac

SEQ ID NO: 10016 - RNA, 22 nt, Homo sapiens
uguggccuguucugccuucuga

SEQ ID NO: 10017 - RNA, 22 nt, Homo sapiens
acuagagggcaggaggccagag

SEQ ID NO: 10018 - RNA, 22 nt, Homo sapiens
aguuccucugcugguuuuuuca

SEQ ID NO: 10019 - RNA, 22 nt, Homo sapiens
aguauucagcuggaggagcuga

SEQ ID NO: 10020 - RNA, 22 nt, Homo sapiens
ugaucaauaauaagauugauac

SEQ ID NO: 10021 - RNA, 22 nt, Homo sapiens
aguuaaucuucuuauugaucag

SEQ ID NO: 10022 - RNA, 22 nt, Homo sapiens
uaagugccuugauuuugcagcu

SEQ ID NO: 10023 - RNA, 22 nt, Homo sapiens
gccugccugggaaggguauugc

SEQ ID NO: 10024 - RNA, 22 nt, Homo sapiens
ucuguuuugugucucucuggug

SEQ ID NO: 10025 - RNA, 22 nt, Homo sapiens
uaauaagauggcaggaggcaga

SEQ ID NO: 10026 - RNA, 22 nt, Homo sapiens
ucgccguugcccauggcuucgc

SEQ ID NO: 10027 - RNA, 22 nt, Homo sapiens
ucggccggggcgggcgcgggac

SEQ ID NO: 10028 - RNA, 22 nt, Homo sapiens
uuuuaucuguucuucagucugu

SEQ ID NO: 10029 - RNA, 22 nt, Homo sapiens
ggcaggagagcagaaaggagaa

SEQ ID NO: 10030 - RNA, 22 nt, Homo sapiens
ugguugcuugaugagauuagag

SEQ ID NO: 10031 - RNA, 22 nt, Homo sapiens
uguaacugcucauaggaaacca

SEQ ID NO: 10032 - RNA, 20 nt, Homo sapiens
cauaaaguagaaagcacuac

SEQ ID NO: 10033 - RNA, 23 nt, Homo sapiens
uguaguguuuccuacuuuaugga

SEQ ID NO: 10034 - RNA, 22 nt, Homo sapiens
gaggccacaaggguaucauuua

SEQ ID NO: 10035 - RNA, 22 nt, Homo sapiens
aaugggccccuuuugaccugaa

SEQ ID NO: 10036 - RNA, 22 nt, Homo sapiens
ugccucuggagcugaacacuca

SEQ ID NO: 10037 - RNA, 22 nt, Homo sapiens
uggguccccaguuccugagcag

SEQ ID NO: 10038 - RNA, 22 nt, Homo sapiens
ucaggaugcucacaguccagug

SEQ ID NO: 10039 - RNA, 22 nt, Homo sapiens
ccauggcugcuggccaucugga

SEQ ID NO: 10040 - RNA, 22 nt, Homo sapiens
aaauugucuucuccacgaggug

SEQ ID NO: 10041 - RNA, 22 nt, Homo sapiens
auuuuguagaagguagagaugc

SEQ ID NO: 10042 - RNA, 22 nt, Homo sapiens
uccugcucgcggccucucccag

SEQ ID NO: 10043 - RNA, 22 nt, Homo sapiens
ugcggaucuaaggcugggaggg

SEQ ID NO: 10044 - RNA, 22 nt, Homo sapiens
cagaggaggggacagaggcucc

SEQ ID NO: 10045 - RNA, 22 nt, Homo sapiens
gccucaguuuucucaucuguaa

SEQ ID NO: 10046 - RNA, 22 nt, Homo sapiens
uuucuuccacuauauggugaua

SEQ ID NO: 10047 - RNA, 22 nt, Homo sapiens
ucacaauauaguggaagacaca

SEQ ID NO: 10048 - RNA, 22 nt, Homo sapiens
uggaggguauccucaugagggg

SEQ ID NO: 10049 - RNA, 22 nt, Homo sapiens
cauaugaggcugcccuugaaug

SEQ ID NO: 10050 - RNA, 22 nt, Homo sapiens
uugaaacaaacuccagugaacu

SEQ ID NO: 10051 - RNA, 22 nt, Homo sapiens
ucaguagagauuguuucaacac

SEQ ID NO: 10052 - RNA, 22 nt, Homo sapiens
aggaggguucucagaggauccu

SEQ ID NO: 10053 - RNA, 22 nt, Homo sapiens
ggauucccuggaccauccuuua

SEQ ID NO: 10054 - RNA, 22 nt, Homo sapiens
ccaggcuuuuguaaucuuugcu

SEQ ID NO: 10055 - RNA, 22 nt, Homo sapiens
gggggugcagaaguuuggagca

SEQ ID NO: 10056 - RNA, 22 nt, Homo sapiens
ugucagcuguucuuuucucuau

SEQ ID NO: 10057 - RNA, 18 nt, Homo sapiens
aagggagacaaguuggca

SEQ ID NO: 10058 - RNA, 22 nt, Homo sapiens
ugcguucauuuugagugcuguu

SEQ ID NO: 10059 - RNA, 22 nt, Homo sapiens
agcauuccacaauggaucaguu

SEQ ID NO: 10060 - RNA, 22 nt, Homo sapiens
ugggaacaguuuuguuugaaag

SEQ ID NO: 10061 - RNA, 22 nt, Homo sapiens
uugcaaacaagcuguggccaua

SEQ ID NO: 10062 - RNA, 22 nt, Homo sapiens
uacccuccccgcucagccggcc

SEQ ID NO: 10063 - RNA, 22 nt, Homo sapiens
gugcaggccugugugggucagg

SEQ ID NO: 10064 - RNA, 22 nt, Homo sapiens
uucaggcagcgauggagacuuu

SEQ ID NO: 10065 - RNA, 22 nt, Homo sapiens
cgugaagucucccugccaggau

SEQ ID NO: 10066 - RNA, 22 nt, Homo sapiens
ugauucuaugcuucugaaucau

SEQ ID NO: 10067 - RNA, 22 nt, Homo sapiens
gauuuggggagcagaacugguu

SEQ ID NO: 10068 - RNA, 22 nt, Homo sapiens
cggcgcgagccucgggccgggc

SEQ ID NO: 10069 - RNA, 22 nt, Homo sapiens
cagcggccgacgcggcggcgcc

SEQ ID NO: 10070 - RNA, 23 nt, Homo sapiens
aagccaggagagagugacaugac

SEQ ID NO: 10071 - RNA, 22 nt, Homo sapiens
cacuguauugagauuucauugu

SEQ ID NO: 10072 - RNA, 22 nt, Homo sapiens
aauaaggucagauggggugagg

SEQ ID NO: 10073 - RNA, 22 nt, Homo sapiens
uggugggugaaguuaugcuggg

SEQ ID NO: 10074 - RNA, 19 nt, Homo sapiens
aggauaaaaggacccauca

SEQ ID NO: 10075 - RNA, 22 nt, Homo sapiens
acaagccaguugucguguauga

SEQ ID NO: 10076 - RNA, 22 nt, Homo sapiens
ugcacacuacaacuggcuugug

SEQ ID NO: 10077 - RNA, 22 nt, Homo sapiens
uggcccugagugccccucggcc

SEQ ID NO: 10078 - RNA, 20 nt, Homo sapiens
gcugccagggcaggggcugg

SEQ ID NO: 10079 - RNA, 22 nt, Homo sapiens
ugggcaucaacccccauccagg

SEQ ID NO: 10080 - RNA, 22 nt, Homo sapiens
ugggcuggggcugagccugucg

SEQ ID NO: 10081 - RNA, 22 nt, Homo sapiens
ccucauggagcuugcaucuagu

SEQ ID NO: 10082 - RNA, 22 nt, Homo sapiens
ugaauacaagcuccacgaggga

SEQ ID NO: 10083 - RNA, 22 nt, Homo sapiens
uaucccuauuaaaaugugugug

SEQ ID NO: 10084 - RNA, 22 nt, Homo sapiens
uacacauuuuaauaggauacag

SEQ ID NO: 10085 - RNA, 22 nt, Homo sapiens
ccuuuauccagcuuugugugcc

SEQ ID NO: 10086 - RNA, 22 nt, Homo sapiens
guguacaaggcugccaagagag

SEQ ID NO: 10087 - RNA, 22 nt, Homo sapiens
ccucugggguuaauagaguuua

SEQ ID NO: 10088 - RNA, 22 nt, Homo sapiens
ugaaagcuuauuuucuccuagg

SEQ ID NO: 10089 - RNA, 22 nt, Homo sapiens
aggaacagugggauugacugaa

SEQ ID NO: 10090 - RNA, 22 nt, Homo sapiens
uagguucaguuauccuauccuc

SEQ ID NO: 10091 - RNA, 22 nt, Homo sapiens
ugugguuucugcgcugguuauc

SEQ ID NO: 10092 - RNA, 22 nt, Homo sapiens
ggggccaccggggaaaaucugc

SEQ ID NO: 10093 - RNA, 22 nt, Homo sapiens
ucacacgccucccguuccccca

SEQ ID NO: 10094 - RNA, 22 nt, Homo sapiens
gggguggggggauguguuuguu

SEQ ID NO: 10095 - RNA, 22 nt, Homo sapiens
ugugggggcaggaggggcguca

SEQ ID NO: 10096 - RNA, 22 nt, Homo sapiens
ugcccuggccuguccccgcagg

SEQ ID NO: 10097 - RNA, 22 nt, Homo sapiens
ugggguaggaggguaagucuua

SEQ ID NO: 10098 - RNA, 22 nt, Homo sapiens
ucagaagaagcucuccuuuuca

SEQ ID NO: 10099 - RNA, 22 nt, Homo sapiens
aauguguuauuauuguaauugu

SEQ ID NO: 10100 - RNA, 22 nt, Homo sapiens
cuuauuacuauaauaaccauuu

SEQ ID NO: 10101 - RNA, 22 nt, Homo sapiens
uucauucagguguauuuauggg

SEQ ID NO: 10102 - RNA, 22 nt, Homo sapiens
caauaaauauaacaauggauga

SEQ ID NO: 10103 - RNA, 22 nt, Homo sapiens
ugagcagucugggggacucuug

SEQ ID NO: 10104 - RNA, 22 nt, Homo sapiens
gaguguucuagaaacugcucuu

SEQ ID NO: 10105 - RNA, 22 nt, Homo sapiens
ucaaagagcacagggugagagc

SEQ ID NO: 10106 - RNA, 22 nt, Homo sapiens
uuuuuauuccuuuuucuuugug

SEQ ID NO: 10107 - RNA, 22 nt, Homo sapiens
aguugagggugaaccauuuugg

SEQ ID NO: 10108 - RNA, 22 nt, Homo sapiens
aauuggcucgccuuuaagguuu

SEQ ID NO: 10109 - RNA, 22 nt, Homo sapiens
ucugccuuccggggacgguagg

SEQ ID NO: 10110 - RNA, 22 nt, Homo sapiens
uagcguuccuggaaacaggugu

SEQ ID NO: 10111 - RNA, 22 nt, Homo sapiens
uaaagagaccauggcuucucaa

SEQ ID NO: 10112 - RNA, 22 nt, Homo sapiens
gaagccacuggucuauuuauau

SEQ ID NO: 10113 - RNA, 22 nt, Homo sapiens
ugugggucuggagccaaucugg

SEQ ID NO: 10114 - RNA, 22 nt, Homo sapiens
cccugacuggcuccaguguuau

SEQ ID NO: 10115 - RNA, 22 nt, Homo sapiens
uuugucuuauaggaggaagaga

SEQ ID NO: 10116 - RNA, 22 nt, Homo sapiens
ucuucuuccugaagacagcagc

SEQ ID NO: 10117 - RNA, 22 nt, Homo sapiens
ggugcagagugggcagcugguu

SEQ ID NO: 10118 - RNA, 22 nt, Homo sapiens
ccccgcugguugaucaccugua

SEQ ID NO: 10119 - RNA, 22 nt, Homo sapiens
uacuauaccucaguuuuaucag

SEQ ID NO: 10120 - RNA, 22 nt, Homo sapiens
uggaaacacugagguugugucu

SEQ ID NO: 10121 - RNA, 22 nt, Homo sapiens
uuuugcaguccuuagcuguugc

SEQ ID NO: 10122 - RNA, 22 nt, Homo sapiens
aacuuacugagggcuuugaagg

SEQ ID NO: 10123 - RNA, 22 nt, Homo sapiens
aagagugugagguugugcuuuu

SEQ ID NO: 10124 - RNA, 22 nt, Homo sapiens
agcaccuguccucgcugcucca

SEQ ID NO: 10125 - RNA, 22 nt, Homo sapiens
ugugugugagagagagaguggc

SEQ ID NO: 10126 - RNA, 22 nt, Homo sapiens
cucucucucuaaauaaauacac

SEQ ID NO: 10127 - RNA, 22 nt, Homo sapiens
gcccaggugaugguuuucuggu

SEQ ID NO: 10128 - RNA, 22 nt, Homo sapiens
agagagcgaucgcuugggaaaa

SEQ ID NO: 10129 - RNA, 19 nt, Homo sapiens
aagugcuuccuuuuagagg

SEQ ID NO: 10130 - RNA, 20 nt, Homo sapiens
aagugcuuccuuuuagaggg

SEQ ID NO: 10131 - RNA, 21 nt, Homo sapiens
aagugcuuccuuuuagagggu

SEQ ID NO: 10132 - RNA, 22 nt, Homo sapiens
aagugcuuccuuuuagaggguu

SEQ ID NO: 10133 - RNA, 23 nt, Homo sapiens
caagugcuuccuuuuagaggguu

SEQ ID NO: 10134 - RNA, 22 nt, Homo sapiens
uacgugucccggcaugcccugc

SEQ ID NO: 10135 - RNA, 22 nt, Homo sapiens
ugaggcaugcugggauuuguag

SEQ ID NO: 10136 - RNA, 22 nt, Homo sapiens
uugccauguuagauauugauuu

SEQ ID NO: 10137 - RNA, 19 nt, Homo sapiens
ucgauguuuaucauggcag

SEQ ID NO: 10138 - RNA, 22 nt, Homo sapiens
ugggggcuugugucacugugag

SEQ ID NO: 10139 - RNA, 17 nt, Homo sapiens
cagugacacagccccca

SEQ ID NO: 10140 - RNA, 22 nt, Homo sapiens
uacuauaccuauuaccaaaggg

SEQ ID NO: 10141 - RNA, 22 nt, Homo sapiens
uuugguaguagguaggguagua

SEQ ID NO: 10142 - RNA, 22 nt, Homo sapiens
uccaaugacugcaguuggcuua

SEQ ID NO: 10143 - RNA, 22 nt, Homo sapiens
gucagcuccagucucuggaccu

SEQ ID NO: 10144 - RNA, 22 nt, Homo sapiens
aggccucuuguccuuuccuugg

SEQ ID NO: 10145 - RNA, 21 nt, Homo sapiens
ucaagaggggauuaggggcuu

SEQ ID NO: 10146 - RNA, 22 nt, Homo sapiens
gcguguggcucccacguggccu

SEQ ID NO: 10147 - RNA, 22 nt, Homo sapiens
gccaguccugggggcucuaugc

SEQ ID NO: 10148 - RNA, 22 nt, Homo sapiens
ucaagaggugugccuuagucac

SEQ ID NO: 10149 - RNA, 22 nt, Homo sapiens
accuagagcaagucacuugacc

SEQ ID NO: 10150 - RNA, 22 nt, Homo sapiens
aggccucagugucauggacucu

SEQ ID NO: 10151 - RNA, 22 nt, Homo sapiens
agguuaugaccaacugaggccu

SEQ ID NO: 10152 - RNA, 22 nt, Homo sapiens
ucagaguacaugcuggguuagg

SEQ ID NO: 10153 - RNA, 22 nt, Homo sapiens
ucaaccccguauguccucugaa

SEQ ID NO: 10154 - RNA, 22 nt, Homo sapiens
ggaacuaguaaggaaaagcagg

SEQ ID NO: 10155 - RNA, 21 nt, Homo sapiens
ucuggcuuccuucuugguuuc

SEQ ID NO: 10156 - RNA, 22 nt, Homo sapiens
cgcugaucaauaagaagauuaa

SEQ ID NO: 10157 - RNA, 22 nt, Homo sapiens
ucuuauuauugaucaguuuagc

SEQ ID NO: 10158 - RNA, 22 nt, Homo sapiens
ucaaaauugaaccuucucagac

SEQ ID NO: 10159 - RNA, 22 nt, Homo sapiens
ugaugagcucuguucacuuuug

SEQ ID NO: 10160 - RNA, 22 nt, Homo sapiens
ucguuguggagagaaugauauc

SEQ ID NO: 10161 - RNA, 22 nt, Homo sapiens
aagcaucucucucccaauguga

SEQ ID NO: 10162 - RNA, 22 nt, Homo sapiens
ggauggaccugucccuuucuag

SEQ ID NO: 10163 - RNA, 22 nt, Homo sapiens
uggcagggggcagaguucuucc

SEQ ID NO: 10164 - RNA, 22 nt, Homo sapiens
gagaggauacccuuuguauguu

SEQ ID NO: 10165 - RNA, 22 nt, Homo sapiens
auauacagggggagacucucau

SEQ ID NO: 10166 - RNA, 22 nt, Homo sapiens
cugcugggcuuucugggacgac

SEQ ID NO: 10167 - RNA, 22 nt, Homo sapiens
ccucccagaaacuccacaccca

SEQ ID NO: 10168 - RNA, 22 nt, Homo sapiens
ucuuuuccugcugagccaacug

SEQ ID NO: 10169 - RNA, 22 nt, Homo sapiens
ggaggagcggcagauggagugg

SEQ ID NO: 10170 - RNA, 22 nt, Homo sapiens
ugggagccuggcaggccagagg

SEQ ID NO: 10171 - RNA, 20 nt, Homo sapiens
uggcuauaugcuggcuucca

SEQ ID NO: 10172 - RNA, 22 nt, Homo sapiens
uccuugcagauucaucacuucu

SEQ ID NO: 10173 - RNA, 22 nt, Homo sapiens
aaguggugauggauuugcaaua

SEQ ID NO: 10174 - RNA, 22 nt, Homo sapiens
uggaugccuuuuauuucuuugu

SEQ ID NO: 10175 - RNA, 22 nt, Homo sapiens
caagaggaagggaaggcggcca

SEQ ID NO: 10176 - RNA, 22 nt, Homo sapiens
ucucuuccccuuaguuuccuuu

SEQ ID NO: 10177 - RNA, 22 nt, Homo sapiens
agggggcugagguggaggaagg

SEQ ID NO: 10178 - RNA, 22 nt, Homo sapiens
augccgcugggagcucagaggg

SEQ ID NO: 10179 - RNA, 22 nt, Homo sapiens
uguguccuccagcagugguaca

SEQ ID NO: 10180 - RNA, 22 nt, Homo sapiens
uggacugucuuuguuuaagagc

SEQ ID NO: 10181 - RNA, 22 nt, Homo sapiens
cugcuggugaauagagaagccu

SEQ ID NO: 10182 - RNA, 22 nt, Homo sapiens
aaguguaugguguagcuggugu

SEQ ID NO: 10183 - RNA, 22 nt, Homo sapiens
ccaguuauaacguacacuaugc

SEQ ID NO: 10184 - RNA, 22 nt, Homo sapiens
gcuuuugauauccucagguaga

SEQ ID NO: 10185 - RNA, 22 nt, Homo sapiens
uaccugggagggauacaaggcc

SEQ ID NO: 10186 - RNA, 22 nt, Homo sapiens
ggauugacuugaagaguaggau

SEQ ID NO: 10187 - RNA, 22 nt, Homo sapiens
ucuacugaauuaaucauuucuc

SEQ ID NO: 10188 - RNA, 22 nt, Homo sapiens
aggggugaugcgcaugauuuuu

SEQ ID NO: 10189 - RNA, 18 nt, Homo sapiens
ggucaguuguuuaccccu

SEQ ID NO: 10190 - RNA, 22 nt, Homo sapiens
aggggugaugcgcaugauuuuu

SEQ ID NO: 10191 - RNA, 18 nt, Homo sapiens
ggucaguuguuuaccccu

SEQ ID NO: 10192 - RNA, 22 nt, Homo sapiens
aggggugaugcgcaugauuuuu

SEQ ID NO: 10193 - RNA, 18 nt, Homo sapiens
ggucaguuguuuaccccu

SEQ ID NO: 10194 - RNA, 22 nt, Homo sapiens
ugggugauguagcucauucucu

SEQ ID NO: 10195 - RNA, 22 nt, Homo sapiens
aaagaaagagccuguccccauu

SEQ ID NO: 10196 - RNA, 22 nt, Homo sapiens
ugaugugcauggaggcuuucau

SEQ ID NO: 10197 - RNA, 22 nt, Homo sapiens
uggaaagaucucuugcuuguua

SEQ ID NO: 10198 - RNA, 22 nt, Homo sapiens
ucagcagucaggguuugggguc

SEQ ID NO: 10199 - RNA, 22 nt, Homo sapiens
cccaagaguuugaguguuuggg

SEQ ID NO: 10200 - RNA, 22 nt, Homo sapiens
ccucuacagggaagcgcuuucu

SEQ ID NO: 10201 - RNA, 22 nt, Homo sapiens
aaagugcauccuuuuagagugu

SEQ ID NO: 10202 - RNA, 25 nt, Homo sapiens
aaagugcauccuuuuagaguguuac

SEQ ID NO: 10203 - RNA, 22 nt, Homo sapiens
agguuccugccuccugacguac

SEQ ID NO: 10204 - RNA, 21 nt, Homo sapiens
ucgaugggaugcugggaccug

SEQ ID NO: 10205 - RNA, 22 nt, Homo sapiens
uuuucuccccagacuuguuggc

SEQ ID NO: 10206 - RNA, 22 nt, Homo sapiens
cuucaagcucugagggaaaggg

SEQ ID NO: 10207 - RNA, 20 nt, Homo sapiens
aaagugcuuccuuuuagagg

SEQ ID NO: 10208 - RNA, 21 nt, Homo sapiens
aaagugcuuccuuuuagaggg

SEQ ID NO: 10209 - RNA, 22 nt, Homo sapiens
aaagugcuuccuuuuagagggu

SEQ ID NO: 10210 - RNA, 23 nt, Homo sapiens
aaagugcuuccuuuuagaggguu

SEQ ID NO: 10211 - RNA, 21 nt, Homo sapiens
cucuagagggaagcacuuucu

SEQ ID NO: 10212 - RNA, 23 nt, Homo sapiens
gaaagugcuuccuuuuagagggu

SEQ ID NO: 10213 - RNA, 20 nt, Homo sapiens
ucuagagggaagcacuuucu

SEQ ID NO: 10214 - RNA, 21 nt, Homo sapiens
ucuagagggaagcacuuucug

SEQ ID NO: 10215 - RNA, 22 nt, Homo sapiens
ucugauucagugauccucuucu

SEQ ID NO: 10216 - RNA, 22 nt, Homo sapiens
aggggauaauaaugcaucagau

SEQ ID NO: 10217 - RNA, 22 nt, Homo sapiens
uccuugucuucugguaaaugcc

SEQ ID NO: 10218 - RNA, 22 nt, Homo sapiens
caauuggcagcaagucaggaug

SEQ ID NO: 10219 - RNA, 22 nt, Homo sapiens
uguuuccaggaguuuugccaca

SEQ ID NO: 10220 - RNA, 22 nt, Homo sapiens
ugguaucaggacuccugggaua

SEQ ID NO: 10221 - RNA, 22 nt, Homo sapiens
ugauucacccagucuaagcuac

SEQ ID NO: 10222 - RNA, 22 nt, Homo sapiens
uaugguaagacugagugaauca

SEQ ID NO: 10223 - RNA, 22 nt, Homo sapiens
aauuguuuggcuggauguccug

SEQ ID NO: 10224 - RNA, 22 nt, Homo sapiens
ggaauaucuauauuguaggguu

SEQ ID NO: 10225 - RNA, 22 nt, Homo sapiens
ucugagcugggaugcagugguc

SEQ ID NO: 10226 - RNA, 22 nt, Homo sapiens
gauccucuccuggcucagcuuu

SEQ ID NO: 10227 - RNA, 22 nt, Homo sapiens
ugcacucgcuuccuugggcugu

SEQ ID NO: 10228 - RNA, 22 nt, Homo sapiens
caguccaaguggcucagugucu

SEQ ID NO: 10229 - RNA, 22 nt, Homo sapiens
uaaacaacagagaaucaguaaa

SEQ ID NO: 10230 - RNA, 22 nt, Homo sapiens
uauugauuccugcagcuguuua

SEQ ID NO: 10231 - RNA, 22 nt, Homo sapiens
uucuuuguuucuaggugagagu

SEQ ID NO: 10232 - RNA, 22 nt, Homo sapiens
uuucaaaccuagggacauugga

SEQ ID NO: 10233 - RNA, 22 nt, Homo sapiens
uaguuuuuauauagaaaucaac

SEQ ID NO: 10234 - RNA, 22 nt, Homo sapiens
uugauaaauauguaaguuuuuc

SEQ ID NO: 10235 - RNA, 22 nt, Homo sapiens
uaguuuuuauauagaaaucaac

SEQ ID NO: 10236 - RNA, 22 nt, Homo sapiens
uugauaaauauguaaguuuuuc

SEQ ID NO: 10237 - RNA, 22 nt, Homo sapiens
gaagguggaggugguguaguug

SEQ ID NO: 10238 - RNA, 22 nt, Homo sapiens
auuacaucugagccucuggccc

SEQ ID NO: 10239 - RNA, 22 nt, Homo sapiens
uuuuauggugcuuuuuugaagu

SEQ ID NO: 10240 - RNA, 22 nt, Homo sapiens
ucagaaaugcugugaucccagg

SEQ ID NO: 10241 - RNA, 22 nt, Homo sapiens
agaggggaaggaguggugucuu

SEQ ID NO: 10242 - RNA, 22 nt, Homo sapiens
gauuccugcuuucuccacucac

SEQ ID NO: 10243 - RNA, 22 nt, Homo sapiens
agcuuucuuuugguggagaagg

SEQ ID NO: 10244 - RNA, 22 nt, Homo sapiens
uuuauucucaucaaaaggcaua

SEQ ID NO: 10245 - RNA, 22 nt, Homo sapiens
uuacaggcucugaacuaaguaa

SEQ ID NO: 10246 - RNA, 22 nt, Homo sapiens
uuaguuuagagccugcuauacu

SEQ ID NO: 10247 - RNA, 22 nt, Homo sapiens
aaucagguuaccagcagaucau

SEQ ID NO: 10248 - RNA, 16 nt, Homo sapiens
ugcuggcugcuugauu

SEQ ID NO: 10249 - RNA, 22 nt, Homo sapiens
ugcagccagagcuugagggcaa

SEQ ID NO: 10250 - RNA, 22 nt, Homo sapiens
uguccucugccaugguugggau

SEQ ID NO: 10251 - RNA, 22 nt, Homo sapiens
ucuacaaaggaaagcgcuuucu

SEQ ID NO: 10252 - RNA, 22 nt, Homo sapiens
aaagcgcuucccuuuugagggu

SEQ ID NO: 10253 - RNA, 22 nt, Homo sapiens
uccuuaaccucuuagugcaucu

SEQ ID NO: 10254 - RNA, 22 nt, Homo sapiens
ugcacuccaagaugugguggga

SEQ ID NO: 10255 - RNA, 22 nt, Homo sapiens
ggucaggaaucaccagggaggu

SEQ ID NO: 10256 - RNA, 22 nt, Homo sapiens
uccuugguccuuccaugaaagc

SEQ ID NO: 10257 - RNA, 22 nt, Homo sapiens
aauggacaggucugugaggagu

SEQ ID NO: 10258 - RNA, 22 nt, Homo sapiens
cuccucaggaugcugccaugug

SEQ ID NO: 10259 - RNA, 22 nt, Homo sapiens
aagauacaauaugggugugugu

SEQ ID NO: 10260 - RNA, 22 nt, Homo sapiens
aaacauauauauuugcaucuac

SEQ ID NO: 10261 - RNA, 22 nt, Homo sapiens
uggaccugggaacugcuuaccu

SEQ ID NO: 10262 - RNA, 22 nt, Homo sapiens
agaagaggaucuugcaggucca

SEQ ID NO: 10263 - RNA, 22 nt, Homo sapiens
uuugguauggucaaagccugug

SEQ ID NO: 10264 - RNA, 22 nt, Homo sapiens
cacggcuugaccauuuugauug

SEQ ID NO: 10265 - RNA, 22 nt, Homo sapiens
cauuuuccuagucaugugcuuc

SEQ ID NO: 10266 - RNA, 20 nt, Homo sapiens
gagacacuggauggaaaaug

SEQ ID NO: 10267 - RNA, 14 nt, Homo sapiens
accugggcaaggau

SEQ ID NO: 10268 - RNA, 21 nt, Homo sapiens
auccuugcuaucugggugcua

SEQ ID NO: 10269 - RNA, 22 nt, Homo sapiens
uccauaugugggugggcuagca

SEQ ID NO: 10270 - RNA, 22 nt, Homo sapiens
uggcaucuguccucaugugaga

SEQ ID NO: 10271 - RNA, 22 nt, Homo sapiens
uggguggucacauggcaggccc

SEQ ID NO: 10272 - RNA, 22 nt, Homo sapiens
gaggcugcugauguccccaccc

SEQ ID NO: 10273 - RNA, 22 nt, Homo sapiens
ucugcacuuguuucucucuucc

SEQ ID NO: 10274 - RNA, 22 nt, Homo sapiens
accugagagaagaggguagaag

SEQ ID NO: 10275 - RNA, 22 nt, Homo sapiens
acccucugcaggccacccccac

SEQ ID NO: 10276 - RNA, 22 nt, Homo sapiens
ggagggugguggccggggguga

SEQ ID NO: 10277 - RNA, 22 nt, Homo sapiens
gcgucuuaccagacaugguuag

SEQ ID NO: 10278 - RNA, 22 nt, Homo sapiens
uaauacugucugguaaaaccgu

SEQ ID NO: 10279 - RNA, 22 nt, Homo sapiens
ccaucuguucacuguguccucc

SEQ ID NO: 10280 - RNA, 17 nt, Homo sapiens
gagacagagacagaugg

SEQ ID NO: 10281 - RNA, 22 nt, Homo sapiens
ggcagggugcguuagcuuugag

SEQ ID NO: 10282 - RNA, 22 nt, Homo sapiens
uaaagcugauguguugacccug

SEQ ID NO: 10283 - RNA, 22 nt, Homo sapiens
ugcuaggaagugccagguugau

SEQ ID NO: 10284 - RNA, 22 nt, Homo sapiens
ugagccuggcauaucccaggca

SEQ ID NO: 10285 - RNA, 22 nt, Homo sapiens
agagccagguugacuugcuccc

SEQ ID NO: 10286 - RNA, 22 nt, Homo sapiens
gagcaagucuacagaggcucuc

SEQ ID NO: 10287 - RNA, 22 nt, Homo sapiens
cagcuggaacggcagcccagca

SEQ ID NO: 10288 - RNA, 22 nt, Homo sapiens
cucgggcgccggccacgcuacc

SEQ ID NO: 10289 - RNA, 22 nt, Homo sapiens
cagcuggaacggcagcccagca

SEQ ID NO: 10290 - RNA, 22 nt, Homo sapiens
cucgggcgccggccacgcuacc

SEQ ID NO: 10291 - RNA, 22 nt, Homo sapiens
uagcagauccaggaauagaagc

SEQ ID NO: 10292 - RNA, 22 nt, Homo sapiens
gaauuuguucucuuucuguuaa

SEQ ID NO: 10293 - RNA, 22 nt, Homo sapiens
accccccgcgccaggcccaggc

SEQ ID NO: 10294 - RNA, 22 nt, Homo sapiens
ucugggccaggcgagccgaggg

SEQ ID NO: 10295 - RNA, 22 nt, Homo sapiens
ugugugcagaugaucucaucuc

SEQ ID NO: 10296 - RNA, 22 nt, Homo sapiens
gguaagguuacugucacacagu

SEQ ID NO: 10297 - RNA, 22 nt, Homo sapiens
gggguucuuugugcuuugauaa

SEQ ID NO: 10298 - RNA, 22 nt, Homo sapiens
ugcuggcagagcacagcuaucu

SEQ ID NO: 10299 - RNA, 22 nt, Homo sapiens
uccugguuccugcacgucucag

SEQ ID NO: 10300 - RNA, 22 nt, Homo sapiens
uugagagaugccaacuaggggu

SEQ ID NO: 10301 - RNA, 22 nt, Homo sapiens
uauugauuucagacccaguuuu

SEQ ID NO: 10302 - RNA, 22 nt, Homo sapiens
agaauuugguccuguguuuaga

SEQ ID NO: 10303 - RNA, 22 nt, Homo sapiens
uggauuucuuugugaaucacca

SEQ ID NO: 10304 - RNA, 22 nt, Homo sapiens
uggugguuuacaaaguaauuca

SEQ ID NO: 10305 - RNA, 22 nt, Homo sapiens
ugugucuguguuucagccccua

SEQ ID NO: 10306 - RNA, 22 nt, Homo sapiens
uaggcuuuaacaucagacaggu

SEQ ID NO: 10307 - RNA, 22 nt, Homo sapiens
uggcagcucauugaauccaauu

SEQ ID NO: 10308 - RNA, 22 nt, Homo sapiens
uguuuuuaucugagcuuccauu

SEQ ID NO: 10309 - RNA, 22 nt, Homo sapiens
ugggaaauaagcugauaguaaa

SEQ ID NO: 10310 - RNA, 22 nt, Homo sapiens
ucugugcagguuaacauuucug

SEQ ID NO: 10311 - RNA, 22 nt, Homo sapiens
ugucucccacaugggaggagug

SEQ ID NO: 10312 - RNA, 22 nt, Homo sapiens
uccuuacccaucugugaggugc

SEQ ID NO: 10313 - RNA, 22 nt, Homo sapiens
ggaaaaaugucaggaugggaaa

SEQ ID NO: 10314 - RNA, 22 nt, Homo sapiens
uuuuccagccaugacauuucag

SEQ ID NO: 10315 - RNA, 22 nt, Homo sapiens
aaagugcugucauagcugaggu

SEQ ID NO: 10316 - RNA, 22 nt, Homo sapiens
aagugcugucauagcugagguc

SEQ ID NO: 10317 - RNA, 22 nt, Homo sapiens
acucagccuugagggcacuuuc

SEQ ID NO: 10318 - RNA, 23 nt, Homo sapiens
cacucagccuugagggcacuuuc

SEQ ID NO: 10319 - RNA, 22 nt, Homo sapiens
gaaguggcacucugguggcuuu

SEQ ID NO: 10320 - RNA, 22 nt, Homo sapiens
agacuaacaggaugcuguuuuc

SEQ ID NO: 10321 - RNA, 22 nt, Homo sapiens
ugcacccugguccgggcagccc

SEQ ID NO: 10322 - RNA, 21 nt, Homo sapiens
ugccugcuaacuggggugcag

SEQ ID NO: 10323 - RNA, 22 nt, Homo sapiens
agcuucuccaugcuggugcuca

SEQ ID NO: 10324 - RNA, 22 nt, Homo sapiens
ugagcagcagcugggaaauugc

SEQ ID NO: 10325 - RNA, 22 nt, Homo sapiens
gggccaucaaauuuggagcuua

SEQ ID NO: 10326 - RNA, 22 nt, Homo sapiens
uuagccaaguuuuguggcuuuu

SEQ ID NO: 10327 - RNA, 22 nt, Homo sapiens
uucuuuccucccacaggaaguc

SEQ ID NO: 10328 - RNA, 22 nt, Homo sapiens
acuuucugagggagauugaaaa

SEQ ID NO: 10329 - RNA, 22 nt, Homo sapiens
ucugguguguauagaguuaacc

SEQ ID NO: 10330 - RNA, 22 nt, Homo sapiens
uaguuaacuucuuucaccagga

SEQ ID NO: 10331 - RNA, 22 nt, Homo sapiens
accugucuaggcccagcuuuug

SEQ ID NO: 10332 - RNA, 22 nt, Homo sapiens
aaggcaggccuggacacccugu

SEQ ID NO: 10333 - RNA, 22 nt, Homo sapiens
uucucucccugaagcacuuguu

SEQ ID NO: 10334 - RNA, 22 nt, Homo sapiens
ccgcgugccucaaggggaggcu

SEQ ID NO: 10335 - RNA, 22 nt, Homo sapiens
uuguuacucaaauagaguucuc

SEQ ID NO: 10336 - RNA, 22 nt, Homo sapiens
acuuggauuagguaauuggaca

SEQ ID NO: 10337 - RNA, 22 nt, Homo sapiens
ggcaaggguuggacucuguggc

SEQ ID NO: 10338 - RNA, 20 nt, Homo sapiens
cacagcugucuuccuuugcu

SEQ ID NO: 10339 - RNA, 22 nt, Homo sapiens
ggagaaaggggcgggcaucugg

SEQ ID NO: 10340 - RNA, 22 nt, Homo sapiens
ucagaggcuuauucaucucauc

SEQ ID NO: 10341 - RNA, 22 nt, Homo sapiens
cuuucagucggauguuuacagc

SEQ ID NO: 10342 - RNA, 20 nt, Homo sapiens
uguaaacauccuugacugga

SEQ ID NO: 10343 - RNA, 22 nt, Homo sapiens
ucuaaauugugaagaauaagca

SEQ ID NO: 10344 - RNA, 22 nt, Homo sapiens
cuugucuacauuucuuuagaca

SEQ ID NO: 10345 - RNA, 22 nt, Homo sapiens
ucuaaauugugaagaauaagca

SEQ ID NO: 10346 - RNA, 22 nt, Homo sapiens
cuugucuacauuucuuuagaca

SEQ ID NO: 10347 - RNA, 22 nt, Homo sapiens
ucuaaauugugaagaauaagca

SEQ ID NO: 10348 - RNA, 22 nt, Homo sapiens
cuugucuacauuucuuuagaca

SEQ ID NO: 10349 - RNA, 22 nt, Homo sapiens
ucuaaauugugaagaauaagca

SEQ ID NO: 10350 - RNA, 22 nt, Homo sapiens
cuugucuacauuucuuuagaca

SEQ ID NO: 10351 - RNA, 22 nt, Homo sapiens
aacuguccuuccuggaggugua

SEQ ID NO: 10352 - RNA, 22 nt, Homo sapiens
augucuccugggaggagaggcc

SEQ ID NO: 10353 - RNA, 22 nt, Homo sapiens
ugaccagcccaggcaucggccc

SEQ ID NO: 10354 - RNA, 22 nt, Homo sapiens
ugacugaguuaggguugggguu

SEQ ID NO: 10355 - RNA, 22 nt, Homo sapiens
uuuaaugaaauauggauuuaua

SEQ ID NO: 10356 - RNA, 22 nt, Homo sapiens
uguaguccauauuucaauuaau

SEQ ID NO: 10357 - RNA, 22 nt, Homo sapiens
gcacuauauuuaaaccugugga

SEQ ID NO: 10358 - RNA, 20 nt, Homo sapiens
ucuugguuacgcuguagugc

SEQ ID NO: 10359 - RNA, 22 nt, Homo sapiens
acccaguguugugggagaaaug

SEQ ID NO: 10360 - RNA, 22 nt, Homo sapiens
ucgcuuucacggcacuuggggu

SEQ ID NO: 10361 - RNA, 22 nt, Homo sapiens
uaaaauggggaugaugauaaca

SEQ ID NO: 10362 - RNA, 22 nt, Homo sapiens
uauuguuauccccauuuugcau

SEQ ID NO: 10363 - RNA, 22 nt, Homo sapiens
ugugucacugugggcauagaaa

SEQ ID NO: 10364 - RNA, 22 nt, Homo sapiens
auauucucacagugacacaagc

SEQ ID NO: 10365 - RNA, 22 nt, Homo sapiens
gcuaaauuacaaacucagagga

SEQ ID NO: 10366 - RNA, 22 nt, Homo sapiens
uucuggguggugauuuagucaa

SEQ ID NO: 10367 - RNA, 22 nt, Homo sapiens
uucuggggaucacaugagggaa

SEQ ID NO: 10368 - RNA, 22 nt, Homo sapiens
cauucaauagaucccuaggaug

SEQ ID NO: 10369 - RNA, 22 nt, Homo sapiens
agugccuguuggccaaagcuca

SEQ ID NO: 10370 - RNA, 22 nt, Homo sapiens
gcucaaguggccagcagggcac

SEQ ID NO: 10371 - RNA, 22 nt, Homo sapiens
ccuggucccguggcugagagug

SEQ ID NO: 10372 - RNA, 22 nt, Homo sapiens
cccucuaauggccauggugacc

SEQ ID NO: 10373 - RNA, 22 nt, Homo sapiens
ugggcuugguaggugugggugc

SEQ ID NO: 10374 - RNA, 22 nt, Homo sapiens
ccaguacugggccaggccuacc

SEQ ID NO: 10375 - RNA, 22 nt, Homo sapiens
ggagaggagaguguugagcaca

SEQ ID NO: 10376 - RNA, 22 nt, Homo sapiens
uguuugacacuuucacuuuucc

SEQ ID NO: 10377 - RNA, 22 nt, Homo sapiens
uggcuaagcuuccaaggcccuc

SEQ ID NO: 10378 - RNA, 22 nt, Homo sapiens
aaucgggccgggaguuggguca

SEQ ID NO: 10379 - RNA, 22 nt, Homo sapiens
gccgcggggcuuguuguugacu

SEQ ID NO: 10380 - RNA, 22 nt, Homo sapiens
gucaggggcuggcucucggcga

SEQ ID NO: 10381 - RNA, 22 nt, Homo sapiens
agacaugcagcucuagggcucg

SEQ ID NO: 10382 - RNA, 21 nt, Homo sapiens
gcugugggagcugucgugucu

SEQ ID NO: 10383 - RNA, 22 nt, Homo sapiens
aaaauaguuuagaauugguuuu

SEQ ID NO: 10384 - RNA, 22 nt, Homo sapiens
agcuauguaucuaaacuauuuc

SEQ ID NO: 10385 - RNA, 22 nt, Homo sapiens
aguugcuccuguacuuagcugc

SEQ ID NO: 10386 - RNA, 19 nt, Homo sapiens
guuauuacaggcagcagcu

SEQ ID NO: 10387 - RNA, 22 nt, Homo sapiens
uauuuauaccuggucucauucc

SEQ ID NO: 10388 - RNA, 22 nt, Homo sapiens
agugugauucaguauaauauaa

SEQ ID NO: 10389 - RNA, 22 nt, Homo sapiens
ggagggggugugcucugcagag

SEQ ID NO: 10390 - RNA, 22 nt, Homo sapiens
uccugggcaguacucaccucca

SEQ ID NO: 10391 - RNA, 22 nt, Homo sapiens
uggucagagugcaucugcgcaa

SEQ ID NO: 10392 - RNA, 22 nt, Homo sapiens
ugcacacuugacacucuugacc

SEQ ID NO: 10393 - RNA, 22 nt, Homo sapiens
uauuagguuggugcaaaaguca

SEQ ID NO: 10394 - RNA, 22 nt, Homo sapiens
acuuuugcacuaagcuaaauau

SEQ ID NO: 10395 - RNA, 22 nt, Homo sapiens
uaaacuugcauccauguggcuu

SEQ ID NO: 10396 - RNA, 22 nt, Homo sapiens
ccauauggccucaaguuagcau

SEQ ID NO: 10397 - RNA, 22 nt, Homo sapiens
ucucucucuggccaucauuggc

SEQ ID NO: 10398 - RNA, 22 nt, Homo sapiens
uaaaagugacccagaggaggug

SEQ ID NO: 10399 - RNA, 22 nt, Homo sapiens
ggaggaggagcugaagcuuggu

SEQ ID NO: 10400 - RNA, 22 nt, Homo sapiens
cccacggcuucagcccugcuca

SEQ ID NO: 10401 - RNA, 22 nt, Homo sapiens
gacaaaagcgggcggcgggccg

SEQ ID NO: 10402 - RNA, 22 nt, Homo sapiens
gcgcucccucucugcuuuuugu

SEQ ID NO: 10403 - RNA, 22 nt, Homo sapiens
ucccagcccaugcucugugccu

SEQ ID NO: 10404 - RNA, 22 nt, Homo sapiens
acaggugcugcuggcuguggag

SEQ ID NO: 10405 - RNA, 22 nt, Homo sapiens
uacaggugcugaggggcucugu

SEQ ID NO: 10406 - RNA, 22 nt, Homo sapiens
cuuggccccguggcgcucugua

SEQ ID NO: 10407 - RNA, 22 nt, Homo sapiens
ugagcaaggaggauauaaauag

SEQ ID NO: 10408 - RNA, 22 nt, Homo sapiens
ucuuuguugauuccugugcuua

SEQ ID NO: 10409 - RNA, 22 nt, Homo sapiens
agaccccuggggguuuccuuuc

SEQ ID NO: 10410 - RNA, 17 nt, Homo sapiens
aaguccccauggggucu

SEQ ID NO: 10411 - RNA, 22 nt, Homo sapiens
uucugcucuguuuucuaauagu

SEQ ID NO: 10412 - RNA, 22 nt, Homo sapiens
uauucagaguguaagagcuaga

SEQ ID NO: 10413 - RNA, 22 nt, Homo sapiens
ggugugugcguuagaaugcagc

SEQ ID NO: 10414 - RNA, 22 nt, Homo sapiens
cagcaauaguuucuaaugcugu

SEQ ID NO: 10415 - RNA, 22 nt, Homo sapiens
uccagcuuaauggcauguuucc

SEQ ID NO: 10416 - RNA, 22 nt, Homo sapiens
agcagccauggagcuuggaucu

SEQ ID NO: 10417 - RNA, 22 nt, Homo sapiens
uccagcuuaauggcauguuucc

SEQ ID NO: 10418 - RNA, 22 nt, Homo sapiens
agcagccauggagcuuggaucu

SEQ ID NO: 10419 - RNA, 22 nt, Homo sapiens
agagaggaaggaguggugucuu

SEQ ID NO: 10420 - RNA, 22 nt, Homo sapiens
agauuccugcuuucuccacuca

SEQ ID NO: 10421 - RNA, 22 nt, Homo sapiens
agaggggaaggaguggugucuu

SEQ ID NO: 10422 - RNA, 22 nt, Homo sapiens
gauuccugcuuucuccacucac

SEQ ID NO: 10423 - RNA, 22 nt, Homo sapiens
agaggggaaggaguggugucuu

SEQ ID NO: 10424 - RNA, 22 nt, Homo sapiens
gauuccugcuuucuccacucac

SEQ ID NO: 10425 - RNA, 22 nt, Homo sapiens
ucaccacacuuccuggugccug

SEQ ID NO: 10426 - RNA, 22 nt, Homo sapiens
cuagacgcccaguagguggaug

SEQ ID NO: 10427 - RNA, 22 nt, Homo sapiens
uucugcugcuuguugcgugucu

SEQ ID NO: 10428 - RNA, 22 nt, Homo sapiens
aaaugcgacaagcuguggaugu

SEQ ID NO: 10429 - RNA, 22 nt, Homo sapiens
uaauucaugcaaauugaucccu

SEQ ID NO: 10430 - RNA, 22 nt, Homo sapiens
guuuuaauuuguugaacuugug

SEQ ID NO: 10431 - RNA, 22 nt, Homo sapiens
ugaaugcugaugaaguguccag

SEQ ID NO: 10432 - RNA, 22 nt, Homo sapiens
uggagcugcauucagcauuccu

SEQ ID NO: 10433 - RNA, 22 nt, Homo sapiens
ucaaauuucuuuuugugcaugu

SEQ ID NO: 10434 - RNA, 22 nt, Homo sapiens
ugugcaaagaauuuauuuggau

SEQ ID NO: 10435 - RNA, 22 nt, Homo sapiens
aggcguggggaaccuuuccuga

SEQ ID NO: 10436 - RNA, 22 nt, Homo sapiens
uccagguggguucccgacucug

SEQ ID NO: 10437 - RNA, 22 nt, Homo sapiens
ugggcuuguugacugggcugga

SEQ ID NO: 10438 - RNA, 22 nt, Homo sapiens
ugggucuaguuggagcccccag

SEQ ID NO: 10439 - RNA, 22 nt, Homo sapiens
ugccccccggagcgaagacccc

SEQ ID NO: 10440 - RNA, 22 nt, Homo sapiens
ggggucugcuuagggguccacu

SEQ ID NO: 10441 - RNA, 22 nt, Homo sapiens
ugccccccggagcgaagacccc

SEQ ID NO: 10442 - RNA, 22 nt, Homo sapiens
ggggucugcuuagggguccacu

SEQ ID NO: 10443 - RNA, 22 nt, Homo sapiens
ucuguaagaagaggcugcacug

SEQ ID NO: 10444 - RNA, 22 nt, Homo sapiens
uguagaaucucaucugacguga

SEQ ID NO: 10445 - RNA, 22 nt, Homo sapiens
ucauuacauggagaggaauuuu

SEQ ID NO: 10446 - RNA, 22 nt, Homo sapiens
gaguuuucuuuccagggaauag

SEQ ID NO: 10447 - RNA, 22 nt, Homo sapiens
ucuguccccuaccccuuccccc

SEQ ID NO: 10448 - RNA, 22 nt, Homo sapiens
ggaggggggaggaggcaagaag

SEQ ID NO: 10449 - RNA, 22 nt, Homo sapiens
gguccggguccggcccggcuug

SEQ ID NO: 10450 - RNA, 22 nt, Homo sapiens
augccgggccccgacgccggau

SEQ ID NO: 10451 - RNA, 22 nt, Homo sapiens
ucgggaaagcugcccgaaugag

SEQ ID NO: 10452 - RNA, 22 nt, Homo sapiens
uuguuuggaguaguuuauccuc

SEQ ID NO: 10453 - RNA, 22 nt, Homo sapiens
uuggaagcuggagaucccaggu

SEQ ID NO: 10454 - RNA, 22 nt, Homo sapiens
ugggaccuuccgguuucuccug

SEQ ID NO: 10455 - RNA, 22 nt, Homo sapiens
ucccacuuuuaucugaugggga

SEQ ID NO: 10456 - RNA, 22 nt, Homo sapiens
ucugugggaugaaaugggagga

SEQ ID NO: 10457 - RNA, 22 nt, Homo sapiens
gagaucaauaucaagauuuguu

SEQ ID NO: 10458 - RNA, 22 nt, Homo sapiens
auaaaucuuguuauugacuaga

SEQ ID NO: 10459 - RNA, 22 nt, Homo sapiens
uggaaauaguaaugcauaagug

SEQ ID NO: 10460 - RNA, 22 nt, Homo sapiens
uuaaaauguuuaccauuuccag

SEQ ID NO: 10461 - RNA, 22 nt, Homo sapiens
uggguaccaccucacugaauuc

SEQ ID NO: 10462 - RNA, 22 nt, Homo sapiens
augccucaguagggugguaugc

SEQ ID NO: 10463 - RNA, 22 nt, Homo sapiens
ucuacuucuguggcuccaagac

SEQ ID NO: 10464 - RNA, 22 nt, Homo sapiens
uuaaagcuaccgaaaguugggc

SEQ ID NO: 10465 - RNA, 22 nt, Homo sapiens
ugugcugugggcuaacaaucaa

SEQ ID NO: 10466 - RNA, 22 nt, Homo sapiens
uuucuuggccccagcuagcaca

SEQ ID NO: 10467 - RNA, 22 nt, Homo sapiens
uaggggaaguucaugcgcagcc

SEQ ID NO: 10468 - RNA, 22 nt, Homo sapiens
cagcgugcgcgugagccccuug

SEQ ID NO: 10469 - RNA, 22 nt, Homo sapiens
uuuuucuuccuucaaucucuuu

SEQ ID NO: 10470 - RNA, 22 nt, Homo sapiens
uggcaaggaguuggggaaaaaa

SEQ ID NO: 10471 - RNA, 22 nt, Homo sapiens
uuuuucuuccuucaaucucuuu

SEQ ID NO: 10472 - RNA, 22 nt, Homo sapiens
uggcaaggaguuggggaaaaaa

SEQ ID NO: 10473 - RNA, 22 nt, Homo sapiens
uggguggagaggacaggauggg

SEQ ID NO: 10474 - RNA, 22 nt, Homo sapiens
ccuccggucccccucccaccca

SEQ ID NO: 10475 - RNA, 22 nt, Homo sapiens
ucccagccagcccaguggcacc

SEQ ID NO: 10476 - RNA, 22 nt, Homo sapiens
gacagcacugggggacugggau

SEQ ID NO: 10477 - RNA, 22 nt, Homo sapiens
gccucgcccaugcccagcggcu

SEQ ID NO: 10478 - RNA, 22 nt, Homo sapiens
ugucucaggugggguggggugg

SEQ ID NO: 10479 - RNA, 22 nt, Homo sapiens
ccccccgccaccuucuuuuccc

SEQ ID NO: 10480 - RNA, 22 nt, Homo sapiens
gcaggaggagaaguggggggau

SEQ ID NO: 10481 - RNA, 22 nt, Homo sapiens
ugugagaauguguaaugugugu

SEQ ID NO: 10482 - RNA, 22 nt, Homo sapiens
uacauuauguaugaucaauaua

SEQ ID NO: 10483 - RNA, 22 nt, Homo sapiens
cagcauugcugagccuuaccau

SEQ ID NO: 10484 - RNA, 22 nt, Homo sapiens
uaaaagggcuuggcaaaugcug

SEQ ID NO: 10485 - RNA, 22 nt, Homo sapiens
gacugagggauggugggcuugu

SEQ ID NO: 10486 - RNA, 22 nt, Homo sapiens
gcucaucugcaccuugguucuc

SEQ ID NO: 10487 - RNA, 22 nt, Homo sapiens
ucugggcuggcuuugucuccuu

SEQ ID NO: 10488 - RNA, 22 nt, Homo sapiens
gcaugggacuuuaguccagauu

SEQ ID NO: 10489 - RNA, 22 nt, Homo sapiens
uguagugugcuucuugucugaa

SEQ ID NO: 10490 - RNA, 22 nt, Homo sapiens
agacaagaaaguagauacacgc

SEQ ID NO: 10491 - RNA, 22 nt, Homo sapiens
ucuccggggcccccaggccugg

SEQ ID NO: 10492 - RNA, 22 nt, Homo sapiens
gggcugcagggcccuggagugg

SEQ ID NO: 10493 - RNA, 22 nt, Homo sapiens
uaugucaggccucauucuaccu

SEQ ID NO: 10494 - RNA, 22 nt, Homo sapiens
guagaaagaggccugauaaucu

SEQ ID NO: 10495 - RNA, 22 nt, Homo sapiens
ucgaaaguggcagguauccagg

SEQ ID NO: 10496 - RNA, 22 nt, Homo sapiens
ugaggaugugugauucuuuuga

SEQ ID NO: 10497 - RNA, 22 nt, Homo sapiens
ucagucuguuggaauaucgcug

SEQ ID NO: 10498 - RNA, 22 nt, Homo sapiens
gaacggguguguucugucagac

SEQ ID NO: 10499 - RNA, 22 nt, Homo sapiens
gcagagccugucuccagggacu

SEQ ID NO: 10500 - RNA, 22 nt, Homo sapiens
cccugggggacggccgcucugu

SEQ ID NO: 10501 - RNA, 22 nt, Homo sapiens
gcagagccugucuccagggacu

SEQ ID NO: 10502 - RNA, 22 nt, Homo sapiens
cccugggggacggccgcucugu

SEQ ID NO: 10503 - RNA, 22 nt, Homo sapiens
uccaccauguggcucagcaaca

SEQ ID NO: 10504 - RNA, 22 nt, Homo sapiens
uugccaagaccauguguuggga

SEQ ID NO: 10505 - RNA, 22 nt, Homo sapiens
ugugaccauccucacugagcug

SEQ ID NO: 10506 - RNA, 22 nt, Homo sapiens
cuuggugagcaggacaugggug

SEQ ID NO: 10507 - RNA, 22 nt, Homo sapiens
ccuuucuccuggcccagcuuuc

SEQ ID NO: 10508 - RNA, 20 nt, Homo sapiens
cugggccugggcagggaagg

SEQ ID NO: 10509 - RNA, 22 nt, Homo sapiens
uccccuggucugcagcuguuag

SEQ ID NO: 10510 - RNA, 21 nt, Homo sapiens
gacugcgguaucuugggggag

SEQ ID NO: 10511 - RNA, 22 nt, Homo sapiens
ugcucuuuucucaaugugguaa

SEQ ID NO: 10512 - RNA, 22 nt, Homo sapiens
uacgugccauagagaaaagaag

SEQ ID NO: 10513 - RNA, 22 nt, Homo sapiens
agguggugacuguugugggcau

SEQ ID NO: 10514 - RNA, 22 nt, Homo sapiens
cucagaaugguucacccauccu

SEQ ID NO: 10515 - RNA, 22 nt, Homo sapiens
ugugcagcacagggagcggcuc

SEQ ID NO: 10516 - RNA, 22 nt, Homo sapiens
cugcuccccugagcauugcaca

SEQ ID NO: 10517 - RNA, 22 nt, Homo sapiens
cagcagaacggaaaaggcuggg

SEQ ID NO: 10518 - RNA, 22 nt, Homo sapiens
ugcgcuuucccucuucugccac

SEQ ID NO: 10519 - RNA, 22 nt, Homo sapiens
ucagauuagagaggggaauggg

SEQ ID NO: 10520 - RNA, 22 nt, Homo sapiens
uauucuccucuguauuguuuga

SEQ ID NO: 10521 - RNA, 22 nt, Homo sapiens
gaagggaagaauggggagaugg

SEQ ID NO: 10522 - RNA, 22 nt, Homo sapiens
uuauucugaaccucauuuuucu

SEQ ID NO: 10523 - RNA, 22 nt, Homo sapiens
uggucucaaggacaggaccuua

SEQ ID NO: 10524 - RNA, 22 nt, Homo sapiens
gcuccuuuucuuggggccuaaa

SEQ ID NO: 10525 - RNA, 22 nt, Homo sapiens
uuccuuuucuuaacaccuccau

SEQ ID NO: 10526 - RNA, 22 nt, Homo sapiens
ugauguguugggugaagagcuc

SEQ ID NO: 10527 - RNA, 22 nt, Homo sapiens
ugcucuggcccagagcgcaugu

SEQ ID NO: 10528 - RNA, 22 nt, Homo sapiens
ugggcucugggccggaggcguc

SEQ ID NO: 10529 - RNA, 22 nt, Homo sapiens
cagguggggcgggcugggaggc

SEQ ID NO: 10530 - RNA, 22 nt, Homo sapiens
ccucaggcugcuccaagcccug

SEQ ID NO: 10531 - RNA, 22 nt, Homo sapiens
ccccucuccggaauccccuauc

SEQ ID NO: 10532 - RNA, 22 nt, Homo sapiens
augggaucugggggugaggggc

SEQ ID NO: 10533 - RNA, 22 nt, Homo sapiens
uagguagggcuaauuagaaauu

SEQ ID NO: 10534 - RNA, 22 nt, Homo sapiens
accucuacaguccuucagccua

SEQ ID NO: 10535 - RNA, 22 nt, Homo sapiens
ccugcauggugguggggcggga

SEQ ID NO: 10536 - RNA, 22 nt, Homo sapiens
cguccuacucucucacugcaag

SEQ ID NO: 10537 - RNA, 22 nt, Homo sapiens
uuggcccucuccugcugggcga

SEQ ID NO: 10538 - RNA, 22 nt, Homo sapiens
cuggugagagaggugcccagga

SEQ ID NO: 10539 - RNA, 22 nt, Homo sapiens
uagggcuacagcccccauuguc

SEQ ID NO: 10540 - RNA, 22 nt, Homo sapiens
cagugagggccauagcucuagg

SEQ ID NO: 10541 - RNA, 22 nt, Homo sapiens
aguugcacaguuguugggcagu

SEQ ID NO: 10542 - RNA, 22 nt, Homo sapiens
ugcuccagcugugcugcagaug

SEQ ID NO: 10543 - RNA, 22 nt, Homo sapiens
caccucaggagggagggaggga

SEQ ID NO: 10544 - RNA, 22 nt, Homo sapiens
cucuugcuccuucacugggugg

SEQ ID NO: 10545 - RNA, 22 nt, Homo sapiens
caucuggagaagcaucaaggcc

SEQ ID NO: 10546 - RNA, 21 nt, Homo sapiens
uggagcugccuggaccagaug

SEQ ID NO: 10547 - RNA, 22 nt, Homo sapiens
uccgugcuucccuccugccucu

SEQ ID NO: 10548 - RNA, 22 nt, Homo sapiens
ggcugggagggaggucagaaug

SEQ ID NO: 10549 - RNA, 22 nt, Homo sapiens
aagggggauuugugcuuguaac

SEQ ID NO: 10550 - RNA, 22 nt, Homo sapiens
ugcauguguaaaucuuccuccu

SEQ ID NO: 10551 - RNA, 22 nt, Homo sapiens
uggugaugcuuagggagaagug

SEQ ID NO: 10552 - RNA, 22 nt, Homo sapiens
ccuuccaaagcaauacucacca

SEQ ID NO: 10553 - RNA, 22 nt, Homo sapiens
ccaccucgccuggccuggacca

SEQ ID NO: 10554 - RNA, 22 nt, Homo sapiens
gccugggccuggcaugggaggu

SEQ ID NO: 10555 - RNA, 22 nt, Homo sapiens
uugaggccuucauuucuccguc

SEQ ID NO: 10556 - RNA, 22 nt, Homo sapiens
guggaccuugaaggccucuucu

SEQ ID NO: 10557 - RNA, 22 nt, Homo sapiens
uggcaggugagagcucuuugaa

SEQ ID NO: 10558 - RNA, 22 nt, Homo sapiens
aaguguucuucuuugccuguga

SEQ ID NO: 10559 - RNA, 22 nt, Homo sapiens
uggcaggugagagcucuuugaa

SEQ ID NO: 10560 - RNA, 22 nt, Homo sapiens
aaguguucuucuuugccuguga

SEQ ID NO: 10561 - RNA, 22 nt, Homo sapiens
aguuugaagccuguuguucauc

SEQ ID NO: 10562 - RNA, 22 nt, Homo sapiens
ugggauuggaagucuucagauu

SEQ ID NO: 10563 - RNA, 22 nt, Homo sapiens
gaauuauagugccauuuguuuu

SEQ ID NO: 10564 - RNA, 22 nt, Homo sapiens
aacaaaugacaguacgauuucc

SEQ ID NO: 10565 - RNA, 22 nt, Homo sapiens
uggaauaaauacaggguuuggu

SEQ ID NO: 10566 - RNA, 22 nt, Homo sapiens
aaccuaguacugguucuggcau

SEQ ID NO: 10567 - RNA, 22 nt, Homo sapiens
uggggaagagggagcuggaaug

SEQ ID NO: 10568 - RNA, 22 nt, Homo sapiens
ucucaguugcuuucuuuuccug

SEQ ID NO: 10569 - RNA, 22 nt, Homo sapiens
ggggcagggacgcggugggcgg

SEQ ID NO: 10570 - RNA, 22 nt, Homo sapiens
cucucugugcccugugcuggcc

SEQ ID NO: 10571 - RNA, 22 nt, Homo sapiens
gguagaagugagguggagcaug

SEQ ID NO: 10572 - RNA, 22 nt, Homo sapiens
uccgugcccauccacuccucuu

SEQ ID NO: 10573 - RNA, 22 nt, Homo sapiens
ucccuucuuuuugcagaggagg

SEQ ID NO: 10574 - RNA, 22 nt, Homo sapiens
ccucccuacaaggaagagauaa

SEQ ID NO: 10575 - RNA, 22 nt, Homo sapiens
uccgcuggggcuguuucuuaac

SEQ ID NO: 10576 - RNA, 22 nt, Homo sapiens
agaacagacagcuccagacgga

SEQ ID NO: 10577 - RNA, 22 nt, Homo sapiens
aagcugggggagaggaggacca

SEQ ID NO: 10578 - RNA, 22 nt, Homo sapiens
ugucucucucccuucagcuucu

SEQ ID NO: 10579 - RNA, 22 nt, Homo sapiens
ggucagagguuuuucagguucu

SEQ ID NO: 10580 - RNA, 22 nt, Homo sapiens
aacaugcugggccuccgaucuc

SEQ ID NO: 10581 - RNA, 22 nt, Homo sapiens
uaaggcagauagagaauuaaau

SEQ ID NO: 10582 - RNA, 22 nt, Homo sapiens
uugauucucuaucuccccuauc

SEQ ID NO: 10583 - RNA, 22 nt, Homo sapiens
uucuuuuauuuugagucaaguu

SEQ ID NO: 10584 - RNA, 22 nt, Homo sapiens
uugaccacaaagaaaagaauua

SEQ ID NO: 10585 - RNA, 22 nt, Homo sapiens
uugacaauucaaaaacaaaugc

SEQ ID NO: 10586 - RNA, 21 nt, Homo sapiens
aaguuguuuuugaauguuaac

SEQ ID NO: 10587 - RNA, 22 nt, Homo sapiens
gcugugaacuucaaauuuggca

SEQ ID NO: 10588 - RNA, 22 nt, Homo sapiens
caauuuugaagaaaaaugguuu

SEQ ID NO: 10589 - RNA, 22 nt, Homo sapiens
gccuaguaauuuucgauaaagc

SEQ ID NO: 10590 - RNA, 22 nt, Homo sapiens
uugacugaaaauuaccaggcuu

SEQ ID NO: 10591 - RNA, 22 nt, Homo sapiens
caucuguucaaacauaaugcuc

SEQ ID NO: 10592 - RNA, 22 nt, Homo sapiens
gcaugauauuugacagauggag

SEQ ID NO: 10593 - RNA, 22 nt, Homo sapiens
uguggaaauggguuggauggag

SEQ ID NO: 10594 - RNA, 22 nt, Homo sapiens
cacacaucucuaauucaguucu

SEQ ID NO: 10595 - RNA, 22 nt, Homo sapiens
uuuuaaauaagcaucuuguggg

SEQ ID NO: 10596 - RNA, 22 nt, Homo sapiens
acagguugcuuauuaaaaaugc

SEQ ID NO: 10597 - RNA, 22 nt, Homo sapiens
ucccagcaggcaccgcuucugc

SEQ ID NO: 10598 - RNA, 21 nt, Homo sapiens
uggcggcggugccggcuggga

SEQ ID NO: 10599 - RNA, 22 nt, Homo sapiens
uagguuaaaugcuaaguauuuu

SEQ ID NO: 10600 - RNA, 22 nt, Homo sapiens
guacuuuggcauauggccuuua

SEQ ID NO: 10601 - RNA, 22 nt, Homo sapiens
uaaugccccuaaaaauccuuau

SEQ ID NO: 10602 - RNA, 22 nt, Homo sapiens
ugagggacuuucaggggcagcu

SEQ ID NO: 10603 - RNA, 22 nt, Homo sapiens
auaaugccccuaaaaauccuua

SEQ ID NO: 10604 - RNA, 20 nt, Homo sapiens
uaaugccccuaaaaauccuu

SEQ ID NO: 10605 - RNA, 19 nt, Homo sapiens
ugccccuaaaaauccuuau

SEQ ID NO: 10606 - RNA, 22 nt, Homo sapiens
agacaagcaaggggguugcuuu

SEQ ID NO: 10607 - RNA, 22 nt, Homo sapiens
acacaauccccuucacaauugu

SEQ ID NO: 10608 - RNA, 22 nt, Homo sapiens
uacagggaggcugcaguggagc

SEQ ID NO: 10609 - RNA, 22 nt, Homo sapiens
ucugcuuccagcucucuguaag

SEQ ID NO: 10610 - RNA, 22 nt, Homo sapiens
cagcugcauggugaaauggccu

SEQ ID NO: 10611 - RNA, 20 nt, Homo sapiens
ggugcuucaccaggugguug

SEQ ID NO: 10612 - RNA, 22 nt, Homo sapiens
ggaucccugcagggcagcuuag

SEQ ID NO: 10613 - RNA, 22 nt, Homo sapiens
ccgggguuggcgcaggggccuc

SEQ ID NO: 10614 - RNA, 22 nt, Homo sapiens
gcugcccacggcaggcaugugg

SEQ ID NO: 10615 - RNA, 19 nt, Homo sapiens
cgacccuugucggggcagc

SEQ ID NO: 10616 - RNA, 22 nt, Homo sapiens
uuugaaaauguggcagugggug

SEQ ID NO: 10617 - RNA, 22 nt, Homo sapiens
ucacacugcacauuucuagaua

SEQ ID NO: 10618 - RNA, 22 nt, Homo sapiens
ccggccaaucgcugcguuggga

SEQ ID NO: 10619 - RNA, 18 nt, Homo sapiens
cgggcagcgacuggcugg

SEQ ID NO: 10620 - RNA, 22 nt, Homo sapiens
uggcuuguugaauacuuggcug

SEQ ID NO: 10621 - RNA, 22 nt, Homo sapiens
auuaagugucaguuaaucccug

SEQ ID NO: 10622 - RNA, 22 nt, Homo sapiens
aaacugucauuggaugcauuug

SEQ ID NO: 10623 - RNA, 22 nt, Homo sapiens
auucaguucgaugugcaguucu

SEQ ID NO: 10624 - RNA, 22 nt, Homo sapiens
aggagaacaaggccauggucug

SEQ ID NO: 10625 - RNA, 22 nt, Homo sapiens
acccgugcgcuuugcuuuccuu

SEQ ID NO: 10626 - RNA, 22 nt, Homo sapiens
ggugagggagaggcugugggug

SEQ ID NO: 10627 - RNA, 22 nt, Homo sapiens
cccccauccaucuuuccaccuc

SEQ ID NO: 10628 - RNA, 22 nt, Homo sapiens
uauagaauuggaaaugcaagga

SEQ ID NO: 10629 - RNA, 20 nt, Homo sapiens
uugcaguucuggcuuuguaa

SEQ ID NO: 10630 - RNA, 22 nt, Homo sapiens
gggaugggcaagguagaacuca

SEQ ID NO: 10631 - RNA, 22 nt, Homo sapiens
ggcaucuaucugucugacucuu

SEQ ID NO: 10632 - RNA, 22 nt, Homo sapiens
ugguucauuaauacaguacaug

SEQ ID NO: 10633 - RNA, 22 nt, Homo sapiens
gggcccuauauuaauggaccaa

SEQ ID NO: 10634 - RNA, 22 nt, Homo sapiens
ugcugcuucaucuauccuguga

SEQ ID NO: 10635 - RNA, 22 nt, Homo sapiens
uuuugggaugaguggggagcaa

SEQ ID NO: 10636 - RNA, 22 nt, Homo sapiens
agaugcugcuuguucacgggca

SEQ ID NO: 10637 - RNA, 22 nt, Homo sapiens
cucugagcucgugcaguacuuc

SEQ ID NO: 10638 - RNA, 22 nt, Homo sapiens
acccacaauauaccuguguggg

SEQ ID NO: 10639 - RNA, 22 nt, Homo sapiens
uggauagguuauaucgugggug

SEQ ID NO: 10640 - RNA, 22 nt, Homo sapiens
uuuucacucagagcugugcuug

SEQ ID NO: 10641 - RNA, 22 nt, Homo sapiens
agugcagcucugaguuaaaaca

SEQ ID NO: 10642 - RNA, 22 nt, Homo sapiens
uccacggucccuucuggcccua

SEQ ID NO: 10643 - RNA, 22 nt, Homo sapiens
gggccaggccagacuggggagg

SEQ ID NO: 10644 - RNA, 22 nt, Homo sapiens
ggcagcagggaugggugggagc

SEQ ID NO: 10645 - RNA, 22 nt, Homo sapiens
cauccucccagcucugcuccca

SEQ ID NO: 10646 - RNA, 22 nt, Homo sapiens
accauacuuuuccugggaguac

SEQ ID NO: 10647 - RNA, 22 nt, Homo sapiens
gacuuuugggagaggguggaag

SEQ ID NO: 10648 - RNA, 22 nt, Homo sapiens
uaacuauacaaucuauugccuu

SEQ ID NO: 10649 - RNA, 22 nt, Homo sapiens
ugagguaguagauuguauaguu

SEQ ID NO: 10650 - RNA, 22 nt, Homo sapiens
ugugucaauaugcgaugaugug

SEQ ID NO: 10651 - RNA, 20 nt, Homo sapiens
cgucaucacguggugacgca

SEQ ID NO: 10652 - RNA, 22 nt, Homo sapiens
uagagagccugguguucacgcc

SEQ ID NO: 10653 - RNA, 22 nt, Homo sapiens
ggaaaugagagccaagcuccug

SEQ ID NO: 10654 - RNA, 22 nt, Homo sapiens
cauaaugacaauaaucauuaac

SEQ ID NO: 10655 - RNA, 22 nt, Homo sapiens
guuaaugaauuauuauagugca

SEQ ID NO: 10656 - RNA, 22 nt, Homo sapiens
gguaacaaagagcaagagaagu

SEQ ID NO: 10657 - RNA, 19 nt, Homo sapiens
cuucucucucucuguuacc

SEQ ID NO: 10658 - RNA, 22 nt, Homo sapiens
uuugaggaacagcuggggugga

SEQ ID NO: 10659 - RNA, 22 nt, Homo sapiens
gggccucagcauuuccacagau

SEQ ID NO: 10660 - RNA, 22 nt, Homo sapiens
ucuuuucugauuccagugggac

SEQ ID NO: 10661 - RNA, 22 nt, Homo sapiens
cacuaggagucucaaaaagacu

SEQ ID NO: 10662 - RNA, 22 nt, Homo sapiens
gggcagcuugugucccgcuggu

SEQ ID NO: 10663 - RNA, 22 nt, Homo sapiens
agugguggaaaggguagccucc

SEQ ID NO: 10664 - RNA, 22 nt, Homo sapiens
uugauuagguugauacuaauug

SEQ ID NO: 10665 - RNA, 22 nt, Homo sapiens
auuggauccaacugaccaaccu

SEQ ID NO: 10666 - RNA, 22 nt, Homo sapiens
ugaggauugucuuuuccacugc

SEQ ID NO: 10667 - RNA, 22 nt, Homo sapiens
uguggagaaggacuguucaugu

SEQ ID NO: 10668 - RNA, 22 nt, Homo sapiens
gacacuugucugagauuggaug

SEQ ID NO: 10669 - RNA, 22 nt, Homo sapiens
uucccaguuguuuccaaggucu

SEQ ID NO: 10670 - RNA, 22 nt, Homo sapiens
uucuucugugauauugggagug

SEQ ID NO: 10671 - RNA, 22 nt, Homo sapiens
cugucaguaucuauaguggaug

SEQ ID NO: 10672 - RNA, 22 nt, Homo sapiens
uucuucugugauauugggagug

SEQ ID NO: 10673 - RNA, 22 nt, Homo sapiens
cugucaguaucuauaguggaug

SEQ ID NO: 10674 - RNA, 22 nt, Homo sapiens
gagagagaucuuuucuguguuu

SEQ ID NO: 10675 - RNA, 21 nt, Homo sapiens
auacagaaggcagacucucuc

SEQ ID NO: 10676 - RNA, 22 nt, Homo sapiens
ugcucugagaacuccacaaugu

SEQ ID NO: 10677 - RNA, 22 nt, Homo sapiens
ugugggguucuguggaucaugu

SEQ ID NO: 10678 - RNA, 22 nt, Homo sapiens
agaaagaaggcaggacgguugu

SEQ ID NO: 10679 - RNA, 19 nt, Homo sapiens
cagccaccgcugucuuucu

SEQ ID NO: 10680 - RNA, 22 nt, Homo sapiens
aggcccugcuguagugcuuacu

SEQ ID NO: 10681 - RNA, 22 nt, Homo sapiens
uaaucacuagagcggggacuca

SEQ ID NO: 10682 - RNA, 22 nt, Homo sapiens
uggccuggaagcuaggauaggg

SEQ ID NO: 10683 - RNA, 22 nt, Homo sapiens
cugucuagcuguguggcccggc

SEQ ID NO: 10684 - RNA, 22 nt, Homo sapiens
ccaguccaagaugaggauauuu

SEQ ID NO: 10685 - RNA, 22 nt, Homo sapiens
aguuuccucaucuuuggacugc

SEQ ID NO: 10686 - RNA, 22 nt, Homo sapiens
cguagaaugaaaugcuuuuuca

SEQ ID NO: 10687 - RNA, 22 nt, Homo sapiens
aggagauguuucagagugcccg

SEQ ID NO: 10688 - RNA, 22 nt, Homo sapiens
uugguuuguuaguuaauggccc

SEQ ID NO: 10689 - RNA, 22 nt, Homo sapiens
gcgguuaagacucuaacaaacg

SEQ ID NO: 10690 - RNA, 22 nt, Homo sapiens
ugaggaagcuagaaaugaagaa

SEQ ID NO: 10691 - RNA, 22 nt, Homo sapiens
ucuuuaugucugaguuucuugg

SEQ ID NO: 10692 - RNA, 22 nt, Homo sapiens
uugcucaucuucucaccaggac

SEQ ID NO: 10693 - RNA, 21 nt, Homo sapiens
uccccugaugggaagagcaga

SEQ ID NO: 10694 - RNA, 22 nt, Homo sapiens
gagaggaggugccugcugcggg

SEQ ID NO: 10695 - RNA, 21 nt, Homo sapiens
cugcagggguagccccucuuc

SEQ ID NO: 10696 - RNA, 22 nt, Homo sapiens
ucccccauggcugacagaccac

SEQ ID NO: 10697 - RNA, 19 nt, Homo sapiens
ucuguuggcacagggggag

SEQ ID NO: 10698 - RNA, 22 nt, Homo sapiens
ucauguauucaguugucuuugg

SEQ ID NO: 10699 - RNA, 22 nt, Homo sapiens
aaagacaucugaauacaugaug

SEQ ID NO: 10700 - RNA, 22 nt, Homo sapiens
cauuuuucacagcaacagcucu

SEQ ID NO: 10701 - RNA, 22 nt, Homo sapiens
gcuguuuacaugaaaaaugcuc

SEQ ID NO: 10702 - RNA, 22 nt, Homo sapiens
uguuugccgucauugccuugau

SEQ ID NO: 10703 - RNA, 22 nt, Homo sapiens
gaggcaggaaggguaaggagaa

SEQ ID NO: 10704 - RNA, 22 nt, Homo sapiens
aggauggagggucacaccccga

SEQ ID NO: 10705 - RNA, 22 nt, Homo sapiens
ggguguucugcccuguguaccc

SEQ ID NO: 10706 - RNA, 22 nt, Homo sapiens
ucuuugaguagagcagggguac

SEQ ID NO: 10707 - RNA, 22 nt, Homo sapiens
uccuacugcuuggaucaggggg

SEQ ID NO: 10708 - RNA, 22 nt, Homo sapiens
gggggaugugggggugaguuuc

SEQ ID NO: 10709 - RNA, 22 nt, Homo sapiens
ggauuugucccuguacccccug

SEQ ID NO: 10710 - RNA, 22 nt, Homo sapiens
ugaacuaucaccuaauccugga

SEQ ID NO: 10711 - RNA, 22 nt, Homo sapiens
ugggguuaagugaggaguucag

SEQ ID NO: 10712 - RNA, 22 nt, Homo sapiens
uggggagggccuggggagcgcc

SEQ ID NO: 10713 - RNA, 22 nt, Homo sapiens
cgcuuccccagccaggccccgc

SEQ ID NO: 10714 - RNA, 22 nt, Homo sapiens
uucagugccagagugggaggau

SEQ ID NO: 10715 - RNA, 22 nt, Homo sapiens
ucucacccaccuuuggcaugau

SEQ ID NO: 10716 - RNA, 22 nt, Homo sapiens
cccuccagacuucucuucccag

SEQ ID NO: 10717 - RNA, 22 nt, Homo sapiens
ugggauagaaggccugcagggg

SEQ ID NO: 10718 - RNA, 22 nt, Homo sapiens
ugcccacaccaggcccuggcuu

SEQ ID NO: 10719 - RNA, 20 nt, Homo sapiens
gccugggccggcggugggua

SEQ ID NO: 10720 - RNA, 22 nt, Homo sapiens
uccuguaauagugauucuccac

SEQ ID NO: 10721 - RNA, 20 nt, Homo sapiens
gaaucacugugagaugggag

SEQ ID NO: 10722 - RNA, 22 nt, Homo sapiens
aagggccaggggcaggcuggaa

SEQ ID NO: 10723 - RNA, 22 nt, Homo sapiens
caguggcaccuuggcccucagc

SEQ ID NO: 10724 - RNA, 22 nt, Homo sapiens
ucuguuccccuuuuccugccac

SEQ ID NO: 10725 - RNA, 22 nt, Homo sapiens
caggaggagggacccagggccu

SEQ ID NO: 10726 - RNA, 22 nt, Homo sapiens
ggcagcuaauuugcaccuguuc

SEQ ID NO: 10727 - RNA, 21 nt, Homo sapiens
ggugugaaugagacagcugcc

SEQ ID NO: 10728 - RNA, 22 nt, Homo sapiens
ugauggaguuuuuaaaaccugc

SEQ ID NO: 10729 - RNA, 22 nt, Homo sapiens
uagaccuuaaaaaucugucaua

SEQ ID NO: 10730 - RNA, 22 nt, Homo sapiens
agaccuaucuauaaaagugaau

SEQ ID NO: 10731 - RNA, 22 nt, Homo sapiens
ucacuuuuauagacaggucugg

SEQ ID NO: 10732 - RNA, 22 nt, Homo sapiens
uuccuuucccugcuccaaaguu

SEQ ID NO: 10733 - RNA, 22 nt, Homo sapiens
uuacuaguagagaaaggaaaau

SEQ ID NO: 10734 - RNA, 22 nt, Homo sapiens
acuuuucaagcugguuuuugga

SEQ ID NO: 10735 - RNA, 20 nt, Homo sapiens
acagaagcuagcaggaaagu

SEQ ID NO: 10736 - RNA, 22 nt, Homo sapiens
uuuuccuuuacugaguaccaaa

SEQ ID NO: 10737 - RNA, 22 nt, Homo sapiens
uggacuuuaauaaaagggaaau

SEQ ID NO: 10738 - RNA, 22 nt, Homo sapiens
uuccaggagugacgcuaaggcu

SEQ ID NO: 10739 - RNA, 22 nt, Homo sapiens
cugcaaugucauucccagaagu

SEQ ID NO: 10740 - RNA, 22 nt, Homo sapiens
cccuaagauacaaaugucaaua

SEQ ID NO: 10741 - RNA, 22 nt, Homo sapiens
uugaauggaugugucagagggg

SEQ ID NO: 10742 - RNA, 22 nt, Homo sapiens
acuuugaagauuuugcucugcu

SEQ ID NO: 10743 - RNA, 22 nt, Homo sapiens
ucaggggaaauccucagaguca

SEQ ID NO: 10744 - RNA, 22 nt, Homo sapiens
aaggguaaagugaugugcuagu

SEQ ID NO: 10745 - RNA, 22 nt, Homo sapiens
uaauuugaaucuauuugcccuc

SEQ ID NO: 10746 - RNA, 22 nt, Homo sapiens
agcaguguuugccagaaccggg

SEQ ID NO: 10747 - RNA, 22 nt, Homo sapiens
uggcgcuggcaaaugcuggggu

SEQ ID NO: 10748 - RNA, 22 nt, Homo sapiens
uuaaugaccagcugggaggaac

SEQ ID NO: 10749 - RNA, 22 nt, Homo sapiens
ccucccagccagccauuaauuc

SEQ ID NO: 10750 - RNA, 22 nt, Homo sapiens
uggggcaauguucugcuuauaa

SEQ ID NO: 10751 - RNA, 20 nt, Homo sapiens
ucaaagcgugcaggccccau

SEQ ID NO: 10752 - RNA, 22 nt, Homo sapiens
uucauggaauguuaaauaaugc

SEQ ID NO: 10753 - RNA, 22 nt, Homo sapiens
auugcuugaaaccaggucauga

SEQ ID NO: 10754 - RNA, 22 nt, Homo sapiens
gaaaggaaaugagguuugucug

SEQ ID NO: 10755 - RNA, 22 nt, Homo sapiens
gcaagccucauuuccgucuuug

SEQ ID NO: 10756 - RNA, 22 nt, Homo sapiens
cgugucaaugaggaaccaguag

SEQ ID NO: 10757 - RNA, 22 nt, Homo sapiens
cugguuacaguuauuggcaucc

SEQ ID NO: 10758 - RNA, 22 nt, Homo sapiens
aggggaacaggcuuggugacga

SEQ ID NO: 10759 - RNA, 22 nt, Homo sapiens
ucacuccagccuggagccccuc

SEQ ID NO: 10760 - RNA, 22 nt, Homo sapiens
uaaucacccugagcagauuuug

SEQ ID NO: 10761 - RNA, 22 nt, Homo sapiens
aaccuguucagggauaauuaug

SEQ ID NO: 10762 - RNA, 22 nt, Homo sapiens
ugggaagaaagccuggugauac

SEQ ID NO: 10763 - RNA, 22 nt, Homo sapiens
uggucaccagaagcaucucucc

SEQ ID NO: 10764 - RNA, 22 nt, Homo sapiens
uugcuuuuucucuuuggggaca

SEQ ID NO: 10765 - RNA, 22 nt, Homo sapiens
ccccuugaugaacaaggcuaac

SEQ ID NO: 10766 - RNA, 22 nt, Homo sapiens
aggaauguuuuccagaccuaga

SEQ ID NO: 10767 - RNA, 22 nt, Homo sapiens
uagguuuggaagauagaguccu

SEQ ID NO: 10768 - RNA, 22 nt, Homo sapiens
uuagcauuacuauuuauaaaga

SEQ ID NO: 10769 - RNA, 22 nt, Homo sapiens
ucauaaauagauaaaauuaacu

SEQ ID NO: 10770 - RNA, 22 nt, Homo sapiens
uacaucaaaaugagacaagaaa

SEQ ID NO: 10771 - RNA, 22 nt, Homo sapiens
uauucuugucucaaggagaugu

SEQ ID NO: 10772 - RNA, 22 nt, Homo sapiens
ucucaagggagggugcaggccu

SEQ ID NO: 10773 - RNA, 22 nt, Homo sapiens
uugcuucccuccugugagaucu

SEQ ID NO: 10774 - RNA, 22 nt, Homo sapiens
gcacggcuugagauauugucag

SEQ ID NO: 10775 - RNA, 22 nt, Homo sapiens
ucguagaugauaccagguguga

SEQ ID NO: 10776 - RNA, 22 nt, Homo sapiens
uaguuaaugauaugcaugcuga

SEQ ID NO: 10777 - RNA, 22 nt, Homo sapiens
cauguauaucauuaacuagugc

SEQ ID NO: 10778 - RNA, 22 nt, Homo sapiens
cccucggagagcucacagcugu

SEQ ID NO: 10779 - RNA, 22 nt, Homo sapiens
cucagcugugaguucuuccuug

SEQ ID NO: 10780 - RNA, 22 nt, Homo sapiens
cccuaaccagauguucugauua

SEQ ID NO: 10781 - RNA, 22 nt, Homo sapiens
auuggaauauuaguacaggguu

SEQ ID NO: 10782 - RNA, 22 nt, Homo sapiens
uguucuuuuggaauuaggcuuc

SEQ ID NO: 10783 - RNA, 22 nt, Homo sapiens
ggucugugugaaaggauaggga

SEQ ID NO: 10784 - RNA, 22 nt, Homo sapiens
ucaucagacuggcucaguuucu

SEQ ID NO: 10785 - RNA, 22 nt, Homo sapiens
ugagaaagaggguuugaugguc

SEQ ID NO: 10786 - RNA, 22 nt, Homo sapiens
gggagaaaggaaggaacagggg

SEQ ID NO: 10787 - RNA, 22 nt, Homo sapiens
uuguucucaucuuucuucuuuu

SEQ ID NO: 10788 - RNA, 22 nt, Homo sapiens
uccuuccaccuguuuuaugcug

SEQ ID NO: 10789 - RNA, 22 nt, Homo sapiens
ugcgaggcaguguggagggcug

SEQ ID NO: 10790 - RNA, 22 nt, Homo sapiens
agcaggugagaggguauaaguu

SEQ ID NO: 10791 - RNA, 22 nt, Homo sapiens
cuuuauuaguucaucuguuuua

SEQ ID NO: 10792 - RNA, 22 nt, Homo sapiens
ucucaauaggcucuaacuguua

SEQ ID NO: 10793 - RNA, 21 nt, Homo sapiens
gcaguugggcugcggagaugu

SEQ ID NO: 10794 - RNA, 22 nt, Homo sapiens
aguuauauaagagauacugaau

SEQ ID NO: 10795 - RNA, 22 nt, Homo sapiens
uucucugucucuuauguacuua

SEQ ID NO: 10796 - RNA, 22 nt, Homo sapiens
uuuuugcaauaaugcuagcaga

SEQ ID NO: 10797 - RNA, 33 nt, Homo sapiens
aagcacugugcuaaaauugcagacacuaggacc

SEQ ID NO: 10798 - RNA, 29 nt, Homo sapiens
acugugcuaaaauugcagacacuaggacc

SEQ ID NO: 10799 - RNA, 31 nt, Homo sapiens
gcacugugcuaaaauugcagacacuaggacc

SEQ ID NO: 10800 - RNA, 22 nt, Homo sapiens
ggacaggcuccaggggcugggg

SEQ ID NO: 10801 - RNA, 22 nt, Homo sapiens
gggcacagccccugagucuccc

SEQ ID NO: 10802 - RNA, 22 nt, Homo sapiens
uuucuacccugcagcuaugucu

SEQ ID NO: 10803 - RNA, 21 nt, Homo sapiens
cagauuagucaggaagaaaga

SEQ ID NO: 10804 - RNA, 22 nt, Homo sapiens
uggauaugcaugcacaauuucc

SEQ ID NO: 10805 - RNA, 22 nt, Homo sapiens
gguuuuguuguguguauccaag

SEQ ID NO: 10806 - RNA, 22 nt, Homo sapiens
agaaccuuugcccuccuuuccu

SEQ ID NO: 10807 - RNA, 22 nt, Homo sapiens
ggcuggggagggaaagggauac

SEQ ID NO: 10808 - RNA, 22 nt, Homo sapiens
uggccagaccgggaagggggag

SEQ ID NO: 10809 - RNA, 22 nt, Homo sapiens
caagucccucccuccccauugg

SEQ ID NO: 10810 - RNA, 22 nt, Homo sapiens
acugacgaccacaaguuggaug

SEQ ID NO: 10811 - RNA, 21 nt, Homo sapiens
ugcauccuauuguccguuagu

SEQ ID NO: 10812 - RNA, 22 nt, Homo sapiens
ccccccaccaacuucugacugg

SEQ ID NO: 10813 - RNA, 21 nt, Homo sapiens
ccugcaugggagugggggggu

SEQ ID NO: 10814 - RNA, 22 nt, Homo sapiens
uuuucacagcagugugcugcuu

SEQ ID NO: 10815 - RNA, 22 nt, Homo sapiens
guaguugcugcucugaaagagg

SEQ ID NO: 10816 - RNA, 22 nt, Homo sapiens
uacccuguggcuggaagugguc

SEQ ID NO: 10817 - RNA, 22 nt, Homo sapiens
uacuuccaggccaagaagggua

SEQ ID NO: 10818 - RNA, 19 nt, Homo sapiens
gugcauuguaguugcauug

SEQ ID NO: 10819 - RNA, 22 nt, Homo sapiens
ugcaauguuuccacagugcauc

SEQ ID NO: 10820 - RNA, 22 nt, Homo sapiens
caaaucuagagacaguuuggag

SEQ ID NO: 10821 - RNA, 16 nt, Homo sapiens
agacugucuggguuug

SEQ ID NO: 10822 - RNA, 22 nt, Homo sapiens
ggcuuacuggaaaggccauucc

SEQ ID NO: 10823 - RNA, 22 nt, Homo sapiens
ugaagugcuugcuaguagguag

SEQ ID NO: 10824 - RNA, 22 nt, Homo sapiens
gcauagaucaaugcacugaagc

SEQ ID NO: 10825 - RNA, 22 nt, Homo sapiens
gcuuuuagcauugguagugcca

SEQ ID NO: 10826 - RNA, 22 nt, Homo sapiens
ggaaggcugggggcagggacgu

SEQ ID NO: 10827 - RNA, 22 nt, Homo sapiens
accccugggcucugggcucccu

SEQ ID NO: 10828 - RNA, 22 nt, Homo sapiens
uucuuugagucuacacuaugua

SEQ ID NO: 10829 - RNA, 22 nt, Homo sapiens
aggaugugcccucaaggaaugu

SEQ ID NO: 10830 - RNA, 22 nt, Homo sapiens
uucuuuuuuguggggaugcuuu

SEQ ID NO: 10831 - RNA, 22 nt, Homo sapiens
acucacauuccuagagaaaaga

SEQ ID NO: 10832 - RNA, 22 nt, Homo sapiens
uggggcagguggaagggugagc

SEQ ID NO: 10833 - RNA, 20 nt, Homo sapiens
cccuuuucaugcggccccau

SEQ ID NO: 10834 - RNA, 22 nt, Homo sapiens
uugguuuuuggucaccuuggaa

SEQ ID NO: 10835 - RNA, 22 nt, Homo sapiens
ucuugggaugauuugggaggaa

SEQ ID NO: 10836 - RNA, 22 nt, Homo sapiens
agcugaugguggugcugaccau

SEQ ID NO: 10837 - RNA, 22 nt, Homo sapiens
guuuggugucaccaucaacccu

SEQ ID NO: 10838 - RNA, 22 nt, Homo sapiens
ugguaugcuuuccaguaucuca

SEQ ID NO: 10839 - RNA, 22 nt, Homo sapiens
agacugggaggugugaccuaug

SEQ ID NO: 10840 - RNA, 22 nt, Homo sapiens
ugucuggcugcuuguuuugaug

SEQ ID NO: 10841 - RNA, 22 nt, Homo sapiens
uagaccgagcagcccaacugaa

SEQ ID NO: 10842 - RNA, 22 nt, Homo sapiens
gagggauugguggugguuguug

SEQ ID NO: 10843 - RNA, 22 nt, Homo sapiens
cuaacuaugacuauuaugccua

SEQ ID NO: 10844 - RNA, 22 nt, Homo sapiens
uaaugagugcuguggagagcug

SEQ ID NO: 10845 - RNA, 22 nt, Homo sapiens
uaauggcuuucugcggucauua

SEQ ID NO: 10846 - RNA, 22 nt, Homo sapiens
gacauugcuugaugauucauag

SEQ ID NO: 10847 - RNA, 22 nt, Homo sapiens
ugaguuaucuaaguacaguccu

SEQ ID NO: 10848 - RNA, 22 nt, Homo sapiens
accugcaauaggguccacaggg

SEQ ID NO: 10849 - RNA, 22 nt, Homo sapiens
ucuguaggccacccuuguaggu

SEQ ID NO: 10850 - RNA, 22 nt, Homo sapiens
agagauuaggcugggggcuuua

SEQ ID NO: 10851 - RNA, 22 nt, Homo sapiens
uccugaaucccugccuauuuug

SEQ ID NO: 10852 - RNA, 22 nt, Homo sapiens
ggacauggagucugcggccgcc

SEQ ID NO: 10853 - RNA, 22 nt, Homo sapiens
ugaggaugggcagcuccguccc

SEQ ID NO: 10854 - RNA, 22 nt, Homo sapiens
uucugagaagcugcaucugaau

SEQ ID NO: 10855 - RNA, 22 nt, Homo sapiens
cagaaguagcuggaagagagag

SEQ ID NO: 10856 - RNA, 22 nt, Homo sapiens
uggugggagagaagagaggaau

SEQ ID NO: 10857 - RNA, 22 nt, Homo sapiens
ugucucuuucuucccuucuccc

SEQ ID NO: 10858 - RNA, 22 nt, Homo sapiens
uacuuuggauguucauucuaaa

SEQ ID NO: 10859 - RNA, 22 nt, Homo sapiens
uggaauggauuucccuaagugg

SEQ ID NO: 10860 - RNA, 22 nt, Homo sapiens
auucccccuccucacuugcccc

SEQ ID NO: 10861 - RNA, 22 nt, Homo sapiens
gaaaguggugggggacacccca

SEQ ID NO: 10862 - RNA, 22 nt, Homo sapiens
uuuacaaagccagauaaaaucu

SEQ ID NO: 10863 - RNA, 22 nt, Homo sapiens
uaaagucuggcuuuguaaauuu

SEQ ID NO: 10864 - RNA, 22 nt, Homo sapiens
ugaguuuuagaugccuguuaga

SEQ ID NO: 10865 - RNA, 22 nt, Homo sapiens
ugaguggguguuuggauauaua

SEQ ID NO: 10866 - RNA, 22 nt, Homo sapiens
ucaaagauggaaaagaaaugag

SEQ ID NO: 10867 - RNA, 20 nt, Homo sapiens
uuuuuuccuuuuccuuugau

SEQ ID NO: 10868 - RNA, 22 nt, Homo sapiens
uagugaaauauugaggcagcaa

SEQ ID NO: 10869 - RNA, 20 nt, Homo sapiens
ugcugucucaacauuuacua

SEQ ID NO: 10870 - RNA, 22 nt, Homo sapiens
ggcagggauacaggugugugaa

SEQ ID NO: 10871 - RNA, 18 nt, Homo sapiens
acacccuggccccuuguc

SEQ ID NO: 10872 - RNA, 22 nt, Homo sapiens
ucggcuaacaugcaacugcugu

SEQ ID NO: 10873 - RNA, 22 nt, Homo sapiens
uggcaguguauuguuagcuggu

SEQ ID NO: 10874 - RNA, 22 nt, Homo sapiens
aaauccugcuaauugauacacu

SEQ ID NO: 10875 - RNA, 22 nt, Homo sapiens
auaaugucaguuggugguuuag

SEQ ID NO: 10876 - RNA, 22 nt, Homo sapiens
aacauucauugcugucgguggg

SEQ ID NO: 10877 - RNA, 22 nt, Homo sapiens
cucacugaacaaugaaugcaac

SEQ ID NO: 10878 - RNA, 23 nt, Homo sapiens
aacauucauugcugucggugggu

SEQ ID NO: 10879 - RNA, 22 nt, Homo sapiens
aaaauguaucuucgugucuuua

SEQ ID NO: 10880 - RNA, 22 nt, Homo sapiens
ugaagcauaaagauaaauuucu

SEQ ID NO: 10881 - RNA, 22 nt, Homo sapiens
gaggcagaauuguuacuuuuag

SEQ ID NO: 10882 - RNA, 22 nt, Homo sapiens
uuugugggggaucucugccugc

SEQ ID NO: 10883 - RNA, 22 nt, Homo sapiens
gggguccccggugcucggaucu

SEQ ID NO: 10884 - RNA, 22 nt, Homo sapiens
gguccgagccugggucucccuc

SEQ ID NO: 10885 - RNA, 22 nt, Homo sapiens
ugugagagguguacgcagaaau

SEQ ID NO: 10886 - RNA, 22 nt, Homo sapiens
uugugcaagugccucccacaca

SEQ ID NO: 10887 - RNA, 22 nt, Homo sapiens
uuguggggaggagggagaguua

SEQ ID NO: 10888 - RNA, 22 nt, Homo sapiens
uaaccucauuuuccucccuugu

SEQ ID NO: 10889 - RNA, 22 nt, Homo sapiens
gauugggaacugcuauuccgug

SEQ ID NO: 10890 - RNA, 22 nt, Homo sapiens
caggauagcgguucccagucug

SEQ ID NO: 10891 - RNA, 22 nt, Homo sapiens
cuugguuuuacaaguauggagg

SEQ ID NO: 10892 - RNA, 22 nt, Homo sapiens
cuauacuugugaaaucaaagau

SEQ ID NO: 10893 - RNA, 22 nt, Homo sapiens
gguugaugcaaaaguaagugug

SEQ ID NO: 10894 - RNA, 22 nt, Homo sapiens
gcauuacuagugcgccagccua

SEQ ID NO: 10895 - RNA, 22 nt, Homo sapiens
uaguuauuccacacccauuauc

SEQ ID NO: 10896 - RNA, 22 nt, Homo sapiens
uaaugguguggaauaacuauuu

SEQ ID NO: 10897 - RNA, 22 nt, Homo sapiens
uccucaccugaacuccauguug

SEQ ID NO: 10898 - RNA, 22 nt, Homo sapiens
cauggauucaaagugaggauua

SEQ ID NO: 10899 - RNA, 20 nt, Homo sapiens
aaagugcuuccuuuuagagg

SEQ ID NO: 10900 - RNA, 21 nt, Homo sapiens
aaagugcuuccuuuuagaggg

SEQ ID NO: 10901 - RNA, 22 nt, Homo sapiens
ucauaauuauuucucccugugg

SEQ ID NO: 10902 - RNA, 22 nt, Homo sapiens
cuuguacaugagcaauaauugu

SEQ ID NO: 10903 - RNA, 22 nt, Homo sapiens
ucagggauccuacuuaacuucu

SEQ ID NO: 10904 - RNA, 22 nt, Homo sapiens
gaaguuaaguagcaucccugau

SEQ ID NO: 10905 - RNA, 22 nt, Homo sapiens
ugaccccaccugcucucauuuc

SEQ ID NO: 10906 - RNA, 22 nt, Homo sapiens
aaauuagagcaguuggggucau

SEQ ID NO: 10907 - RNA, 22 nt, Homo sapiens
ccucgggugauggugggagggc

SEQ ID NO: 10908 - RNA, 22 nt, Homo sapiens
cugaugccugcgcuuuuacuua

SEQ ID NO: 10909 - RNA, 22 nt, Homo sapiens
caggucacgggcucuaccuugg

SEQ ID NO: 10910 - RNA, 22 nt, Homo sapiens
uaagguggaacacgugaccuag

SEQ ID NO: 10911 - RNA, 22 nt, Homo sapiens
uucggcccugacccuuggaggc

SEQ ID NO: 10912 - RNA, 22 nt, Homo sapiens
cccaaaguucagggaggccggg

SEQ ID NO: 10913 - RNA, 22 nt, Homo sapiens
uagguauauagugcaaaaacuu

SEQ ID NO: 10914 - RNA, 22 nt, Homo sapiens
gguuuuacacuauauaccuaga

SEQ ID NO: 10915 - RNA, 22 nt, Homo sapiens
ccacuuuaauagaugauacauu

SEQ ID NO: 10916 - RNA, 22 nt, Homo sapiens
ugugacucaucuauuagagugg

SEQ ID NO: 10917 - RNA, 22 nt, Homo sapiens
caggguuccucucuagcauuug

SEQ ID NO: 10918 - RNA, 22 nt, Homo sapiens
aaaugcuagggagaaacucucc

SEQ ID NO: 10919 - RNA, 22 nt, Homo sapiens
ucaaguggucauuucacucuuu

SEQ ID NO: 10920 - RNA, 22 nt, Homo sapiens
ugagacaugauuaacuugcaau

SEQ ID NO: 10921 - RNA, 22 nt, Homo sapiens
ugggugaugaggaagugaugac

SEQ ID NO: 10922 - RNA, 22 nt, Homo sapiens
gucacuucacagucacaccaca

SEQ ID NO: 10923 - RNA, 22 nt, Homo sapiens
uggagagagccaggggcuggag

SEQ ID NO: 10924 - RNA, 22 nt, Homo sapiens
ucuggucccagcucugcugcuc

SEQ ID NO: 10925 - RNA, 22 nt, Homo sapiens
ugugugugggaggcacuugcac

SEQ ID NO: 10926 - RNA, 22 nt, Homo sapiens
cguacaccucucacacacugcu

SEQ ID NO: 10927 - RNA, 22 nt, Homo sapiens
uauucaccaucaguagcagaaa

SEQ ID NO: 10928 - RNA, 22 nt, Homo sapiens
uuuguuacugaugguaaguaaa

SEQ ID NO: 10929 - RNA, 22 nt, Homo sapiens
cgggggcuggggcugcaggaug

SEQ ID NO: 10930 - RNA, 22 nt, Homo sapiens
ucccuuggccccacccucuuca

SEQ ID NO: 10931 - RNA, 22 nt, Homo sapiens
agggcacugacgggcggcuccc

SEQ ID NO: 10932 - RNA, 22 nt, Homo sapiens
guggguagcccucggucccugc

SEQ ID NO: 10933 - RNA, 22 nt, Homo sapiens
acuccaguaauuuuaaauugcu

SEQ ID NO: 10934 - RNA, 22 nt, Homo sapiens
gugauuuaaaaucauuggagug

SEQ ID NO: 10935 - RNA, 22 nt, Homo sapiens
uggucguaugugugacgccauu

SEQ ID NO: 10936 - RNA, 23 nt, Homo sapiens
agugacaucacauauacggcagc

SEQ ID NO: 10937 - RNA, 22 nt, Homo sapiens
cgcgccgcagguugcuuaggag

SEQ ID NO: 10938 - RNA, 22 nt, Homo sapiens
cugggcguuccugggcgccggg

SEQ ID NO: 10939 - RNA, 22 nt, Homo sapiens
ggcuuugugccccgggugcccc

SEQ ID NO: 10940 - RNA, 22 nt, Homo sapiens
gcaucuggcccacaaagcccgg

SEQ ID NO: 10941 - RNA, 22 nt, Homo sapiens
agaauuguggcuggacaucugu

SEQ ID NO: 10942 - RNA, 21 nt, Homo sapiens
ugauuguccaaacgcaauucu

SEQ ID NO: 10943 - RNA, 20 nt, Homo sapiens
agaauuguggcuggacaucu

SEQ ID NO: 10944 - RNA, 19 nt, Homo sapiens
auuguggcuggacaucugu

SEQ ID NO: 10945 - RNA, 21 nt, Homo sapiens
uaaagugcugacagugcagau

SEQ ID NO: 10946 - RNA, 22 nt, Homo sapiens
uaccgcacuguggguacuugcu

SEQ ID NO: 10947 - RNA, 22 nt, Homo sapiens
cauuccucgaggagccacuggu

SEQ ID NO: 10948 - RNA, 22 nt, Homo sapiens
uagaggccuuuuagugaguuga

SEQ ID NO: 10949 - RNA, 22 nt, Homo sapiens
ucaucauccuccgaggguuagg

SEQ ID NO: 10950 - RNA, 22 nt, Homo sapiens
uuuccucauagaaggauaugac

SEQ ID NO: 10951 - RNA, 22 nt, Homo sapiens
cagagcugggcuuggcuggucc

SEQ ID NO: 10952 - RNA, 22 nt, Homo sapiens
gaccagcacaggccccucucuc

SEQ ID NO: 10953 - RNA, 22 nt, Homo sapiens
caccggccgcuccaugugaaac

SEQ ID NO: 10954 - RNA, 19 nt, Homo sapiens
uacagcagagcagcuggug

SEQ ID NO: 10955 - RNA, 22 nt, Homo sapiens
gggagucccagaggggugacag

SEQ ID NO: 10956 - RNA, 22 nt, Homo sapiens
uguggcucacuccuggguuccc

SEQ ID NO: 10957 - RNA, 22 nt, Homo sapiens
agcgccucgacgacagagccgg

SEQ ID NO: 10958 - RNA, 21 nt, Homo sapiens
ucccuguccuccaggagcuca

SEQ ID NO: 10959 - RNA, 22 nt, Homo sapiens
gcuccagcuccauaaacauaag

SEQ ID NO: 10960 - RNA, 20 nt, Homo sapiens
uauucuucuggacuuggagu

SEQ ID NO: 10961 - RNA, 22 nt, Homo sapiens
ccucuagauguacuucuuggcu

SEQ ID NO: 10962 - RNA, 22 nt, Homo sapiens
gacgaagagguuugcaacuaag

SEQ ID NO: 10963 - RNA, 22 nt, Homo sapiens
gguuuuaccugaagagcguaaa

SEQ ID NO: 10964 - RNA, 21 nt, Homo sapiens
uacagcucggcagauaaagcc

SEQ ID NO: 10965 - RNA, 22 nt, Homo sapiens
cacaucugggaggugguaugag

SEQ ID NO: 10966 - RNA, 22 nt, Homo sapiens
ugcauccuaucuccuguguguu

SEQ ID NO: 10967 - RNA, 22 nt, Homo sapiens
cacaucugggaggugguaugag

SEQ ID NO: 10968 - RNA, 22 nt, Homo sapiens
ugcauccuaucuccuguguguu

SEQ ID NO: 10969 - RNA, 22 nt, Homo sapiens
ucuaucggcccccaucacuugu

SEQ ID NO: 10970 - RNA, 22 nt, Homo sapiens
aagugaugggggcugauagaca

SEQ ID NO: 10971 - RNA, 22 nt, Homo sapiens
cugccagcccuagaccugcugg

SEQ ID NO: 10972 - RNA, 22 nt, Homo sapiens
cccaggucuaaguaaguaugca

SEQ ID NO: 10973 - RNA, 22 nt, Homo sapiens
uccgccuucucuucccgguucu

SEQ ID NO: 10974 - RNA, 22 nt, Homo sapiens
agcuggguugagagggcgaaaa

SEQ ID NO: 10975 - RNA, 22 nt, Homo sapiens
uaaucagcccauaaaaucuauu

SEQ ID NO: 10976 - RNA, 22 nt, Homo sapiens
uuauaauuuaugagcugacuac

SEQ ID NO: 10977 - RNA, 22 nt, Homo sapiens
gggcuucuggucugccugcugu

SEQ ID NO: 10978 - RNA, 21 nt, Homo sapiens
agcaggagacacacaaguccc

SEQ ID NO: 10979 - RNA, 22 nt, Homo sapiens
gggcuucuggucugccugccgu

SEQ ID NO: 10980 - RNA, 22 nt, Homo sapiens
cagcaggagacacacaaguccc

SEQ ID NO: 10981 - RNA, 22 nt, Homo sapiens
gggcuucuggucugccugccgu

SEQ ID NO: 10982 - RNA, 22 nt, Homo sapiens
cagcaggagacacacaaguccc

SEQ ID NO: 10983 - RNA, 22 nt, Homo sapiens
uucuuacccuccuuaccagcag

SEQ ID NO: 10984 - RNA, 22 nt, Homo sapiens
uguggguuggggaaggaggaga

SEQ ID NO: 10985 - RNA, 22 nt, Homo sapiens
aacccagauuagguggcagaag

SEQ ID NO: 10986 - RNA, 22 nt, Homo sapiens
ucugcugcucaaacuggaguug

SEQ ID NO: 10987 - RNA, 22 nt, Homo sapiens
ggcugaggacccaagucaggcc

SEQ ID NO: 10988 - RNA, 22 nt, Homo sapiens
ccuggccugggguccacaccug

SEQ ID NO: 10989 - RNA, 22 nt, Homo sapiens
cugcuggccacuugagcccgcu

SEQ ID NO: 10990 - RNA, 22 nt, Homo sapiens
uggugagcuuuggccaacaggc

SEQ ID NO: 10991 - RNA, 22 nt, Homo sapiens
ggggaaugguggggcccucucu

SEQ ID NO: 10992 - RNA, 22 nt, Homo sapiens
acaggagggccugacuacuccc

SEQ ID NO: 10993 - RNA, 22 nt, Homo sapiens
ucucugucaugugagugguccc

SEQ ID NO: 10994 - RNA, 22 nt, Homo sapiens
auugcuggcagugacaggaagg

SEQ ID NO: 10995 - RNA, 22 nt, Homo sapiens
uaccuucuuucucuuucuccau

SEQ ID NO: 10996 - RNA, 22 nt, Homo sapiens
uggagggagagaaggcaaggau

SEQ ID NO: 10997 - RNA, 22 nt, Homo sapiens
uuauuaggauagggaaagaggg

SEQ ID NO: 10998 - RNA, 22 nt, Homo sapiens
uccuuccuuccuuccuggugcu

SEQ ID NO: 10999 - RNA, 23 nt, Homo sapiens
uaagugcuuccauguuugagugu

SEQ ID NO: 11000 - RNA, 22 nt, Homo sapiens
uacuuuaacauggaggcacuug

SEQ ID NO: 11001 - RNA, 22 nt, Homo sapiens
ggaauuaagaggaaggcugucu

SEQ ID NO: 11002 - RNA, 22 nt, Homo sapiens
caguucacuuuuucuuucucag

SEQ ID NO: 11003 - RNA, 22 nt, Homo sapiens
gaccuguccguggugcugcuug

SEQ ID NO: 11004 - RNA, 22 nt, Homo sapiens
aauuauccagcuucagggacag

SEQ ID NO: 11005 - RNA, 22 nt, Homo sapiens
uuccuagaggucuccaccucuc

SEQ ID NO: 11006 - RNA, 22 nt, Homo sapiens
aaaggugguuccucuguagaau

SEQ ID NO: 11007 - RNA, 22 nt, Homo sapiens
uggcauuccaggaucugugggu

SEQ ID NO: 11008 - RNA, 20 nt, Homo sapiens
auucauucuugacaauguca

SEQ ID NO: 11009 - RNA, 22 nt, Homo sapiens
ucuuucccagcccuguaccugg

SEQ ID NO: 11010 - RNA, 20 nt, Homo sapiens
ugcagguguugcagaaagau

SEQ ID NO: 11011 - RNA, 22 nt, Homo sapiens
cggagaggggcggggccaggcg

SEQ ID NO: 11012 - RNA, 22 nt, Homo sapiens
uagcucacgcccccucucccgg

SEQ ID NO: 11013 - RNA, 22 nt, Homo sapiens
agagaaauggccccagcugagg

SEQ ID NO: 11014 - RNA, 22 nt, Homo sapiens
ucacacugggcccacuuugcuc

SEQ ID NO: 11015 - RNA, 22 nt, Homo sapiens
cagaugugccuugcaucugagu

SEQ ID NO: 11016 - RNA, 22 nt, Homo sapiens
ucagaaagugcauaccucccuc

SEQ ID NO: 11017 - RNA, 22 nt, Homo sapiens
cgagggcacccagcugaccuug

SEQ ID NO: 11018 - RNA, 22 nt, Homo sapiens
aggguugggugcuuuuccuugg

SEQ ID NO: 11019 - RNA, 22 nt, Homo sapiens
ucagcucacugcacugcuccug

SEQ ID NO: 11020 - RNA, 22 nt, Homo sapiens
agugguacaggaggcugauuca

SEQ ID NO: 11021 - RNA, 22 nt, Homo sapiens
aauagugcaugccagacaucau

SEQ ID NO: 11022 - RNA, 22 nt, Homo sapiens
ugccagcugucugguacucacu

SEQ ID NO: 11023 - RNA, 22 nt, Homo sapiens
ucauccauuuguucaguguuuu

SEQ ID NO: 11024 - RNA, 22 nt, Homo sapiens
gcacugagaacaggaagaugaa

SEQ ID NO: 11025 - RNA, 22 nt, Homo sapiens
uacagggcaggguggggugaaa

SEQ ID NO: 11026 - RNA, 21 nt, Homo sapiens
ucaccccccgcccacccugug

SEQ ID NO: 11027 - RNA, 22 nt, Homo sapiens
agccacaugucacagugcccug

SEQ ID NO: 11028 - RNA, 22 nt, Homo sapiens
gaggccuguggaacacauggcu

SEQ ID NO: 11029 - RNA, 22 nt, Homo sapiens
agccacaugucacagugcccug

SEQ ID NO: 11030 - RNA, 22 nt, Homo sapiens
gaggccuguggaacacauggcu

SEQ ID NO: 11031 - RNA, 22 nt, Homo sapiens
agccacaugucacagugcccug

SEQ ID NO: 11032 - RNA, 22 nt, Homo sapiens
gaggccuguggaacacauggcu

SEQ ID NO: 11033 - RNA, 22 nt, Homo sapiens
aauaaaccauuuuaaaagcuuu

SEQ ID NO: 11034 - RNA, 22 nt, Homo sapiens
gaagcuuuuaaaaugcugugaa

SEQ ID NO: 11035 - RNA, 22 nt, Homo sapiens
ccaggagaggucucugugucuc

SEQ ID NO: 11036 - RNA, 22 nt, Homo sapiens
aggagacagaaccauccuggga

SEQ ID NO: 11037 - RNA, 22 nt, Homo sapiens
uaggaaguuuaggaaauuguuc

SEQ ID NO: 11038 - RNA, 22 nt, Homo sapiens
agcaguuucagacuuuccauau

SEQ ID NO: 11039 - RNA, 22 nt, Homo sapiens
uaggaaguuuaggaaauuguuc

SEQ ID NO: 11040 - RNA, 22 nt, Homo sapiens
agcaguuucagacuuuccauau

SEQ ID NO: 11041 - RNA, 22 nt, Homo sapiens
agcgggcaucauggggacagca

SEQ ID NO: 11042 - RNA, 22 nt, Homo sapiens
cugcacccaaggaguuggugac

SEQ ID NO: 11043 - RNA, 22 nt, Homo sapiens
gggaacuggcacagggcagggg

SEQ ID NO: 11044 - RNA, 22 nt, Homo sapiens
cagcccagagccaguucccgcu

SEQ ID NO: 11045 - RNA, 22 nt, Homo sapiens
uauuuuugauccagaccuccuu

SEQ ID NO: 11046 - RNA, 22 nt, Homo sapiens
gggggaaguuggggaggaauga

SEQ ID NO: 11047 - RNA, 22 nt, Homo sapiens
uaggucacgguauaguuugaag

SEQ ID NO: 11048 - RNA, 22 nt, Homo sapiens
uucaggcugucuggaucuacgc

SEQ ID NO: 11049 - RNA, 22 nt, Homo sapiens
agauauguuaauuucagugcuu

SEQ ID NO: 11050 - RNA, 22 nt, Homo sapiens
agcacugauauuaacauauuau

SEQ ID NO: 11051 - RNA, 22 nt, Homo sapiens
ucucucccaggucuuccuuucc

SEQ ID NO: 11052 - RNA, 22 nt, Homo sapiens
aaaggaagagacugagguggga

SEQ ID NO: 11053 - RNA, 22 nt, Homo sapiens
caguaaugcauacaaguuagug

SEQ ID NO: 11054 - RNA, 22 nt, Homo sapiens
uaauuaguuugcauuacuuuag

SEQ ID NO: 11055 - RNA, 22 nt, Homo sapiens
ugccacucugcuuccuuuaucc

SEQ ID NO: 11056 - RNA, 22 nt, Homo sapiens
ugaaggaggcagaccagggauu

SEQ ID NO: 11057 - RNA, 22 nt, Homo sapiens
cagagcucuuuaaauauugcug

SEQ ID NO: 11058 - RNA, 22 nt, Homo sapiens
gcaugauauuuaaagauuuuug

SEQ ID NO: 11059 - RNA, 22 nt, Homo sapiens
uuucugcuuaggaaaauaucug

SEQ ID NO: 11060 - RNA, 22 nt, Homo sapiens
agaggguccugagcaggaaugc

SEQ ID NO: 11061 - RNA, 22 nt, Homo sapiens
ugguggcagagcugggauuuga

SEQ ID NO: 11062 - RNA, 22 nt, Homo sapiens
acucccagcccuguuccugucc

SEQ ID NO: 11063 - RNA, 22 nt, Homo sapiens
ucucaagggcagucccucccag

SEQ ID NO: 11064 - RNA, 22 nt, Homo sapiens
uggagagggcugauagggagug

SEQ ID NO: 11065 - RNA, 22 nt, Homo sapiens
ucauuaauacuuugccuagcua

SEQ ID NO: 11066 - RNA, 22 nt, Homo sapiens
cuaaacaagauacuaaugaggu

SEQ ID NO: 11067 - RNA, 22 nt, Homo sapiens
cacuguguuugaugccaauaau

SEQ ID NO: 11068 - RNA, 22 nt, Homo sapiens
gagguuggcaucagacccucuu

SEQ ID NO: 11069 - RNA, 22 nt, Homo sapiens
uugcagacagugagagugaaag

SEQ ID NO: 11070 - RNA, 21 nt, Homo sapiens
uauugacucucaaauuugcag

SEQ ID NO: 11071 - RNA, 22 nt, Homo sapiens
ucuuggcuguccucugucccuu

SEQ ID NO: 11072 - RNA, 22 nt, Homo sapiens
augggcugagagguggccggug

SEQ ID NO: 11073 - RNA, 22 nt, Homo sapiens
uggaauuuccugucaaagcaac

SEQ ID NO: 11074 - RNA, 22 nt, Homo sapiens
gcucugcacuuugauuggacau

SEQ ID NO: 11075 - RNA, 22 nt, Homo sapiens
uccauaacccauguauggcuuu

SEQ ID NO: 11076 - RNA, 22 nt, Homo sapiens
aaccauacauggguucugcagg

SEQ ID NO: 11077 - RNA, 22 nt, Homo sapiens
cagcacugcuugcugucacugg

SEQ ID NO: 11078 - RNA, 22 nt, Homo sapiens
gacagauggcaggaagcagugg

SEQ ID NO: 11079 - RNA, 22 nt, Homo sapiens
uggcuggcucggaagggacugc

SEQ ID NO: 11080 - RNA, 22 nt, Homo sapiens
ugggacucuagggccagcccug

SEQ ID NO: 11081 - RNA, 22 nt, Homo sapiens
ucauuauuccuagugcuuacga

SEQ ID NO: 11082 - RNA, 22 nt, Homo sapiens
uaaguacuggaugaaugaauga

SEQ ID NO: 11083 - RNA, 22 nt, Homo sapiens
uguuaguccuagaagccacgga

SEQ ID NO: 11084 - RNA, 22 nt, Homo sapiens
auuggcuuucaggacuuaucua

SEQ ID NO: 11085 - RNA, 22 nt, Homo sapiens
ugucagcauaaggaguugagga

SEQ ID NO: 11086 - RNA, 18 nt, Homo sapiens
ucaaguucugacugauau

SEQ ID NO: 11087 - RNA, 22 nt, Homo sapiens
ucccaguaggcauuagcaccug

SEQ ID NO: 11088 - RNA, 22 nt, Homo sapiens
uagguguuaggcagugcugguu

SEQ ID NO: 11089 - RNA, 22 nt, Homo sapiens
uuugugccccgggugccccacc

SEQ ID NO: 11090 - RNA, 17 nt, Homo sapiens
gcaucuggcccacaaag

SEQ ID NO: 11091 - RNA, 22 nt, Homo sapiens
ggugcugccgucagaaggcaca

SEQ ID NO: 11092 - RNA, 19 nt, Homo sapiens
ugugcucuggcucagcacc

SEQ ID NO: 11093 - RNA, 22 nt, Homo sapiens
ucagaagaggaggcggcuugac

SEQ ID NO: 11094 - RNA, 22 nt, Homo sapiens
accaggcccuuuucuccuggga

SEQ ID NO: 11095 - RNA, 22 nt, Homo sapiens
ugugcuugagugcuggagcaug

SEQ ID NO: 11096 - RNA, 22 nt, Homo sapiens
aucuccaguacugaguacagug

SEQ ID NO: 11097 - RNA, 22 nt, Homo sapiens
acucaguuuuuggccucugcug

SEQ ID NO: 11098 - RNA, 22 nt, Homo sapiens
caagaguggcagcgggaacuga

SEQ ID NO: 11099 - RNA, 22 nt, Homo sapiens
uggccacagcuuguuugcaaag

SEQ ID NO: 11100 - RNA, 22 nt, Homo sapiens
uucaaacaaaacuguucccaua

SEQ ID NO: 11101 - RNA, 22 nt, Homo sapiens
ucaugucauugaaugaaaaucu

SEQ ID NO: 11102 - RNA, 22 nt, Homo sapiens
auuagcauuuaaugacaugcau

SEQ ID NO: 11103 - RNA, 22 nt, Homo sapiens
uuuccccaacaaauguugccaa

SEQ ID NO: 11104 - RNA, 21 nt, Homo sapiens
gugacauuuguagaggaaaac

SEQ ID NO: 11105 - RNA, 22 nt, Homo sapiens
acccaggcaauuuucuguugca

SEQ ID NO: 11106 - RNA, 22 nt, Homo sapiens
uaacagaaaauugacucugcaa

SEQ ID NO: 11107 - RNA, 22 nt, Homo sapiens
uucccagagggcuaggcgccgc

SEQ ID NO: 11108 - RNA, 22 nt, Homo sapiens
gcgcgcuuagacucuugggagu

SEQ ID NO: 11109 - RNA, 22 nt, Homo sapiens
ggagugggcagauuugggucca

SEQ ID NO: 11110 - RNA, 22 nt, Homo sapiens
gugacuugagccugucugcuuc

SEQ ID NO: 11111 - RNA, 22 nt, Homo sapiens
aggcgggcugugcagauguuau

SEQ ID NO: 11112 - RNA, 22 nt, Homo sapiens
cuugcgacaucuaagcccgcug

SEQ ID NO: 11113 - RNA, 22 nt, Homo sapiens
uaaaguccggaguggguguggc

SEQ ID NO: 11114 - RNA, 22 nt, Homo sapiens
ucuggcacaccuacucacuuug

SEQ ID NO: 11115 - RNA, 22 nt, Homo sapiens
agugggagggcgauggcgcccc

SEQ ID NO: 11116 - RNA, 22 nt, Homo sapiens
gagcgcgccucccccucaacuc

SEQ ID NO: 11117 - RNA, 22 nt, Homo sapiens
uucugugcagggaccuuugcug

SEQ ID NO: 11118 - RNA, 22 nt, Homo sapiens
agggaaggccagcaucugaaau

SEQ ID NO: 11119 - RNA, 22 nt, Homo sapiens
ucuuccagccaaaaccaucuca

SEQ ID NO: 11120 - RNA, 22 nt, Homo sapiens
agguuuuugcuggaagguaauu

SEQ ID NO: 11121 - RNA, 22 nt, Homo sapiens
agaagcugaagggagagagaca

SEQ ID NO: 11122 - RNA, 22 nt, Homo sapiens
uccuccucucccccagcuucuc

SEQ ID NO: 11123 - RNA, 22 nt, Homo sapiens
gcagcaggcgggcauucccaca

SEQ ID NO: 11124 - RNA, 22 nt, Homo sapiens
ugggaaugccaaccugcuuauu

SEQ ID NO: 11125 - RNA, 22 nt, Homo sapiens
uccacucugcuccguccgccca

SEQ ID NO: 11126 - RNA, 22 nt, Homo sapiens
gguggggugcagagaugggggu

SEQ ID NO: 11127 - RNA, 22 nt, Homo sapiens
uuuuccaagauguaacuacgga

SEQ ID NO: 11128 - RNA, 22 nt, Homo sapiens
ugauguaguuuuuggaggaaaa

SEQ ID NO: 11129 - RNA, 22 nt, Homo sapiens
uuagaggagcaccgagacuggg

SEQ ID NO: 11130 - RNA, 22 nt, Homo sapiens
ugagguuuuggugaaggcuccu

SEQ ID NO: 11131 - RNA, 22 nt, Homo sapiens
uaugacucccugugguauuuua

SEQ ID NO: 11132 - RNA, 22 nt, Homo sapiens
aaacaccacaggggcugauaac

SEQ ID NO: 11133 - RNA, 22 nt, Homo sapiens
uccucuguccucaagucugagc

SEQ ID NO: 11134 - RNA, 22 nt, Homo sapiens
gggcagggcugggggccgggac

SEQ ID NO: 11135 - RNA, 22 nt, Homo sapiens
ucucuccccaaauucugggcgg

SEQ ID NO: 11136 - RNA, 22 nt, Homo sapiens
ucauccaugauggggggguaca

SEQ ID NO: 11137 - RNA, 23 nt, Homo sapiens
aucuggagguaagaagcacuuuc

SEQ ID NO: 11138 - RNA, 24 nt, Homo sapiens
aucuggagguaagaagcacuuucu

SEQ ID NO: 11139 - RNA, 25 nt, Homo sapiens
aucuggagguaagaagcacuuucug

SEQ ID NO: 11140 - RNA, 23 nt, Homo sapiens
caucuggagguaagaagcacuuu

SEQ ID NO: 11141 - RNA, 18 nt, Homo sapiens
ugcuuccuuucagagggu

SEQ ID NO: 11142 - RNA, 22 nt, Homo sapiens
ucuaagacuccucacauuuucu

SEQ ID NO: 11143 - RNA, 19 nt, Homo sapiens
aagaagugaggcucuugga

SEQ ID NO: 11144 - RNA, 22 nt, Homo sapiens
uggggagaggaauugggaaggu

SEQ ID NO: 11145 - RNA, 22 nt, Homo sapiens
uuugccaggaguuucacuccaa

SEQ ID NO: 11146 - RNA, 22 nt, Homo sapiens
uaagccaggucaccucugaacu

SEQ ID NO: 11147 - RNA, 22 nt, Homo sapiens
ucaguguugccugcuuuauggg

SEQ ID NO: 11148 - RNA, 22 nt, Homo sapiens
cccugggcgcucagcaguucug

SEQ ID NO: 11149 - RNA, 22 nt, Homo sapiens
aggagcggggcagccugagggu

SEQ ID NO: 11150 - RNA, 22 nt, Homo sapiens
ccugcagcugcacuauagaugc

SEQ ID NO: 11151 - RNA, 21 nt, Homo sapiens
uuuauggaaaugcucugcagg

SEQ ID NO: 11152 - RNA, 22 nt, Homo sapiens
gcgcugucuuugagcccccgcc

SEQ ID NO: 11153 - RNA, 22 nt, Homo sapiens
cgccgggggucaaucugcagcg

SEQ ID NO: 11154 - RNA, 22 nt, Homo sapiens
uuuaguuugcccacagcaugag

SEQ ID NO: 11155 - RNA, 22 nt, Homo sapiens
gagcagcuguggcaauucaaau

SEQ ID NO: 11156 - RNA, 22 nt, Homo sapiens
cgggaccuagguccagcaaggc

SEQ ID NO: 11157 - RNA, 20 nt, Homo sapiens
gucgugcuggaucgucccgu

SEQ ID NO: 11158 - RNA, 22 nt, Homo sapiens
uaccugcucacacuguuacucc

SEQ ID NO: 11159 - RNA, 22 nt, Homo sapiens
guaacaguguaggcagguaaga

SEQ ID NO: 11160 - RNA, 22 nt, Homo sapiens
accuugccuggggcccccgugc

SEQ ID NO: 11161 - RNA, 22 nt, Homo sapiens
gaugguggcggccccagggagg

SEQ ID NO: 11162 - RNA, 22 nt, Homo sapiens
ucaucucuguuacagaggugcu

SEQ ID NO: 11163 - RNA, 22 nt, Homo sapiens
ucacuguaaugagggagaaggg

SEQ ID NO: 11164 - RNA, 22 nt, Homo sapiens
gggugugcucagagcagggggc

SEQ ID NO: 11165 - RNA, 22 nt, Homo sapiens
cuccucuguuuauaacacaccc

SEQ ID NO: 11166 - RNA, 22 nt, Homo sapiens
ucugcucuuccucucacugagc

SEQ ID NO: 11167 - RNA, 22 nt, Homo sapiens
ugaguggagguugagcagagga

SEQ ID NO: 11168 - RNA, 22 nt, Homo sapiens
uacaguacugugauaacugaag

SEQ ID NO: 11169 - RNA, 22 nt, Homo sapiens
ucaguuaucacagugcugaugc

SEQ ID NO: 11170 - RNA, 22 nt, Homo sapiens
agauggcguauagacuggcuca

SEQ ID NO: 11171 - RNA, 22 nt, Homo sapiens
agccaggcuccaugccaccucu

SEQ ID NO: 11172 - RNA, 22 nt, Homo sapiens
uuuuuugcuccugucuccagac

SEQ ID NO: 11173 - RNA, 22 nt, Homo sapiens
gaggcaggagcauuucagaugg

SEQ ID NO: 11174 - RNA, 22 nt, Homo sapiens
ugagccuuagccagcagaggac

SEQ ID NO: 11175 - RNA, 22 nt, Homo sapiens
cuuaggcuguugagcucagcuc

SEQ ID NO: 11176 - RNA, 22 nt, Homo sapiens
cuuccacacugggggcggagcc

SEQ ID NO: 11177 - RNA, 22 nt, Homo sapiens
cucugcguccuguggcugagug

SEQ ID NO: 11178 - RNA, 22 nt, Homo sapiens
uuugcuguagagauucucaguu

SEQ ID NO: 11179 - RNA, 22 nt, Homo sapiens
cuggggauccagcugcacaauu

SEQ ID NO: 11180 - RNA, 22 nt, Homo sapiens
uuccaugaccugccucugaacc

SEQ ID NO: 11181 - RNA, 22 nt, Homo sapiens
ucagagccagggaaugggguga

SEQ ID NO: 11182 - RNA, 22 nt, Homo sapiens
uguagguucugggucccuccga

SEQ ID NO: 11183 - RNA, 22 nt, Homo sapiens
cagaaggaccuaguaaacccac

SEQ ID NO: 11184 - RNA, 22 nt, Homo sapiens
uaaauagcaauguuuccugagc

SEQ ID NO: 11185 - RNA, 22 nt, Homo sapiens
ucagcaaacauuacuauuuaau

SEQ ID NO: 11186 - RNA, 22 nt, Homo sapiens
ccaaggaugauucuaaaggagg

SEQ ID NO: 11187 - RNA, 22 nt, Homo sapiens
ucuuucagaaucauccuugagg

SEQ ID NO: 11188 - RNA, 22 nt, Homo sapiens
ggugccagauagagcuguaggu

SEQ ID NO: 11189 - RNA, 22 nt, Homo sapiens
uauagcugugucacuguggcau

SEQ ID NO: 11190 - RNA, 22 nt, Homo sapiens
uguaugugaaaaugucaagugc

SEQ ID NO: 11191 - RNA, 21 nt, Homo sapiens
cuugccauuuucaagugcagu

SEQ ID NO: 11192 - RNA, 22 nt, Homo sapiens
ccccaaagccuaugcuuuucuc

SEQ ID NO: 11193 - RNA, 22 nt, Homo sapiens
aagaguuuagacuuuuggggca

SEQ ID NO: 11194 - RNA, 22 nt, Homo sapiens
ugcagagcuaggcugagugaau

SEQ ID NO: 11195 - RNA, 17 nt, Homo sapiens
ugggcuuggguuuguag

SEQ ID NO: 11196 - RNA, 22 nt, Homo sapiens
uugucauuucgggcauggaguc

SEQ ID NO: 11197 - RNA, 22 nt, Homo sapiens
cuugucuccauggaaaugaaaa

SEQ ID NO: 11198 - RNA, 22 nt, Homo sapiens
uguuggccacugguccuguuau

SEQ ID NO: 11199 - RNA, 21 nt, Homo sapiens
guaagugccaguggcagcagg

SEQ ID NO: 11200 - RNA, 22 nt, Homo sapiens
aauauggguuuacuaguuggug

SEQ ID NO: 11201 - RNA, 22 nt, Homo sapiens
ccaacuauuaggccuuuauguc

SEQ ID NO: 11202 - RNA, 22 nt, Homo sapiens
uucgggugcuguuugccugugu

SEQ ID NO: 11203 - RNA, 17 nt, Homo sapiens
uaggagcagaacccgaa

SEQ ID NO: 11204 - RNA, 22 nt, Homo sapiens
uggucuguugucuacccucccg

SEQ ID NO: 11205 - RNA, 15 nt, Homo sapiens
ggagacagagaccag

SEQ ID NO: 11206 - RNA, 22 nt, Homo sapiens
ucaguuccaccaguacccagac

SEQ ID NO: 11207 - RNA, 22 nt, Homo sapiens
ggagcuggggcagcugugggaa

SEQ ID NO: 11208 - RNA, 22 nt, Homo sapiens
gagugggagcaagggugauuug

SEQ ID NO: 11209 - RNA, 22 nt, Homo sapiens
gaagacaaacuucuccuaaucc

SEQ ID NO: 11210 - RNA, 22 nt, Homo sapiens
uucucaagagggaggcaaucau

SEQ ID NO: 11211 - RNA, 22 nt, Homo sapiens
auugacaccucugugaguggag

SEQ ID NO: 11212 - RNA, 22 nt, Homo sapiens
uggaaggcugagguucaaaggc

SEQ ID NO: 11213 - RNA, 20 nt, Homo sapiens
cgccggcccuuagcuuccac

SEQ ID NO: 11214 - RNA, 22 nt, Homo sapiens
ugaaaauuuagcaagggcaaau

SEQ ID NO: 11215 - RNA, 22 nt, Homo sapiens
uaucuugcuaaauauuuuggcu

SEQ ID NO: 11216 - RNA, 22 nt, Homo sapiens
ggugcucuuauucgccacauuu

SEQ ID NO: 11217 - RNA, 22 nt, Homo sapiens
guguggggagguuaagggacuu

SEQ ID NO: 11218 - RNA, 22 nt, Homo sapiens
uugaccuccugaauguuuucau

SEQ ID NO: 11219 - RNA, 22 nt, Homo sapiens
aaacagaaggguagguaaacau

SEQ ID NO: 11220 - RNA, 22 nt, Homo sapiens
gcuguccuagagacaucagaug

SEQ ID NO: 11221 - RNA, 22 nt, Homo sapiens
uuucauguuucuauuggaugga

SEQ ID NO: 11222 - RNA, 22 nt, Homo sapiens
uccuaacugcccuaugcugcau

SEQ ID NO: 11223 - RNA, 22 nt, Homo sapiens
ugcagcacaggggcaguuagaa

SEQ ID NO: 11224 - RNA, 22 nt, Homo sapiens
ggauccuuacgguguaaugggg

SEQ ID NO: 11225 - RNA, 22 nt, Homo sapiens
cuaugcgcuaauacgggucccc

SEQ ID NO: 11226 - RNA, 22 nt, Homo sapiens
uccugcccuggaugguccagag

SEQ ID NO: 11227 - RNA, 22 nt, Homo sapiens
cacuggauuauuugggguccac

SEQ ID NO: 11228 - RNA, 22 nt, Homo sapiens
aggggcuggguagcucugaagg

SEQ ID NO: 11229 - RNA, 22 nt, Homo sapiens
cagcaagucaccucacagcccu

SEQ ID NO: 11230 - RNA, 22 nt, Homo sapiens
gggcugaugagcagauaguggg

SEQ ID NO: 11231 - RNA, 21 nt, Homo sapiens
ucccacccugccauggcccuu

SEQ ID NO: 11232 - RNA, 22 nt, Homo sapiens
caggcucuaaacuaaauggcug

SEQ ID NO: 11233 - RNA, 22 nt, Homo sapiens
guuacuuaguucagagccugua

SEQ ID NO: 11234 - RNA, 22 nt, Homo sapiens
caacaugccugcuggucaggcc

SEQ ID NO: 11235 - RNA, 22 nt, Homo sapiens
ugggccugagcacgggugcugg

SEQ ID NO: 11236 - RNA, 22 nt, Homo sapiens
gaggccaugagagauccugggg

SEQ ID NO: 11237 - RNA, 22 nt, Homo sapiens
ccugagauaugcugauggccug

SEQ ID NO: 11238 - RNA, 22 nt, Homo sapiens
ugggggcagagaggaggaauuu

SEQ ID NO: 11239 - RNA, 22 nt, Homo sapiens
aauucccuuucugccugggccc

SEQ ID NO: 11240 - RNA, 22 nt, Homo sapiens
uggcagauguguugugugggag

SEQ ID NO: 11241 - RNA, 22 nt, Homo sapiens
ucugacaagcacaugugcaaau

SEQ ID NO: 11242 - RNA, 22 nt, Homo sapiens
aggagugccugccccaugguuu

SEQ ID NO: 11243 - RNA, 22 nt, Homo sapiens
agcccggggguggggcucuggg

SEQ ID NO: 11244 - RNA, 22 nt, Homo sapiens
ugagcauaugugcugcaaccac

SEQ ID NO: 11245 - RNA, 22 nt, Homo sapiens
uggugugugcgcaggugcagau

SEQ ID NO: 11246 - RNA, 22 nt, Homo sapiens
uggguauauuuacuggugaguu

SEQ ID NO: 11247 - RNA, 22 nt, Homo sapiens
accucugccaggagauauuucc

SEQ ID NO: 11248 - RNA, 22 nt, Homo sapiens
ggugucugacuuggccauucag

SEQ ID NO: 11249 - RNA, 18 nt, Homo sapiens
aaugguacaguggacacc

SEQ ID NO: 11250 - RNA, 22 nt, Homo sapiens
uggcccuucucuuccugggagc

SEQ ID NO: 11251 - RNA, 22 nt, Homo sapiens
ugccagaagaggagggguuagc

SEQ ID NO: 11252 - RNA, 22 nt, Homo sapiens
gcugccccucacucugcccucc

SEQ ID NO: 11253 - RNA, 22 nt, Homo sapiens
gugggcacagugggcuggaggc

SEQ ID NO: 11254 - RNA, 22 nt, Homo sapiens
uucauuguugucgguggguugu

SEQ ID NO: 11255 - RNA, 17 nt, Homo sapiens
cccaccgggggaugaau

SEQ ID NO: 11256 - RNA, 22 nt, Homo sapiens
agagccugcggcuggcguuuga

SEQ ID NO: 11257 - RNA, 22 nt, Homo sapiens
ugagcgcggcggcugggucucg

SEQ ID NO: 11258 - RNA, 22 nt, Homo sapiens
uggaaaggucagagauuggaau

SEQ ID NO: 11259 - RNA, 22 nt, Homo sapiens
ugcuaaauuuuagcuuuucugu

SEQ ID NO: 11260 - RNA, 22 nt, Homo sapiens
uggcugaugacagaacaaugug

SEQ ID NO: 11261 - RNA, 22 nt, Homo sapiens
cuuuguucugggcauugugcua

SEQ ID NO: 11262 - RNA, 22 nt, Homo sapiens
gcacccgcauguccugguccuu

SEQ ID NO: 11263 - RNA, 22 nt, Homo sapiens
gcggccaggacagagguggagg

SEQ ID NO: 11264 - RNA, 22 nt, Homo sapiens
gcacccgcauguccugguccuu

SEQ ID NO: 11265 - RNA, 22 nt, Homo sapiens
gcggccaggacagagguggagg

SEQ ID NO: 11266 - RNA, 22 nt, Homo sapiens
gggcccggggccuugcacaacu

SEQ ID NO: 11267 - RNA, 22 nt, Homo sapiens
uuugcaaggcccgcgccgagcg

SEQ ID NO: 11268 - RNA, 22 nt, Homo sapiens
ggcagauuguaggcuaagacau

SEQ ID NO: 11269 - RNA, 22 nt, Homo sapiens
uguuucauugcuaugaucucuu

SEQ ID NO: 11270 - RNA, 22 nt, Homo sapiens
accggcuaccccgcccccacac

SEQ ID NO: 11271 - RNA, 22 nt, Homo sapiens
ugugaagggcgggagacuggga

SEQ ID NO: 11272 - RNA, 22 nt, Homo sapiens
uccuguugcaucugucauauau

SEQ ID NO: 11273 - RNA, 22 nt, Homo sapiens
uuuggugauagauuaaaaaggg

SEQ ID NO: 11274 - RNA, 22 nt, Homo sapiens
uuuucuggaaggggagacagag

SEQ ID NO: 11275 - RNA, 21 nt, Homo sapiens
uagcuuucucuccucaggaaa

SEQ ID NO: 11276 - RNA, 22 nt, Homo sapiens
gggaggagguucagaggcaaua

SEQ ID NO: 11277 - RNA, 22 nt, Homo sapiens
ucuugguuuugaugacucccuc

SEQ ID NO: 11278 - RNA, 22 nt, Homo sapiens
uuugggagacuuugacgaaaga

SEQ ID NO: 11279 - RNA, 22 nt, Homo sapiens
uuccaagucaaagaaucccaaa

SEQ ID NO: 11280 - RNA, 22 nt, Homo sapiens
uuagggugcuuagcuguuaacu

SEQ ID NO: 11281 - RNA, 22 nt, Homo sapiens
uaguaagggcuuagcuuaauua

SEQ ID NO: 11282 - RNA, 22 nt, Homo sapiens
ucaggaagcucuccugaaugcc

SEQ ID NO: 11283 - RNA, 22 nt, Homo sapiens
gagauuuaggagaaguucucug

SEQ ID NO: 11284 - RNA, 22 nt, Homo sapiens
accuuugagccucugcucucuc

SEQ ID NO: 11285 - RNA, 22 nt, Homo sapiens
agaggguuggaggauguaggag

SEQ ID NO: 11286 - RNA, 22 nt, Homo sapiens
ccaggucacgucucugcaguua

SEQ ID NO: 11287 - RNA, 21 nt, Homo sapiens
gccugcugggguggaaccugg

SEQ ID NO: 11288 - RNA, 22 nt, Homo sapiens
ucccuaccaucuuuaguucucu

SEQ ID NO: 11289 - RNA, 22 nt, Homo sapiens
aggggugaggagagguggcaag

SEQ ID NO: 11290 - RNA, 22 nt, Homo sapiens
uccagaaauguuuuacucuaac

SEQ ID NO: 11291 - RNA, 22 nt, Homo sapiens
agugguagagcauuugggaggg

SEQ ID NO: 11292 - RNA, 22 nt, Homo sapiens
agacuggaaaaucucugcaggc

SEQ ID NO: 11293 - RNA, 21 nt, Homo sapiens
ccguagagauucuacagucug

SEQ ID NO: 11294 - RNA, 22 nt, Homo sapiens
ugaguugaaacauuggucacac

SEQ ID NO: 11295 - RNA, 20 nt, Homo sapiens
ugugaaucaguguaacucau

SEQ ID NO: 11296 - RNA, 22 nt, Homo sapiens
uaggggacaccauacucauguu

SEQ ID NO: 11297 - RNA, 22 nt, Homo sapiens
ugaacauguguguggcccugga

SEQ ID NO: 11298 - RNA, 22 nt, Homo sapiens
uggcacuagggucagcaguucu

SEQ ID NO: 11299 - RNA, 22 nt, Homo sapiens
agacuaugacccaggugaugug

SEQ ID NO: 11300 - RNA, 22 nt, Homo sapiens
acugauugaugaacuucagcuu

SEQ ID NO: 11301 - RNA, 19 nt, Homo sapiens
cugagguuuccaaauuagu

SEQ ID NO: 11302 - RNA, 22 nt, Homo sapiens
ugggagugaucaacauauacug

SEQ ID NO: 11303 - RNA, 18 nt, Homo sapiens
uguauguugugacuucua

SEQ ID NO: 11304 - RNA, 22 nt, Homo sapiens
aggaaggcaaaggagaggacag

SEQ ID NO: 11305 - RNA, 22 nt, Homo sapiens
uuguuggcuccauguuuucuuu

SEQ ID NO: 11306 - RNA, 22 nt, Homo sapiens
gccugcggugggccaggugcuc

SEQ ID NO: 11307 - RNA, 22 nt, Homo sapiens
cgauguggcccaccugaggucc

SEQ ID NO: 11308 - RNA, 22 nt, Homo sapiens
gcagaucguuuaacuucucucu

SEQ ID NO: 11309 - RNA, 22 nt, Homo sapiens
agacaggauuauaugaucucca

SEQ ID NO: 11310 - RNA, 22 nt, Homo sapiens
uauugcugcugucucagcuguu

SEQ ID NO: 11311 - RNA, 19 nt, Homo sapiens
gcagcuaggcaaggcaaua

SEQ ID NO: 11312 - RNA, 22 nt, Homo sapiens
gaccaugcacugauucagacaa

SEQ ID NO: 11313 - RNA, 20 nt, Homo sapiens
ucuguuucgguauguggucu

SEQ ID NO: 11314 - RNA, 22 nt, Homo sapiens
gggcacugggugccugggcucu

SEQ ID NO: 11315 - RNA, 22 nt, Homo sapiens
agccuuggucucccgggcccuc

SEQ ID NO: 11316 - RNA, 22 nt, Homo sapiens
agagagagaggaaaguguuguu

SEQ ID NO: 11317 - RNA, 22 nt, Homo sapiens
cagcuucuuuuccucucuuuca

SEQ ID NO: 11318 - RNA, 22 nt, Homo sapiens
auuucaguggagugaaguucag

SEQ ID NO: 11319 - RNA, 22 nt, Homo sapiens
uccuucauuccaccggagucug

SEQ ID NO: 11320 - RNA, 18 nt, Homo sapiens
cauuccaccggagucugu

SEQ ID NO: 11321 - RNA, 21 nt, Homo sapiens
uccuucauuccaccggagucu

SEQ ID NO: 11322 - RNA, 22 nt, Homo sapiens
gggggugggucaugggcucuaa

SEQ ID NO: 11323 - RNA, 16 nt, Homo sapiens
gcuuaugaacaccccc

SEQ ID NO: 11324 - RNA, 22 nt, Homo sapiens
uggcagagggcagggccaggau

SEQ ID NO: 11325 - RNA, 22 nt, Homo sapiens
uccugcugcccgcccucugggg

SEQ ID NO: 11326 - RNA, 22 nt, Homo sapiens
uggcccaagaauagcuggccag

SEQ ID NO: 11327 - RNA, 22 nt, Homo sapiens
gcuggccacucuugggaaagcu

SEQ ID NO: 11328 - RNA, 22 nt, Homo sapiens
ucgggaagccagaggccccaug

SEQ ID NO: 11329 - RNA, 22 nt, Homo sapiens
uugggggucugugacuuugggg

SEQ ID NO: 11330 - RNA, 22 nt, Homo sapiens
uggggaggguugggggaggcug

SEQ ID NO: 11331 - RNA, 21 nt, Homo sapiens
uuucuuccgccaaauucccca

SEQ ID NO: 11332 - RNA, 22 nt, Homo sapiens
uucacauuucucugacguuuga

SEQ ID NO: 11333 - RNA, 22 nt, Homo sapiens
gacuaggagaggugagaaagug

SEQ ID NO: 11334 - RNA, 22 nt, Homo sapiens
gcaaucaugugcagugccaaua

SEQ ID NO: 11335 - RNA, 22 nt, Homo sapiens
uuuggcacuagcacauuuuugc

SEQ ID NO: 11336 - RNA, 23 nt, Homo sapiens
uuuggcacuagcacauuuuugcu

SEQ ID NO: 11337 - RNA, 22 nt, Homo sapiens
agaguggggaggcaggggaagu

SEQ ID NO: 11338 - RNA, 22 nt, Homo sapiens
cuucccucugcuccuuggucca

SEQ ID NO: 11339 - RNA, 22 nt, Homo sapiens
uguuuggaaugcaugcugucuc

SEQ ID NO: 11340 - RNA, 21 nt, Homo sapiens
gggagcaugcagagaggcggc

SEQ ID NO: 11341 - RNA, 22 nt, Homo sapiens
cagauguacagaaaugcuacac

SEQ ID NO: 11342 - RNA, 22 nt, Homo sapiens
uauggcauuuccuugugcaucu

SEQ ID NO: 11343 - RNA, 22 nt, Homo sapiens
ggacuggcagcagaggacagaa

SEQ ID NO: 11344 - RNA, 22 nt, Homo sapiens
aaacugugccucugcaguccua

SEQ ID NO: 11345 - RNA, 22 nt, Homo sapiens
uaggagcugguguguugcugua

SEQ ID NO: 11346 - RNA, 22 nt, Homo sapiens
gagucaguauucuagcucuugc

SEQ ID NO: 11347 - RNA, 22 nt, Homo sapiens
uguggggguggugugggggagg

SEQ ID NO: 11348 - RNA, 22 nt, Homo sapiens
ucuucccauaccgguacacagg

SEQ ID NO: 11349 - RNA, 22 nt, Homo sapiens
agagucaauuuucuguuacaua

SEQ ID NO: 11350 - RNA, 22 nt, Homo sapiens
ugcaacagaaaauugccugggu

SEQ ID NO: 11351 - RNA, 22 nt, Homo sapiens
uccuguugccaucugcaucucu

SEQ ID NO: 11352 - RNA, 22 nt, Homo sapiens
uagggaucaguggcauggggac

SEQ ID NO: 11353 - RNA, 22 nt, Homo sapiens
ugcaggagggagggagcaguga

SEQ ID NO: 11354 - RNA, 22 nt, Homo sapiens
ucagaccugucuccucuugcca

SEQ ID NO: 11355 - RNA, 22 nt, Homo sapiens
gcgaaucauuauuugcugcucu

SEQ ID NO: 11356 - RNA, 22 nt, Homo sapiens
uagcagcacaucaugguuuaca

SEQ ID NO: 11357 - RNA, 19 nt, Homo sapiens
cgaaucauuauuugcugcu

SEQ ID NO: 11358 - RNA, 20 nt, Homo sapiens
cgaaucauuauuugcugcuc

SEQ ID NO: 11359 - RNA, 21 nt, Homo sapiens
cgaaucauuauuugcugcucu

SEQ ID NO: 11360 - RNA, 22 nt, Homo sapiens
agggagguaauggaaucaucug

SEQ ID NO: 11361 - RNA, 22 nt, Homo sapiens
gauggugacaucuauuuccgcu

SEQ ID NO: 11362 - RNA, 22 nt, Homo sapiens
uggacggagaacugauaagggu

SEQ ID NO: 11363 - RNA, 22 nt, Homo sapiens
uuaucacuuuuccagcccagcu

SEQ ID NO: 11364 - RNA, 22 nt, Homo sapiens
uccugcuggucaaucacagccc

SEQ ID NO: 11365 - RNA, 22 nt, Homo sapiens
gcuaugguugaccagcaggauu

SEQ ID NO: 11366 - RNA, 22 nt, Homo sapiens
uccacugugccuuucucaguag

SEQ ID NO: 11367 - RNA, 21 nt, Homo sapiens
uggugaggaggaaaaguggac

SEQ ID NO: 11368 - RNA, 22 nt, Homo sapiens
gggcugggagaucacucuggug

SEQ ID NO: 11369 - RNA, 22 nt, Homo sapiens
ccagugugauuuucuggccagu

SEQ ID NO: 11370 - RNA, 20 nt, Homo sapiens
ccucugggcccuuccuccag

SEQ ID NO: 11371 - RNA, 22 nt, Homo sapiens
uggaggcagggccuuugugaag

SEQ ID NO: 11372 - RNA, 21 nt, Homo sapiens
uaaagcuagauaaccgaaagu

SEQ ID NO: 11373 - RNA, 23 nt, Homo sapiens
ucuuugguuaucuagcuguauga

SEQ ID NO: 11374 - RNA, 18 nt, Homo sapiens
cuagauaaccgaaaguaa

SEQ ID NO: 11375 - RNA, 22 nt, Homo sapiens
aaagugcauccuuuuagagugu

SEQ ID NO: 11376 - RNA, 25 nt, Homo sapiens
aaagugcauccuuuuagaguguuac

SEQ ID NO: 11377 - RNA, 20 nt, Homo sapiens
cucuagagggaagcgcuuuc

SEQ ID NO: 11378 - RNA, 24 nt, Homo sapiens
cucuagagggaagcgcuuucuguu

SEQ ID NO: 11379 - RNA, 22 nt, Homo sapiens
ggauguuucaugacuacucugc

SEQ ID NO: 11380 - RNA, 22 nt, Homo sapiens
gcauacucaugaagcauccuag

SEQ ID NO: 11381 - RNA, 22 nt, Homo sapiens
uucuaacugccccugugcugca

SEQ ID NO: 11382 - RNA, 22 nt, Homo sapiens
cagcauagggcaguuaggagau

SEQ ID NO: 11383 - RNA, 22 nt, Homo sapiens
aaaguucugagacacuccgacu

SEQ ID NO: 11384 - RNA, 22 nt, Homo sapiens
ucagugcacuacagaacuuugu

SEQ ID NO: 11385 - RNA, 22 nt, Homo sapiens
aagcaauugagaggaugucuaa

SEQ ID NO: 11386 - RNA, 22 nt, Homo sapiens
uaaacguccuuucaaucacuuu

SEQ ID NO: 11387 - RNA, 22 nt, Homo sapiens
uacaauucuauaauuugacaau

SEQ ID NO: 11388 - RNA, 22 nt, Homo sapiens
uggcaaauuauagaauugcagc

SEQ ID NO: 11389 - RNA, 22 nt, Homo sapiens
aaucauacacgguugaccuauu

SEQ ID NO: 11390 - RNA, 22 nt, Homo sapiens
uagguuauccguguugccuucg

SEQ ID NO: 11391 - RNA, 21 nt, Homo sapiens
aaucauacacgguugaccuau

SEQ ID NO: 11392 - RNA, 21 nt, Homo sapiens
uagguuauccguguugccuuc

SEQ ID NO: 11393 - RNA, 23 nt, Homo sapiens
uagguuauccguguugccuucgc

SEQ ID NO: 11394 - RNA, 22 nt, Homo sapiens
uccuucccggggcugcugugau

SEQ ID NO: 11395 - RNA, 22 nt, Homo sapiens
cgcccccacccugggagggucu

SEQ ID NO: 11396 - RNA, 22 nt, Homo sapiens
agaaguugcccauguuauuuuc

SEQ ID NO: 11397 - RNA, 21 nt, Homo sapiens
aaacaaacauggugcacuucu

SEQ ID NO: 11398 - RNA, 22 nt, Homo sapiens
aaacaaacauggugcacuucuu

SEQ ID NO: 11399 - RNA, 23 nt, Homo sapiens
aaacaaacauggugcacuucuuu

SEQ ID NO: 11400 - RNA, 22 nt, Homo sapiens
gaaucucuacggguaagugugu

SEQ ID NO: 11401 - RNA, 22 nt, Homo sapiens
cauuugccugcagagauuuucc

SEQ ID NO: 11402 - RNA, 22 nt, Homo sapiens
uggcaauaaauacaucugggca

SEQ ID NO: 11403 - RNA, 29 nt, Homo sapiens
uucauucggcuguccagauguauccaagu

SEQ ID NO: 11404 - RNA, 22 nt, Homo sapiens
ugguagccaaugauaugccauu

SEQ ID NO: 11405 - RNA, 22 nt, Homo sapiens
uagccaugucauaaaaugguua

SEQ ID NO: 11406 - RNA, 22 nt, Homo sapiens
uccaguaggaugaacucagaga

SEQ ID NO: 11407 - RNA, 22 nt, Homo sapiens
ugcugaauucguccuccugggc

SEQ ID NO: 11408 - RNA, 22 nt, Homo sapiens
uuguuccagcacugacaccauc

SEQ ID NO: 11409 - RNA, 22 nt, Homo sapiens
gugcuuagcccuggaauaugcu

SEQ ID NO: 11410 - RNA, 22 nt, Homo sapiens
aucauucacggacaacacuuuu

SEQ ID NO: 11411 - RNA, 22 nt, Homo sapiens
gaaguuguucgugguggauucg

SEQ ID NO: 11412 - RNA, 21 nt, Homo sapiens
aaucauucacggacaacacuu

SEQ ID NO: 11413 - RNA, 22 nt, Homo sapiens
aaucauucacggacaacacuuu

SEQ ID NO: 11414 - RNA, 22 nt, Homo sapiens
cccugaacgaggggucuggagg

SEQ ID NO: 11415 - RNA, 21 nt, Homo sapiens
ugcugacuccuaguccagggc

SEQ ID NO: 11416 - RNA, 21 nt, Homo sapiens
cuuuuugcggucugggcuugc

SEQ ID NO: 11417 - RNA, 22 nt, Homo sapiens
ggaagcccuuaccccaaaaagu

SEQ ID NO: 11418 - RNA, 22 nt, Homo sapiens
ggagguagcagcguuggcgguc

SEQ ID NO: 11419 - RNA, 22 nt, Homo sapiens
ccgccaccuccgucugcuccuc

SEQ ID NO: 11420 - RNA, 22 nt, Homo sapiens
uuauuucaaugauaccaccaaa

SEQ ID NO: 11421 - RNA, 22 nt, Homo sapiens
uaguaguaucauugaaaugaca

SEQ ID NO: 11422 - RNA, 22 nt, Homo sapiens
aaguucuucuccugcuaauccu

SEQ ID NO: 11423 - RNA, 22 nt, Homo sapiens
auuagcagaagaggaacuguca

SEQ ID NO: 11424 - RNA, 22 nt, Homo sapiens
cagguuacuguaaagaugaaau

SEQ ID NO: 11425 - RNA, 22 nt, Homo sapiens
aaacaucuagaacagugccugg

SEQ ID NO: 11426 - RNA, 22 nt, Homo sapiens
cagguuacuguaaagaugaaau

SEQ ID NO: 11427 - RNA, 22 nt, Homo sapiens
aaacaucuagaacagugccugg

SEQ ID NO: 11428 - RNA, 22 nt, Homo sapiens
cagguuacuguaaagaugaaau

SEQ ID NO: 11429 - RNA, 22 nt, Homo sapiens
aaacaucuagaacagugccugg

SEQ ID NO: 11430 - RNA, 22 nt, Homo sapiens
cagguuacuguaaagaugaaau

SEQ ID NO: 11431 - RNA, 22 nt, Homo sapiens
aaacaucuagaacagugccugg

SEQ ID NO: 11432 - RNA, 22 nt, Homo sapiens
uguguccagacgccagcugccu

SEQ ID NO: 11433 - RNA, 22 nt, Homo sapiens
cugcggcuggcauggacccagg

SEQ ID NO: 11434 - RNA, 22 nt, Homo sapiens
ugauauguuugauauuggguug

SEQ ID NO: 11435 - RNA, 22 nt, Homo sapiens
cuaaaugucaaacauauucuua

SEQ ID NO: 11436 - RNA, 22 nt, Homo sapiens
uggcuugugaacauugcucagc

SEQ ID NO: 11437 - RNA, 17 nt, Homo sapiens
cacuuguucucgagcca

SEQ ID NO: 11438 - RNA, 22 nt, Homo sapiens
aaucugagcagaaguaagguuu

SEQ ID NO: 11439 - RNA, 22 nt, Homo sapiens
accacuacuucugauaguguuu

SEQ ID NO: 11440 - RNA, 22 nt, Homo sapiens
gagcuuggggguugucguuaag

SEQ ID NO: 11441 - RNA, 22 nt, Homo sapiens
cugaugaauccccaaacuccug

SEQ ID NO: 11442 - RNA, 22 nt, Homo sapiens
uggugauugaagagcagauguu

SEQ ID NO: 11443 - RNA, 22 nt, Homo sapiens
uuaucuugcucuucucuaaucc

SEQ ID NO: 11444 - RNA, 22 nt, Homo sapiens
agcgccugccccgguggguggg

SEQ ID NO: 11445 - RNA, 22 nt, Homo sapiens
ucaugcagcgagcgggcggcgc

SEQ ID NO: 11446 - RNA, 22 nt, Homo sapiens
gccuuccaguuugcucaguugg

SEQ ID NO: 11447 - RNA, 22 nt, Homo sapiens
uaaagggugagcuggaaggcuc

SEQ ID NO: 11448 - RNA, 22 nt, Homo sapiens
ccacuuucagcagucugguuua

SEQ ID NO: 11449 - RNA, 22 nt, Homo sapiens
agccaaguuggcugagugugaa

SEQ ID NO: 11450 - RNA, 22 nt, Homo sapiens
aggugaguaggucgcauggaaa

SEQ ID NO: 11451 - RNA, 17 nt, Homo sapiens
uuuccaaccucucaccu

SEQ ID NO: 11452 - RNA, 22 nt, Homo sapiens
ucuggugcggagagggcccaca

SEQ ID NO: 11453 - RNA, 22 nt, Homo sapiens
uguaugcccucaccgcucagcc

SEQ ID NO: 11454 - RNA, 22 nt, Homo sapiens
gauaagcagcgugguuuggugc

SEQ ID NO: 11455 - RNA, 22 nt, Homo sapiens
acugaaucacaugcugcucuuu

SEQ ID NO: 11456 - RNA, 22 nt, Homo sapiens
agcuugcuccucucgucgugca

SEQ ID NO: 11457 - RNA, 20 nt, Homo sapiens
uuugacaggaggugugagcu

SEQ ID NO: 11458 - RNA, 22 nt, Homo sapiens
aaaccuacuuucuuuuuagauu

SEQ ID NO: 11459 - RNA, 22 nt, Homo sapiens
gaaaugugaaggagugguuuga

SEQ ID NO: 11460 - RNA, 22 nt, Homo sapiens
ugcccauauucuguaugguuaa

SEQ ID NO: 11461 - RNA, 20 nt, Homo sapiens
ugcggcucuaauuugggcac

SEQ ID NO: 11462 - RNA, 22 nt, Homo sapiens
ugacucauuagcagucuguaaa

SEQ ID NO: 11463 - RNA, 22 nt, Homo sapiens
uacuuacugcuaccugacuugu

SEQ ID NO: 11464 - RNA, 22 nt, Homo sapiens
uagacagaggaggcagcauaau

SEQ ID NO: 11465 - RNA, 22 nt, Homo sapiens
aagcauguucucuuccucauuc

SEQ ID NO: 11466 - RNA, 22 nt, Homo sapiens
ggguggaucacgaugcaauuuu

SEQ ID NO: 11467 - RNA, 20 nt, Homo sapiens
aauugcacgguauccaucug

SEQ ID NO: 11468 - RNA, 21 nt, Homo sapiens
aauugcacgguauccaucugu

SEQ ID NO: 11469 - RNA, 22 nt, Homo sapiens
aauugcacgguauccaucugua

SEQ ID NO: 11470 - RNA, 22 nt, Homo sapiens
uuucugaaugaacugacaauuu

SEQ ID NO: 11471 - RNA, 22 nt, Homo sapiens
acguugagguucuucugaggug

SEQ ID NO: 11472 - RNA, 22 nt, Homo sapiens
ugaccuucuuccucucugguuu

SEQ ID NO: 11473 - RNA, 22 nt, Homo sapiens
accaggaaggugaaagaggguc

SEQ ID NO: 11474 - RNA, 22 nt, Homo sapiens
gcucauuccccuucuaucugca

SEQ ID NO: 11475 - RNA, 22 nt, Homo sapiens
cagaucaagggagaugugccau

SEQ ID NO: 11476 - RNA, 22 nt, Homo sapiens
ucuuagaugcccaguuaaaugg

SEQ ID NO: 11477 - RNA, 21 nt, Homo sapiens
acucuaacuggugcuuuaggg

SEQ ID NO: 11478 - RNA, 22 nt, Homo sapiens
gagaaguugcccguguuuuuuu

SEQ ID NO: 11479 - RNA, 22 nt, Homo sapiens
gaaacauucgcggugcacuucu

SEQ ID NO: 11480 - RNA, 22 nt, Homo sapiens
aggaugggggaggcaaagccaa

SEQ ID NO: 11481 - RNA, 22 nt, Homo sapiens
ugauuuugguacccaccuccuc

SEQ ID NO: 11482 - RNA, 22 nt, Homo sapiens
uuggucauucauucugauguuu

SEQ ID NO: 11483 - RNA, 22 nt, Homo sapiens
acaucuggaaguugggugacag

SEQ ID NO: 11484 - RNA, 22 nt, Homo sapiens
cacagagaagcacagggcccag

SEQ ID NO: 11485 - RNA, 22 nt, Homo sapiens
ucugcccuggugcucuucuguc

SEQ ID NO: 11486 - RNA, 21 nt, Homo sapiens
aauaauacaugguugaucuuu

SEQ ID NO: 11487 - RNA, 22 nt, Homo sapiens
gggagaucgaccguguuauauu

SEQ ID NO: 11488 - RNA, 22 nt, Homo sapiens
aggaagugccagaaaugucaga

SEQ ID NO: 11489 - RNA, 22 nt, Homo sapiens
caugggauuuccugccuuccuu

SEQ ID NO: 11490 - RNA, 22 nt, Homo sapiens
ggagucaugcuucucugagguu

SEQ ID NO: 11491 - RNA, 19 nt, Homo sapiens
cacagagacgucugacuuc

SEQ ID NO: 11492 - RNA, 22 nt, Homo sapiens
uccucauuucuacagucgcugc

SEQ ID NO: 11493 - RNA, 22 nt, Homo sapiens
cagcccuguaggaguuaggggg

SEQ ID NO: 11494 - RNA, 22 nt, Homo sapiens
ucggccauuuccggcgcggcgc

SEQ ID NO: 11495 - RNA, 22 nt, Homo sapiens
gucgccugucggaaauggcugc

SEQ ID NO: 11496 - RNA, 22 nt, Homo sapiens
uuccuucuaaaaguugaagggu

SEQ ID NO: 11497 - RNA, 22 nt, Homo sapiens
uucagcuuuuagaaggaaucgg

SEQ ID NO: 11498 - RNA, 22 nt, Homo sapiens
ugggcuuagagaaguuuucagc

SEQ ID NO: 11499 - RNA, 22 nt, Homo sapiens
ugagcgcuuuucucuggcucau

SEQ ID NO: 11500 - RNA, 22 nt, Homo sapiens
uauuuauggaaaacuggcauuu

SEQ ID NO: 11501 - RNA, 22 nt, Homo sapiens
ugcugguuuucuaugaauauau

SEQ ID NO: 11502 - RNA, 22 nt, Homo sapiens
ugaugcaaacuuuguuuaccag

SEQ ID NO: 11503 - RNA, 22 nt, Homo sapiens
guaaacaaaguguuugcccuua

SEQ ID NO: 11504 - RNA, 22 nt, Homo sapiens
ccuguguugagugccucugugu

SEQ ID NO: 11505 - RNA, 22 nt, Homo sapiens
uauaguaaguacucaauaaagg

SEQ ID NO: 11506 - RNA, 22 nt, Homo sapiens
gcugaggccugcaguagacugu

SEQ ID NO: 11507 - RNA, 22 nt, Homo sapiens
agucugcuggagucuuggcuuc

SEQ ID NO: 11508 - RNA, 22 nt, Homo sapiens
uggcaggaagaggacagaaaua

SEQ ID NO: 11509 - RNA, 22 nt, Homo sapiens
ucuuucuuccuuucugcccucc

SEQ ID NO: 11510 - RNA, 22 nt, Homo sapiens
uuuucuuuguccagacagcucu

SEQ ID NO: 11511 - RNA, 22 nt, Homo sapiens
gcuagaccuguuuguuaagaaa

SEQ ID NO: 11512 - RNA, 22 nt, Homo sapiens
ccuggcaaggcuugauugcuuu

SEQ ID NO: 11513 - RNA, 22 nt, Homo sapiens
gcagcagagucuagcuagguuc

SEQ ID NO: 11514 - RNA, 22 nt, Homo sapiens
ucauaugugucccaagucucua

SEQ ID NO: 11515 - RNA, 22 nt, Homo sapiens
gaguuuggggcacaaauguacu

SEQ ID NO: 11516 - RNA, 22 nt, Homo sapiens
gaaucuguugccuccagguguu

SEQ ID NO: 11517 - RNA, 19 nt, Homo sapiens
ccuggggcaugguggguuu

SEQ ID NO: 11518 - RNA, 22 nt, Homo sapiens
gaaucuguugccuccagguguu

SEQ ID NO: 11519 - RNA, 19 nt, Homo sapiens
ccuggggcaugguggguuu

SEQ ID NO: 11520 - RNA, 22 nt, Homo sapiens
gaaucuguugccuccagguguu

SEQ ID NO: 11521 - RNA, 19 nt, Homo sapiens
ccuggggcaugguggguuu

SEQ ID NO: 11522 - RNA, 22 nt, Homo sapiens
gaaucuguugccuccagguguu

SEQ ID NO: 11523 - RNA, 19 nt, Homo sapiens
ccuggggcaugguggguuu

SEQ ID NO: 11524 - RNA, 22 nt, Homo sapiens
gaaucuguugccuccagguguu

SEQ ID NO: 11525 - RNA, 19 nt, Homo sapiens
ccuggggcaugguggguuu

SEQ ID NO: 11526 - RNA, 22 nt, Homo sapiens
gaaucuguugccuccagguguu

SEQ ID NO: 11527 - RNA, 19 nt, Homo sapiens
ccuggggcaugguggguuu

SEQ ID NO: 11528 - RNA, 22 nt, Homo sapiens
gaaucuguugccuccagguguu

SEQ ID NO: 11529 - RNA, 19 nt, Homo sapiens
ccuggggcaugguggguuu

SEQ ID NO: 11530 - RNA, 22 nt, Homo sapiens
gaaucuguugccuccagguguu

SEQ ID NO: 11531 - RNA, 19 nt, Homo sapiens
ccuggggcaugguggguuu

SEQ ID NO: 11532 - RNA, 22 nt, Homo sapiens
gaaucuguugccuccagguguu

SEQ ID NO: 11533 - RNA, 19 nt, Homo sapiens
ccuggggcaugguggguuu

SEQ ID NO: 11534 - RNA, 22 nt, Homo sapiens
ugagaaaggagagcuuaaugug

SEQ ID NO: 11535 - RNA, 22 nt, Homo sapiens
cugagaauuaagcuguccuuuc

SEQ ID NO: 11536 - RNA, 22 nt, Homo sapiens
aguccccgcucuagugauuaca

SEQ ID NO: 11537 - RNA, 22 nt, Homo sapiens
uaagcacuacagcagggccuca

SEQ ID NO: 11538 - RNA, 22 nt, Homo sapiens
gggguuagggggucagaguaag

SEQ ID NO: 11539 - RNA, 22 nt, Homo sapiens
ugcccuccuugacuccuacacc

SEQ ID NO: 11540 - RNA, 22 nt, Homo sapiens
aguaacaguuggcuuacaucuu

SEQ ID NO: 11541 - RNA, 22 nt, Homo sapiens
agguguauacgauugugcuucu

SEQ ID NO: 11542 - RNA, 22 nt, Homo sapiens
uggguuuacuagguccuucuga

SEQ ID NO: 11543 - RNA, 21 nt, Homo sapiens
ucggagggacccagaaccuac

SEQ ID NO: 11544 - RNA, 22 nt, Homo sapiens
uucccuuaccaggcuccucuuu

SEQ ID NO: 11545 - RNA, 20 nt, Homo sapiens
aggggccuggaguggggagc

SEQ ID NO: 11546 - RNA, 22 nt, Homo sapiens
aaauauguaaaagcaacuuagc

SEQ ID NO: 11547 - RNA, 17 nt, Homo sapiens
cugaguucuucauguuu

SEQ ID NO: 11548 - RNA, 22 nt, Homo sapiens
ugauucucucgaacugugcgac

SEQ ID NO: 11549 - RNA, 22 nt, Homo sapiens
uggacacagauugaagaaucug

SEQ ID NO: 11550 - RNA, 22 nt, Homo sapiens
cacauuuccacuucauaaacag

SEQ ID NO: 11551 - RNA, 22 nt, Homo sapiens
uguuuagaaacuagaaauguag

SEQ ID NO: 11552 - RNA, 22 nt, Homo sapiens
uuuauugugcacugucucauuu

SEQ ID NO: 11553 - RNA, 22 nt, Homo sapiens
ugaggcagguacauuugauuau

SEQ ID NO: 11554 - RNA, 22 nt, Homo sapiens
uacugugcucagugcuauuuaa

SEQ ID NO: 11555 - RNA, 22 nt, Homo sapiens
uuaaauggcaaugaaguaguaa

SEQ ID NO: 11556 - RNA, 22 nt, Homo sapiens
gagggcuaugcggcgggggaga

SEQ ID NO: 11557 - RNA, 22 nt, Homo sapiens
uccuuuguccgcccugcccucc

SEQ ID NO: 11558 - RNA, 22 nt, Homo sapiens
uaguugacauagcacugacugc

SEQ ID NO: 11559 - RNA, 22 nt, Homo sapiens
uaaaugcagucugugcugggcu

SEQ ID NO: 11560 - RNA, 22 nt, Homo sapiens
uguguaaggaugaggcacucca

SEQ ID NO: 11561 - RNA, 22 nt, Homo sapiens
guggguuguuuugacuuuuuau

SEQ ID NO: 11562 - RNA, 22 nt, Homo sapiens
ggaaugcugaaugcagcuccau

SEQ ID NO: 11563 - RNA, 22 nt, Homo sapiens
uggacacuucaucagcauucac

SEQ ID NO: 11564 - RNA, 22 nt, Homo sapiens
ucucugcaggcgggcuucgccc

SEQ ID NO: 11565 - RNA, 22 nt, Homo sapiens
gcgcggggcgcucugcagaccc

SEQ ID NO: 11566 - RNA, 22 nt, Homo sapiens
ugaucucuggccuagauggaca

SEQ ID NO: 11567 - RNA, 22 nt, Homo sapiens
uccaucuguuggccgaggguca

SEQ ID NO: 11568 - RNA, 22 nt, Homo sapiens
ucgcggcgcaaggcggggucgc

SEQ ID NO: 11569 - RNA, 22 nt, Homo sapiens
cggccaacggcugcucgcaggg

SEQ ID NO: 11570 - RNA, 22 nt, Homo sapiens
uaaucccaaaucugucaggccu

SEQ ID NO: 11571 - RNA, 22 nt, Homo sapiens
gccugaaaggucugguguuaag

SEQ ID NO: 11572 - RNA, 22 nt, Homo sapiens
ucggguguucaguaaauguaag

SEQ ID NO: 11573 - RNA, 22 nt, Homo sapiens
cacgcacuuauuggacaugcgu

SEQ ID NO: 11574 - RNA, 22 nt, Homo sapiens
cagggaaggccugagggcuggu

SEQ ID NO: 11575 - RNA, 22 nt, Homo sapiens
uccccagcucucuccucccucu

SEQ ID NO: 11576 - RNA, 22 nt, Homo sapiens
ucuggguuaaagauaguuuuug

SEQ ID NO: 11577 - RNA, 22 nt, Homo sapiens
gguacuauuauugacccugagg

SEQ ID NO: 11578 - RNA, 22 nt, Homo sapiens
gaaagcaacugaugaacugucu

SEQ ID NO: 11579 - RNA, 22 nt, Homo sapiens
gauaguucuguaguucuuucuc

SEQ ID NO: 11580 - RNA, 22 nt, Homo sapiens
ggagggaauuuggguuagaugc

SEQ ID NO: 11581 - RNA, 22 nt, Homo sapiens
agcuaucuguaaauucccuuca

SEQ ID NO: 11582 - RNA, 22 nt, Homo sapiens
uaggaaaacuggcacaauacua

SEQ ID NO: 11583 - RNA, 22 nt, Homo sapiens
uuugugaagugccaauuuuaug

SEQ ID NO: 11584 - RNA, 22 nt, Homo sapiens
ggugauggagagagacagagcu

SEQ ID NO: 11585 - RNA, 22 nt, Homo sapiens
uggccugucucuccucuguccu

SEQ ID NO: 11586 - RNA, 22 nt, Homo sapiens
ccaggguuagaugcuagucuug

SEQ ID NO: 11587 - RNA, 22 nt, Homo sapiens
agucugguuauuuguagcuggg

SEQ ID NO: 11588 - RNA, 22 nt, Homo sapiens
uaaagcagcgagacugauuuga

SEQ ID NO: 11589 - RNA, 22 nt, Homo sapiens
agucagucucauuacuuucuac

SEQ ID NO: 11590 - RNA, 22 nt, Homo sapiens
ucaauguaacuugucaagagcc

SEQ ID NO: 11591 - RNA, 22 nt, Homo sapiens
uuugacaggauggauggacuga

SEQ ID NO: 11592 - RNA, 22 nt, Homo sapiens
gucuggggaucuuaguuugaga

SEQ ID NO: 11593 - RNA, 22 nt, Homo sapiens
uauaacugggaccucagaaugg

SEQ ID NO: 11594 - RNA, 22 nt, Homo sapiens
ugccuguugucugcucucguuc

SEQ ID NO: 11595 - RNA, 20 nt, Homo sapiens
gcacagcagggugacgggca

SEQ ID NO: 11596 - RNA, 22 nt, Homo sapiens
ugggcugugugucucuguuuug

SEQ ID NO: 11597 - RNA, 22 nt, Homo sapiens
cuuggcagagagacacuccccu

SEQ ID NO: 11598 - RNA, 22 nt, Homo sapiens
ugggcugugugucucuguuuug

SEQ ID NO: 11599 - RNA, 22 nt, Homo sapiens
cuuggcagagagacacuccccu

SEQ ID NO: 11600 - RNA, 22 nt, Homo sapiens
gggagcugaggggaucuugcaa

SEQ ID NO: 11601 - RNA, 21 nt, Homo sapiens
ugccccagauucccgcuccuc

SEQ ID NO: 11602 - RNA, 22 nt, Homo sapiens
acgugcucucugucauggcagg

SEQ ID NO: 11603 - RNA, 22 nt, Homo sapiens
ugcugugaucaggagugacccc

SEQ ID NO: 11604 - RNA, 22 nt, Homo sapiens
ccucugccucccuccuguggca

SEQ ID NO: 11605 - RNA, 22 nt, Homo sapiens
ucauagcggggggugcagaggc

SEQ ID NO: 11606 - RNA, 22 nt, Homo sapiens
cacccacgacuguaaacuccaa

SEQ ID NO: 11607 - RNA, 22 nt, Homo sapiens
ugaggaguucacaguugcugcc

SEQ ID NO: 11608 - RNA, 22 nt, Homo sapiens
uuccaugucuguuuccacauug

SEQ ID NO: 11609 - RNA, 22 nt, Homo sapiens
ugaggagacgcauuuggauaaa

SEQ ID NO: 11610 - RNA, 22 nt, Homo sapiens
uuuucuagcccuucacacuacu

SEQ ID NO: 11611 - RNA, 22 nt, Homo sapiens
uaaugugaaggacuaagagaag

SEQ ID NO: 11612 - RNA, 22 nt, Homo sapiens
uguggguccugccugccgucag

SEQ ID NO: 11613 - RNA, 22 nt, Homo sapiens
ggggucagggagacuuggagcu

SEQ ID NO: 11614 - RNA, 22 nt, Homo sapiens
cgggcggugugggcgcgucggg

SEQ ID NO: 11615 - RNA, 19 nt, Homo sapiens
uccgcgcgcccccugccug

SEQ ID NO: 11616 - RNA, 22 nt, Homo sapiens
uuuguucaugacauuauaauca

SEQ ID NO: 11617 - RNA, 22 nt, Homo sapiens
auugugaugucacaaauggagg

SEQ ID NO: 11618 - RNA, 22 nt, Homo sapiens
gaaggaugugucacucucagga

SEQ ID NO: 11619 - RNA, 20 nt, Homo sapiens
cuccagggaugauuccuucc

SEQ ID NO: 11620 - RNA, 22 nt, Homo sapiens
gaggcccugugcaaagcaggac

SEQ ID NO: 11621 - RNA, 18 nt, Homo sapiens
uccugugaugugggccuc

SEQ ID NO: 11622 - RNA, 22 nt, Homo sapiens
accugcguaugcugccaccagg

SEQ ID NO: 11623 - RNA, 22 nt, Homo sapiens
cucguagcagcauaguaggugc

SEQ ID NO: 11624 - RNA, 22 nt, Homo sapiens
agccaugcccguguucaugaaa

SEQ ID NO: 11625 - RNA, 22 nt, Homo sapiens
ucucaucaugggcaugugucgu

SEQ ID NO: 11626 - RNA, 22 nt, Homo sapiens
ucacauuuuuauagcaggagcu

SEQ ID NO: 11627 - RNA, 20 nt, Homo sapiens
cuucaugcugugaaugugau

SEQ ID NO: 11628 - RNA, 22 nt, Homo sapiens
auuucccaaagaaaccuuucuu

SEQ ID NO: 11629 - RNA, 22 nt, Homo sapiens
aaaacuuucuuugggaaagguu

SEQ ID NO: 11630 - RNA, 22 nt, Homo sapiens
ugaggauuggagaaccaggauu

SEQ ID NO: 11631 - RNA, 21 nt, Homo sapiens
aaaucuauucuccuuucucau

SEQ ID NO: 11632 - RNA, 22 nt, Homo sapiens
ugggcugcugggcuuucuggga

SEQ ID NO: 11633 - RNA, 22 nt, Homo sapiens
ucccagaaacuccacacccaca

SEQ ID NO: 11634 - RNA, 22 nt, Homo sapiens
gaaaccucaccucgggauggcu

SEQ ID NO: 11635 - RNA, 22 nt, Homo sapiens
ccauuucugcaggugcuggcuu

SEQ ID NO: 11636 - RNA, 22 nt, Homo sapiens
agcuuuggcccgguguuaauua

SEQ ID NO: 11637 - RNA, 22 nt, Homo sapiens
gucugcgccuggcccuggcugu

SEQ ID NO: 11638 - RNA, 22 nt, Homo sapiens
agaguguuugcuguauaauugg

SEQ ID NO: 11639 - RNA, 22 nt, Homo sapiens
uagagguacaguaggcaugacu

SEQ ID NO: 11640 - RNA, 22 nt, Homo sapiens
uucucuuugggucucaguuucc

SEQ ID NO: 11641 - RNA, 22 nt, Homo sapiens
gaaauuggaucaaaugaguggg

SEQ ID NO: 11642 - RNA, 22 nt, Homo sapiens
uaguuauguuugcaaggaggga

SEQ ID NO: 11643 - RNA, 22 nt, Homo sapiens
ugucucuccaguaguagcuauu

SEQ ID NO: 11644 - RNA, 22 nt, Homo sapiens
uagcauggggauuaugccagaa

SEQ ID NO: 11645 - RNA, 22 nt, Homo sapiens
uuggcugccauuuccaugcucc

SEQ ID NO: 11646 - RNA, 22 nt, Homo sapiens
uauuugauguaggcugagccac

SEQ ID NO: 11647 - RNA, 22 nt, Homo sapiens
uggcucagcugucugucagagc

SEQ ID NO: 11648 - RNA, 22 nt, Homo sapiens
uugaauaaagccagcugugagu

SEQ ID NO: 11649 - RNA, 22 nt, Homo sapiens
uuccagcuguuuuguugaacug

SEQ ID NO: 11650 - RNA, 22 nt, Homo sapiens
aacagcaaccuucccuaaagug

SEQ ID NO: 11651 - RNA, 22 nt, Homo sapiens
gcuacuuuagaaggaugcugua

SEQ ID NO: 11652 - RNA, 22 nt, Homo sapiens
ucugcuccucuaauugauacgg

SEQ ID NO: 11653 - RNA, 22 nt, Homo sapiens
uaucguauuaaaggaaguagac

SEQ ID NO: 11654 - RNA, 22 nt, Homo sapiens
gccaguucuacucucagcuucu

SEQ ID NO: 11655 - RNA, 22 nt, Homo sapiens
gaggugagaagagaaagggcuu

SEQ ID NO: 11656 - RNA, 22 nt, Homo sapiens
augguucugucaagcaccgcgg

SEQ ID NO: 11657 - RNA, 21 nt, Homo sapiens
uugugcuugaucuaaccaugu

SEQ ID NO: 11658 - RNA, 22 nt, Homo sapiens
uguucuuuuaguaaaauguggu

SEQ ID NO: 11659 - RNA, 18 nt, Homo sapiens
cauguuguacuggaauag

SEQ ID NO: 11660 - RNA, 22 nt, Homo sapiens
uguuacaaagcauucagcauga

SEQ ID NO: 11661 - RNA, 22 nt, Homo sapiens
ugcugaaaugcuuuguaauaug

SEQ ID NO: 11662 - RNA, 22 nt, Homo sapiens
uggggauuucauagggcaaaca

SEQ ID NO: 11663 - RNA, 20 nt, Homo sapiens
uguuugcuguauuuccccag

SEQ ID NO: 11664 - RNA, 22 nt, Homo sapiens
ggaagcugaugcaaaggguucc

SEQ ID NO: 11665 - RNA, 22 nt, Homo sapiens
acccucugcaucagcuucuuua

SEQ ID NO: 11666 - RNA, 22 nt, Homo sapiens
uguguguuuauugauauuucac

SEQ ID NO: 11667 - RNA, 22 nt, Homo sapiens
ugaagaauaauaucaaugagca

SEQ ID NO: 11668 - RNA, 22 nt, Homo sapiens
ugguugguaaucacugcugaug

SEQ ID NO: 11669 - RNA, 22 nt, Homo sapiens
ugucaucagcaagggucagcca

SEQ ID NO: 11670 - RNA, 22 nt, Homo sapiens
ggaugcaggguguggacucaug

SEQ ID NO: 11671 - RNA, 19 nt, Homo sapiens
aguucacauccuaguauuc

SEQ ID NO: 11672 - RNA, 22 nt, Homo sapiens
ugugucacugugggcauagaaa

SEQ ID NO: 11673 - RNA, 22 nt, Homo sapiens
auauucucacagugacacaagc

SEQ ID NO: 11674 - RNA, 22 nt, Homo sapiens
ggcugugucacugugggcauag

SEQ ID NO: 11675 - RNA, 22 nt, Homo sapiens
uccucacagugacacgagcccc

SEQ ID NO: 11676 - RNA, 22 nt, Homo sapiens
ccgaggcaggacaacuggaaug

SEQ ID NO: 11677 - RNA, 22 nt, Homo sapiens
uacuuguuaaacugccuuggca

SEQ ID NO: 11678 - RNA, 22 nt, Homo sapiens
ucaacuuuguuuccuguugguu

SEQ ID NO: 11679 - RNA, 22 nt, Homo sapiens
cuuaaaaagggaagcagggcuu

SEQ ID NO: 11680 - RNA, 22 nt, Homo sapiens
agaguuuuauaugcaguugcca

SEQ ID NO: 11681 - RNA, 22 nt, Homo sapiens
gacaaauugcacaggaggcauu

SEQ ID NO: 11682 - RNA, 22 nt, Homo sapiens
ggaagggacaagaccaauggga

SEQ ID NO: 11683 - RNA, 22 nt, Homo sapiens
uuccaguccuguuccuucuacc

SEQ ID NO: 11684 - RNA, 22 nt, Homo sapiens
agagcuguuuuuccaaacuauu

SEQ ID NO: 11685 - RNA, 20 nt, Homo sapiens
ugauuggaaaaacuaguuuu

SEQ ID NO: 11686 - RNA, 22 nt, Homo sapiens
uuagaaacaguugucaagugug

SEQ ID NO: 11687 - RNA, 22 nt, Homo sapiens
ugagacugggagcuguuucuaa

SEQ ID NO: 11688 - RNA, 22 nt, Homo sapiens
gcugguuucauauggugguuua

SEQ ID NO: 11689 - RNA, 23 nt, Homo sapiens
uagcaccauuugaaaucaguguu

SEQ ID NO: 11690 - RNA, 22 nt, Homo sapiens
uagugccaaggggaauauuggg

SEQ ID NO: 11691 - RNA, 22 nt, Homo sapiens
uaccccauucccuugugugcug

SEQ ID NO: 11692 - RNA, 22 nt, Homo sapiens
ucugagcagcagcccugcacuc

SEQ ID NO: 11693 - RNA, 22 nt, Homo sapiens
ugggucuaggugcugugggagg

SEQ ID NO: 11694 - RNA, 22 nt, Homo sapiens
ccccugcagaguuccuucaccc

SEQ ID NO: 11695 - RNA, 22 nt, Homo sapiens
uggaggaggcggugcagggguc

SEQ ID NO: 11696 - RNA, 22 nt, Homo sapiens
ucucuugucuuaauacuuagga

SEQ ID NO: 11697 - RNA, 22 nt, Homo sapiens
ucuuuguggccagggugggaga

SEQ ID NO: 11698 - RNA, 22 nt, Homo sapiens
gcacaaagcaggcaauucugag

SEQ ID NO: 11699 - RNA, 22 nt, Homo sapiens
ucugaauuaaacccuuugugcc

SEQ ID NO: 11700 - RNA, 22 nt, Homo sapiens
ucugagaggccacucuaacuac

SEQ ID NO: 11701 - RNA, 22 nt, Homo sapiens
aguggagcuaggccucaucagc

SEQ ID NO: 11702 - RNA, 22 nt, Homo sapiens
uucuuucaagaagcuggaaguc

SEQ ID NO: 11703 - RNA, 22 nt, Homo sapiens
cuucaagguucuuggcaggaau

SEQ ID NO: 11704 - RNA, 22 nt, Homo sapiens
ugcuagaagguggggcagggau

SEQ ID NO: 11705 - RNA, 22 nt, Homo sapiens
ucccugacucucuuucugcgug

SEQ ID NO: 11706 - RNA, 22 nt, Homo sapiens
uuaccgguacucacuccaugcu

SEQ ID NO: 11707 - RNA, 22 nt, Homo sapiens
gagguggcuagagagcugguca

SEQ ID NO: 11708 - RNA, 22 nt, Homo sapiens
caggcuuccauccagcuuaacg

SEQ ID NO: 11709 - RNA, 22 nt, Homo sapiens
ggaggagcuggggaagcucugc

SEQ ID NO: 11710 - RNA, 22 nt, Homo sapiens
aaggguuaaaguguaugggcuu

SEQ ID NO: 11711 - RNA, 22 nt, Homo sapiens
agcaccugcauuuuacucuugu

SEQ ID NO: 11712 - RNA, 22 nt, Homo sapiens
uguggucucuaggcugacucuu

SEQ ID NO: 11713 - RNA, 22 nt, Homo sapiens
ggcagcaaagaguccucaguuu

SEQ ID NO: 11714 - RNA, 22 nt, Homo sapiens
gaagccaugaaucaggagaggu

SEQ ID NO: 11715 - RNA, 22 nt, Homo sapiens
ucuccuugaucccuuuggcuuc

SEQ ID NO: 11716 - RNA, 22 nt, Homo sapiens
ucuucucuauuauaagcugggu

SEQ ID NO: 11717 - RNA, 22 nt, Homo sapiens
caguauauggugguagaggcac

SEQ ID NO: 11718 - RNA, 22 nt, Homo sapiens
cagcagcaauucauguuuugaa

SEQ ID NO: 11719 - RNA, 22 nt, Homo sapiens
ucaaaacgugaggcgcugcuau

SEQ ID NO: 11720 - RNA, 22 nt, Homo sapiens
gcggggaggaugaggggcacug

SEQ ID NO: 11721 - RNA, 22 nt, Homo sapiens
ugucccggcucuauccccagcu

SEQ ID NO: 11722 - RNA, 22 nt, Homo sapiens
aacacaggggcaggcaguggac

SEQ ID NO: 11723 - RNA, 22 nt, Homo sapiens
guguuugucuccuuuguguccu

SEQ ID NO: 11724 - RNA, 22 nt, Homo sapiens
ugaccuucauccacuaaagaag

SEQ ID NO: 11725 - RNA, 22 nt, Homo sapiens
ucgcaaguggaggaaggcucau

SEQ ID NO: 11726 - RNA, 22 nt, Homo sapiens
gauuaggaagagggcagugcuu

SEQ ID NO: 11727 - RNA, 22 nt, Homo sapiens
gugcucuccucuccugcaucug

SEQ ID NO: 11728 - RNA, 22 nt, Homo sapiens
gauggggaaagggagggaacga

SEQ ID NO: 11729 - RNA, 22 nt, Homo sapiens
uuccauccucuucccucauccu

SEQ ID NO: 11730 - RNA, 22 nt, Homo sapiens
agccugcauuugucucucuauc

SEQ ID NO: 11731 - RNA, 22 nt, Homo sapiens
uguagagauagauguggccugg

SEQ ID NO: 11732 - RNA, 22 nt, Homo sapiens
ggcaggcagagcgccaugcuuc

SEQ ID NO: 11733 - RNA, 20 nt, Homo sapiens
gccauggccucugcccugcc

SEQ ID NO: 11734 - RNA, 22 nt, Homo sapiens
caggccuuggagguagcacgcg

SEQ ID NO: 11735 - RNA, 22 nt, Homo sapiens
cugcuggacucugaagucugug

SEQ ID NO: 11736 - RNA, 22 nt, Homo sapiens
ucccuggcugguggaagggcau

SEQ ID NO: 11737 - RNA, 22 nt, Homo sapiens
ccucucucgcuaaccaggugau

SEQ ID NO: 11738 - RNA, 22 nt, Homo sapiens
accagcaugacucuagcaugcu

SEQ ID NO: 11739 - RNA, 22 nt, Homo sapiens
ccuuugcagcuaaggucagacu

SEQ ID NO: 11740 - RNA, 22 nt, Homo sapiens
uggcucacuucccaggcggugg

SEQ ID NO: 11741 - RNA, 22 nt, Homo sapiens
agcaccguugggaggugagggc

SEQ ID NO: 11742 - RNA, 22 nt, Homo sapiens
uucaggacgguuggcugaaugg

SEQ ID NO: 11743 - RNA, 22 nt, Homo sapiens
uuuagccacaugugcugaaugu

SEQ ID NO: 11744 - RNA, 22 nt, Homo sapiens
uccacucucauggaauuuccau

SEQ ID NO: 11745 - RNA, 22 nt, Homo sapiens
gaagaguuuaugagaguuugag

SEQ ID NO: 11746 - RNA, 22 nt, Homo sapiens
gccugugguucauugauucuga

SEQ ID NO: 11747 - RNA, 22 nt, Homo sapiens
aucuacagugaucacaaggcga

SEQ ID NO: 11748 - RNA, 22 nt, Homo sapiens
uguguuugcauguuggaguugg

SEQ ID NO: 11749 - RNA, 22 nt, Homo sapiens
ucaauuucaaugcaacgcugca

SEQ ID NO: 11750 - RNA, 22 nt, Homo sapiens
ugugguuacucagaaaccagca

SEQ ID NO: 11751 - RNA, 22 nt, Homo sapiens
ugguuuacagaguaaaccaaua

SEQ ID NO: 11752 - RNA, 22 nt, Homo sapiens
ugggcagaggugaggggcuggg

SEQ ID NO: 11753 - RNA, 22 nt, Homo sapiens
caccccuccuguguuccagcuc

SEQ ID NO: 11754 - RNA, 22 nt, Homo sapiens
uauaacuugcacuguaggaaug

SEQ ID NO: 11755 - RNA, 22 nt, Homo sapiens
uccuacaaugcagguuaaaucu

SEQ ID NO: 11756 - RNA, 22 nt, Homo sapiens
uuuaccugauagauuaggaugg

SEQ ID NO: 11757 - RNA, 22 nt, Homo sapiens
ucuugcucuauuaggcaaauga

SEQ ID NO: 11758 - RNA, 22 nt, Homo sapiens
aaggggacagugagugugcuug

SEQ ID NO: 11759 - RNA, 22 nt, Homo sapiens
ugagagaaccacugcuuccuuc

SEQ ID NO: 11760 - RNA, 22 nt, Homo sapiens
ggcuccaaaccacaugcuggac

SEQ ID NO: 11761 - RNA, 22 nt, Homo sapiens
uccauaugugccuuuugagagc

SEQ ID NO: 11762 - RNA, 22 nt, Homo sapiens
caagacucuagcagggcaguug

SEQ ID NO: 11763 - RNA, 22 nt, Homo sapiens
ucccaugccucuggggucaucu

SEQ ID NO: 11764 - RNA, 22 nt, Homo sapiens
ugcccuguucauaccugccuag

SEQ ID NO: 11765 - RNA, 22 nt, Homo sapiens
aggugggugggacauuccaggc

SEQ ID NO: 11766 - RNA, 20 nt, Homo sapiens
auugacacuucugugaguag

SEQ ID NO: 11767 - RNA, 22 nt, Homo sapiens
ugauugacacuucugugaguag

SEQ ID NO: 11768 - RNA, 22 nt, Homo sapiens
uugauugacacuucugugagua

SEQ ID NO: 11769 - RNA, 20 nt, Homo sapiens
auugacacuucugugaguag

SEQ ID NO: 11770 - RNA, 22 nt, Homo sapiens
ugauugacacuucugugaguag

SEQ ID NO: 11771 - RNA, 22 nt, Homo sapiens
uugauugacacuucugugagua

SEQ ID NO: 11772 - RNA, 20 nt, Homo sapiens
auugacacuucugugaguag

SEQ ID NO: 11773 - RNA, 22 nt, Homo sapiens
ugauugacacuucugugaguag

SEQ ID NO: 11774 - RNA, 22 nt, Homo sapiens
uugauugacacuucugugagua

SEQ ID NO: 11775 - RNA, 22 nt, Homo sapiens
uugauuguugacauugguggca

SEQ ID NO: 11776 - RNA, 19 nt, Homo sapiens
caacugugaacauaucaag

SEQ ID NO: 11777 - RNA, 22 nt, Homo sapiens
uggguguggcugcccauugguc

SEQ ID NO: 11778 - RNA, 22 nt, Homo sapiens
gcuuguggcagcagguguaugu

SEQ ID NO: 11779 - RNA, 22 nt, Homo sapiens
uggguguggcugcccauugguc

SEQ ID NO: 11780 - RNA, 22 nt, Homo sapiens
gcuuguggcagcagguguaugu

SEQ ID NO: 11781 - RNA, 22 nt, Homo sapiens
ggacgccgaggagcugaagagu

SEQ ID NO: 11782 - RNA, 22 nt, Homo sapiens
uuuucagcuuccuucccucccu

SEQ ID NO: 11783 - RNA, 22 nt, Homo sapiens
ggguggaccgcgguuucugcug

SEQ ID NO: 11784 - RNA, 22 nt, Homo sapiens
aggggaaacugaggcagcccac

SEQ ID NO: 11785 - RNA, 22 nt, Homo sapiens
ugugugggcaaggcagccagcu

SEQ ID NO: 11786 - RNA, 22 nt, Homo sapiens
gagggcugccuugucaguaaau

SEQ ID NO: 11787 - RNA, 22 nt, Homo sapiens
uggguuauuuuuccucucaucu

SEQ ID NO: 11788 - RNA, 22 nt, Homo sapiens
aacugagggaaggcaccugaag

SEQ ID NO: 11789 - RNA, 22 nt, Homo sapiens
uuccccaggucaucagccagaa

SEQ ID NO: 11790 - RNA, 21 nt, Homo sapiens
ucuuugauuccuugagggagg

SEQ ID NO: 11791 - RNA, 22 nt, Homo sapiens
uuugcugccuugcuucuaacca

SEQ ID NO: 11792 - RNA, 20 nt, Homo sapiens
ucagaagugaggcaagcaaa

SEQ ID NO: 11793 - RNA, 22 nt, Homo sapiens
ggcaagcauuuacauugagaga

SEQ ID NO: 11794 - RNA, 22 nt, Homo sapiens
uucuucauuguugcucugccuc

SEQ ID NO: 11795 - RNA, 22 nt, Homo sapiens
ccucauguucagggaagaccag

SEQ ID NO: 11796 - RNA, 22 nt, Homo sapiens
gcuguuuucccgaguggugggu

SEQ ID NO: 11797 - RNA, 22 nt, Homo sapiens
ugagcccacuuggacagagguc

SEQ ID NO: 11798 - RNA, 22 nt, Homo sapiens
cugguccaggccuggagcucag

SEQ ID NO: 11799 - RNA, 22 nt, Homo sapiens
aggauucaggagcagccuccca

SEQ ID NO: 11800 - RNA, 22 nt, Homo sapiens
ucugcugucccugacugucacu

SEQ ID NO: 11801 - RNA, 22 nt, Homo sapiens
uuguuccuccauuacacugucc

SEQ ID NO: 11802 - RNA, 22 nt, Homo sapiens
caguguaaugaguugggagagc

SEQ ID NO: 11803 - RNA, 22 nt, Homo sapiens
uugguaacucuggagcaagggc

SEQ ID NO: 11804 - RNA, 22 nt, Homo sapiens
cccugcuccaggucaccugggg

SEQ ID NO: 11805 - RNA, 22 nt, Homo sapiens
ugaagauagauggauucccuua

SEQ ID NO: 11806 - RNA, 22 nt, Homo sapiens
ggggaugcccucuaucugcaau

SEQ ID NO: 11807 - RNA, 22 nt, Homo sapiens
ucacccuuccuucuacagagca

SEQ ID NO: 11808 - RNA, 22 nt, Homo sapiens
uuaauagaaaaggaggcugugg

SEQ ID NO: 11809 - RNA, 22 nt, Homo sapiens
uggacuugaauuggcacugagu

SEQ ID NO: 11810 - RNA, 22 nt, Homo sapiens
uucagaugggguuugaguccua

SEQ ID NO: 11811 - RNA, 22 nt, Homo sapiens
gcccugugggggaacgggaggc

SEQ ID NO: 11812 - RNA, 22 nt, Homo sapiens
guccuggucuccucuagagugu

SEQ ID NO: 11813 - RNA, 22 nt, Homo sapiens
accucugggugccacugucugu

SEQ ID NO: 11814 - RNA, 22 nt, Homo sapiens
aggcagcuggcauccuaaggau

SEQ ID NO: 11815 - RNA, 22 nt, Homo sapiens
caugugggucaguucauucuca

SEQ ID NO: 11816 - RNA, 22 nt, Homo sapiens
gcauuggcuguucccaaaugug

SEQ ID NO: 11817 - RNA, 18 nt, Homo sapiens
ucuacagugcacgugucu

SEQ ID NO: 11818 - RNA, 22 nt, Homo sapiens
uggagacgcggcccuguuggag

SEQ ID NO: 11819 - RNA, 22 nt, Homo sapiens
uaaucccuuugugccugugggg

SEQ ID NO: 11820 - RNA, 22 nt, Homo sapiens
cacagggcacacaggugagaaa

SEQ ID NO: 11821 - RNA, 22 nt, Homo sapiens
ccuccccugcccuggcuuggga

SEQ ID NO: 11822 - RNA, 21 nt, Homo sapiens
cgagcuaggaugggaggaggc

SEQ ID NO: 11823 - RNA, 22 nt, Homo sapiens
agggagggagcaggagagggaa

SEQ ID NO: 11824 - RNA, 20 nt, Homo sapiens
ccucccucucuccacucccu

SEQ ID NO: 11825 - RNA, 22 nt, Homo sapiens
ugcacuugaggccaaggaaggu

SEQ ID NO: 11826 - RNA, 22 nt, Homo sapiens
uacuauuuaggccucaggguau

SEQ ID NO: 11827 - RNA, 22 nt, Homo sapiens
gccagaugcagaaaccaaagag

SEQ ID NO: 11828 - RNA, 22 nt, Homo sapiens
uuuauaguuugugcauuuggau

SEQ ID NO: 11829 - RNA, 22 nt, Homo sapiens
cguucagucagagaaaaauuug

SEQ ID NO: 11830 - RNA, 22 nt, Homo sapiens
cagauccucucucugcaacggu

SEQ ID NO: 11831 - RNA, 22 nt, Homo sapiens
ugcugugaguuaccuuugguua

SEQ ID NO: 11832 - RNA, 22 nt, Homo sapiens
cccaugguggcuccaagugccc

SEQ ID NO: 11833 - RNA, 22 nt, Homo sapiens
uggcguuuccuguucugggugc

SEQ ID NO: 11834 - RNA, 22 nt, Homo sapiens
uacuuagagucgggaugcacaa

SEQ ID NO: 11835 - RNA, 22 nt, Homo sapiens
agguucugcucugggcugaaga

SEQ ID NO: 11836 - RNA, 22 nt, Homo sapiens
ucugugcccagaccagcccugc

SEQ ID NO: 11837 - RNA, 22 nt, Homo sapiens
uugcucaucccccagugccuca

SEQ ID NO: 11838 - RNA, 22 nt, Homo sapiens
agugcaguggagggauagaagc

SEQ ID NO: 11839 - RNA, 22 nt, Homo sapiens
ggggaggggcaaacagguugga

SEQ ID NO: 11840 - RNA, 22 nt, Homo sapiens
uccaggcuguuguuucucuccu

SEQ ID NO: 11841 - RNA, 22 nt, Homo sapiens
agaaaagcaacguugaagaugc

SEQ ID NO: 11842 - RNA, 22 nt, Homo sapiens
auuugcagagcgugcuuaucau

SEQ ID NO: 11843 - RNA, 22 nt, Homo sapiens
uguuucugaccuucccaccauu

SEQ ID NO: 11844 - RNA, 22 nt, Homo sapiens
ugugguaggugucaggaaagag

SEQ ID NO: 11845 - RNA, 22 nt, Homo sapiens
uugauacuucuuucauccuauc

SEQ ID NO: 11846 - RNA, 22 nt, Homo sapiens
uaggaugaaggaagguucauca

SEQ ID NO: 11847 - RNA, 22 nt, Homo sapiens
aggcagcaaugaaauagugcuc

SEQ ID NO: 11848 - RNA, 21 nt, Homo sapiens
agcaauuucagagcgugccug

SEQ ID NO: 11849 - RNA, 22 nt, Homo sapiens
ucgaggcuagagucacgcuugg

SEQ ID NO: 11850 - RNA, 21 nt, Homo sapiens
ugagugugcuagaguccucga

SEQ ID NO: 11851 - RNA, 22 nt, Homo sapiens
ggggagccagacaugcccacau

SEQ ID NO: 11852 - RNA, 22 nt, Homo sapiens
ucugaggcugaugggucucccc

SEQ ID NO: 11853 - RNA, 22 nt, Homo sapiens
ugagcuuagaagucaggcaggc

SEQ ID NO: 11854 - RNA, 22 nt, Homo sapiens
gcacugccguuuucuaacuaua

SEQ ID NO: 11855 - RNA, 22 nt, Homo sapiens
ugagcuuagaagucaggcaggc

SEQ ID NO: 11856 - RNA, 22 nt, Homo sapiens
gcacugccguuuucuaacuaua

SEQ ID NO: 11857 - RNA, 22 nt, Homo sapiens
ugagcuuagaagucaggcaggc

SEQ ID NO: 11858 - RNA, 22 nt, Homo sapiens
gcacugccguuuucuaacuaua

SEQ ID NO: 11859 - RNA, 22 nt, Homo sapiens
uaagcauccaucucuucuucac

SEQ ID NO: 11860 - RNA, 22 nt, Homo sapiens
gaaagaugaagauguuuaagga

SEQ ID NO: 11861 - RNA, 22 nt, Homo sapiens
gcagccugguguggugugcugg

SEQ ID NO: 11862 - RNA, 22 nt, Homo sapiens
aguaacugccaauccaugguug

SEQ ID NO: 11863 - RNA, 22 nt, Homo sapiens
aggaaguggcugggcuggguug

SEQ ID NO: 11864 - RNA, 22 nt, Homo sapiens
ccaggcucgcuccgucacuucc

SEQ ID NO: 11865 - RNA, 22 nt, Homo sapiens
ucagaugccacagagaacgaga

SEQ ID NO: 11866 - RNA, 22 nt, Homo sapiens
ucugucuuugugugcaucugug

SEQ ID NO: 11867 - RNA, 22 nt, Homo sapiens
uccccggcgcgccuucccgcgg

SEQ ID NO: 11868 - RNA, 22 nt, Homo sapiens
cgggccaggcggcccgggagca

SEQ ID NO: 11869 - RNA, 22 nt, Homo sapiens
ggguucuuuaagugccugugau

SEQ ID NO: 11870 - RNA, 22 nt, Homo sapiens
ucacaggcauuuaaagcacugu

SEQ ID NO: 11871 - RNA, 22 nt, Homo sapiens
ggaaagcugaguggcagcuugc

SEQ ID NO: 11872 - RNA, 20 nt, Homo sapiens
ugcgcugucaaagucuuucc

SEQ ID NO: 11873 - RNA, 22 nt, Homo sapiens
aaaaugguucccuuuagagugu

SEQ ID NO: 11874 - RNA, 23 nt, Homo sapiens
aaaaugguucccuuuagaguguu

SEQ ID NO: 11875 - RNA, 20 nt, Homo sapiens
cucuagagggaagcgcuuuc

SEQ ID NO: 11876 - RNA, 24 nt, Homo sapiens
cucuagagggaagcgcuuucuguu

SEQ ID NO: 11877 - RNA, 20 nt, Homo sapiens
aaagcgcuucccuucagagu

SEQ ID NO: 11878 - RNA, 21 nt, Homo sapiens
aaagcgcuucccuucagagug

SEQ ID NO: 11879 - RNA, 22 nt, Homo sapiens
aaagcgcuucccuucagagugu

SEQ ID NO: 11880 - RNA, 20 nt, Homo sapiens
aagcgcuucccuucagagug

SEQ ID NO: 11881 - RNA, 20 nt, Homo sapiens
cucuagagggaagcgcuuuc

SEQ ID NO: 11882 - RNA, 24 nt, Homo sapiens
cucuagagggaagcgcuuucuguu

SEQ ID NO: 11883 - RNA, 22 nt, Homo sapiens
agagugaucagggauugcaugg

SEQ ID NO: 11884 - RNA, 22 nt, Homo sapiens
auggcaaugcccuggcucuccu

SEQ ID NO: 11885 - RNA, 22 nt, Homo sapiens
gagggagggacgggggcugugc

SEQ ID NO: 11886 - RNA, 22 nt, Homo sapiens
ucuggcuccgugucuucacucc

SEQ ID NO: 11887 - RNA, 22 nt, Homo sapiens
uaugucaggccucauucuaccu

SEQ ID NO: 11888 - RNA, 22 nt, Homo sapiens
guagaaagaggccugauaaucu

SEQ ID NO: 11889 - RNA, 22 nt, Homo sapiens
acagaguguaaugagaaugcag

SEQ ID NO: 11890 - RNA, 20 nt, Homo sapiens
auucucauuacaaucuuugu

SEQ ID NO: 11891 - RNA, 22 nt, Homo sapiens
ucaagaacuuugaucagggagu

SEQ ID NO: 11892 - RNA, 22 nt, Homo sapiens
aagacuauuggugguucuugag

SEQ ID NO: 11893 - RNA, 22 nt, Homo sapiens
ccuuggccaucagggcagaugc

SEQ ID NO: 11894 - RNA, 20 nt, Homo sapiens
ucuccuuggugggcccaagg

SEQ ID NO: 11895 - RNA, 22 nt, Homo sapiens
ugggcuuuggaagccagggcaa

SEQ ID NO: 11896 - RNA, 22 nt, Homo sapiens
cucaggcccccaaagccaacag

SEQ ID NO: 11897 - RNA, 22 nt, Homo sapiens
uguucagugucuugguuggcug

SEQ ID NO: 11898 - RNA, 22 nt, Homo sapiens
ucagcugggacucuaaaccaga

SEQ ID NO: 11899 - RNA, 22 nt, Homo sapiens
ugagacagugugugcaggcacc

SEQ ID NO: 11900 - RNA, 20 nt, Homo sapiens
ccugacaugcugauucucau

SEQ ID NO: 11901 - RNA, 22 nt, Homo sapiens
cccucuaggagcuucagucugu

SEQ ID NO: 11902 - RNA, 22 nt, Homo sapiens
gaaaugaagugcuuagagaagg

SEQ ID NO: 11903 - RNA, 22 nt, Homo sapiens
uuuguuuugcucuuauauggug

SEQ ID NO: 11904 - RNA, 22 nt, Homo sapiens
cuaguaagacuaagacacuaag

SEQ ID NO: 11905 - RNA, 22 nt, Homo sapiens
uccauuguuuuuaaucgacucc

SEQ ID NO: 11906 - RNA, 22 nt, Homo sapiens
cguagaugcugaaacauggagg

SEQ ID NO: 11907 - RNA, 22 nt, Homo sapiens
aacauucauuguugucgguggg

SEQ ID NO: 11908 - RNA, 24 nt, Homo sapiens
aacauucauuguugucgguggguu

SEQ ID NO: 11909 - RNA, 22 nt, Homo sapiens
uaagggaagcuaugugguccag

SEQ ID NO: 11910 - RNA, 22 nt, Homo sapiens
gaccugaauggcuugccauuau

SEQ ID NO: 11911 - RNA, 22 nt, Homo sapiens
uagcuuagcacgguuuacuuaa

SEQ ID NO: 11912 - RNA, 22 nt, Homo sapiens
gaaagcuguguuggagaggcag

SEQ ID NO: 11913 - RNA, 22 nt, Homo sapiens
uauggucagacugccuggguaa

SEQ ID NO: 11914 - RNA, 22 nt, Homo sapiens
uacuuaguaucuggcuuuggac

SEQ ID NO: 11915 - RNA, 22 nt, Homo sapiens
ucuuguaccuugcagcacacuc

SEQ ID NO: 11916 - RNA, 22 nt, Homo sapiens
ugugccuguaagauguauuagc

SEQ ID NO: 11917 - RNA, 22 nt, Homo sapiens
ucuuguaccuugcagcacacuc

SEQ ID NO: 11918 - RNA, 22 nt, Homo sapiens
ugugccuguaagauguauuagc

SEQ ID NO: 11919 - RNA, 22 nt, Homo sapiens
ccccacccucgcugucccccgc

SEQ ID NO: 11920 - RNA, 18 nt, Homo sapiens
gggugcgaggcugugggg

SEQ ID NO: 11921 - RNA, 22 nt, Homo sapiens
ggccuaaagccagaagcaggaa

SEQ ID NO: 11922 - RNA, 22 nt, Homo sapiens
ucuuguaucuggaaagaggcau

SEQ ID NO: 11923 - RNA, 22 nt, Homo sapiens
ucccauuccuaguuccuuccgc

SEQ ID NO: 11924 - RNA, 22 nt, Homo sapiens
ucugcugaaaggaaguagggaa

SEQ ID NO: 11925 - RNA, 22 nt, Homo sapiens
ugcuagaguccaucaguuaagc

SEQ ID NO: 11926 - RNA, 22 nt, Homo sapiens
uaacugaugaacucuggcuguc

SEQ ID NO: 11927 - RNA, 22 nt, Homo sapiens
ugucuuuagccacuugccucuu

SEQ ID NO: 11928 - RNA, 22 nt, Homo sapiens
agugcacauggcugaagauagu

SEQ ID NO: 11929 - RNA, 22 nt, Homo sapiens
ugucuggaucagugggugcuug

SEQ ID NO: 11930 - RNA, 22 nt, Homo sapiens
gcugccucagugauugggaagg

SEQ ID NO: 11931 - RNA, 22 nt, Homo sapiens
ugaccccaaaacagcugguuaa

SEQ ID NO: 11932 - RNA, 22 nt, Homo sapiens
ugagugccagaugugggggauc

SEQ ID NO: 11933 - RNA, 22 nt, Homo sapiens
ucagcauggcagggauuaguag

SEQ ID NO: 11934 - RNA, 22 nt, Homo sapiens
uacucaguuccugccaugcccu

SEQ ID NO: 11935 - RNA, 22 nt, Homo sapiens
uggccucuggcagauaucaguc

SEQ ID NO: 11936 - RNA, 22 nt, Homo sapiens
ggacugaaucugcugagccagc

SEQ ID NO: 11937 - RNA, 22 nt, Homo sapiens
agcuuccuuccaugcugucacu

SEQ ID NO: 11938 - RNA, 22 nt, Homo sapiens
cacugugcguggagggaggugg

SEQ ID NO: 11939 - RNA, 22 nt, Homo sapiens
ccucuguuucucuucuaggccu

SEQ ID NO: 11940 - RNA, 22 nt, Homo sapiens
agccugguaagaggcacuggcu

SEQ ID NO: 11941 - RNA, 22 nt, Homo sapiens
uacccuccucuggccucccucc

SEQ ID NO: 11942 - RNA, 21 nt, Homo sapiens
guggggcugggggcgggggug

SEQ ID NO: 11943 - RNA, 22 nt, Homo sapiens
acagaggaccuagcaugugccc

SEQ ID NO: 11944 - RNA, 22 nt, Homo sapiens
gcaggugcagggcugcuguauc

SEQ ID NO: 11945 - RNA, 22 nt, Homo sapiens
ugccuuggaccacugugcuccc

SEQ ID NO: 11946 - RNA, 22 nt, Homo sapiens
ugguggcagguggcaggggcag

SEQ ID NO: 11947 - RNA, 22 nt, Homo sapiens
uagggugagcuuugaggaugac

SEQ ID NO: 11948 - RNA, 22 nt, Homo sapiens
uuguuuuccaagcugucccauu

SEQ ID NO: 11949 - RNA, 22 nt, Homo sapiens
ugcacucagcugccacuguccg

SEQ ID NO: 11950 - RNA, 22 nt, Homo sapiens
gagcauggcagcugagggcagg

SEQ ID NO: 11951 - RNA, 22 nt, Homo sapiens
accuccuccccucugauuugaa

SEQ ID NO: 11952 - RNA, 22 nt, Homo sapiens
uagaucagaggaagaaguaguu

SEQ ID NO: 11953 - RNA, 22 nt, Homo sapiens
uggagaagacuggagaggguau

SEQ ID NO: 11954 - RNA, 22 nt, Homo sapiens
ugccucucuggucuuuguccau

SEQ ID NO: 11955 - RNA, 22 nt, Homo sapiens
agcugggggacugcuuuaggag

SEQ ID NO: 11956 - RNA, 22 nt, Homo sapiens
ucccaugaggcgugucccuggg

SEQ ID NO: 11957 - RNA, 22 nt, Homo sapiens
uggcuguguccuagauuuauga

SEQ ID NO: 11958 - RNA, 22 nt, Homo sapiens
ugaagucuagauacaaaugcca

SEQ ID NO: 11959 - RNA, 22 nt, Homo sapiens
uggccuuggcagggcggacacg

SEQ ID NO: 11960 - RNA, 22 nt, Homo sapiens
ugugccgugucaaggccgggag

SEQ ID NO: 11961 - RNA, 22 nt, Homo sapiens
ccuugggcugcgguuuaagaca

SEQ ID NO: 11962 - RNA, 22 nt, Homo sapiens
uuugagcugacagcuauuuaag

SEQ ID NO: 11963 - RNA, 22 nt, Homo sapiens
ucccccagugcccaccucagug

SEQ ID NO: 11964 - RNA, 22 nt, Homo sapiens
ucuggggauggggcuggugagg

SEQ ID NO: 11965 - RNA, 22 nt, Homo sapiens
uucuuccuccgugggagcuggg

SEQ ID NO: 11966 - RNA, 22 nt, Homo sapiens
uuccucccacggaggccgggcc

SEQ ID NO: 11967 - RNA, 22 nt, Homo sapiens
cggcuuuggagauuauggggaa

SEQ ID NO: 11968 - RNA, 22 nt, Homo sapiens
ugcauuuucucauaaaacugcc

SEQ ID NO: 11969 - RNA, 22 nt, Homo sapiens
cggggccccccagugaaccucu

SEQ ID NO: 11970 - RNA, 22 nt, Homo sapiens
guggcacucugggggcuccucu

SEQ ID NO: 11971 - RNA, 22 nt, Homo sapiens
agauuugugcauguugaauuaa

SEQ ID NO: 11972 - RNA, 22 nt, Homo sapiens
uaauucaacgugcacaaauugu

SEQ ID NO: 11973 - RNA, 22 nt, Homo sapiens
ugucauguaaugugucauagca

SEQ ID NO: 11974 - RNA, 22 nt, Homo sapiens
ugcuaugcaugucauaugugag

SEQ ID NO: 11975 - RNA, 22 nt, Homo sapiens
uaggagucagucacuccuaucu

SEQ ID NO: 11976 - RNA, 22 nt, Homo sapiens
gcuaggagaguugucugauuuu

SEQ ID NO: 11977 - RNA, 22 nt, Homo sapiens
ugguuuucagaguggauugaaa

SEQ ID NO: 11978 - RNA, 22 nt, Homo sapiens
ugcuucaaaacauccuggaaau

SEQ ID NO: 11979 - RNA, 22 nt, Homo sapiens
uccucuccaccuccuguugcca

SEQ ID NO: 11980 - RNA, 22 nt, Homo sapiens
cagcagggagggggggaggagg

SEQ ID NO: 11981 - RNA, 22 nt, Homo sapiens
uuuagcgaggccuugauccaga

SEQ ID NO: 11982 - RNA, 22 nt, Homo sapiens
ugggccagggccucuggagcug

SEQ ID NO: 11983 - RNA, 22 nt, Homo sapiens
uggcuguauauauuuugcauau

SEQ ID NO: 11984 - RNA, 22 nt, Homo sapiens
ugcaaaguuguauacacaaagc

SEQ ID NO: 11985 - RNA, 22 nt, Homo sapiens
uaaaauggguaauugcacacac

SEQ ID NO: 11986 - RNA, 22 nt, Homo sapiens
uaugcaauuauccauuuugcau

SEQ ID NO: 11987 - RNA, 22 nt, Homo sapiens
acaaggcacguguguccugacc

SEQ ID NO: 11988 - RNA, 22 nt, Homo sapiens
ucccagauacugugucuuaacu

SEQ ID NO: 11989 - RNA, 22 nt, Homo sapiens
ugggcagugcuguucagaggag

SEQ ID NO: 11990 - RNA, 22 nt, Homo sapiens
ucuggaaguacuguuagcucag

SEQ ID NO: 11991 - RNA, 22 nt, Homo sapiens
gccccagcuuuccccacuuguc

SEQ ID NO: 11992 - RNA, 22 nt, Homo sapiens
aaagguggggagcuggggaaga

SEQ ID NO: 11993 - RNA, 22 nt, Homo sapiens
ugcuuagaaagcugucgucggg

SEQ ID NO: 11994 - RNA, 22 nt, Homo sapiens
uugaccauguagucaucugagu

SEQ ID NO: 11995 - RNA, 22 nt, Homo sapiens
ccuucacucauccucacggagg

SEQ ID NO: 11996 - RNA, 22 nt, Homo sapiens
ugcugugggaaugggaaugggg

SEQ ID NO: 11997 - RNA, 22 nt, Homo sapiens
gcaguuggugcugaaaaaaaau

SEQ ID NO: 11998 - RNA, 22 nt, Homo sapiens
acauuugcagugucaaccgccu

SEQ ID NO: 11999 - RNA, 22 nt, Homo sapiens
uacauuucuaguuucuaaacaa

SEQ ID NO: 12000 - RNA, 22 nt, Homo sapiens
uuuaugaaguggaaaugugguc

SEQ ID NO: 12001 - RNA, 22 nt, Homo sapiens
caccuacucccagggucaugca

SEQ ID NO: 12002 - RNA, 22 nt, Homo sapiens
ugcacaauccugugagugaguc

SEQ ID NO: 12003 - RNA, 22 nt, Homo sapiens
ugcuugaguauggaacuauggc

SEQ ID NO: 12004 - RNA, 19 nt, Homo sapiens
uccaugcuauguuuaagca

SEQ ID NO: 12005 - RNA, 22 nt, Homo sapiens
gauuuuucugugcuggagcacu

SEQ ID NO: 12006 - RNA, 22 nt, Homo sapiens
gaugauccagggcagagcuuca

SEQ ID NO: 12007 - RNA, 22 nt, Homo sapiens
uguauagucacuguuuucucag

SEQ ID NO: 12008 - RNA, 22 nt, Homo sapiens
gaaagcagugaugcauacagcu

SEQ ID NO: 12009 - RNA, 22 nt, Homo sapiens
caggauuuuaguaauugaaacu

SEQ ID NO: 12010 - RNA, 22 nt, Homo sapiens
uuucacuuauugacucccuguc

SEQ ID NO: 12011 - RNA, 22 nt, Homo sapiens
uugggagagggaagggauuucu

SEQ ID NO: 12012 - RNA, 22 nt, Homo sapiens
aucucuuccuccuacccccaag

SEQ ID NO: 12013 - RNA, 22 nt, Homo sapiens
gccuuuggaggccuccagcugg

SEQ ID NO: 12014 - RNA, 22 nt, Homo sapiens
gcuggaguucuccaaaggacuu

SEQ ID NO: 12015 - RNA, 22 nt, Homo sapiens
ugccuggcccccagggaccugg

SEQ ID NO: 12016 - RNA, 22 nt, Homo sapiens
cagguccccagggcucaggcug

SEQ ID NO: 12017 - RNA, 21 nt, Homo sapiens
gccccugggccuauccuagaa

SEQ ID NO: 12018 - RNA, 22 nt, Homo sapiens
uguucuagguauggucccaggg

SEQ ID NO: 12019 - RNA, 22 nt, Homo sapiens
cuagguauggucccagggaucc

SEQ ID NO: 12020 - RNA, 22 nt, Homo sapiens
uccauuuacuugcuucuucuga

SEQ ID NO: 12021 - RNA, 22 nt, Homo sapiens
aggaguaagugugaauggauaa

SEQ ID NO: 12022 - RNA, 22 nt, Homo sapiens
uguucccagagucuguuucuuc

SEQ ID NO: 12023 - RNA, 22 nt, Homo sapiens
agaggcaguccucggagcccaa

SEQ ID NO: 12024 - RNA, 22 nt, Homo sapiens
aaacagacagagccaggugggu

SEQ ID NO: 12025 - RNA, 22 nt, Homo sapiens
ucuccuggcucuuucuauuuuc

SEQ ID NO: 12026 - RNA, 22 nt, Homo sapiens
ugggggugagauauuuugcaua

SEQ ID NO: 12027 - RNA, 22 nt, Homo sapiens
gcggaauuucaucaacucccuu

SEQ ID NO: 12028 - RNA, 22 nt, Homo sapiens
uuucucauuucauaaugagaug

SEQ ID NO: 12029 - RNA, 22 nt, Homo sapiens
ucauaacgaaaugagagacuga

SEQ ID NO: 12030 - RNA, 22 nt, Homo sapiens
uauuuguaaggcagggccagua

SEQ ID NO: 12031 - RNA, 22 nt, Homo sapiens
cuggcucugcuuuacaaacagg

SEQ ID NO: 12032 - RNA, 22 nt, Homo sapiens
ucugaccuucgcguaccuuuaa

SEQ ID NO: 12033 - RNA, 22 nt, Homo sapiens
gggguaugugaagaucagagaa

SEQ ID NO: 12034 - RNA, 22 nt, Homo sapiens
ucagguuuugcuauaauggaua

SEQ ID NO: 12035 - RNA, 22 nt, Homo sapiens
ucuuuauagcauacauugacua

SEQ ID NO: 12036 - RNA, 22 nt, Homo sapiens
uaaaaaaugcaucuggugugug

SEQ ID NO: 12037 - RNA, 22 nt, Homo sapiens
aggaguuggauggauuuuuuau

SEQ ID NO: 12038 - RNA, 22 nt, Homo sapiens
ugggguauuguuuccgcugcca

SEQ ID NO: 12039 - RNA, 18 nt, Homo sapiens
uagcagcgggaacaguuc

SEQ ID NO: 12040 - RNA, 20 nt, Homo sapiens
uagcagcgggaacaguucug

SEQ ID NO: 12041 - RNA, 23 nt, Homo sapiens
uagcagcgggaacaguucugcag

SEQ ID NO: 12042 - RNA, 22 nt, Homo sapiens
uuugugauuuuagggcuguuuu

SEQ ID NO: 12043 - RNA, 18 nt, Homo sapiens
auggcucugagacacgga

SEQ ID NO: 12044 - RNA, 22 nt, Homo sapiens
ugacugauuacauuacauauug

SEQ ID NO: 12045 - RNA, 22 nt, Homo sapiens
guauguagugcaaucagucagg

SEQ ID NO: 12046 - RNA, 22 nt, Homo sapiens
agacagaagggagggagagugc

SEQ ID NO: 12047 - RNA, 22 nt, Homo sapiens
uucucucucccuuccgucuguu

SEQ ID NO: 12048 - RNA, 22 nt, Homo sapiens
uacaagucccaguaugcauugc

SEQ ID NO: 12049 - RNA, 22 nt, Homo sapiens
acugcaugcugggaccuguagu

SEQ ID NO: 12050 - RNA, 22 nt, Homo sapiens
acagcagaagguauuaguccau

SEQ ID NO: 12051 - RNA, 22 nt, Homo sapiens
uguucuaauauuuucagcuguu

SEQ ID NO: 12052 - RNA, 22 nt, Homo sapiens
uaauggaggagguaauaagaug

SEQ ID NO: 12053 - RNA, 22 nt, Homo sapiens
uuuaugcccuccuuuauaauua

SEQ ID NO: 12054 - RNA, 22 nt, Homo sapiens
uggggauuuugugguuugaaga

SEQ ID NO: 12055 - RNA, 22 nt, Homo sapiens
ucuuugaacuacagaaacccug

SEQ ID NO: 12056 - RNA, 22 nt, Homo sapiens
ugcuauuucccucaguugaggg

SEQ ID NO: 12057 - RNA, 22 nt, Homo sapiens
ucucaacuugggggagggggcg

SEQ ID NO: 12058 - RNA, 22 nt, Homo sapiens
gcacgcacuaaguguaugccaa

SEQ ID NO: 12059 - RNA, 22 nt, Homo sapiens
uggcauauacuuagugcaugcu

SEQ ID NO: 12060 - RNA, 22 nt, Homo sapiens
uagaaauuaggagguuaucccc

SEQ ID NO: 12061 - RNA, 22 nt, Homo sapiens
gguuugaguuucuaguuacuag

SEQ ID NO: 12062 - RNA, 22 nt, Homo sapiens
uagaaauuaggagguuaucccc

SEQ ID NO: 12063 - RNA, 22 nt, Homo sapiens
gguuugaguuucuaguuacuag

SEQ ID NO: 12064 - RNA, 22 nt, Homo sapiens
uuccagagaagagcucuguuuu

SEQ ID NO: 12065 - RNA, 22 nt, Homo sapiens
auuaggcaagcuuuuccuggag

SEQ ID NO: 12066 - RNA, 22 nt, Homo sapiens
aguguucuggaaaauugcuucu

SEQ ID NO: 12067 - RNA, 22 nt, Homo sapiens
aggcuuaguuuucagagacuua

SEQ ID NO: 12068 - RNA, 22 nt, Homo sapiens
uccauuugcuuauuuugcugag

SEQ ID NO: 12069 - RNA, 22 nt, Homo sapiens
agcgaaacaggcaaacggagaa

SEQ ID NO: 12070 - RNA, 22 nt, Homo sapiens
uaaucugggauauuuauuaggu

SEQ ID NO: 12071 - RNA, 22 nt, Homo sapiens
uaaugaaugucuuuuguuacuc

SEQ ID NO: 12072 - RNA, 22 nt, Homo sapiens
ugagagaugucuuaggaugguu

SEQ ID NO: 12073 - RNA, 22 nt, Homo sapiens
ucaucucagguacagauuuuag

SEQ ID NO: 12074 - RNA, 22 nt, Homo sapiens
uuucuuaucugcaggaggcauc

SEQ ID NO: 12075 - RNA, 19 nt, Homo sapiens
gucuccaugcagaaggaag

SEQ ID NO: 12076 - RNA, 22 nt, Homo sapiens
uuucccucugcagcccaaaaua

SEQ ID NO: 12077 - RNA, 22 nt, Homo sapiens
uuggggugacagagauggggag

SEQ ID NO: 12078 - RNA, 22 nt, Homo sapiens
agagccacgaacagggcugugc

SEQ ID NO: 12079 - RNA, 22 nt, Homo sapiens
agagagcccugaacguggcccu

SEQ ID NO: 12080 - RNA, 22 nt, Homo sapiens
ugauucucuagcugugauaaac

SEQ ID NO: 12081 - RNA, 22 nt, Homo sapiens
guuuagccauuuaggaauugga

SEQ ID NO: 12082 - RNA, 22 nt, Homo sapiens
uucaugggaaagaaucacuuaa

SEQ ID NO: 12083 - RNA, 22 nt, Homo sapiens
uagauguuuucuucccaggaga

SEQ ID NO: 12084 - RNA, 22 nt, Homo sapiens
ugauuucuaaucccuaguggag

SEQ ID NO: 12085 - RNA, 22 nt, Homo sapiens
uccaggugggcuagaaacaucu

SEQ ID NO: 12086 - RNA, 22 nt, Homo sapiens
ccagccccauccagaccagugg

SEQ ID NO: 12087 - RNA, 22 nt, Homo sapiens
uacugggaauuugguggggugg

SEQ ID NO: 12088 - RNA, 22 nt, Homo sapiens
ucccaucagacccuggggcucg

SEQ ID NO: 12089 - RNA, 22 nt, Homo sapiens
guccuagggucuucugggaacu

SEQ ID NO: 12090 - RNA, 22 nt, Homo sapiens
uacuuguguaucuagggagaug

SEQ ID NO: 12091 - RNA, 22 nt, Homo sapiens
ucucaaaugaugaguagguguu

SEQ ID NO: 12092 - RNA, 22 nt, Homo sapiens
uguaaggcacagcuguauaggc

SEQ ID NO: 12093 - RNA, 22 nt, Homo sapiens
caucgcagcagugcuuugauag

SEQ ID NO: 12094 - RNA, 22 nt, Homo sapiens
uccugggcaguuuugagugcua

SEQ ID NO: 12095 - RNA, 22 nt, Homo sapiens
cagucaauuugcugccauggga

SEQ ID NO: 12096 - RNA, 22 nt, Homo sapiens
aaugggucaagccagugcucuu

SEQ ID NO: 12097 - RNA, 22 nt, Homo sapiens
gagcacuggccuugguccuggg

SEQ ID NO: 12098 - RNA, 22 nt, Homo sapiens
uauggguaccaccucacugaau

SEQ ID NO: 12099 - RNA, 22 nt, Homo sapiens
gugccucgguagggugguaugc

SEQ ID NO: 12100 - RNA, 22 nt, Homo sapiens
acccagguguccaccuagggcc

SEQ ID NO: 12101 - RNA, 22 nt, Homo sapiens
ggccugauguccaccuggaguc

SEQ ID NO: 12102 - RNA, 22 nt, Homo sapiens
acagggguucuccuggaguacc

SEQ ID NO: 12103 - RNA, 22 nt, Homo sapiens
uacugcaggggaugcucugccu

SEQ ID NO: 12104 - RNA, 22 nt, Homo sapiens
uggcgcgugggggggucagcug

SEQ ID NO: 12105 - RNA, 22 nt, Homo sapiens
cuggaccccgcgcagugcucuc

SEQ ID NO: 12106 - RNA, 22 nt, Homo sapiens
caauugggcuagcugcucuuca

SEQ ID NO: 12107 - RNA, 22 nt, Homo sapiens
augagcgggugccuggcgucga

SEQ ID NO: 12108 - RNA, 22 nt, Homo sapiens
agggagcagcgcuggggccucc

SEQ ID NO: 12109 - RNA, 22 nt, Homo sapiens
ggccacaaugacugccccuugg

SEQ ID NO: 12110 - RNA, 22 nt, Homo sapiens
uaauagacuucauuaucuggcu

SEQ ID NO: 12111 - RNA, 20 nt, Homo sapiens
aauuagaugagaggcuauua

SEQ ID NO: 12112 - RNA, 22 nt, Homo sapiens
gauacaugagaugguugaccag

SEQ ID NO: 12113 - RNA, 22 nt, Homo sapiens
ugguccacuaacccucaguauc

SEQ ID NO: 12114 - RNA, 22 nt, Homo sapiens
acagucacccugggaguuuggu

SEQ ID NO: 12115 - RNA, 22 nt, Homo sapiens
uccaugcuuucagggucacugu

SEQ ID NO: 12116 - RNA, 22 nt, Homo sapiens
uggcagguuccgagaugaggag

SEQ ID NO: 12117 - RNA, 22 nt, Homo sapiens
cucugcauccgaacccgccacc

SEQ ID NO: 12118 - RNA, 22 nt, Homo sapiens
uaacucgcaacugugcuaacuu

SEQ ID NO: 12119 - RNA, 22 nt, Homo sapiens
aauucuagucaguuuggguuaa

SEQ ID NO: 12120 - RNA, 22 nt, Homo sapiens
uguuuuagcuggcccauuuuga

SEQ ID NO: 12121 - RNA, 17 nt, Homo sapiens
guggggcagcaaaagca

SEQ ID NO: 12122 - RNA, 22 nt, Homo sapiens
ugacagguaaacacuuguuuug

SEQ ID NO: 12123 - RNA, 22 nt, Homo sapiens
aaacacaaguguucuugacaca

SEQ ID NO: 12124 - RNA, 22 nt, Homo sapiens
uaauugggagagaagggaauua

SEQ ID NO: 12125 - RNA, 22 nt, Homo sapiens
uaauuucucagucucucucaua

SEQ ID NO: 12126 - RNA, 22 nt, Homo sapiens
uacuggagggagggaugguggu

SEQ ID NO: 12127 - RNA, 22 nt, Homo sapiens
acauccugcccuucagcuuugg

SEQ ID NO: 12128 - RNA, 22 nt, Homo sapiens
gggagaggcggcgcaggggccc

SEQ ID NO: 12129 - RNA, 22 nt, Homo sapiens
ggcccuugccugcacuccucgg

SEQ ID NO: 12130 - RNA, 22 nt, Homo sapiens
acugacucuggcuucagugugg

SEQ ID NO: 12131 - RNA, 22 nt, Homo sapiens
uaggcuggaggcaaagaggcag

SEQ ID NO: 12132 - RNA, 22 nt, Homo sapiens
ugggcugggaagcuggguauuu

SEQ ID NO: 12133 - RNA, 22 nt, Homo sapiens
aguggcucagcacccuccuugg

SEQ ID NO: 12134 - RNA, 22 nt, Homo sapiens
ucugguuuuggaggaaggaugc

SEQ ID NO: 12135 - RNA, 22 nt, Homo sapiens
cacucuuccccuuaccagaauc

SEQ ID NO: 12136 - RNA, 22 nt, Homo sapiens
aaggaagguaacugacaguugu

SEQ ID NO: 12137 - RNA, 22 nt, Homo sapiens
guauuuugucuaucuuuugcau

SEQ ID NO: 12138 - RNA, 22 nt, Homo sapiens
ugaaaccccaagagaauccauc

SEQ ID NO: 12139 - RNA, 22 nt, Homo sapiens
auggauuccggguguuuugggg

SEQ ID NO: 12140 - RNA, 22 nt, Homo sapiens
uccaaggggaugcuauggggaa

SEQ ID NO: 12141 - RNA, 22 nt, Homo sapiens
uuuccccauagacuccccacag

SEQ ID NO: 12142 - RNA, 22 nt, Homo sapiens
uggggagagcugagggagcugu

SEQ ID NO: 12143 - RNA, 20 nt, Homo sapiens
cuuccuuuauuucacuccac

SEQ ID NO: 12144 - RNA, 22 nt, Homo sapiens
uauuguuuaauauauaugugug

SEQ ID NO: 12145 - RNA, 22 nt, Homo sapiens
guguauauauauguaaacuaaa

SEQ ID NO: 12146 - RNA, 22 nt, Homo sapiens
uaggcacuguuuuugcugaggu

SEQ ID NO: 12147 - RNA, 20 nt, Homo sapiens
ucaguggaaaugaggccugc

SEQ ID NO: 12148 - RNA, 22 nt, Homo sapiens
gcagggagcacagagaugaaga

SEQ ID NO: 12149 - RNA, 20 nt, Homo sapiens
ucuaucuuugaguccucugc

SEQ ID NO: 12150 - RNA, 22 nt, Homo sapiens
uggcaguugaaggagcuuugaa

SEQ ID NO: 12151 - RNA, 22 nt, Homo sapiens
aggccucuuugccugcacacuc

SEQ ID NO: 12152 - RNA, 22 nt, Homo sapiens
agaguccagcaucucagaggcc

SEQ ID NO: 12153 - RNA, 22 nt, Homo sapiens
ucuuuguagaagcugaacucug

SEQ ID NO: 12154 - RNA, 22 nt, Homo sapiens
acacucaggagcaugucucucu

SEQ ID NO: 12155 - RNA, 22 nt, Homo sapiens
aagagagacaucugagucagac

SEQ ID NO: 12156 - RNA, 22 nt, Homo sapiens
cgggaaccgggagggagcgggc

SEQ ID NO: 12157 - RNA, 22 nt, Homo sapiens
ccgcgaccccucugggacccgc

SEQ ID NO: 12158 - RNA, 22 nt, Homo sapiens
uaugccauggaaucaccuccag

SEQ ID NO: 12159 - RNA, 22 nt, Homo sapiens
uggaaaggauuccgugauacag

SEQ ID NO: 12160 - RNA, 22 nt, Homo sapiens
acucaucaacuuguuuuuuugc

SEQ ID NO: 12161 - RNA, 22 nt, Homo sapiens
gcaagagcaaugugauaagucc

SEQ ID NO: 12162 - RNA, 22 nt, Homo sapiens
uuugccacccccagagccuuga

SEQ ID NO: 12163 - RNA, 20 nt, Homo sapiens
ucaagggucacaggggcaga

SEQ ID NO: 12164 - RNA, 22 nt, Homo sapiens
auggcuauuccauugaaaguca

SEQ ID NO: 12165 - RNA, 22 nt, Homo sapiens
uccuucaaugggaaaagccagg

SEQ ID NO: 12166 - RNA, 22 nt, Homo sapiens
acuucuccccuugaagaagcag

SEQ ID NO: 12167 - RNA, 22 nt, Homo sapiens
ugcuuuuugagggaagggagga

SEQ ID NO: 12168 - RNA, 22 nt, Homo sapiens
uuuaguuauggucgcccuggua

SEQ ID NO: 12169 - RNA, 22 nt, Homo sapiens
cggguugacuauaaaugaaggc

SEQ ID NO: 12170 - RNA, 22 nt, Homo sapiens
uagcgaaagggauucuggccaa

SEQ ID NO: 12171 - RNA, 22 nt, Homo sapiens
uggcacagaauuauugauuggc

SEQ ID NO: 12172 - RNA, 22 nt, Homo sapiens
ugggugaggcauuuuauuuguu

SEQ ID NO: 12173 - RNA, 22 nt, Homo sapiens
caaauuagagccucccauuuua

SEQ ID NO: 12174 - RNA, 22 nt, Homo sapiens
ugggugaggcauuuuauuuguu

SEQ ID NO: 12175 - RNA, 22 nt, Homo sapiens
caaauuagagccucccauuuua

SEQ ID NO: 12176 - RNA, 22 nt, Homo sapiens
uuuugcugaaugauuucuggug

SEQ ID NO: 12177 - RNA, 22 nt, Homo sapiens
aaucccagagauaaagcacaga

SEQ ID NO: 12178 - RNA, 22 nt, Homo sapiens
ucagcacagacagccaacguuc

SEQ ID NO: 12179 - RNA, 22 nt, Homo sapiens
acgugagugucugaugguggug

SEQ ID NO: 12180 - RNA, 22 nt, Homo sapiens
ugcugaguauuuccucuauagc

SEQ ID NO: 12181 - RNA, 22 nt, Homo sapiens
guguagagcaaacacucggugc

SEQ ID NO: 12182 - RNA, 22 nt, Homo sapiens
ugcaggaagggcgccugccuua

SEQ ID NO: 12183 - RNA, 19 nt, Homo sapiens
gggggugcccugcccugca

SEQ ID NO: 12184 - RNA, 22 nt, Homo sapiens
cgcucgaugaggcccacgaggu

SEQ ID NO: 12185 - RNA, 21 nt, Homo sapiens
cucgcgggccucggacgagcg

SEQ ID NO: 12186 - RNA, 22 nt, Homo sapiens
ccagucagugugggaugggcca

SEQ ID NO: 12187 - RNA, 22 nt, Homo sapiens
ggcauccuccacugaccaggca

SEQ ID NO: 12188 - RNA, 22 nt, Homo sapiens
ggguggguugggagggguugua

SEQ ID NO: 12189 - RNA, 22 nt, Homo sapiens
cuuccccuccuccccguucccc

SEQ ID NO: 12190 - RNA, 22 nt, Homo sapiens
uggguuggggagagaugaagac

SEQ ID NO: 12191 - RNA, 22 nt, Homo sapiens
uucuucucuuguucccccaggg

SEQ ID NO: 12192 - RNA, 22 nt, Homo sapiens
uaaugcaucuucccccucagac

SEQ ID NO: 12193 - RNA, 22 nt, Homo sapiens
acugaggugaagucagcauugg

SEQ ID NO: 12194 - RNA, 22 nt, Homo sapiens
ccaguaauaaagagccugcaaa

SEQ ID NO: 12195 - RNA, 22 nt, Homo sapiens
aguaaaaucuuuauugcuggug

SEQ ID NO: 12196 - RNA, 22 nt, Homo sapiens
aaagcccuagguggucacagcc

SEQ ID NO: 12197 - RNA, 22 nt, Homo sapiens
cuggugcuguccuggggguugc

SEQ ID NO: 12198 - RNA, 22 nt, Homo sapiens
ucuuaggcaguuccagaguuuu

SEQ ID NO: 12199 - RNA, 22 nt, Homo sapiens
gcucugggaauugccagauauc

SEQ ID NO: 12200 - RNA, 22 nt, Homo sapiens
uccugagccaugaugggcccca

SEQ ID NO: 12201 - RNA, 22 nt, Homo sapiens
uguggcagcaucauggugucca

SEQ ID NO: 12202 - RNA, 22 nt, Homo sapiens
uaagaguagaggaguuaaagag

SEQ ID NO: 12203 - RNA, 22 nt, Homo sapiens
uuugacccuguuauucucccug

SEQ ID NO: 12204 - RNA, 22 nt, Homo sapiens
agguggagcaguguugggugaa

SEQ ID NO: 12205 - RNA, 21 nt, Homo sapiens
accugacacugcaacccauuu

SEQ ID NO: 12206 - RNA, 22 nt, Homo sapiens
aggccucugaggagcugcguga

SEQ ID NO: 12207 - RNA, 22 nt, Homo sapiens
cagucaggccccuuagggagcc

SEQ ID NO: 12208 - RNA, 22 nt, Homo sapiens
ggggagaaggcacaacacagcu

SEQ ID NO: 12209 - RNA, 22 nt, Homo sapiens
uugcaguuguugcugcuucugc

SEQ ID NO: 12210 - RNA, 22 nt, Homo sapiens
ucucuaucccagagcuccagaa

SEQ ID NO: 12211 - RNA, 20 nt, Homo sapiens
uggggcugggagcaggagac

SEQ ID NO: 12212 - RNA, 22 nt, Homo sapiens
ucuuguugccacugccuggccu

SEQ ID NO: 12213 - RNA, 22 nt, Homo sapiens
gcucagcgguggcagcagacga

SEQ ID NO: 12214 - RNA, 22 nt, Homo sapiens
ggccgagggggcugggcgggcu

SEQ ID NO: 12215 - RNA, 22 nt, Homo sapiens
gaucuguuucaggucuccucgc

SEQ ID NO: 12216 - RNA, 22 nt, Homo sapiens
ugcugaacccucgagggucuga

SEQ ID NO: 12217 - RNA, 22 nt, Homo sapiens
ggcuuuccugaggguguggcgg

SEQ ID NO: 12218 - RNA, 22 nt, Homo sapiens
ucauucuugcaucucugggguc

SEQ ID NO: 12219 - RNA, 22 nt, Homo sapiens
ccagagggugcaggggaggcaa

SEQ ID NO: 12220 - RNA, 22 nt, Homo sapiens
agaaaucagucauuaccauaga

SEQ ID NO: 12221 - RNA, 22 nt, Homo sapiens
uacuguuaaugaccuauuucuu

SEQ ID NO: 12222 - RNA, 22 nt, Homo sapiens
uucuuaaacaccaaaggaugug

SEQ ID NO: 12223 - RNA, 21 nt, Homo sapiens
uguucuuugguguagaaggac

SEQ ID NO: 12224 - RNA, 22 nt, Homo sapiens
uaaugccccuaaaaauccuuau

SEQ ID NO: 12225 - RNA, 22 nt, Homo sapiens
ugagggacuuuugggggcagau

SEQ ID NO: 12226 - RNA, 22 nt, Homo sapiens
auaaugccccuaaaaauccuua

SEQ ID NO: 12227 - RNA, 20 nt, Homo sapiens
uaaugccccuaaaaauccuu

SEQ ID NO: 12228 - RNA, 19 nt, Homo sapiens
ugccccuaaaaauccuuau

SEQ ID NO: 12229 - RNA, 22 nt, Homo sapiens
ugaaaaacgugcaaacugucuu

SEQ ID NO: 12230 - RNA, 22 nt, Homo sapiens
gacaguuugcaagcgugauuca

SEQ ID NO: 12231 - RNA, 22 nt, Homo sapiens
ggcugaauucgcaggcccaagg

SEQ ID NO: 12232 - RNA, 22 nt, Homo sapiens
ugggccuugagaaucauguuuc

SEQ ID NO: 12233 - RNA, 22 nt, Homo sapiens
aagagcacgcucuauuuaggag

SEQ ID NO: 12234 - RNA, 22 nt, Homo sapiens
uccuaacuauaaaguggcuccu

SEQ ID NO: 12235 - RNA, 22 nt, Homo sapiens
uaaagagauggagagaggccau

SEQ ID NO: 12236 - RNA, 22 nt, Homo sapiens
ugaccuacuuuucccucucaua

SEQ ID NO: 12237 - RNA, 22 nt, Homo sapiens
ucacagcuugguaucaccagcu

SEQ ID NO: 12238 - RNA, 22 nt, Homo sapiens
agcugggauguugauguuguac

SEQ ID NO: 12239 - RNA, 22 nt, Homo sapiens
cggguuuuggaucuauuugauc

SEQ ID NO: 12240 - RNA, 22 nt, Homo sapiens
acugaucaaguuccuaauccug

SEQ ID NO: 12241 - RNA, 22 nt, Homo sapiens
acaccuuucucuuguacaguuu

SEQ ID NO: 12242 - RNA, 22 nt, Homo sapiens
aacuguaaaagaaaggugucac

SEQ ID NO: 12243 - RNA, 22 nt, Homo sapiens
ucuaauaacuacagcccuucag

SEQ ID NO: 12244 - RNA, 20 nt, Homo sapiens
ucagggguugagagguuaga

SEQ ID NO: 12245 - RNA, 22 nt, Homo sapiens
cccugcugacguuuuggcucug

SEQ ID NO: 12246 - RNA, 22 nt, Homo sapiens
gcuaaagcaucugcagcaucuu

SEQ ID NO: 12247 - RNA, 22 nt, Homo sapiens
ggguuggaggccugcguguccc

SEQ ID NO: 12248 - RNA, 22 nt, Homo sapiens
gggucugagggucccaggcuuc

SEQ ID NO: 12249 - RNA, 22 nt, Homo sapiens
ugaccugauuuugaacugcaac

SEQ ID NO: 12250 - RNA, 22 nt, Homo sapiens
gugcggucacagugagguggcc

SEQ ID NO: 12251 - RNA, 22 nt, Homo sapiens
caaauuacuuaucucuguuccg

SEQ ID NO: 12252 - RNA, 22 nt, Homo sapiens
ccaaugaagauaguaaaaaugc

SEQ ID NO: 12253 - RNA, 22 nt, Homo sapiens
cagccaaacccaaacuccagac

SEQ ID NO: 12254 - RNA, 21 nt, Homo sapiens
ugggguuuugguggcggcugu

SEQ ID NO: 12255 - RNA, 22 nt, Homo sapiens
uggccccucaucugguuucaug

SEQ ID NO: 12256 - RNA, 22 nt, Homo sapiens
augagagugacagggguuagaa

SEQ ID NO: 12257 - RNA, 22 nt, Homo sapiens
ggcagggcagugccagacgggg

SEQ ID NO: 12258 - RNA, 22 nt, Homo sapiens
uuaugcugguagaugcccugcu

SEQ ID NO: 12259 - RNA, 22 nt, Homo sapiens
ccauauuuuuuaaaguguuguc

SEQ ID NO: 12260 - RNA, 22 nt, Homo sapiens
cauuccugcucgaaaagaugug

SEQ ID NO: 12261 - RNA, 22 nt, Homo sapiens
aaaaccaggauuuuguuuugcc

SEQ ID NO: 12262 - RNA, 22 nt, Homo sapiens
uaagauagaauucuggcaguua

SEQ ID NO: 12263 - RNA, 22 nt, Homo sapiens
ugggugugggcaggcuggacag

SEQ ID NO: 12264 - RNA, 22 nt, Homo sapiens
ugucagcacccugcccacaugc

SEQ ID NO: 12265 - RNA, 22 nt, Homo sapiens
agccauguguuccacaggccuc

SEQ ID NO: 12266 - RNA, 22 nt, Homo sapiens
gggcacugugacauguggcucc

SEQ ID NO: 12267 - RNA, 22 nt, Homo sapiens
agccauguguuccacaggccuc

SEQ ID NO: 12268 - RNA, 22 nt, Homo sapiens
gggcacugugacauguggcucc

SEQ ID NO: 12269 - RNA, 22 nt, Homo sapiens
acuggaagucuuuggaaguggg

SEQ ID NO: 12270 - RNA, 22 nt, Homo sapiens
uguuuccagagcaacccuuaga

SEQ ID NO: 12271 - RNA, 22 nt, Homo sapiens
gccuccuuuguaaaauggagaa

SEQ ID NO: 12272 - RNA, 22 nt, Homo sapiens
uucucuuuuacaggggaggaaa

SEQ ID NO: 12273 - RNA, 22 nt, Homo sapiens
cauauacaaagagagaaugcau

SEQ ID NO: 12274 - RNA, 22 nt, Homo sapiens
ugcagucucuuuuguguagcau

SEQ ID NO: 12275 - RNA, 22 nt, Homo sapiens
ugaagugggggcucugaagggc

SEQ ID NO: 12276 - RNA, 22 nt, Homo sapiens
uaaccuuuggaagucccugacu

SEQ ID NO: 12277 - RNA, 22 nt, Homo sapiens
agguuucaaggcuguugguuug

SEQ ID NO: 12278 - RNA, 22 nt, Homo sapiens
accaguggccuuaagaaauagg

SEQ ID NO: 12279 - RNA, 22 nt, Homo sapiens
uccccaaggcuuccaggcauuu

SEQ ID NO: 12280 - RNA, 16 nt, Homo sapiens
cuccggagcagggggg

SEQ ID NO: 12281 - RNA, 22 nt, Homo sapiens
aggugauguaaggcuggggagg

SEQ ID NO: 12282 - RNA, 22 nt, Homo sapiens
uccucauucuugcaucccugaa

SEQ ID NO: 12283 - RNA, 22 nt, Homo sapiens
uggucuauuggguaaauaugua

SEQ ID NO: 12284 - RNA, 22 nt, Homo sapiens
uacuuacauacuuaauaggcug

SEQ ID NO: 12285 - RNA, 22 nt, Homo sapiens
ccacccucucaguguuguuuuc

SEQ ID NO: 12286 - RNA, 22 nt, Homo sapiens
agacuguccuaggaggggcugc

SEQ ID NO: 12287 - RNA, 22 nt, Homo sapiens
agagaaaagugugugcagaggg

SEQ ID NO: 12288 - RNA, 22 nt, Homo sapiens
ucugugcauuacacuuuucuca

SEQ ID NO: 12289 - RNA, 22 nt, Homo sapiens
ugggaggugagucacuaaaaag

SEQ ID NO: 12290 - RNA, 22 nt, Homo sapiens
cugaugggacuugccucccgcc

SEQ ID NO: 12291 - RNA, 22 nt, Homo sapiens
ugacccacuucucuccugcuuu

SEQ ID NO: 12292 - RNA, 22 nt, Homo sapiens
gggggaugagggaggggccaga

SEQ ID NO: 12293 - RNA, 22 nt, Homo sapiens
ugcaaacaaccacugauuaacc

SEQ ID NO: 12294 - RNA, 22 nt, Homo sapiens
guuagauguggauguuugcuuc

SEQ ID NO: 12295 - RNA, 22 nt, Homo sapiens
uaggacugugugccugcacaua

SEQ ID NO: 12296 - RNA, 22 nt, Homo sapiens
ugugcagacacacauaucuaua

SEQ ID NO: 12297 - RNA, 18 nt, Homo sapiens
gcuccucaagacagggag

SEQ ID NO: 12298 - RNA, 22 nt, Homo sapiens
aaacaaacugauucuaacccgu

SEQ ID NO: 12299 - RNA, 22 nt, Homo sapiens
ugaguuagaauugguuuguuuu

SEQ ID NO: 12300 - RNA, 22 nt, Homo sapiens
uagacacuauugguugcuaauu

SEQ ID NO: 12301 - RNA, 22 nt, Homo sapiens
uaauuguccuaaugcacucugc

SEQ ID NO: 12302 - RNA, 22 nt, Homo sapiens
uccugaccccccugggguuguu

SEQ ID NO: 12303 - RNA, 22 nt, Homo sapiens
caggaucagguggguagggagc

SEQ ID NO: 12304 - RNA, 22 nt, Homo sapiens
ugggacaggggugggggcacag

SEQ ID NO: 12305 - RNA, 22 nt, Homo sapiens
uguagcaccccagcuucucccu

SEQ ID NO: 12306 - RNA, 22 nt, Homo sapiens
uaaguaggguuuggaacuggga

SEQ ID NO: 12307 - RNA, 22 nt, Homo sapiens
caguucacagaccuagauuuag

SEQ ID NO: 12308 - RNA, 22 nt, Homo sapiens
uugaauuugucaaaugucacac

SEQ ID NO: 12309 - RNA, 22 nt, Homo sapiens
ugagauuugacaucaugugagc

SEQ ID NO: 12310 - RNA, 22 nt, Homo sapiens
cucuacccucaguuaugugugu

SEQ ID NO: 12311 - RNA, 22 nt, Homo sapiens
gugcauaauugagggcagaauu

SEQ ID NO: 12312 - RNA, 22 nt, Homo sapiens
gcuggaacucaagugaacacau

SEQ ID NO: 12313 - RNA, 22 nt, Homo sapiens
ugcuguucucuagaaauccagc

SEQ ID NO: 12314 - RNA, 22 nt, Homo sapiens
gcuggaacucaagugaacgcuu

SEQ ID NO: 12315 - RNA, 21 nt, Homo sapiens
gcuguucucuagaaauccagc

SEQ ID NO: 12316 - RNA, 22 nt, Homo sapiens
gcuggaacucaagugaacgcuu

SEQ ID NO: 12317 - RNA, 21 nt, Homo sapiens
gcuguucucuagaaauccagc

SEQ ID NO: 12318 - RNA, 22 nt, Homo sapiens
cgcacugguccaggcaagcaua

SEQ ID NO: 12319 - RNA, 22 nt, Homo sapiens
ugcuugcugggguugaggcggu

SEQ ID NO: 12320 - RNA, 22 nt, Homo sapiens
uggcugguugggguuaaugucu

SEQ ID NO: 12321 - RNA, 22 nt, Homo sapiens
gccaucaacucuuuucagcugg

SEQ ID NO: 12322 - RNA, 22 nt, Homo sapiens
uucuagugggggguagauguca

SEQ ID NO: 12323 - RNA, 22 nt, Homo sapiens
gcucuaccaccacuagaagaac

SEQ ID NO: 12324 - RNA, 22 nt, Homo sapiens
acaggcccccugggagcuuggu

SEQ ID NO: 12325 - RNA, 22 nt, Homo sapiens
uccgugcuuucagggucgcugu

SEQ ID NO: 12326 - RNA, 21 nt, Homo sapiens
acagcaggcacagacaggcag

SEQ ID NO: 12327 - RNA, 22 nt, Homo sapiens
ugccugucuacacuugcugugc

SEQ ID NO: 12328 - RNA, 22 nt, Homo sapiens
aacauuuauugagcaccuggca

SEQ ID NO: 12329 - RNA, 22 nt, Homo sapiens
cugggcacucaguaaguaucug

SEQ ID NO: 12330 - RNA, 22 nt, Homo sapiens
gaagcaaccauccagaggaaaa

SEQ ID NO: 12331 - RNA, 17 nt, Homo sapiens
uuccuggauucuguuuc

SEQ ID NO: 12332 - RNA, 22 nt, Homo sapiens
accagaaauuguuauauauaca

SEQ ID NO: 12333 - RNA, 22 nt, Homo sapiens
uguauguauagcaucuucuaac

SEQ ID NO: 12334 - RNA, 22 nt, Homo sapiens
ugggcacaggugcacacacagg

SEQ ID NO: 12335 - RNA, 22 nt, Homo sapiens
uguguguacaccuaaccuacac

SEQ ID NO: 12336 - RNA, 22 nt, Homo sapiens
ucugcccuuuguccugugagcc

SEQ ID NO: 12337 - RNA, 22 nt, Homo sapiens
guucuagaggacaaagcagccc

SEQ ID NO: 12338 - RNA, 22 nt, Homo sapiens
uggugggaagagcuuggacuuu

SEQ ID NO: 12339 - RNA, 22 nt, Homo sapiens
ugaauccuggcuuuaccacuua

SEQ ID NO: 12340 - RNA, 22 nt, Homo sapiens
ucugcuuagcccaucugccugu

SEQ ID NO: 12341 - RNA, 22 nt, Homo sapiens
gcaagugccugcugacaggugg

SEQ ID NO: 12342 - RNA, 22 nt, Homo sapiens
cacgacuucuugucagcgugau

SEQ ID NO: 12343 - RNA, 22 nt, Homo sapiens
ugugcugacaagaccacguggg

SEQ ID NO: 12344 - RNA, 22 nt, Homo sapiens
ugaagcuuagagaggcaaagua

SEQ ID NO: 12345 - RNA, 22 nt, Homo sapiens
uauuucaccucucugaggcuca

SEQ ID NO: 12346 - RNA, 22 nt, Homo sapiens
agucaggggagggguggagaga

SEQ ID NO: 12347 - RNA, 22 nt, Homo sapiens
ggccucccaccuccuagggcuc

SEQ ID NO: 12348 - RNA, 22 nt, Homo sapiens
ucagucuucuuggaggcuucuu

SEQ ID NO: 12349 - RNA, 22 nt, Homo sapiens
gcaguaguuaaggagaggagag

SEQ ID NO: 12350 - RNA, 22 nt, Homo sapiens
gcaguggucagggaccucaaga

SEQ ID NO: 12351 - RNA, 22 nt, Homo sapiens
augaaauucuuggaucacugga

SEQ ID NO: 12352 - RNA, 22 nt, Homo sapiens
uccaagugcgaguaguaggccg

SEQ ID NO: 12353 - RNA, 21 nt, Homo sapiens
gcuauggcucgcaucuggggg

SEQ ID NO: 12354 - RNA, 22 nt, Homo sapiens
ucucuugguccccauccuguca

SEQ ID NO: 12355 - RNA, 22 nt, Homo sapiens
augagggugaggaagagagggg

SEQ ID NO: 12356 - RNA, 22 nt, Homo sapiens
aggccaucugcagagaagaaag

SEQ ID NO: 12357 - RNA, 22 nt, Homo sapiens
uucuugucagcacuugguaggg

SEQ ID NO: 12358 - RNA, 22 nt, Homo sapiens
aguauuaacugugcugcugaag

SEQ ID NO: 12359 - RNA, 22 nt, Homo sapiens
uagcagcacguaaauauuggcg

SEQ ID NO: 12360 - RNA, 22 nt, Homo sapiens
uacuuggaaaggcaucaguugc

SEQ ID NO: 12361 - RNA, 22 nt, Homo sapiens
acuauucccuuucugaguagag

SEQ ID NO: 12362 - RNA, 22 nt, Homo sapiens
uguccuaguccaugaugccugg

SEQ ID NO: 12363 - RNA, 20 nt, Homo sapiens
cuggagucagagagaggaca

SEQ ID NO: 12364 - RNA, 22 nt, Homo sapiens
ugcgggcucaggacaggccggg

SEQ ID NO: 12365 - RNA, 22 nt, Homo sapiens
ccuguccugggcgcugggccac

SEQ ID NO: 12366 - RNA, 22 nt, Homo sapiens
agaggaugugaccuguggccca

SEQ ID NO: 12367 - RNA, 22 nt, Homo sapiens
ggccuuggcugcauccugggca

SEQ ID NO: 12368 - RNA, 22 nt, Homo sapiens
ggggccagccucaucccacugc

SEQ ID NO: 12369 - RNA, 19 nt, Homo sapiens
gugagugaggacaggccuc

SEQ ID NO: 12370 - RNA, 22 nt, Homo sapiens
uguagacucugaguacggugcu

SEQ ID NO: 12371 - RNA, 22 nt, Homo sapiens
cucuggcuuaggguuuagaagg

SEQ ID NO: 12372 - RNA, 22 nt, Homo sapiens
uagggucacagaccccagccca

SEQ ID NO: 12373 - RNA, 22 nt, Homo sapiens
ugggagggggcugugugcaccu

SEQ ID NO: 12374 - RNA, 22 nt, Homo sapiens
gaucagugaaggaggaagcugg

SEQ ID NO: 12375 - RNA, 22 nt, Homo sapiens
cugagcguuucuucuugauccu

SEQ ID NO: 12376 - RNA, 22 nt, Homo sapiens
aaagaacccugggccucaugcg

SEQ ID NO: 12377 - RNA, 22 nt, Homo sapiens
aaggcuggggucuggguguucu

SEQ ID NO: 12378 - RNA, 22 nt, Homo sapiens
agcuaauucuuucggggaccgg

SEQ ID NO: 12379 - RNA, 22 nt, Homo sapiens
ucuguuccugaauuugguguga

SEQ ID NO: 12380 - RNA, 22 nt, Homo sapiens
gaggccaaugacagucagaggu

SEQ ID NO: 12381 - RNA, 22 nt, Homo sapiens
ugcugauugucguugucaucug

SEQ ID NO: 12382 - RNA, 22 nt, Homo sapiens
aaugagggcagguaucaaccau

SEQ ID NO: 12383 - RNA, 22 nt, Homo sapiens
ugggauauccuguuuuccauuu

SEQ ID NO: 12384 - RNA, 22 nt, Homo sapiens
acugcucccgggccuccuuucu

SEQ ID NO: 12385 - RNA, 22 nt, Homo sapiens
aaggaggaccccuccugagcaa

SEQ ID NO: 12386 - RNA, 22 nt, Homo sapiens
agggagacagcagaaacuagag

SEQ ID NO: 12387 - RNA, 22 nt, Homo sapiens
ugcuuaggucccuguuguucau

SEQ ID NO: 12388 - RNA, 22 nt, Homo sapiens
gggugaucuucacguaagccug

SEQ ID NO: 12389 - RNA, 22 nt, Homo sapiens
cacacgggcagcggaggaacca

SEQ ID NO: 12390 - RNA, 22 nt, Homo sapiens
ugccguccuugaauugaucagc

SEQ ID NO: 12391 - RNA, 22 nt, Homo sapiens
cauuagauuaauucagggaaug

SEQ ID NO: 12392 - RNA, 22 nt, Homo sapiens
aggcgggagaagcagccgggcc

SEQ ID NO: 12393 - RNA, 22 nt, Homo sapiens
cccuacgcugcugcuucccgac

SEQ ID NO: 12394 - RNA, 22 nt, Homo sapiens
aaugcugucagagcugccuuca

SEQ ID NO: 12395 - RNA, 22 nt, Homo sapiens
aggcagauucuuacggcaguug

SEQ ID NO: 12396 - RNA, 22 nt, Homo sapiens
gaagcagguucuucaggaugaa

SEQ ID NO: 12397 - RNA, 22 nt, Homo sapiens
cauucccugacagccucuuuca

SEQ ID NO: 12398 - RNA, 22 nt, Homo sapiens
gcagacaguuaucccuuucuag

SEQ ID NO: 12399 - RNA, 20 nt, Homo sapiens
ucuagagggagucagucugc

SEQ ID NO: 12400 - RNA, 22 nt, Homo sapiens
uuaagauccaaaugagauaaag

SEQ ID NO: 12401 - RNA, 22 nt, Homo sapiens
uauaucucauuuggauccuaaa

SEQ ID NO: 12402 - RNA, 22 nt, Homo sapiens
ugagaugcuugaagagauggau

SEQ ID NO: 12403 - RNA, 21 nt, Homo sapiens
ucaaccucuuugagccucagu

SEQ ID NO: 12404 - RNA, 22 nt, Homo sapiens
ugggucuuucuuucucuuggug

SEQ ID NO: 12405 - RNA, 22 nt, Homo sapiens
cuaggagaaagaaagagcuggc

SEQ ID NO: 12406 - RNA, 22 nt, Homo sapiens
ucaucggaaaucagaucugaug

SEQ ID NO: 12407 - RNA, 22 nt, Homo sapiens
uccgaucagauuuccagugagu

SEQ ID NO: 12408 - RNA, 22 nt, Homo sapiens
gaggaugggacgcguggggacu

SEQ ID NO: 12409 - RNA, 22 nt, Homo sapiens
gcccucgcgcgcucugagccuc

SEQ ID NO: 12410 - RNA, 22 nt, Homo sapiens
ucauaugugacacgugauuaca

SEQ ID NO: 12411 - RNA, 22 nt, Homo sapiens
uaaucacaugugucacauguga

SEQ ID NO: 12412 - RNA, 22 nt, Homo sapiens
uugcuucuaaggcuccugaaac

SEQ ID NO: 12413 - RNA, 22 nt, Homo sapiens
ucaggaaccuugggaguaacug

SEQ ID NO: 12414 - RNA, 22 nt, Homo sapiens
acucccagcaggccacgcgccg

SEQ ID NO: 12415 - RNA, 22 nt, Homo sapiens
cgcagggccuucugggagcugu

SEQ ID NO: 12416 - RNA, 22 nt, Homo sapiens
uaugcaaaauggauaauugcau

SEQ ID NO: 12417 - RNA, 22 nt, Homo sapiens
ugugcaauuacccauuuuaugc

SEQ ID NO: 12418 - RNA, 22 nt, Homo sapiens
uaaauugugcaugugcaugcag

SEQ ID NO: 12419 - RNA, 22 nt, Homo sapiens
ugugcacauguacgcagauaug

SEQ ID NO: 12420 - RNA, 22 nt, Homo sapiens
ugugacagauugauaacugaaa

SEQ ID NO: 12421 - RNA, 23 nt, Homo sapiens
ucggggaucaucaugucacgaga

SEQ ID NO: 12422 - RNA, 22 nt, Homo sapiens
aauggaguucugcaaaguacug

SEQ ID NO: 12423 - RNA, 22 nt, Homo sapiens
gacuuugcaugaaucucauuua

SEQ ID NO: 12424 - RNA, 22 nt, Homo sapiens
uucccauccuccaugcauggga

SEQ ID NO: 12425 - RNA, 22 nt, Homo sapiens
uuuccacaggaugguggggggg

SEQ ID NO: 12426 - RNA, 22 nt, Homo sapiens
uucccauccuccaugcauggga

SEQ ID NO: 12427 - RNA, 22 nt, Homo sapiens
uuuccacaggaugguggggggg

SEQ ID NO: 12428 - RNA, 22 nt, Homo sapiens
uccgucauuauucaauaauagc

SEQ ID NO: 12429 - RNA, 22 nt, Homo sapiens
auuauuaaauagcucauugacc

SEQ ID NO: 12430 - RNA, 22 nt, Homo sapiens
ccauuagaagggcuggaagaag

SEQ ID NO: 12431 - RNA, 22 nt, Homo sapiens
ucuuccagcucuucuaauggua

SEQ ID NO: 12432 - RNA, 22 nt, Homo sapiens
uacauacuucuuuauguaccca

SEQ ID NO: 12433 - RNA, 21 nt, Homo sapiens
uggaauguaaagaaguaugua

SEQ ID NO: 12434 - RNA, 22 nt, Homo sapiens
cgauauucuuccccacuaauua

SEQ ID NO: 12435 - RNA, 22 nt, Homo sapiens
uaauuguggggaagaaugccgu

SEQ ID NO: 12436 - RNA, 22 nt, Homo sapiens
ugaaacucucugugguauuugu

SEQ ID NO: 12437 - RNA, 22 nt, Homo sapiens
uaaauaugauaaggaguuucag

SEQ ID NO: 12438 - RNA, 22 nt, Homo sapiens
aguugcaaaccaucuccuuagc

SEQ ID NO: 12439 - RNA, 22 nt, Homo sapiens
uaaggagacaguuugcaacuug

SEQ ID NO: 12440 - RNA, 22 nt, Homo sapiens
ugcuaccaugaaggaagaagag

SEQ ID NO: 12441 - RNA, 22 nt, Homo sapiens
uccuccuucacuguagcaugug

SEQ ID NO: 12442 - RNA, 22 nt, Homo sapiens
agagguuguccguguugucuuc

SEQ ID NO: 12443 - RNA, 21 nt, Homo sapiens
ugaaacauacacgggaaaccu

SEQ ID NO: 12444 - RNA, 23 nt, Homo sapiens
ugaaacauacacgggaaaccucu

SEQ ID NO: 12445 - RNA, 24 nt, Homo sapiens
ugaaacauacacgggaaaccucuu

SEQ ID NO: 12446 - RNA, 22 nt, Homo sapiens
uagcccgggccuauggacuaau

SEQ ID NO: 12447 - RNA, 22 nt, Homo sapiens
ugguucugugggcccuggcugg

SEQ ID NO: 12448 - RNA, 22 nt, Homo sapiens
ucgugucacugugaggauauug

SEQ ID NO: 12449 - RNA, 22 nt, Homo sapiens
cuauacccacagugacacagcc

SEQ ID NO: 12450 - RNA, 22 nt, Homo sapiens
ucucuucaccuugagcccuggg

SEQ ID NO: 12451 - RNA, 22 nt, Homo sapiens
ucugggcggcaggguggggaau

SEQ ID NO: 12452 - RNA, 22 nt, Homo sapiens
ugucagaaaugauuuuucugac

SEQ ID NO: 12453 - RNA, 22 nt, Homo sapiens
agaaaaaucaucucugacauuu

SEQ ID NO: 12454 - RNA, 22 nt, Homo sapiens
aagaggaacuuaggagcuaaau

SEQ ID NO: 12455 - RNA, 22 nt, Homo sapiens
uuugcuccagaauguucuuuuc

SEQ ID NO: 12456 - RNA, 22 nt, Homo sapiens
uaggcaguagcuugagauauaa

SEQ ID NO: 12457 - RNA, 22 nt, Homo sapiens
gaggucucggaacugcugauug

SEQ ID NO: 12458 - RNA, 22 nt, Homo sapiens
gagccucuucaaaacagagccc

SEQ ID NO: 12459 - RNA, 22 nt, Homo sapiens
gcagucugaguuuugaaaggcu

SEQ ID NO: 12460 - RNA, 22 nt, Homo sapiens
uuuaucauuucuuuauaagaaa

SEQ ID NO: 12461 - RNA, 22 nt, Homo sapiens
ucuuauaaagaaaauauaaauc

SEQ ID NO: 12462 - RNA, 22 nt, Homo sapiens
ggaguucuacauuuguugauga

SEQ ID NO: 12463 - RNA, 15 nt, Homo sapiens
uugaauguaagcucc

SEQ ID NO: 12464 - RNA, 22 nt, Homo sapiens
acagauuuccuaagcaucaauc

SEQ ID NO: 12465 - RNA, 22 nt, Homo sapiens
uugaugcuggggaacucugugg

SEQ ID NO: 12466 - RNA, 22 nt, Homo sapiens
uccuugguugauuuucuggggc

SEQ ID NO: 12467 - RNA, 22 nt, Homo sapiens
uuaagaaaaacagucauccugc

SEQ ID NO: 12468 - RNA, 22 nt, Homo sapiens
uccucucuuuccaugaucaugu

SEQ ID NO: 12469 - RNA, 22 nt, Homo sapiens
augguugggaggcagagagggc

SEQ ID NO: 12470 - RNA, 22 nt, Homo sapiens
aaagugcaucuuuuuagaggau

SEQ ID NO: 12471 - RNA, 20 nt, Homo sapiens
cucuagagggaagcgcuuuc

SEQ ID NO: 12472 - RNA, 24 nt, Homo sapiens
cucuagagggaagcgcuuucuguu

SEQ ID NO: 12473 - RNA, 23 nt, Homo sapiens
agcagcauuguacagggcuauca

SEQ ID NO: 12474 - RNA, 22 nt, Homo sapiens
cagcuucuuuacaguguugccu

SEQ ID NO: 12475 - RNA, 22 nt, Homo sapiens
gcuacguuuucuagggcucaac

SEQ ID NO: 12476 - RNA, 22 nt, Homo sapiens
ucaagcccagaggaaaauggcu

SEQ ID NO: 12477 - RNA, 22 nt, Homo sapiens
ugcaccugucucucauucccau

SEQ ID NO: 12478 - RNA, 22 nt, Homo sapiens
uggggcugagacacaaguggau

SEQ ID NO: 12479 - RNA, 22 nt, Homo sapiens
uaguggaucuuuucacuugggu

SEQ ID NO: 12480 - RNA, 22 nt, Homo sapiens
uccaagugaaaaugucaaauaa

SEQ ID NO: 12481 - RNA, 22 nt, Homo sapiens
agcuacaaguguuuugguuuua

SEQ ID NO: 12482 - RNA, 22 nt, Homo sapiens
gccaagauuacuuuugugacug

SEQ ID NO: 12483 - RNA, 22 nt, Homo sapiens
cuuucuggacucuuggguccua

SEQ ID NO: 12484 - RNA, 22 nt, Homo sapiens
gccccaguguccuagaaacguu

SEQ ID NO: 12485 - RNA, 22 nt, Homo sapiens
aaggcagagaggcuuggcucug

SEQ ID NO: 12486 - RNA, 22 nt, Homo sapiens
ggcccggcccuccucucucccu

SEQ ID NO: 12487 - RNA, 22 nt, Homo sapiens
gccccggguagcugggaagggc

SEQ ID NO: 12488 - RNA, 22 nt, Homo sapiens
ccuccaagcugcccagggacag

SEQ ID NO: 12489 - RNA, 22 nt, Homo sapiens
ugccuugccuuucuccucauuc

SEQ ID NO: 12490 - RNA, 22 nt, Homo sapiens
ugaugaggguagaguuagauuu

SEQ ID NO: 12491 - RNA, 22 nt, Homo sapiens
ugaaggauaacagcauugaguc

SEQ ID NO: 12492 - RNA, 22 nt, Homo sapiens
cuuauuuguuguuauaauaaac

SEQ ID NO: 12493 - RNA, 22 nt, Homo sapiens
ggguggcugcagggggugguau

SEQ ID NO: 12494 - RNA, 18 nt, Homo sapiens
auccccaugcacccaccc

SEQ ID NO: 12495 - RNA, 22 nt, Homo sapiens
ucaaggaugauucugaaagagc

SEQ ID NO: 12496 - RNA, 22 nt, Homo sapiens
uccuuuagaaucauccuugggg

SEQ ID NO: 12497 - RNA, 22 nt, Homo sapiens
uccaacugacuguccuaaucag

SEQ ID NO: 12498 - RNA, 22 nt, Homo sapiens
ugauuggagcugcggugggugg

SEQ ID NO: 12499 - RNA, 22 nt, Homo sapiens
aagugagcggcaaggccguggu

SEQ ID NO: 12500 - RNA, 22 nt, Homo sapiens
cacgcuuuguccuuccuggggu

SEQ ID NO: 12501 - RNA, 22 nt, Homo sapiens
aaugccucucacagagaacagg

SEQ ID NO: 12502 - RNA, 22 nt, Homo sapiens
uguucgucugcuagaggucuuu

SEQ ID NO: 12503 - RNA, 22 nt, Homo sapiens
ucguuccccccaccccacuugg

SEQ ID NO: 12504 - RNA, 22 nt, Homo sapiens
cgagggagugggaggacgucgg

SEQ ID NO: 12505 - RNA, 22 nt, Homo sapiens
ggcggacgcccgggggccggga

SEQ ID NO: 12506 - RNA, 22 nt, Homo sapiens
cggcggcgcccggggcuccguc

SEQ ID NO: 12507 - RNA, 22 nt, Homo sapiens
ucagacuauggaagguucauuc

SEQ ID NO: 12508 - RNA, 22 nt, Homo sapiens
uugcugagaaccacauauuuga

SEQ ID NO: 12509 - RNA, 22 nt, Homo sapiens
uucaagaucuguccagaccauu

SEQ ID NO: 12510 - RNA, 22 nt, Homo sapiens
uggucuggacagaccuggaacc

SEQ ID NO: 12511 - RNA, 22 nt, Homo sapiens
uucauuucugccagaauuuaac

SEQ ID NO: 12512 - RNA, 22 nt, Homo sapiens
ugccucuuuucuggggggaaaa

SEQ ID NO: 12513 - RNA, 22 nt, Homo sapiens
cacuccaccuccagcugcucca

SEQ ID NO: 12514 - RNA, 22 nt, Homo sapiens
uucuagcagcuggugcaguggg

SEQ ID NO: 12515 - RNA, 22 nt, Homo sapiens
ugaaccuuaggaguccaggggu

SEQ ID NO: 12516 - RNA, 22 nt, Homo sapiens
gccuugcccugagguugagaga

SEQ ID NO: 12517 - RNA, 22 nt, Homo sapiens
ucuagcuacccuugguacagca

SEQ ID NO: 12518 - RNA, 22 nt, Homo sapiens
ugggcuggggguggcuggcagc

SEQ ID NO: 12519 - RNA, 22 nt, Homo sapiens
cgugcucaugaccacugggugg

SEQ ID NO: 12520 - RNA, 22 nt, Homo sapiens
cccguggucccagagucacagg

SEQ ID NO: 12521 - RNA, 22 nt, Homo sapiens
uugccucccaagagggaaaaua

SEQ ID NO: 12522 - RNA, 19 nt, Homo sapiens
ucccuuaucuggcaggcag

SEQ ID NO: 12523 - RNA, 22 nt, Homo sapiens
ugggaaguugauuggaagcuag

SEQ ID NO: 12524 - RNA, 22 nt, Homo sapiens
ccagcucucaacggcccuuugg

SEQ ID NO: 12525 - RNA, 22 nt, Homo sapiens
uuaugcacacuugaauaaugua

SEQ ID NO: 12526 - RNA, 22 nt, Homo sapiens
uauuauuuaagugugcacaaua

SEQ ID NO: 12527 - RNA, 22 nt, Homo sapiens
uaccugguguuuucagacccag

SEQ ID NO: 12528 - RNA, 22 nt, Homo sapiens
ugggucaugauaacaccuggaa

SEQ ID NO: 12529 - RNA, 22 nt, Homo sapiens
ccgcgacgagccccucgcacaa

SEQ ID NO: 12530 - RNA, 22 nt, Homo sapiens
uuuguucguucggcucgcguga

SEQ ID NO: 12531 - RNA, 22 nt, Homo sapiens
ugggccgagccggggccgccuc

SEQ ID NO: 12532 - RNA, 22 nt, Homo sapiens
cugggcgccccacucggcucag

SEQ ID NO: 12533 - RNA, 22 nt, Homo sapiens
cuucugcagggacuuuguucag

SEQ ID NO: 12534 - RNA, 22 nt, Homo sapiens
ucuggacaaggccggugaagcu

SEQ ID NO: 12535 - RNA, 22 nt, Homo sapiens
uuuugcauccacccucucccuc

SEQ ID NO: 12536 - RNA, 22 nt, Homo sapiens
gaaaguauggagugcuggaggg

SEQ ID NO: 12537 - RNA, 22 nt, Homo sapiens
ccaggcugcagguggaggcuca

SEQ ID NO: 12538 - RNA, 22 nt, Homo sapiens
aagcugcucugccugccuggcu

SEQ ID NO: 12539 - RNA, 22 nt, Homo sapiens
uccugcugagcagcacgccugc

SEQ ID NO: 12540 - RNA, 21 nt, Homo sapiens
caggcugccugcacacaggag

SEQ ID NO: 12541 - RNA, 22 nt, Homo sapiens
ugagacauuuuucaaaauacau

SEQ ID NO: 12542 - RNA, 22 nt, Homo sapiens
uauuuggaaaagaauucccaug

SEQ ID NO: 12543 - RNA, 22 nt, Homo sapiens
ggcccucucagggcccuaggag

SEQ ID NO: 12544 - RNA, 21 nt, Homo sapiens
uccagggccucggacagggcc

SEQ ID NO: 12545 - RNA, 22 nt, Homo sapiens
gaagggggggcagugcaugugu

SEQ ID NO: 12546 - RNA, 22 nt, Homo sapiens
ugcgugcacgugggugucuccu

SEQ ID NO: 12547 - RNA, 22 nt, Homo sapiens
uggucugcuuuccaucucugag

SEQ ID NO: 12548 - RNA, 22 nt, Homo sapiens
ucaaagcaggaaaacaaaccac

SEQ ID NO: 12549 - RNA, 22 nt, Homo sapiens
uggguuauuuuggucuaguggg

SEQ ID NO: 12550 - RNA, 22 nt, Homo sapiens
auuuggaccaaaauagccaaca

SEQ ID NO: 12551 - RNA, 22 nt, Homo sapiens
uucuccuggagggcgacuuuuu

SEQ ID NO: 12552 - RNA, 22 nt, Homo sapiens
ggaggaugccuucccugaagcc

SEQ ID NO: 12553 - RNA, 22 nt, Homo sapiens
uucuccuggaggguaguuuuuu

SEQ ID NO: 12554 - RNA, 22 nt, Homo sapiens
ggaggaugccuucccugaagcc

SEQ ID NO: 12555 - RNA, 17 nt, Homo sapiens
uagugcagaaccuccag

SEQ ID NO: 12556 - RNA, 22 nt, Homo sapiens
cccagugcaaguguagaugccg

SEQ ID NO: 12557 - RNA, 22 nt, Homo sapiens
ucagcguuucacacugccuggu

SEQ ID NO: 12558 - RNA, 22 nt, Homo sapiens
cagggaucaucuugucaguuau

SEQ ID NO: 12559 - RNA, 22 nt, Homo sapiens
uggcugagaucaagaaugauuc

SEQ ID NO: 12560 - RNA, 22 nt, Homo sapiens
uccaccucaauuuauuccuaau

SEQ ID NO: 12561 - RNA, 22 nt, Homo sapiens
ggaauaaauugagauggauucu

SEQ ID NO: 12562 - RNA, 22 nt, Homo sapiens
ucacaaagacugauccaaaguc

SEQ ID NO: 12563 - RNA, 22 nt, Homo sapiens
uugauccagucuuucuugagcc

SEQ ID NO: 12564 - RNA, 22 nt, Homo sapiens
cugcuuuuaacauaaccagaug

SEQ ID NO: 12565 - RNA, 22 nt, Homo sapiens
uuggcaguguacugaaagcaca

SEQ ID NO: 12566 - RNA, 22 nt, Homo sapiens
agcucgcgggugacgggugugg

SEQ ID NO: 12567 - RNA, 22 nt, Homo sapiens
caccuguuacauccacguguug

SEQ ID NO: 12568 - RNA, 22 nt, Homo sapiens
cauggcagggugggagaggcgg

SEQ ID NO: 12569 - RNA, 22 nt, Homo sapiens
ucuucccacuaucugcucauca

SEQ ID NO: 12570 - RNA, 22 nt, Homo sapiens
ugaacuguaaaaucugauuucu

SEQ ID NO: 12571 - RNA, 22 nt, Homo sapiens
agucauguuuuauuguaaaugu

SEQ ID NO: 12572 - RNA, 22 nt, Homo sapiens
gggacgccuggcucucauuguc

SEQ ID NO: 12573 - RNA, 22 nt, Homo sapiens
ggguuggggguuggguccucuc

SEQ ID NO: 12574 - RNA, 22 nt, Homo sapiens
cccuccccaugugugacaguug

SEQ ID NO: 12575 - RNA, 22 nt, Homo sapiens
aacuggggaucuggggagggcg

SEQ ID NO: 12576 - RNA, 22 nt, Homo sapiens
agcagcuuccccaaagugccuu

SEQ ID NO: 12577 - RNA, 22 nt, Homo sapiens
uuuacuuacugggaaaaucugc

SEQ ID NO: 12578 - RNA, 22 nt, Homo sapiens
caucucuguuuggauucccagu

SEQ ID NO: 12579 - RNA, 22 nt, Homo sapiens
ugggaguucugacagggucuuc

SEQ ID NO: 12580 - RNA, 22 nt, Homo sapiens
ucccuuauccuggaccucuuca

SEQ ID NO: 12581 - RNA, 22 nt, Homo sapiens
guaagauccagggaaaaggagg

SEQ ID NO: 12582 - RNA, 22 nt, Homo sapiens
uaugcccagagacacucucuga

SEQ ID NO: 12583 - RNA, 22 nt, Homo sapiens
ggaaguguuucuuuggcauaua

SEQ ID NO: 12584 - RNA, 22 nt, Homo sapiens
ucauguuaccaugacaacugau

SEQ ID NO: 12585 - RNA, 22 nt, Homo sapiens
guugccauggugacaaaaucuu

SEQ ID NO: 12586 - RNA, 22 nt, Homo sapiens
gcuuuccagcuuccucaauagg

SEQ ID NO: 12587 - RNA, 19 nt, Homo sapiens
cuuugaggaagccgagagc

SEQ ID NO: 12588 - RNA, 22 nt, Homo sapiens
ugcaguuaauggccaguuuauu

SEQ ID NO: 12589 - RNA, 22 nt, Homo sapiens
ugggcugagucguuuaaugugg

SEQ ID NO: 12590 - RNA, 22 nt, Homo sapiens
cauucucacucaggugcagucu

SEQ ID NO: 12591 - RNA, 22 nt, Homo sapiens
auugcuccacaagugaggaugg

SEQ ID NO: 12592 - RNA, 22 nt, Homo sapiens
ggcacaaugggggcagaugaaa

SEQ ID NO: 12593 - RNA, 22 nt, Homo sapiens
ucuaucuuuccuucuugugucu

SEQ ID NO: 12594 - RNA, 22 nt, Homo sapiens
cagccuccuggucuuugagccu

SEQ ID NO: 12595 - RNA, 22 nt, Homo sapiens
ggugagagaacaagaggcccca

SEQ ID NO: 12596 - RNA, 22 nt, Homo sapiens
aacucaacaaccuuaggacagc

SEQ ID NO: 12597 - RNA, 22 nt, Homo sapiens
caaguccugagguugaagaguc

SEQ ID NO: 12598 - RNA, 22 nt, Homo sapiens
ucugucucuggcagggcagagg

SEQ ID NO: 12599 - RNA, 22 nt, Homo sapiens
ucuccaggcucaagacacaggc

SEQ ID NO: 12600 - RNA, 22 nt, Homo sapiens
uucuaggcagagggacagcgga

SEQ ID NO: 12601 - RNA, 22 nt, Homo sapiens
caagcauucucugccuagaagu

SEQ ID NO: 12602 - RNA, 22 nt, Homo sapiens
aaacagaucugacuuggcucug

SEQ ID NO: 12603 - RNA, 22 nt, Homo sapiens
auacuggguugaguauaauuuu

SEQ ID NO: 12604 - RNA, 22 nt, Homo sapiens
ugcucccuuuguuuuagauucc

SEQ ID NO: 12605 - RNA, 22 nt, Homo sapiens
acccugaggaugaggaggagca

SEQ ID NO: 12606 - RNA, 22 nt, Homo sapiens
ucagcauuuguggaaucagcac

SEQ ID NO: 12607 - RNA, 22 nt, Homo sapiens
ugguucugcaagugcugagggu

SEQ ID NO: 12608 - RNA, 22 nt, Homo sapiens
uuacugcuagacaaauggcuuu

SEQ ID NO: 12609 - RNA, 22 nt, Homo sapiens
gccauuugucuuuguaaguaau

SEQ ID NO: 12610 - RNA, 22 nt, Homo sapiens
agucacauuucgacauaacuag

SEQ ID NO: 12611 - RNA, 22 nt, Homo sapiens
uaaguuguaugacgaacuguga

SEQ ID NO: 12612 - RNA, 22 nt, Homo sapiens
uaguuauguuggccccugguuc

SEQ ID NO: 12613 - RNA, 22 nt, Homo sapiens
agcuuggugccugucaucacug

SEQ ID NO: 12614 - RNA, 22 nt, Homo sapiens
ugcacaagcaauuaggcauuua

SEQ ID NO: 12615 - RNA, 22 nt, Homo sapiens
aaaugucugauuguguaugcaa

SEQ ID NO: 12616 - RNA, 22 nt, Homo sapiens
ucaauacacauugaccauauua

SEQ ID NO: 12617 - RNA, 22 nt, Homo sapiens
ugaauggucaacauguauugag

SEQ ID NO: 12618 - RNA, 22 nt, Homo sapiens
uagggguuaccuuuagcaucuc

SEQ ID NO: 12619 - RNA, 22 nt, Homo sapiens
gaugccaaaagugccccccaua

SEQ ID NO: 12620 - RNA, 22 nt, Homo sapiens
uuguguuucucugguaaccuuc

SEQ ID NO: 12621 - RNA, 22 nt, Homo sapiens
aagugacuaguuugaggcauca

SEQ ID NO: 12622 - RNA, 22 nt, Homo sapiens
aagcagcggagaggaggaggga

SEQ ID NO: 12623 - RNA, 22 nt, Homo sapiens
ucugcuaaucccugcugcuuug

SEQ ID NO: 12624 - RNA, 22 nt, Homo sapiens
uggguuuuaaagaguugauugu

SEQ ID NO: 12625 - RNA, 22 nt, Homo sapiens
cuauucauuuuuaaaacccaga

SEQ ID NO: 12626 - RNA, 22 nt, Homo sapiens
gaaggaguucaggcuuccgggc

SEQ ID NO: 12627 - RNA, 22 nt, Homo sapiens
ccggagccucagcuuccuuacc

SEQ ID NO: 12628 - RNA, 22 nt, Homo sapiens
ggcacuuuugcaaagaggagca

SEQ ID NO: 12629 - RNA, 22 nt, Homo sapiens
uguuuccucugcaaagugccuu

SEQ ID NO: 12630 - RNA, 22 nt, Homo sapiens
gacacagcagugccugccucag

SEQ ID NO: 12631 - RNA, 22 nt, Homo sapiens
uggggcggggcaccugcuucuc

SEQ ID NO: 12632 - RNA, 22 nt, Homo sapiens
ugcugucagcacagaccagauc

SEQ ID NO: 12633 - RNA, 20 nt, Homo sapiens
gaucuggccuugacacagca

SEQ ID NO: 12634 - RNA, 22 nt, Homo sapiens
ucccaggagacaggcauaggac

SEQ ID NO: 12635 - RNA, 22 nt, Homo sapiens
cuaggccuuucuucuguggauc

SEQ ID NO: 12636 - RNA, 22 nt, Homo sapiens
agaaacagauagaauccuuugc

SEQ ID NO: 12637 - RNA, 21 nt, Homo sapiens
aaaggguucuucaauuuucuu

SEQ ID NO: 12638 - RNA, 22 nt, Homo sapiens
ugaggccuaagcuugguggcug

SEQ ID NO: 12639 - RNA, 22 nt, Homo sapiens
aguggcugagcuuagccuagaa

SEQ ID NO: 12640 - RNA, 22 nt, Homo sapiens
cagguaugugcugaguguucuu

SEQ ID NO: 12641 - RNA, 22 nt, Homo sapiens
agcauucagcauauaauccuac

SEQ ID NO: 12642 - RNA, 22 nt, Homo sapiens
uggaguugagaaagacagagcg

SEQ ID NO: 12643 - RNA, 22 nt, Homo sapiens
caaacuccuacuuucucauucu

SEQ ID NO: 12644 - RNA, 22 nt, Homo sapiens
ugcaggaugagugaaaaggcau

SEQ ID NO: 12645 - RNA, 22 nt, Homo sapiens
ugcuaguucaugucuuucugca

SEQ ID NO: 12646 - RNA, 22 nt, Homo sapiens
uggguguaccgggcucugggag

SEQ ID NO: 12647 - RNA, 22 nt, Homo sapiens
uccccagagccuccugagcccc

SEQ ID NO: 12648 - RNA, 22 nt, Homo sapiens
uguggccaucgcugcccccucg

SEQ ID NO: 12649 - RNA, 22 nt, Homo sapiens
gcaggagguagcgcacagccau

SEQ ID NO: 12650 - RNA, 22 nt, Homo sapiens
ucucaguuacucucccugguac

SEQ ID NO: 12651 - RNA, 22 nt, Homo sapiens
ccagagagagugacugaggcua

SEQ ID NO: 12652 - RNA, 22 nt, Homo sapiens
uguuucacugggaucccucaca

SEQ ID NO: 12653 - RNA, 22 nt, Homo sapiens
ugaggugccuacgcugaaaugg

SEQ ID NO: 12654 - RNA, 22 nt, Homo sapiens
ugccuccaccccgccuggccug

SEQ ID NO: 12655 - RNA, 22 nt, Homo sapiens
cuaggaggguuggguggaggca

SEQ ID NO: 12656 - RNA, 22 nt, Homo sapiens
ucccuccguuucccauugccag

SEQ ID NO: 12657 - RNA, 22 nt, Homo sapiens
agguaaggaagauggagcuaag

SEQ ID NO: 12658 - RNA, 22 nt, Homo sapiens
uaggaucuuuccgucugacuua

SEQ ID NO: 12659 - RNA, 22 nt, Homo sapiens
uaaucagacgugaugaccggac

SEQ ID NO: 12660 - RNA, 22 nt, Homo sapiens
ccuggacuugauggcuucuugg

SEQ ID NO: 12661 - RNA, 22 nt, Homo sapiens
ucaagacuccacaggugccaac

SEQ ID NO: 12662 - RNA, 22 nt, Homo sapiens
agagguugcccuuggugaauuc

SEQ ID NO: 12663 - RNA, 22 nt, Homo sapiens
aucacacaaaggcaacuuuugu

SEQ ID NO: 12664 - RNA, 23 nt, Homo sapiens
aaucacacaaaggcaacuuuugu

SEQ ID NO: 12665 - RNA, 22 nt, Homo sapiens
uggcugagcaggcacgcugcgc

SEQ ID NO: 12666 - RNA, 22 nt, Homo sapiens
gccucgaugcccuuuagccaaa

SEQ ID NO: 12667 - RNA, 22 nt, Homo sapiens
ccuaggccugggggaggggaag

SEQ ID NO: 12668 - RNA, 19 nt, Homo sapiens
cccacccucaucuccuagg

SEQ ID NO: 12669 - RNA, 22 nt, Homo sapiens
caccauggaucuccaggugggu

SEQ ID NO: 12670 - RNA, 21 nt, Homo sapiens
caaccuggaggacuccaugcu

SEQ ID NO: 12671 - RNA, 22 nt, Homo sapiens
caaccuggaggacuccaugcug

SEQ ID NO: 12672 - RNA, 22 nt, Homo sapiens
ucaugcgcuuuucaggaguguu

SEQ ID NO: 12673 - RNA, 22 nt, Homo sapiens
auacauuccugaagguaaugag

SEQ ID NO: 12674 - RNA, 22 nt, Homo sapiens
uuuguuuugcuuugcacugacc

SEQ ID NO: 12675 - RNA, 22 nt, Homo sapiens
ggucccugcagcggggcagaca

SEQ ID NO: 12676 - RNA, 22 nt, Homo sapiens
gcugacaaaacacuaagcucug

SEQ ID NO: 12677 - RNA, 22 nt, Homo sapiens
gcaguucagggucuuguuagcu

SEQ ID NO: 12678 - RNA, 22 nt, Homo sapiens
ccagcaauaaagauuuuacugu

SEQ ID NO: 12679 - RNA, 22 nt, Homo sapiens
ugcaggcucuuuauuacuggug

SEQ ID NO: 12680 - RNA, 22 nt, Homo sapiens
uacuucuccaggagccacuuac

SEQ ID NO: 12681 - RNA, 22 nt, Homo sapiens
gugggggucucugagcagguaa

SEQ ID NO: 12682 - RNA, 22 nt, Homo sapiens
aacaccagucgaugggcugucu

SEQ ID NO: 12683 - RNA, 22 nt, Homo sapiens
uagcuuaucagacugauguuga

SEQ ID NO: 12684 - RNA, 23 nt, Homo sapiens
uagcuuaucagacugauguugac

SEQ ID NO: 12685 - RNA, 22 nt, Homo sapiens
gcuuugccuggaguuucugguu

SEQ ID NO: 12686 - RNA, 20 nt, Homo sapiens
agaucaacucuugccaaagc

SEQ ID NO: 12687 - RNA, 22 nt, Homo sapiens
ugacugcagccccugguguggu

SEQ ID NO: 12688 - RNA, 22 nt, Homo sapiens
cugccuggguucugugucugag

SEQ ID NO: 12689 - RNA, 22 nt, Homo sapiens
ugccucucauuuccugccaguc

SEQ ID NO: 12690 - RNA, 22 nt, Homo sapiens
auggugagaagugaccccagag

SEQ ID NO: 12691 - RNA, 22 nt, Homo sapiens
acuccacgccuuuugucugcug

SEQ ID NO: 12692 - RNA, 18 nt, Homo sapiens
aggcuagggaccuggggu

SEQ ID NO: 12693 - RNA, 22 nt, Homo sapiens
ucugucagccucacugguagca

SEQ ID NO: 12694 - RNA, 22 nt, Homo sapiens
uaccaaugaggcugacagaugg

SEQ ID NO: 12695 - RNA, 22 nt, Homo sapiens
caugaaaagggugggaggggag

SEQ ID NO: 12696 - RNA, 22 nt, Homo sapiens
ucuuugcucacccuuccaccug

SEQ ID NO: 12697 - RNA, 22 nt, Homo sapiens
gagggagugaaauggaauagag

SEQ ID NO: 12698 - RNA, 22 nt, Homo sapiens
ucuguggcuauuugauucucua

SEQ ID NO: 12699 - RNA, 22 nt, Homo sapiens
ggguugggagggauuguacuga

SEQ ID NO: 12700 - RNA, 22 nt, Homo sapiens
ucagaccuuccuucccaauucu

SEQ ID NO: 12701 - RNA, 22 nt, Homo sapiens
agggaaagaauaaccagaguca

SEQ ID NO: 12702 - RNA, 22 nt, Homo sapiens
uggcuccguguucuuucuuucu

SEQ ID NO: 12703 - RNA, 20 nt, Homo sapiens
aacacaccugguuaaccucu

SEQ ID NO: 12704 - RNA, 21 nt, Homo sapiens
aacacaccugguuaaccucuu

SEQ ID NO: 12705 - RNA, 22 nt, Homo sapiens
aacacaccugguuaaccucuuu

SEQ ID NO: 12706 - RNA, 19 nt, Homo sapiens
acacaccugguuaaccucu

SEQ ID NO: 12707 - RNA, 22 nt, Homo sapiens
ucuuucccacccaucuuuguuc

SEQ ID NO: 12708 - RNA, 22 nt, Homo sapiens
cauugaugguagggaaggagug

SEQ ID NO: 12709 - RNA, 22 nt, Homo sapiens
uccucggauucccggauguggg

SEQ ID NO: 12710 - RNA, 22 nt, Homo sapiens
cgugcaggggaagucuggagaa

SEQ ID NO: 12711 - RNA, 22 nt, Homo sapiens
ugcgugacguaggcuggcgugg

SEQ ID NO: 12712 - RNA, 22 nt, Homo sapiens
ccuugccggugcugccacguga

SEQ ID NO: 12713 - RNA, 22 nt, Homo sapiens
ugcgugacguaggcuggcgugg

SEQ ID NO: 12714 - RNA, 22 nt, Homo sapiens
ccuugccggugcugccacguga

SEQ ID NO: 12715 - RNA, 22 nt, Homo sapiens
uccugucgccccaggcccggug

SEQ ID NO: 12716 - RNA, 22 nt, Homo sapiens
cccgcgugggggggacgggaag

SEQ ID NO: 12717 - RNA, 22 nt, Homo sapiens
uaaccauacacauuguuuccgg

SEQ ID NO: 12718 - RNA, 22 nt, Homo sapiens
cucaggcagugguauggauggg

SEQ ID NO: 12719 - RNA, 21 nt, Homo sapiens
cucuagagggaagcacuuucu

SEQ ID NO: 12720 - RNA, 20 nt, Homo sapiens
ucuagagggaagcacuuucu

SEQ ID NO: 12721 - RNA, 21 nt, Homo sapiens
ucuagagggaagcacuuucug

SEQ ID NO: 12722 - RNA, 22 nt, Homo sapiens
ugcugucuguggagccugaagu

SEQ ID NO: 12723 - RNA, 22 nt, Homo sapiens
uucccaggcuccagggagccug

SEQ ID NO: 12724 - RNA, 22 nt, Homo sapiens
uggguguauuuuauuccucagg

SEQ ID NO: 12725 - RNA, 22 nt, Homo sapiens
ccugaggagugaaugggccuca

SEQ ID NO: 12726 - RNA, 22 nt, Homo sapiens
ugucuuccuuugcagucuccau

SEQ ID NO: 12727 - RNA, 22 nt, Homo sapiens
caggggacguggaggagcagag

SEQ ID NO: 12728 - RNA, 22 nt, Homo sapiens
ggagcauuuuuacuagcuaggg

SEQ ID NO: 12729 - RNA, 22 nt, Homo sapiens
uugcuaaaauuaaaugcuuuug

SEQ ID NO: 12730 - RNA, 22 nt, Homo sapiens
ggaggcuggcaucuugccucuu

SEQ ID NO: 12731 - RNA, 20 nt, Homo sapiens
ggaguaagagucucccuccc

SEQ ID NO: 12732 - RNA, 22 nt, Homo sapiens
gcccugacaccccuccuggggu

SEQ ID NO: 12733 - RNA, 22 nt, Homo sapiens
caccagcaggggguccaggccu

SEQ ID NO: 12734 - RNA, 22 nt, Homo sapiens
ugggcaugugggcagggugcug

SEQ ID NO: 12735 - RNA, 22 nt, Homo sapiens
uguccagccugcccacacccac

SEQ ID NO: 12736 - RNA, 22 nt, Homo sapiens
ucugcccaccuagacccccgcu

SEQ ID NO: 12737 - RNA, 22 nt, Homo sapiens
cugggggcugggcugggaggac

SEQ ID NO: 12738 - RNA, 22 nt, Homo sapiens
uguggucaggagagugccgucu

SEQ ID NO: 12739 - RNA, 22 nt, Homo sapiens
guugguuuuagcuuggcccauu

SEQ ID NO: 12740 - RNA, 22 nt, Homo sapiens
uuuggcaggaguaggagagaaa

SEQ ID NO: 12741 - RNA, 22 nt, Homo sapiens
uccucuaccuuuucucccaauu

SEQ ID NO: 12742 - RNA, 22 nt, Homo sapiens
ugcacauccaggcuacuuccug

SEQ ID NO: 12743 - RNA, 22 nt, Homo sapiens
ggaagcauccugagguguccau

SEQ ID NO: 12744 - RNA, 22 nt, Homo sapiens
ugcacauccaggcuacuuccug

SEQ ID NO: 12745 - RNA, 22 nt, Homo sapiens
ggaagcauccugagguguccau

SEQ ID NO: 12746 - RNA, 22 nt, Homo sapiens
gccucccuaagaccuuucccuc

SEQ ID NO: 12747 - RNA, 19 nt, Homo sapiens
gaggagaggguuugggggu

SEQ ID NO: 12748 - RNA, 22 nt, Homo sapiens
uauauagggauauaauuuuagc

SEQ ID NO: 12749 - RNA, 22 nt, Homo sapiens
gauauuaugucccuaauauaca

SEQ ID NO: 12750 - RNA, 22 nt, Homo sapiens
uguguguguguccgucccccca

SEQ ID NO: 12751 - RNA, 22 nt, Homo sapiens
gagggagcgugugcaugugcac

SEQ ID NO: 12752 - RNA, 22 nt, Homo sapiens
uggggauuuucuauuucuuuuu

SEQ ID NO: 12753 - RNA, 22 nt, Homo sapiens
aggauuagaagaugacccagaa

SEQ ID NO: 12754 - RNA, 22 nt, Homo sapiens
uuucuaaaggucggcaaaacuc

SEQ ID NO: 12755 - RNA, 22 nt, Homo sapiens
gaguuuuacuuaccuaagaagc

SEQ ID NO: 12756 - RNA, 22 nt, Homo sapiens
aguuuuguuuuucaaaauaaua

SEQ ID NO: 12757 - RNA, 22 nt, Homo sapiens
aggguugugacaagcuuaaucu

SEQ ID NO: 12758 - RNA, 22 nt, Homo sapiens
caggacccaggggccuggugac

SEQ ID NO: 12759 - RNA, 22 nt, Homo sapiens
caucaccuuuccuggcccuguc

SEQ ID NO: 12760 - RNA, 22 nt, Homo sapiens
agggccuguucugauuggcaga

SEQ ID NO: 12761 - RNA, 22 nt, Homo sapiens
ugcacagcuggaauguggccac

SEQ ID NO: 12762 - RNA, 22 nt, Homo sapiens
uucccucugacguggagggagg

SEQ ID NO: 12763 - RNA, 20 nt, Homo sapiens
gcuuuccucugcacagggaa

SEQ ID NO: 12764 - RNA, 22 nt, Homo sapiens
ucuuugguaaagucugcugcau

SEQ ID NO: 12765 - RNA, 22 nt, Homo sapiens
ugagcagauuuguucuaggggu

SEQ ID NO: 12766 - RNA, 22 nt, Homo sapiens
cggguagagagggcagugggag

SEQ ID NO: 12767 - RNA, 22 nt, Homo sapiens
uucaccaccuucuccacccagc

SEQ ID NO: 12768 - RNA, 22 nt, Homo sapiens
gaguccccuggugaggacaugg

SEQ ID NO: 12769 - RNA, 22 nt, Homo sapiens
ccgucuucucacaggggucucc

SEQ ID NO: 12770 - RNA, 22 nt, Homo sapiens
uguugaaacaaucucuacugaa

SEQ ID NO: 12771 - RNA, 22 nt, Homo sapiens
ucacuggaguuuguuucaauau

SEQ ID NO: 12772 - RNA, 22 nt, Homo sapiens
ugugucccuucuuuaagagugu

SEQ ID NO: 12773 - RNA, 22 nt, Homo sapiens
accucagaaaagggacagaaag

SEQ ID NO: 12774 - RNA, 22 nt, Homo sapiens
agugggcuccaccucccuggga

SEQ ID NO: 12775 - RNA, 22 nt, Homo sapiens
cacucggagguggggccucacc

SEQ ID NO: 12776 - RNA, 22 nt, Homo sapiens
gcccagcuucccagccccuccu

SEQ ID NO: 12777 - RNA, 19 nt, Homo sapiens
aggagggggcugccugggc

SEQ ID NO: 12778 - RNA, 22 nt, Homo sapiens
ugugcuauuccaaggccggggg

SEQ ID NO: 12779 - RNA, 22 nt, Homo sapiens
cugaucuuggaauggcacagcu

SEQ ID NO: 12780 - RNA, 22 nt, Homo sapiens
aguugcaaacugucuccuuagc

SEQ ID NO: 12781 - RNA, 22 nt, Homo sapiens
uaaggagaugguuugcaacuug

SEQ ID NO: 12782 - RNA, 22 nt, Homo sapiens
ucucaggccucagccugccagg

SEQ ID NO: 12783 - RNA, 22 nt, Homo sapiens
uggcagugucuaggggucuggg

SEQ ID NO: 12784 - RNA, 22 nt, Homo sapiens
gaagcuuuuugcucgaauuaug

SEQ ID NO: 12785 - RNA, 22 nt, Homo sapiens
uaagacgaacaaaagguuuguc

SEQ ID NO: 12786 - RNA, 22 nt, Homo sapiens
uacacagguuuaucucucugac

SEQ ID NO: 12787 - RNA, 22 nt, Homo sapiens
uagauugagauaaaugugugua

SEQ ID NO: 12788 - RNA, 22 nt, Homo sapiens
ugucuguuuuucuugccauacc

SEQ ID NO: 12789 - RNA, 22 nt, Homo sapiens
auggcauugcaagggcaggagg

SEQ ID NO: 12790 - RNA, 22 nt, Homo sapiens
uuugaugagaacaucuggggcc

SEQ ID NO: 12791 - RNA, 22 nt, Homo sapiens
gccucugauuuuagaucaagag

SEQ ID NO: 12792 - RNA, 22 nt, Homo sapiens
uuuccguaguaacugugcagga

SEQ ID NO: 12793 - RNA, 20 nt, Homo sapiens
ugccugguuacuagggaaac

SEQ ID NO: 12794 - RNA, 22 nt, Homo sapiens
uacaguauagaugauguacuag

SEQ ID NO: 12795 - RNA, 22 nt, Homo sapiens
ugggauaucaucauauacugua

SEQ ID NO: 12796 - RNA, 23 nt, Homo sapiens
acuccauuuguuuugaugaugga

SEQ ID NO: 12797 - RNA, 22 nt, Homo sapiens
ucaucgucucaaaugagucuuc

SEQ ID NO: 12798 - RNA, 21 nt, Homo sapiens
aucaucgucucaaaugagucu

SEQ ID NO: 12799 - RNA, 22 nt, Homo sapiens
caucaucgucucaaaugagucu

SEQ ID NO: 12800 - RNA, 20 nt, Homo sapiens
ucaucgucucaaaugagucu

SEQ ID NO: 12801 - RNA, 22 nt, Homo sapiens
gaggagaagggggaggugauau

SEQ ID NO: 12802 - RNA, 22 nt, Homo sapiens
aacucuccucucuuucugcuuu

SEQ ID NO: 12803 - RNA, 22 nt, Homo sapiens
uggggcagggggcccaggacag

SEQ ID NO: 12804 - RNA, 22 nt, Homo sapiens
uccuggagcccugcccagccca

SEQ ID NO: 12805 - RNA, 22 nt, Homo sapiens
ucuggggauauguguucagagu

SEQ ID NO: 12806 - RNA, 22 nt, Homo sapiens
uugaaggugugucccaagguau

SEQ ID NO: 12807 - RNA, 22 nt, Homo sapiens
acauaguugucuuggugguaca

SEQ ID NO: 12808 - RNA, 22 nt, Homo sapiens
uaacacuggggguucuguguca

SEQ ID NO: 12809 - RNA, 22 nt, Homo sapiens
uuacugugauaauaauaugagu

SEQ ID NO: 12810 - RNA, 22 nt, Homo sapiens
ucauauuuuuaucacaauaacc

SEQ ID NO: 12811 - RNA, 22 nt, Homo sapiens
uggaggucccagggugguuggg

SEQ ID NO: 12812 - RNA, 18 nt, Homo sapiens
ccguccugggagcucugg

SEQ ID NO: 12813 - RNA, 22 nt, Homo sapiens
uggguucauuauucuugggcgu

SEQ ID NO: 12814 - RNA, 22 nt, Homo sapiens
caccagagacugaugaggccac

SEQ ID NO: 12815 - RNA, 22 nt, Homo sapiens
uuuccaguccuaguuguuccac

SEQ ID NO: 12816 - RNA, 16 nt, Homo sapiens
ggagcugggauggaga

SEQ ID NO: 12817 - RNA, 22 nt, Homo sapiens
gccccugccccgcccccccagg

SEQ ID NO: 12818 - RNA, 20 nt, Homo sapiens
ugggggagcgggggaggggc

SEQ ID NO: 12819 - RNA, 22 nt, Homo sapiens
ugguaccugggcugcagcccgg

SEQ ID NO: 12820 - RNA, 22 nt, Homo sapiens
ggcuggccgccccaugccuucc

SEQ ID NO: 12821 - RNA, 22 nt, Homo sapiens
aaggcuagugcauggaaccucc

SEQ ID NO: 12822 - RNA, 22 nt, Homo sapiens
ugaagaaccaugacuaguguuu

SEQ ID NO: 12823 - RNA, 22 nt, Homo sapiens
ugcugcagucaggaguggggug

SEQ ID NO: 12824 - RNA, 22 nt, Homo sapiens
cccuccccaccccugcagagag

SEQ ID NO: 12825 - RNA, 22 nt, Homo sapiens
ugucaugggguacuacacaugg

SEQ ID NO: 12826 - RNA, 22 nt, Homo sapiens
gugggucacucacauggggguu

SEQ ID NO: 12827 - RNA, 22 nt, Homo sapiens
uauugcauuaauagaucaucag

SEQ ID NO: 12828 - RNA, 22 nt, Homo sapiens
agugauauauuagugcaauaca

SEQ ID NO: 12829 - RNA, 22 nt, Homo sapiens
ugaauucucauggcaucuuuga

SEQ ID NO: 12830 - RNA, 22 nt, Homo sapiens
ucagagagucaaguauuuuuug

SEQ ID NO: 12831 - RNA, 22 nt, Homo sapiens
acaauugugggagcacugcugu

SEQ ID NO: 12832 - RNA, 22 nt, Homo sapiens
cagcucugcuccaucaguugcc

SEQ ID NO: 12833 - RNA, 22 nt, Homo sapiens
gaugagugaugggucuuucuga

SEQ ID NO: 12834 - RNA, 22 nt, Homo sapiens
augaaagauucauacacaucug

SEQ ID NO: 12835 - RNA, 22 nt, Homo sapiens
ccccaggagggccucucugauu

SEQ ID NO: 12836 - RNA, 19 nt, Homo sapiens
uagagcuugcccucugggg

SEQ ID NO: 12837 - RNA, 22 nt, Homo sapiens
ucaccucauuaguaucuuguuu

SEQ ID NO: 12838 - RNA, 22 nt, Homo sapiens
ggcaaaguauuaaugagugacu

SEQ ID NO: 12839 - RNA, 22 nt, Homo sapiens
cagauaguugcucgggggucga

SEQ ID NO: 12840 - RNA, 22 nt, Homo sapiens
gacuuuucgagauaacagguuu

SEQ ID NO: 12841 - RNA, 22 nt, Homo sapiens
uauuagguuggggcgaaaguaa

SEQ ID NO: 12842 - RNA, 22 nt, Homo sapiens
uacuuuugccccaaccuaauac

SEQ ID NO: 12843 - RNA, 22 nt, Homo sapiens
gaaugaacuguggcuaccugug

SEQ ID NO: 12844 - RNA, 22 nt, Homo sapiens
cagaaagccacagugcauugcu

SEQ ID NO: 12845 - RNA, 22 nt, Homo sapiens
aacauucaaccugucggugagu

SEQ ID NO: 12846 - RNA, 22 nt, Homo sapiens
accaucgaccguugaguggacc

SEQ ID NO: 12847 - RNA, 22 nt, Homo sapiens
uaagaauauguuugacauuuag

SEQ ID NO: 12848 - RNA, 22 nt, Homo sapiens
cccaauaucaaacauaucacac

SEQ ID NO: 12849 - RNA, 22 nt, Homo sapiens
cggaggugacccugugcaggcu

SEQ ID NO: 12850 - RNA, 22 nt, Homo sapiens
ccugaccggggucccccuccag

SEQ ID NO: 12851 - RNA, 22 nt, Homo sapiens
ugggagggcccaggaggagggg

SEQ ID NO: 12852 - RNA, 22 nt, Homo sapiens
ggcccuuccucccucccuccag

SEQ ID NO: 12853 - RNA, 22 nt, Homo sapiens
ugcucugauggugcuuuugggg

SEQ ID NO: 12854 - RNA, 22 nt, Homo sapiens
ccagggagucaaaggagaaggg

SEQ ID NO: 12855 - RNA, 22 nt, Homo sapiens
agcuggagauuaacugggcauc

SEQ ID NO: 12856 - RNA, 22 nt, Homo sapiens
uggcuagauagguugucagcuu

SEQ ID NO: 12857 - RNA, 22 nt, Homo sapiens
uuuauauuuucuuuauaagaaa

SEQ ID NO: 12858 - RNA, 22 nt, Homo sapiens
ucuuauaaagaaaugauaaauc

SEQ ID NO: 12859 - RNA, 22 nt, Homo sapiens
ugguuagaacaugcucaagagc

SEQ ID NO: 12860 - RNA, 22 nt, Homo sapiens
ucugugggccugggcuagcugc

SEQ ID NO: 12861 - RNA, 22 nt, Homo sapiens
uuugguggggggugcacugauc

SEQ ID NO: 12862 - RNA, 22 nt, Homo sapiens
ugacugugccccuggccagcga

SEQ ID NO: 12863 - RNA, 22 nt, Homo sapiens
gguaugggugaucugaauauug

SEQ ID NO: 12864 - RNA, 20 nt, Homo sapiens
cagucagugaugcacauacc

SEQ ID NO: 12865 - RNA, 22 nt, Homo sapiens
cauuggcucuuggccuguuugg

SEQ ID NO: 12866 - RNA, 22 nt, Homo sapiens
gagagguggaaggucagaugca

SEQ ID NO: 12867 - RNA, 22 nt, Homo sapiens
ggggccugggagggagggcgcc

SEQ ID NO: 12868 - RNA, 22 nt, Homo sapiens
ggcucucucuccccacgauccc

SEQ ID NO: 12869 - RNA, 22 nt, Homo sapiens
ccuuggcuggcuaccugggccg

SEQ ID NO: 12870 - RNA, 21 nt, Homo sapiens
ucacccuuguggcagcgaggc

SEQ ID NO: 12871 - RNA, 22 nt, Homo sapiens
ugccuuguuacagcugccucuu

SEQ ID NO: 12872 - RNA, 22 nt, Homo sapiens
agaugguauuuguaggaaugcg

SEQ ID NO: 12873 - RNA, 22 nt, Homo sapiens
aguugcuuuuaauguuccuuuc

SEQ ID NO: 12874 - RNA, 22 nt, Homo sapiens
aaggaauuuuauuugaggaacu

SEQ ID NO: 12875 - RNA, 22 nt, Homo sapiens
ccacagaguucauuacagggua

SEQ ID NO: 12876 - RNA, 22 nt, Homo sapiens
uaucuuguaaauauuauguggu

SEQ ID NO: 12877 - RNA, 22 nt, Homo sapiens
gaggggcugggcugggcugggc

SEQ ID NO: 12878 - RNA, 22 nt, Homo sapiens
ccaucuguccagccaccagcgu

SEQ ID NO: 12879 - RNA, 22 nt, Homo sapiens
gagaguuucucccuagcauuug

SEQ ID NO: 12880 - RNA, 22 nt, Homo sapiens
aaaugcuagagaggaacccugc

SEQ ID NO: 12881 - RNA, 22 nt, Homo sapiens
cuccugacuccagguccugugu

SEQ ID NO: 12882 - RNA, 22 nt, Homo sapiens
cuggacuuggagucagaaggcc

SEQ ID NO: 12883 - RNA, 22 nt, Homo sapiens
aauggugguugcuugaacuuua

SEQ ID NO: 12884 - RNA, 22 nt, Homo sapiens
aaguucuuguugcuggauuugg

SEQ ID NO: 12885 - RNA, 22 nt, Homo sapiens
gcgagguaggugcuuccugucc

SEQ ID NO: 12886 - RNA, 22 nt, Homo sapiens
acuuggaacgccaaccuugcuc

SEQ ID NO: 12887 - RNA, 22 nt, Homo sapiens
gucgggauggcacaagacuacu

SEQ ID NO: 12888 - RNA, 22 nt, Homo sapiens
uagugcuguguaucuggaguug

SEQ ID NO: 12889 - RNA, 22 nt, Homo sapiens
uggauaagugaccccccagcua

SEQ ID NO: 12890 - RNA, 22 nt, Homo sapiens
cuguggcaguuauuuauuuuac

SEQ ID NO: 12891 - RNA, 22 nt, Homo sapiens
uggggugggcuguccgauggug

SEQ ID NO: 12892 - RNA, 22 nt, Homo sapiens
acccauuggugccucccuagac

SEQ ID NO: 12893 - RNA, 22 nt, Homo sapiens
uuguuuuggagauggauuuaug

SEQ ID NO: 12894 - RNA, 22 nt, Homo sapiens
ugaauaccauccucacaaggga

SEQ ID NO: 12895 - RNA, 22 nt, Homo sapiens
uccaauuccuuccccaccagcu

SEQ ID NO: 12896 - RNA, 22 nt, Homo sapiens
cagcugauggggaggguguccu

SEQ ID NO: 12897 - RNA, 22 nt, Homo sapiens
aagguggugauuagguuuucag

SEQ ID NO: 12898 - RNA, 22 nt, Homo sapiens
ugagacaaccuaauuaaacacc

SEQ ID NO: 12899 - RNA, 22 nt, Homo sapiens
ggcuguggggauuguugcuuau

SEQ ID NO: 12900 - RNA, 20 nt, Homo sapiens
guggccaguccugagcagcu

SEQ ID NO: 12901 - RNA, 22 nt, Homo sapiens
gagagcuuuggguggacugaga

SEQ ID NO: 12902 - RNA, 22 nt, Homo sapiens
aauuaguucgcuuggagucacc

SEQ ID NO: 12903 - RNA, 22 nt, Homo sapiens
ucuggcacaguucacuggaccu

SEQ ID NO: 12904 - RNA, 22 nt, Homo sapiens
gacguccagggacucacagagc

SEQ ID NO: 12905 - RNA, 22 nt, Homo sapiens
gcacccgcauguccugguccuu

SEQ ID NO: 12906 - RNA, 22 nt, Homo sapiens
guggccaggacagagguggagg

SEQ ID NO: 12907 - RNA, 22 nt, Homo sapiens
aaaggugggcaaaauuucuguu

SEQ ID NO: 12908 - RNA, 19 nt, Homo sapiens
aaauuuugccaugaucuuu

SEQ ID NO: 12909 - RNA, 22 nt, Homo sapiens
gcaacaucccacauuguuuauu

SEQ ID NO: 12910 - RNA, 22 nt, Homo sapiens
agauuaaagugggauucuugcc

SEQ ID NO: 12911 - RNA, 22 nt, Homo sapiens
ucccagaacccagcucaccuac

SEQ ID NO: 12912 - RNA, 22 nt, Homo sapiens
gaaggugggcaguucuggaaug

SEQ ID NO: 12913 - RNA, 22 nt, Homo sapiens
gggcuguacgcuuccucugucu

SEQ ID NO: 12914 - RNA, 22 nt, Homo sapiens
accauaguccagcgugcugccc

SEQ ID NO: 12915 - RNA, 22 nt, Homo sapiens
uaaagugaguuagcccaggccc

SEQ ID NO: 12916 - RNA, 22 nt, Homo sapiens
gggucugauguuggccuuagaa

SEQ ID NO: 12917 - RNA, 22 nt, Homo sapiens
uguggcuaguuagcuaaugcuu

SEQ ID NO: 12918 - RNA, 22 nt, Homo sapiens
cauuccuugggugacuggcugu

SEQ ID NO: 12919 - RNA, 22 nt, Homo sapiens
gaguacucuguaauugagugug

SEQ ID NO: 12920 - RNA, 22 nt, Homo sapiens
cuuccucaauuccaagugcaug

SEQ ID NO: 12921 - RNA, 22 nt, Homo sapiens
ccuuugaccguuuuccugccca

SEQ ID NO: 12922 - RNA, 20 nt, Homo sapiens
gugggaagguggaagaaggg

SEQ ID NO: 12923 - RNA, 22 nt, Homo sapiens
gacagaaaggaugguugucucc

SEQ ID NO: 12924 - RNA, 22 nt, Homo sapiens
agauaaccgucugaucaugacu

SEQ ID NO: 12925 - RNA, 22 nt, Homo sapiens
ugaaaggguuauucaucucgag

SEQ ID NO: 12926 - RNA, 22 nt, Homo sapiens
guccucagugagugauccugug

SEQ ID NO: 12927 - RNA, 22 nt, Homo sapiens
acugaagcuaaauggauauugu

SEQ ID NO: 12928 - RNA, 22 nt, Homo sapiens
acagugucuggguuucagggcc

SEQ ID NO: 12929 - RNA, 22 nt, Homo sapiens
cccuuugcuacccagguaaacu

SEQ ID NO: 12930 - RNA, 22 nt, Homo sapiens
uguguguggguggggagauggg

SEQ ID NO: 12931 - RNA, 22 nt, Homo sapiens
caaccuuuugucaaggaaauua

SEQ ID NO: 12932 - RNA, 22 nt, Homo sapiens
uuuucuuggcaaaagguugagc

SEQ ID NO: 12933 - RNA, 22 nt, Homo sapiens
ucauguggccucaugagccugg

SEQ ID NO: 12934 - RNA, 22 nt, Homo sapiens
augggcaugagacuccacguga

SEQ ID NO: 12935 - RNA, 22 nt, Homo sapiens
gagacagagggugcaggaaaga

SEQ ID NO: 12936 - RNA, 22 nt, Homo sapiens
cccuccuuggccugcccuuugu

SEQ ID NO: 12937 - RNA, 22 nt, Homo sapiens
cagaugcaauuagccucugggu

SEQ ID NO: 12938 - RNA, 22 nt, Homo sapiens
ugcagguggcuaauuguccaug

SEQ ID NO: 12939 - RNA, 22 nt, Homo sapiens
uaaccgagcugucuauauccua

SEQ ID NO: 12940 - RNA, 22 nt, Homo sapiens
uugugauguguugugauagcug

SEQ ID NO: 12941 - RNA, 22 nt, Homo sapiens
ucggagaggaaaaaccauugau

SEQ ID NO: 12942 - RNA, 22 nt, Homo sapiens
ucugcaaaugguggccuucuuc

SEQ ID NO: 12943 - RNA, 22 nt, Homo sapiens
uccucugcaguauccuagccac

SEQ ID NO: 12944 - RNA, 19 nt, Homo sapiens
gcugggauauucaagggga

SEQ ID NO: 12945 - RNA, 22 nt, Homo sapiens
ugcaugaguugcuaauauagac

SEQ ID NO: 12946 - RNA, 22 nt, Homo sapiens
uacugcugugguaaugaugcag

SEQ ID NO: 12947 - RNA, 22 nt, Homo sapiens
ccacugccccaggugcugcugg

SEQ ID NO: 12948 - RNA, 23 nt, Homo sapiens
cgcauccccuagggcauuggugu

SEQ ID NO: 12949 - RNA, 22 nt, Homo sapiens
uauuuuuggugcuggaagccag

SEQ ID NO: 12950 - RNA, 22 nt, Homo sapiens
gcuuucagcaucaagucuguuc

SEQ ID NO: 12951 - RNA, 22 nt, Homo sapiens
uguugaaucugagggccaggcu

SEQ ID NO: 12952 - RNA, 22 nt, Homo sapiens
gccuagucccagggagacagcc

SEQ ID NO: 12953 - RNA, 22 nt, Homo sapiens
aggaagugggugcuuuagaggu

SEQ ID NO: 12954 - RNA, 22 nt, Homo sapiens
uuuuagggcauucugaucuuca

SEQ ID NO: 12955 - RNA, 22 nt, Homo sapiens
ugcuacauucugccuagaacua

SEQ ID NO: 12956 - RNA, 22 nt, Homo sapiens
uucuaggcaaaacauagcagaa

SEQ ID NO: 12957 - RNA, 22 nt, Homo sapiens
ugaggagcaaagcccugugggg

SEQ ID NO: 12958 - RNA, 22 nt, Homo sapiens
uccaugugggcuggugccuccc

SEQ ID NO: 12959 - RNA, 22 nt, Homo sapiens
gaccgcaugcuaaguugggccc

SEQ ID NO: 12960 - RNA, 22 nt, Homo sapiens
gugugacauagcagagugguuu

SEQ ID NO: 12961 - RNA, 22 nt, Homo sapiens
ugacagaacaauguggagagag

SEQ ID NO: 12962 - RNA, 22 nt, Homo sapiens
uccuuacuuuguucugggcauu

SEQ ID NO: 12963 - RNA, 22 nt, Homo sapiens
uccaacaaggaaagacaggagg

SEQ ID NO: 12964 - RNA, 22 nt, Homo sapiens
ucuuguccuuccuuguuggggc

SEQ ID NO: 12965 - RNA, 22 nt, Homo sapiens
ugauaaaaugaugaaaucacug

SEQ ID NO: 12966 - RNA, 22 nt, Homo sapiens
aguggagucagcauuuuaucac

SEQ ID NO: 12967 - RNA, 22 nt, Homo sapiens
ugucauguaauguaucauagca

SEQ ID NO: 12968 - RNA, 22 nt, Homo sapiens
cuaugcaugucauaugugagcu

SEQ ID NO: 12969 - RNA, 22 nt, Homo sapiens
uuguaacuaaccaguuacuuug

SEQ ID NO: 12970 - RNA, 22 nt, Homo sapiens
aaguaacugcuuaguuacaagu

SEQ ID NO: 12971 - RNA, 22 nt, Homo sapiens
gagugauuuucagggggucgca

SEQ ID NO: 12972 - RNA, 22 nt, Homo sapiens
ugggagucccugagggaauuau

SEQ ID NO: 12973 - RNA, 22 nt, Homo sapiens
gagggaggcagggcagaagugg

SEQ ID NO: 12974 - RNA, 22 nt, Homo sapiens
cugcagcucuguuuuucucucu

SEQ ID NO: 12975 - RNA, 22 nt, Homo sapiens
uggauggucgaccaguuggaaa

SEQ ID NO: 12976 - RNA, 22 nt, Homo sapiens
cuucaccugguccacuagccgu

SEQ ID NO: 12977 - RNA, 22 nt, Homo sapiens
ccuauucuugauuacuuguuuc

SEQ ID NO: 12978 - RNA, 21 nt, Homo sapiens
uucaaguaauccaggauaggc

SEQ ID NO: 12979 - RNA, 22 nt, Homo sapiens
aaaagaggcaauagaagaugcu

SEQ ID NO: 12980 - RNA, 22 nt, Homo sapiens
caucuucuaguaucucuuuuua

SEQ ID NO: 12981 - RNA, 22 nt, Homo sapiens
uggucaagucuguggcuggugu

SEQ ID NO: 12982 - RNA, 22 nt, Homo sapiens
accaggcacaggaucugaacuc

SEQ ID NO: 12983 - RNA, 22 nt, Homo sapiens
ggagggcauucuuggguagaug

SEQ ID NO: 12984 - RNA, 22 nt, Homo sapiens
cauacuuugagaaaguguuuag

SEQ ID NO: 12985 - RNA, 22 nt, Homo sapiens
uguauuggaguucuucucuucu

SEQ ID NO: 12986 - RNA, 19 nt, Homo sapiens
aagagaaggcuaaaguaca

SEQ ID NO: 12987 - RNA, 22 nt, Homo sapiens
uggugaugacaguuggaugcac

SEQ ID NO: 12988 - RNA, 22 nt, Homo sapiens
aacuaacuguuaauaaaguagg

SEQ ID NO: 12989 - RNA, 22 nt, Homo sapiens
uaauuauggaauuauggcuuaa

SEQ ID NO: 12990 - RNA, 22 nt, Homo sapiens
uaagucaugauucuguguuacu

SEQ ID NO: 12991 - RNA, 22 nt, Homo sapiens
gcgaggggagggcccagccccu

SEQ ID NO: 12992 - RNA, 16 nt, Homo sapiens
gguuggcccaccucgc

SEQ ID NO: 12993 - RNA, 22 nt, Homo sapiens
ggggcgaggggcacugggcaaa

SEQ ID NO: 12994 - RNA, 22 nt, Homo sapiens
ugcuaaggcuccuccugucuuc

SEQ ID NO: 12995 - RNA, 22 nt, Homo sapiens
uucugggcucuuaacuguauga

SEQ ID NO: 12996 - RNA, 22 nt, Homo sapiens
agcaacaauuaagaagcugcag

SEQ ID NO: 12997 - RNA, 22 nt, Homo sapiens
accccagggccugcagugggac

SEQ ID NO: 12998 - RNA, 22 nt, Homo sapiens
ccccacacaggccucggggagg

SEQ ID NO: 12999 - RNA, 22 nt, Homo sapiens
gauggggaggguggguguaggg

SEQ ID NO: 13000 - RNA, 22 nt, Homo sapiens
uuugccucuccauccucagaug

SEQ ID NO: 13001 - RNA, 22 nt, Homo sapiens
gaugguugaucagagaacguac

SEQ ID NO: 13002 - RNA, 22 nt, Homo sapiens
uaugucaguugauccacagucc

SEQ ID NO: 13003 - RNA, 22 nt, Homo sapiens
acuguucacaaaauucuggcca

SEQ ID NO: 13004 - RNA, 22 nt, Homo sapiens
ccaagguuuugugaacuguguc

SEQ ID NO: 13005 - RNA, 22 nt, Homo sapiens
ggguauuauggcagcugcagcc

SEQ ID NO: 13006 - RNA, 22 nt, Homo sapiens
ugcagcuguuuacagaugcauu

SEQ ID NO: 13007 - RNA, 22 nt, Homo sapiens
uggagacgcggcccuguuggag

SEQ ID NO: 13008 - RNA, 22 nt, Homo sapiens
ucuacagugcacgugucuccag

SEQ ID NO: 13009 - RNA, 22 nt, Homo sapiens
uggggcuggggcgguggcacug

SEQ ID NO: 13010 - RNA, 22 nt, Homo sapiens
uguggcuuccccagcccgucuu

SEQ ID NO: 13011 - RNA, 22 nt, Homo sapiens
uggaccuggaggugaauucagc

SEQ ID NO: 13012 - RNA, 22 nt, Homo sapiens
ugaggucauuuccaucuuccau

SEQ ID NO: 13013 - RNA, 22 nt, Homo sapiens
uggauucaggaucucuccuugg

SEQ ID NO: 13014 - RNA, 22 nt, Homo sapiens
aaggggauaucaugucucuuug

SEQ ID NO: 13015 - RNA, 22 nt, Homo sapiens
uagcaagauuguuuccccauga

SEQ ID NO: 13016 - RNA, 22 nt, Homo sapiens
ucuggggaagccauuuuguaga

SEQ ID NO: 13017 - RNA, 22 nt, Homo sapiens
ccacggaaagagcauuuuugug

SEQ ID NO: 13018 - RNA, 22 nt, Homo sapiens
ccaggcugcucuuucuuguggu

SEQ ID NO: 13019 - RNA, 22 nt, Homo sapiens
gagggguggaggaugggugagg

SEQ ID NO: 13020 - RNA, 22 nt, Homo sapiens
ucucucaggacuccauccuucu

SEQ ID NO: 13021 - RNA, 22 nt, Homo sapiens
uccacagccuuuugugaaauuu

SEQ ID NO: 13022 - RNA, 22 nt, Homo sapiens
gaauccuaagaggcugcuggga

SEQ ID NO: 13023 - RNA, 22 nt, Homo sapiens
uucugucuugggguucugaugg

SEQ ID NO: 13024 - RNA, 22 nt, Homo sapiens
ccagaaucccaugaugaaauua

SEQ ID NO: 13025 - RNA, 22 nt, Homo sapiens
ugauggccaggccaggggauac

SEQ ID NO: 13026 - RNA, 22 nt, Homo sapiens
ugucacuggccuuugccauaaa

SEQ ID NO: 13027 - RNA, 22 nt, Homo sapiens
acgguggccuagauucuugccc

SEQ ID NO: 13028 - RNA, 22 nt, Homo sapiens
uuaagaacucuagguuccugga

SEQ ID NO: 13029 - RNA, 22 nt, Homo sapiens
uuggcuccuguuccucugucug

SEQ ID NO: 13030 - RNA, 22 nt, Homo sapiens
gaagaggcaggaggagcuaaaa

SEQ ID NO: 13031 - RNA, 22 nt, Homo sapiens
agggcaaaaauccucauuuauu

SEQ ID NO: 13032 - RNA, 22 nt, Homo sapiens
uaaggugaggauuuuguucugc

SEQ ID NO: 13033 - RNA, 22 nt, Homo sapiens
uuuagguuaauuggugugaugc

SEQ ID NO: 13034 - RNA, 22 nt, Homo sapiens
ugcaugccuguuaaccuuuaac

SEQ ID NO: 13035 - RNA, 22 nt, Homo sapiens
ggugcuguuuaugggagcaggg

SEQ ID NO: 13036 - RNA, 22 nt, Homo sapiens
ugcuucaauacacagugcccua

SEQ ID NO: 13037 - RNA, 22 nt, Homo sapiens
uauaacuugcuaguuauacuac

SEQ ID NO: 13038 - RNA, 22 nt, Homo sapiens
guauaacuaguaaguuauacua

SEQ ID NO: 13039 - RNA, 22 nt, Homo sapiens
uuaaugaaaucuaguauaaacg

SEQ ID NO: 13040 - RNA, 22 nt, Homo sapiens
uuaaauauuagauuucauuacu

SEQ ID NO: 13041 - RNA, 22 nt, Homo sapiens
uuuuguuuuguucuguuucccu

SEQ ID NO: 13042 - RNA, 22 nt, Homo sapiens
auggaacagaguaaggcaaauc

SEQ ID NO: 13043 - RNA, 22 nt, Homo sapiens
uuggugacaacugguuuggagg

SEQ ID NO: 13044 - RNA, 22 nt, Homo sapiens
uuuggauugugucaucagcucc

SEQ ID NO: 13045 - RNA, 22 nt, Homo sapiens
aaggauuaaagucaaagcccca

SEQ ID NO: 13046 - RNA, 20 nt, Homo sapiens
ugguuuugauuuuuauucuu

SEQ ID NO: 13047 - RNA, 22 nt, Homo sapiens
cacugucuuccaucuaagucau

SEQ ID NO: 13048 - RNA, 22 nt, Homo sapiens
gucugagauggaagacugugca

SEQ ID NO: 13049 - RNA, 22 nt, Homo sapiens
aaagugcaugaaaggaauuaaa

SEQ ID NO: 13050 - RNA, 22 nt, Homo sapiens
uuaauucuuuucauauauuuca

SEQ ID NO: 13051 - RNA, 22 nt, Homo sapiens
ugcaugucuguuucuucucaau

SEQ ID NO: 13052 - RNA, 19 nt, Homo sapiens
uuguaagaaacaguaugua

SEQ ID NO: 13053 - RNA, 22 nt, Homo sapiens
ucaaaauguggaaaggagaaag

SEQ ID NO: 13054 - RNA, 22 nt, Homo sapiens
ugugucuccuuacauuuugugu

SEQ ID NO: 13055 - RNA, 22 nt, Homo sapiens
ucaauuugacaagguucuuucu

SEQ ID NO: 13056 - RNA, 22 nt, Homo sapiens
gggaguaagguucuugucaguu

SEQ ID NO: 13057 - RNA, 22 nt, Homo sapiens
ucuguuucuuucugucucuugg

SEQ ID NO: 13058 - RNA, 22 nt, Homo sapiens
ugaugaucagggcagaagcaga

SEQ ID NO: 13059 - RNA, 22 nt, Homo sapiens
uauauucacacacgcauaggcu

SEQ ID NO: 13060 - RNA, 22 nt, Homo sapiens
uguguguaugugugugcauaug

SEQ ID NO: 13061 - RNA, 22 nt, Homo sapiens
cccugauuuaauuagcuuuucc

SEQ ID NO: 13062 - RNA, 21 nt, Homo sapiens
aagccuguaauuagcucaggg

SEQ ID NO: 13063 - RNA, 22 nt, Homo sapiens
ugguuuuugguuuccagagcag

SEQ ID NO: 13064 - RNA, 20 nt, Homo sapiens
uucucugaagccauaaauca

SEQ ID NO: 13065 - RNA, 22 nt, Homo sapiens
ucauuuugucuccuaagcugau

SEQ ID NO: 13066 - RNA, 21 nt, Homo sapiens
uagugcugaggcaguauggga

SEQ ID NO: 13067 - RNA, 22 nt, Homo sapiens
ugcugacauauucuggaagcuu

SEQ ID NO: 13068 - RNA, 22 nt, Homo sapiens
ugagaguuccugugucaguagg

SEQ ID NO: 13069 - RNA, 22 nt, Homo sapiens
gauucugaggauucuacaaagc

SEQ ID NO: 13070 - RNA, 22 nt, Homo sapiens
uugaccugaauucucgggauuu

SEQ ID NO: 13071 - RNA, 22 nt, Homo sapiens
aggccucagugucauggacucu

SEQ ID NO: 13072 - RNA, 22 nt, Homo sapiens
agguuaugaccaacugaggccu

SEQ ID NO: 13073 - RNA, 22 nt, Homo sapiens
acucagcagcccuucgcaggaa

SEQ ID NO: 13074 - RNA, 22 nt, Homo sapiens
ugcccgaggggcugcugggcag

SEQ ID NO: 13075 - RNA, 22 nt, Homo sapiens
ucaguuccucaggcucagauuu

SEQ ID NO: 13076 - RNA, 22 nt, Homo sapiens
aucugggagcccuggagggcug

SEQ ID NO: 13077 - RNA, 22 nt, Homo sapiens
ucaaggaguugacacuuugggg

SEQ ID NO: 13078 - RNA, 22 nt, Homo sapiens
ccuaaaacauguugacucuuua

SEQ ID NO: 13079 - RNA, 22 nt, Homo sapiens
uguuggaggacauuaggaaggg

SEQ ID NO: 13080 - RNA, 21 nt, Homo sapiens
uuccaagugccuucugcagcu

SEQ ID NO: 13081 - RNA, 22 nt, Homo sapiens
uaaacugugggcauuuauuuac

SEQ ID NO: 13082 - RNA, 22 nt, Homo sapiens
agugagaucucacaaauuguau

SEQ ID NO: 13083 - RNA, 22 nt, Homo sapiens
gguagcuguggcuggcuggguu

SEQ ID NO: 13084 - RNA, 22 nt, Homo sapiens
auaucagcugccacaggacuuu

SEQ ID NO: 13085 - RNA, 22 nt, Homo sapiens
uucaaggauaagucauauguca

SEQ ID NO: 13086 - RNA, 22 nt, Homo sapiens
auaugacaacaucuugcagaaa

SEQ ID NO: 13087 - RNA, 22 nt, Homo sapiens
uguccucucagaguugucugcc

SEQ ID NO: 13088 - RNA, 22 nt, Homo sapiens
ugacugaucauucuagaggcug

SEQ ID NO: 13089 - RNA, 22 nt, Homo sapiens
aucauacagggacauccaguuu

SEQ ID NO: 13090 - RNA, 22 nt, Homo sapiens
gugguuaucccugcuguguucg

SEQ ID NO: 13091 - RNA, 22 nt, Homo sapiens
cccaaauggccagaucugugca

SEQ ID NO: 13092 - RNA, 17 nt, Homo sapiens
ugccaugguccuuuggg

SEQ ID NO: 13093 - RNA, 22 nt, Homo sapiens
uggcucguuuuucuugaaaggc

SEQ ID NO: 13094 - RNA, 21 nt, Homo sapiens
uuuuauugaugaauggccacu

SEQ ID NO: 13095 - RNA, 22 nt, Homo sapiens
uugcugguggcucugauuucau

SEQ ID NO: 13096 - RNA, 22 nt, Homo sapiens
ugaaacucuagcuuucagcacu

SEQ ID NO: 13097 - RNA, 22 nt, Homo sapiens
cucugaaauucaguucuucagc

SEQ ID NO: 13098 - RNA, 22 nt, Homo sapiens
ugagaacugaauuccauggguu

SEQ ID NO: 13099 - RNA, 22 nt, Homo sapiens
ucugauucauugaacguucuga

SEQ ID NO: 13100 - RNA, 18 nt, Homo sapiens
auguucuaaugcauuaga

SEQ ID NO: 13101 - RNA, 22 nt, Homo sapiens
uguugcuuucuuaauggcaaau

SEQ ID NO: 13102 - RNA, 22 nt, Homo sapiens
ugccggaagacaaguugcacug

SEQ ID NO: 13103 - RNA, 22 nt, Homo sapiens
cgguucccagacugcacuggaa

SEQ ID NO: 13104 - RNA, 22 nt, Homo sapiens
ucagugcauuugguggguacug

SEQ ID NO: 13105 - RNA, 22 nt, Homo sapiens
uuuuaugggauuuccuggcuuu

SEQ ID NO: 13106 - RNA, 22 nt, Homo sapiens
gccaguuaaaacucccuugaaa

SEQ ID NO: 13107 - RNA, 22 nt, Homo sapiens
ccaaaguagaaagcaagacaaa

SEQ ID NO: 13108 - RNA, 19 nt, Homo sapiens
uguuuugucuucucuuugg

SEQ ID NO: 13109 - RNA, 20 nt, Homo sapiens
aaagugcuuccuuuuagagg

SEQ ID NO: 13110 - RNA, 21 nt, Homo sapiens
aaagugcuuccuuuuagaggc

SEQ ID NO: 13111 - RNA, 19 nt, Homo sapiens
cucuugagggaagcacuuu

SEQ ID NO: 13112 - RNA, 21 nt, Homo sapiens
cucuugagggaagcacuuucu

SEQ ID NO: 13113 - RNA, 22 nt, Homo sapiens
cucuugagggaagcacuuucug

SEQ ID NO: 13114 - RNA, 23 nt, Homo sapiens
cucuugagggaagcacuuucugu

SEQ ID NO: 13115 - RNA, 24 nt, Homo sapiens
cucuugagggaagcacuuucuguu

SEQ ID NO: 13116 - RNA, 22 nt, Homo sapiens
uuucccuucucccuucaccauu

SEQ ID NO: 13117 - RNA, 22 nt, Homo sapiens
ggaaagggaggacaggaacagg

SEQ ID NO: 13118 - RNA, 22 nt, Homo sapiens
uguuaucacugugugagcugaa

SEQ ID NO: 13119 - RNA, 21 nt, Homo sapiens
gcuaacauucugguuacgugu

SEQ ID NO: 13120 - RNA, 22 nt, Homo sapiens
ucugaaggcaugauuucaacag

SEQ ID NO: 13121 - RNA, 22 nt, Homo sapiens
ugaaggcaucauguuuuggauc

SEQ ID NO: 13122 - RNA, 22 nt, Homo sapiens
ugaggguguuuuauuguacaca

SEQ ID NO: 13123 - RNA, 22 nt, Homo sapiens
uaaagugcagguauaacaccuc

SEQ ID NO: 13124 - RNA, 22 nt, Homo sapiens
agcucggucugaggccccucag

SEQ ID NO: 13125 - RNA, 22 nt, Homo sapiens
ugaggggcagagagcgagacuu

SEQ ID NO: 13126 - RNA, 23 nt, Homo sapiens
agcucggucugaggccccucagu

SEQ ID NO: 13127 - RNA, 21 nt, Homo sapiens
ugaggggcagagagcgagacu

SEQ ID NO: 13128 - RNA, 23 nt, Homo sapiens
ugaggggcagagagcgagacuuu

SEQ ID NO: 13129 - RNA, 22 nt, Homo sapiens
ucuuuuucuguuaguuugaguu

SEQ ID NO: 13130 - RNA, 22 nt, Homo sapiens
ccaaaauaauagagaagaggug

SEQ ID NO: 13131 - RNA, 22 nt, Homo sapiens
gagggccucugggagggagccg

SEQ ID NO: 13132 - RNA, 22 nt, Homo sapiens
gcuccuucccaguuuugcucug

SEQ ID NO: 13133 - RNA, 22 nt, Homo sapiens
ugccaauggcugcaagggguug

SEQ ID NO: 13134 - RNA, 22 nt, Homo sapiens
gggacccucauucauuugcagc

SEQ ID NO: 13135 - RNA, 22 nt, Homo sapiens
ggugcagaguggccaggaggug

SEQ ID NO: 13136 - RNA, 22 nt, Homo sapiens
cccccugccgccucuugucccc

SEQ ID NO: 13137 - RNA, 22 nt, Homo sapiens
gcugcuuggcacuaccagcauu

SEQ ID NO: 13138 - RNA, 20 nt, Homo sapiens
uguuguaguuggccagcagu

SEQ ID NO: 13139 - RNA, 22 nt, Homo sapiens
uggcacagccucggcuuggccc

SEQ ID NO: 13140 - RNA, 22 nt, Homo sapiens
gcuuggcuggggcccagccagg

SEQ ID NO: 13141 - RNA, 22 nt, Homo sapiens
ccuguuuauuaucgucaucagc

SEQ ID NO: 13142 - RNA, 18 nt, Homo sapiens
ugugauggaaauaacagg

SEQ ID NO: 13143 - RNA, 22 nt, Homo sapiens
uucaugcgaugguuggagggau

SEQ ID NO: 13144 - RNA, 20 nt, Homo sapiens
ccucugcuagugcuugagcu

SEQ ID NO: 13145 - RNA, 22 nt, Homo sapiens
uggugaucaaagacucugaggc

SEQ ID NO: 13146 - RNA, 22 nt, Homo sapiens
cugggagaauguugaacaucuu

SEQ ID NO: 13147 - RNA, 22 nt, Homo sapiens
cagcaguggaaacaaggccuga

SEQ ID NO: 13148 - RNA, 20 nt, Homo sapiens
cugagccgugcuccuugcug

SEQ ID NO: 13149 - RNA, 22 nt, Homo sapiens
ccauucaagcacgaagcuuccu

SEQ ID NO: 13150 - RNA, 22 nt, Homo sapiens
gagcuuugugcuugaauucguu

SEQ ID NO: 13151 - RNA, 22 nt, Homo sapiens
gccccgggauggaggggaagua

SEQ ID NO: 13152 - RNA, 22 nt, Homo sapiens
cauuccucuuugucccuuugcu

SEQ ID NO: 13153 - RNA, 22 nt, Homo sapiens
gcaaguggugagggcgaggcgu

SEQ ID NO: 13154 - RNA, 21 nt, Homo sapiens
guccucucccagccucuugcc

SEQ ID NO: 13155 - RNA, 22 nt, Homo sapiens
gaagagguaggaacguaguaag

SEQ ID NO: 13156 - RNA, 22 nt, Homo sapiens
ucauuugcuaguucugccugau

SEQ ID NO: 13157 - RNA, 22 nt, Homo sapiens
ugagguaguagauuguauaguu

SEQ ID NO: 13158 - RNA, 22 nt, Homo sapiens
uggagauaacuauacagucuac

SEQ ID NO: 13159 - RNA, 22 nt, Homo sapiens
aggcuuccuugggaacaacagg

SEQ ID NO: 13160 - RNA, 22 nt, Homo sapiens
ucugguuuccagggcagaugcc

SEQ ID NO: 13161 - RNA, 22 nt, Homo sapiens
ggacccuggagggguuuucagu

SEQ ID NO: 13162 - RNA, 22 nt, Homo sapiens
cugucagccccuccuggccuuc

SEQ ID NO: 13163 - RNA, 22 nt, Homo sapiens
uggugccuccucuagcuuguag

SEQ ID NO: 13164 - RNA, 22 nt, Homo sapiens
ugagaguugggggaggauaaga

SEQ ID NO: 13165 - RNA, 22 nt, Homo sapiens
uuuuuauugaaacaucagaauc

SEQ ID NO: 13166 - RNA, 22 nt, Homo sapiens
uuugaugcuuaaugaaaaguga

SEQ ID NO: 13167 - RNA, 22 nt, Homo sapiens
ucucccaacccuuguaccagug

SEQ ID NO: 13168 - RNA, 22 nt, Homo sapiens
ugguacaggccugggggacagg

SEQ ID NO: 13169 - RNA, 22 nt, Homo sapiens
gaguuaauccuagcaaaaauag

SEQ ID NO: 13170 - RNA, 22 nt, Homo sapiens
uccuuuucuugggauuaacucc

SEQ ID NO: 13171 - RNA, 22 nt, Homo sapiens
gcuccagucucgacguucccgg

SEQ ID NO: 13172 - RNA, 22 nt, Homo sapiens
ggggacgaacgggacgggugcg

SEQ ID NO: 13173 - RNA, 22 nt, Homo sapiens
ucauuguguaguagagguggca

SEQ ID NO: 13174 - RNA, 22 nt, Homo sapiens
guguccucccugcacucaguga

SEQ ID NO: 13175 - RNA, 22 nt, Homo sapiens
cagcugugaaagccauuuccag

SEQ ID NO: 13176 - RNA, 20 nt, Homo sapiens
aggaaauggccauccagcug

SEQ ID NO: 13177 - RNA, 22 nt, Homo sapiens
uaucuugcagccagccgcuggg

SEQ ID NO: 13178 - RNA, 22 nt, Homo sapiens
agucggcucaggcucaugauac

SEQ ID NO: 13179 - RNA, 22 nt, Homo sapiens
ucucugaucaaaugcauguggu

SEQ ID NO: 13180 - RNA, 22 nt, Homo sapiens
acugugcaggugauaugggaca

SEQ ID NO: 13181 - RNA, 22 nt, Homo sapiens
uggcugacccuggggagcuagc

SEQ ID NO: 13182 - RNA, 21 nt, Homo sapiens
cuguuccugagucuugccagu

SEQ ID NO: 13183 - RNA, 22 nt, Homo sapiens
gcucuguauacagucugggcuu

SEQ ID NO: 13184 - RNA, 22 nt, Homo sapiens
cccagaaagaguaaagugcucg

SEQ ID NO: 13185 - RNA, 22 nt, Homo sapiens
ggagagguuacccgagcaacuu

SEQ ID NO: 13186 - RNA, 21 nt, Homo sapiens
aauguugcucggugaaccccu

SEQ ID NO: 13187 - RNA, 23 nt, Homo sapiens
cgaauguugcucggugaaccccu

SEQ ID NO: 13188 - RNA, 22 nt, Homo sapiens
gaauguugcucggugaaccccu

SEQ ID NO: 13189 - RNA, 23 nt, Homo sapiens
gaauguugcucggugaaccccuu

SEQ ID NO: 13190 - RNA, 22 nt, Homo sapiens
gggugaguccucuccagggaug

SEQ ID NO: 13191 - RNA, 22 nt, Homo sapiens
uguacccuggagaggucccccc

SEQ ID NO: 13192 - RNA, 22 nt, Homo sapiens
uucuucuugaguaacaucagau

SEQ ID NO: 13193 - RNA, 20 nt, Homo sapiens
ugauucaacuuggcaggaga

SEQ ID NO: 13194 - RNA, 22 nt, Homo sapiens
uuuucucucucuuuuguuccug

SEQ ID NO: 13195 - RNA, 22 nt, Homo sapiens
ccagggccagauggaggauagg

SEQ ID NO: 13196 - RNA, 22 nt, Homo sapiens
ugaguggugcuuaaguucaggc

SEQ ID NO: 13197 - RNA, 22 nt, Homo sapiens
gcuggacuuugcaccacuucac

SEQ ID NO: 13198 - RNA, 22 nt, Homo sapiens
ugccuauguguaucacuaauau

SEQ ID NO: 13199 - RNA, 22 nt, Homo sapiens
acuaaauaugcacauggguauu

SEQ ID NO: 13200 - RNA, 22 nt, Homo sapiens
ugccagcauagugcuccuggac

SEQ ID NO: 13201 - RNA, 22 nt, Homo sapiens
uccuggacacgcuguuggccug

SEQ ID NO: 13202 - RNA, 22 nt, Homo sapiens
ugccagcauagugcuccuggac

SEQ ID NO: 13203 - RNA, 22 nt, Homo sapiens
uccuggacacgcuguuggccug

SEQ ID NO: 13204 - RNA, 22 nt, Homo sapiens
ugauguuuugguuuucacugaa

SEQ ID NO: 13205 - RNA, 22 nt, Homo sapiens
uccuuguaaccaaacucauuaa

SEQ ID NO: 13206 - RNA, 22 nt, Homo sapiens
uuucccccugguuuggcacaua

SEQ ID NO: 13207 - RNA, 22 nt, Homo sapiens
cugagccgaguagggaggggac

SEQ ID NO: 13208 - RNA, 22 nt, Homo sapiens
ugagguuggggcuugggcuucc

SEQ ID NO: 13209 - RNA, 22 nt, Homo sapiens
ggccaaaucucagcuccaguca

SEQ ID NO: 13210 - RNA, 22 nt, Homo sapiens
uggucccuguccuccuggaccu

SEQ ID NO: 13211 - RNA, 22 nt, Homo sapiens
aggagcaggagcguggaccaac

SEQ ID NO: 13212 - RNA, 22 nt, Homo sapiens
gacucccaagaccuuucccuga

SEQ ID NO: 13213 - RNA, 22 nt, Homo sapiens
uaauaagaaagguucuugggag

SEQ ID NO: 13214 - RNA, 22 nt, Homo sapiens
ucccuacuuuuuguccacuucu

SEQ ID NO: 13215 - RNA, 22 nt, Homo sapiens
ggccuguuugcagaaggugggu

SEQ ID NO: 13216 - RNA, 22 nt, Homo sapiens
acuagacugaagcuccuugagg

SEQ ID NO: 13217 - RNA, 22 nt, Homo sapiens
cccucgaggagcucacagucua

SEQ ID NO: 13218 - RNA, 21 nt, Homo sapiens
cuagacugaagcuccuugagg

SEQ ID NO: 13219 - RNA, 21 nt, Homo sapiens
ucgaggagcucacagucuagu

SEQ ID NO: 13220 - RNA, 22 nt, Homo sapiens
ucgaggagcucacagucuagua

SEQ ID NO: 13221 - RNA, 22 nt, Homo sapiens
ugggguaggauguguucucguu

SEQ ID NO: 13222 - RNA, 22 nt, Homo sapiens
cgagaaaacauauccgucucca

SEQ ID NO: 13223 - RNA, 22 nt, Homo sapiens
ugggguaggauguguucucguu

SEQ ID NO: 13224 - RNA, 22 nt, Homo sapiens
cgagaaaacauauccgucucca

SEQ ID NO: 13225 - RNA, 22 nt, Homo sapiens
ugggguaggauguguucucguu

SEQ ID NO: 13226 - RNA, 22 nt, Homo sapiens
cgagaaaacauauccgucucca

SEQ ID NO: 13227 - RNA, 22 nt, Homo sapiens
ugggguaggauguguucucguu

SEQ ID NO: 13228 - RNA, 22 nt, Homo sapiens
cgagaaaacauauccgucucca

SEQ ID NO: 13229 - RNA, 22 nt, Homo sapiens
ugggguaggauguguucucguu

SEQ ID NO: 13230 - RNA, 22 nt, Homo sapiens
cgagaaaacauauccgucucca

SEQ ID NO: 13231 - RNA, 22 nt, Homo sapiens
ugggguaggauguguucucguu

SEQ ID NO: 13232 - RNA, 22 nt, Homo sapiens
cgagaaaacauauccgucucca

SEQ ID NO: 13233 - RNA, 22 nt, Homo sapiens
ugggguaggauguguucucguu

SEQ ID NO: 13234 - RNA, 22 nt, Homo sapiens
cgagacaacauauccgucucca

SEQ ID NO: 13235 - RNA, 22 nt, Homo sapiens
ugggguaggauguguucucguu

SEQ ID NO: 13236 - RNA, 22 nt, Homo sapiens
cgagacaacauauccgucucca

SEQ ID NO: 13237 - RNA, 22 nt, Homo sapiens
ugggguaggauguguucucguu

SEQ ID NO: 13238 - RNA, 22 nt, Homo sapiens
cgagacaacauauccgucucca

SEQ ID NO: 13239 - RNA, 22 nt, Homo sapiens
ugggguaggauguguucucguu

SEQ ID NO: 13240 - RNA, 22 nt, Homo sapiens
cgagacaacauauccgucucca

SEQ ID NO: 13241 - RNA, 22 nt, Homo sapiens
ugggguaggauguguucucguu

SEQ ID NO: 13242 - RNA, 22 nt, Homo sapiens
cgagacaacauauccgucucca

SEQ ID NO: 13243 - RNA, 22 nt, Homo sapiens
caggucuugacagguguagcac

SEQ ID NO: 13244 - RNA, 22 nt, Homo sapiens
ugcugcucuggccaggaacugc

SEQ ID NO: 13245 - RNA, 22 nt, Homo sapiens
uacuuaugaaguguuaaaugca

SEQ ID NO: 13246 - RNA, 22 nt, Homo sapiens
ggguuuguguuuuauuuguaga

SEQ ID NO: 13247 - RNA, 22 nt, Homo sapiens
uucuacuucagaaauacuaucu

SEQ ID NO: 13248 - RNA, 22 nt, Homo sapiens
gcugugcgucuggaguggaguu

SEQ ID NO: 13249 - RNA, 22 nt, Homo sapiens
uagggugauaaaaccuucugcu

SEQ ID NO: 13250 - RNA, 22 nt, Homo sapiens
ggaggguuuucuucuuuccuac

SEQ ID NO: 13251 - RNA, 22 nt, Homo sapiens
ugucauagucuauguugccaag

SEQ ID NO: 13252 - RNA, 15 nt, Homo sapiens
aacagaggcugacau

SEQ ID NO: 13253 - RNA, 22 nt, Homo sapiens
uauauggauauuuugaguuauu

SEQ ID NO: 13254 - RNA, 22 nt, Homo sapiens
auaacccaagauaugcauaauc

SEQ ID NO: 13255 - RNA, 22 nt, Homo sapiens
caguggggucucucuguaccuc

SEQ ID NO: 13256 - RNA, 22 nt, Homo sapiens
agguaaagaugagcucaguguc

SEQ ID NO: 13257 - RNA, 22 nt, Homo sapiens
ugaguuagcccguuucaauaga

SEQ ID NO: 13258 - RNA, 22 nt, Homo sapiens
ugaaugaaagagggccugcuca

SEQ ID NO: 13259 - RNA, 22 nt, Homo sapiens
acaacauuaaaccacccgauuc

SEQ ID NO: 13260 - RNA, 21 nt, Homo sapiens
uagguaguuucauguuguugg

SEQ ID NO: 13261 - RNA, 22 nt, Homo sapiens
uuuggcaauggauggucaucua

SEQ ID NO: 13262 - RNA, 22 nt, Homo sapiens
ggugccauguauaugucaaaug

SEQ ID NO: 13263 - RNA, 22 nt, Homo sapiens
cauguguguguguggaauacaa

SEQ ID NO: 13264 - RNA, 22 nt, Homo sapiens
uguugcacauauuuggcaugua

SEQ ID NO: 13265 - RNA, 22 nt, Homo sapiens
ugcuguccagaaaccugacucu

SEQ ID NO: 13266 - RNA, 22 nt, Homo sapiens
gaagagagguuugggacagcaa

SEQ ID NO: 13267 - RNA, 22 nt, Homo sapiens
ugggaguugguggggugggaug

SEQ ID NO: 13268 - RNA, 22 nt, Homo sapiens
uuagucccaguuuaccaggccc

SEQ ID NO: 13269 - RNA, 22 nt, Homo sapiens
ggccuuuagguuguaagcacau

SEQ ID NO: 13270 - RNA, 19 nt, Homo sapiens
auguacuuacuuugaggcc

SEQ ID NO: 13271 - RNA, 22 nt, Homo sapiens
ccuaggcccuaggcuuccauca

SEQ ID NO: 13272 - RNA, 22 nt, Homo sapiens
agugggggucagaggccugggg

SEQ ID NO: 13273 - RNA, 22 nt, Homo sapiens
uuuagugggggcagaaucaggu

SEQ ID NO: 13274 - RNA, 22 nt, Homo sapiens
uugguacugaucccuuccuagc

SEQ ID NO: 13275 - RNA, 22 nt, Homo sapiens
uucucacccacagaaguagaca

SEQ ID NO: 13276 - RNA, 22 nt, Homo sapiens
uacuucugugagugagaauuca

SEQ ID NO: 13277 - RNA, 22 nt, Homo sapiens
ugguuguaauuuguguucagag

SEQ ID NO: 13278 - RNA, 22 nt, Homo sapiens
ucuagacuccaaauugcagacu

SEQ ID NO: 13279 - RNA, 22 nt, Homo sapiens
ucccucucucugggcuuugucc

SEQ ID NO: 13280 - RNA, 22 nt, Homo sapiens
cagcagccacagggagagggug

SEQ ID NO: 13281 - RNA, 22 nt, Homo sapiens
aacuaccucuauagcccugcua

SEQ ID NO: 13282 - RNA, 22 nt, Homo sapiens
gcaggagccgaggggcuggucu

SEQ ID NO: 13283 - RNA, 22 nt, Homo sapiens
uacacaaaaauccccuggucac

SEQ ID NO: 13284 - RNA, 22 nt, Homo sapiens
ugaccagggaauuuuuauguag

SEQ ID NO: 13285 - RNA, 22 nt, Homo sapiens
ucucugagccuuccuguggcca

SEQ ID NO: 13286 - RNA, 22 nt, Homo sapiens
gaccacaugggaggcucauggc

SEQ ID NO: 13287 - RNA, 22 nt, Homo sapiens
gcucugggggucaggcagcugg

SEQ ID NO: 13288 - RNA, 22 nt, Homo sapiens
ugccuaggccuuccccaaggcu

SEQ ID NO: 13289 - RNA, 22 nt, Homo sapiens
gacagcacgacacugccuucau

SEQ ID NO: 13290 - RNA, 21 nt, Homo sapiens
uagguaguuuccuguuguugg

SEQ ID NO: 13291 - RNA, 22 nt, Homo sapiens
uagguaguuuccuguuguuggg

SEQ ID NO: 13292 - RNA, 22 nt, Homo sapiens
ggcauuuccuucuauugacuuc

SEQ ID NO: 13293 - RNA, 16 nt, Homo sapiens
gucagaagugaaugcc

SEQ ID NO: 13294 - RNA, 22 nt, Homo sapiens
cccuuuccugugcccuuuuaag

SEQ ID NO: 13295 - RNA, 22 nt, Homo sapiens
uaagaggcuaacacagaagggu

SEQ ID NO: 13296 - RNA, 22 nt, Homo sapiens
uccguuagcuaucuggguugca

SEQ ID NO: 13297 - RNA, 22 nt, Homo sapiens
uguaccccagaguagaugcuua

SEQ ID NO: 13298 - RNA, 22 nt, Homo sapiens
ugcucuuuuauaugugagaggc

SEQ ID NO: 13299 - RNA, 22 nt, Homo sapiens
ucucacauaagaggauccagug

SEQ ID NO: 13300 - RNA, 22 nt, Homo sapiens
ugcucuuuuauaugugagaggc

SEQ ID NO: 13301 - RNA, 22 nt, Homo sapiens
ucucacauaagaggauccagug

SEQ ID NO: 13302 - RNA, 22 nt, Homo sapiens
ugcucuuuuauaugugagaggc

SEQ ID NO: 13303 - RNA, 22 nt, Homo sapiens
ucucacauaagaggauccagug

SEQ ID NO: 13304 - RNA, 22 nt, Homo sapiens
ugcucuuuuauaugugagaggc

SEQ ID NO: 13305 - RNA, 22 nt, Homo sapiens
ucucacauaagaggauccagug

SEQ ID NO: 13306 - RNA, 22 nt, Homo sapiens
ugcucuuuuauaugugagaggc

SEQ ID NO: 13307 - RNA, 22 nt, Homo sapiens
ucucacauaagaggauccagug

SEQ ID NO: 13308 - RNA, 22 nt, Homo sapiens
cguguucacagcggaccuugau

SEQ ID NO: 13309 - RNA, 22 nt, Homo sapiens
uuaaggcacgcggugaaugcca

SEQ ID NO: 13310 - RNA, 21 nt, Homo sapiens
cguguucacagcggaccuuga

SEQ ID NO: 13311 - RNA, 20 nt, Homo sapiens
uaaggcacgcggugaaugcc

SEQ ID NO: 13312 - RNA, 22 nt, Homo sapiens
ucuguuccccccucccgcccag

SEQ ID NO: 13313 - RNA, 16 nt, Homo sapiens
ggggugggugacagac

SEQ ID NO: 13314 - RNA, 22 nt, Homo sapiens
ugaaucacgcuugcaaacuguc

SEQ ID NO: 13315 - RNA, 21 nt, Homo sapiens
acaguuugcacguuuuucaga

SEQ ID NO: 13316 - RNA, 22 nt, Homo sapiens
ugagcuaccugugcaaguaaau

SEQ ID NO: 13317 - RNA, 22 nt, Homo sapiens
uguuagcugugcagguuacuuc

SEQ ID NO: 13318 - RNA, 22 nt, Homo sapiens
uuacugguuuuauuuuuuuccu

SEQ ID NO: 13319 - RNA, 22 nt, Homo sapiens
guggaaggaauuaaccaguaaa

SEQ ID NO: 13320 - RNA, 22 nt, Homo sapiens
ucagguaaagagagggauuucu

SEQ ID NO: 13321 - RNA, 22 nt, Homo sapiens
gaaacccuuucagcugcuuucu

SEQ ID NO: 13322 - RNA, 22 nt, Homo sapiens
uaaggaugaaggcgcucccugu

SEQ ID NO: 13323 - RNA, 22 nt, Homo sapiens
ggggggugcuuccucauuagga

SEQ ID NO: 13324 - RNA, 22 nt, Homo sapiens
ugucugagcuggaugugcaaac

SEQ ID NO: 13325 - RNA, 22 nt, Homo sapiens
guuuugcauucacguuugcacu

SEQ ID NO: 13326 - RNA, 22 nt, Homo sapiens
uggagguuguccaugguguguu

SEQ ID NO: 13327 - RNA, 17 nt, Homo sapiens
auuacauggccaaucuc

SEQ ID NO: 13328 - RNA, 23 nt, Homo sapiens
ugaguauuacauggccaaucucc

SEQ ID NO: 13329 - RNA, 22 nt, Homo sapiens
caguacugucaaucuuacuugg

SEQ ID NO: 13330 - RNA, 22 nt, Homo sapiens
caagauaggagagggcagugcu

SEQ ID NO: 13331 - RNA, 22 nt, Homo sapiens
cggcuucucggacggcugguuu

SEQ ID NO: 13332 - RNA, 22 nt, Homo sapiens
gccugcucuccagacugcugcu

SEQ ID NO: 13333 - RNA, 22 nt, Homo sapiens
uccuaauugguggaaaauuggu

SEQ ID NO: 13334 - RNA, 22 nt, Homo sapiens
cgauuuuccauccauuacuggg

SEQ ID NO: 13335 - RNA, 22 nt, Homo sapiens
uaacguuggauuacuugcuuua

SEQ ID NO: 13336 - RNA, 22 nt, Homo sapiens
ugaagcagguauguucaauuuu

SEQ ID NO: 13337 - RNA, 22 nt, Homo sapiens
ugaucuuucccuucagcguuag

SEQ ID NO: 13338 - RNA, 22 nt, Homo sapiens
gguggggcugaaggaauucacu

SEQ ID NO: 13339 - RNA, 22 nt, Homo sapiens
uuagacgcucuuagacuacugu

SEQ ID NO: 13340 - RNA, 22 nt, Homo sapiens
guaguggcuaagagccugggcc

SEQ ID NO: 13341 - RNA, 22 nt, Homo sapiens
agauggaggaagcugcuucuuu

SEQ ID NO: 13342 - RNA, 22 nt, Homo sapiens
gagaagccguuguucuccaucc

SEQ ID NO: 13343 - RNA, 22 nt, Homo sapiens
ugguggcugcucaagggaggag

SEQ ID NO: 13344 - RNA, 22 nt, Homo sapiens
cucugccuugagcagugcccac

SEQ ID NO: 13345 - RNA, 22 nt, Homo sapiens
agagguuauccguguuauguuc

SEQ ID NO: 13346 - RNA, 22 nt, Homo sapiens
auaauacaugguuaaccucuuu

SEQ ID NO: 13347 - RNA, 22 nt, Homo sapiens
uuggaugcuuugggaaugggug

SEQ ID NO: 13348 - RNA, 22 nt, Homo sapiens
acuucccugagggcagccgagu

SEQ ID NO: 13349 - RNA, 22 nt, Homo sapiens
uccucugcacagcuauuguucc

SEQ ID NO: 13350 - RNA, 19 nt, Homo sapiens
cagccuuuguguggagggc

SEQ ID NO: 13351 - RNA, 22 nt, Homo sapiens
ucuggcucgcuaggcucugggg

SEQ ID NO: 13352 - RNA, 22 nt, Homo sapiens
uccugggcuuaguggcuagguc

SEQ ID NO: 13353 - RNA, 22 nt, Homo sapiens
uuggggaaugaugggguggaac

SEQ ID NO: 13354 - RNA, 22 nt, Homo sapiens
ugguucuacaucuucugugacu

SEQ ID NO: 13355 - RNA, 22 nt, Homo sapiens
uggaggggaagggagacuuggg

SEQ ID NO: 13356 - RNA, 22 nt, Homo sapiens
uucagucgcucaucagaccucu

SEQ ID NO: 13357 - RNA, 22 nt, Homo sapiens
ugaaaacauuggcuucuaaaag

SEQ ID NO: 13358 - RNA, 22 nt, Homo sapiens
gacauuagagcuaaguuuuuag

SEQ ID NO: 13359 - RNA, 22 nt, Homo sapiens
aaugaaaagcagaaggaguugg

SEQ ID NO: 13360 - RNA, 22 nt, Homo sapiens
uaucauccugcugccuuuuguu

SEQ ID NO: 13361 - RNA, 22 nt, Homo sapiens
uguuuaaaauaugcacauggua

SEQ ID NO: 13362 - RNA, 22 nt, Homo sapiens
cccugagcacauuugaaacauu

SEQ ID NO: 13363 - RNA, 22 nt, Homo sapiens
ugugaucucuguagggacuaag

SEQ ID NO: 13364 - RNA, 22 nt, Homo sapiens
uuggcccucuagagaaggcaga

SEQ ID NO: 13365 - RNA, 22 nt, Homo sapiens
ggaggccuugugaaggaggcug

SEQ ID NO: 13366 - RNA, 22 nt, Homo sapiens
uugguggcugcagagguuuucc

SEQ ID NO: 13367 - RNA, 22 nt, Homo sapiens
cagggugggcggggggugaaga

SEQ ID NO: 13368 - RNA, 20 nt, Homo sapiens
uucaccccacccugcccugu

SEQ ID NO: 13369 - RNA, 22 nt, Homo sapiens
uggugacuaaggguguuuguug

SEQ ID NO: 13370 - RNA, 22 nt, Homo sapiens
aaauagcccuuugaaacugcuc

SEQ ID NO: 13371 - RNA, 22 nt, Homo sapiens
ugaggauuaaugaucaacugga

SEQ ID NO: 13372 - RNA, 22 nt, Homo sapiens
cauguggucauuaauuuuguug

SEQ ID NO: 13373 - RNA, 22 nt, Homo sapiens
uuucugcagacauccuuggccg

SEQ ID NO: 13374 - RNA, 22 nt, Homo sapiens
cucugggguggcuguggaaaug

SEQ ID NO: 13375 - RNA, 22 nt, Homo sapiens
ucaugagccaugauuagccuca

SEQ ID NO: 13376 - RNA, 22 nt, Homo sapiens
ugcagcuaugucauggugacug

SEQ ID NO: 13377 - RNA, 22 nt, Homo sapiens
auaaagguguuggaacaaucgu

SEQ ID NO: 13378 - RNA, 22 nt, Homo sapiens
augauuguucucuccuugcgca

SEQ ID NO: 13379 - RNA, 22 nt, Homo sapiens
acugauauucagcuggaaugua

SEQ ID NO: 13380 - RNA, 22 nt, Homo sapiens
ugcuuccaguuggcuaauguuc

SEQ ID NO: 13381 - RNA, 22 nt, Homo sapiens
ugggcugggguugaugagaagg

SEQ ID NO: 13382 - RNA, 22 nt, Homo sapiens
uccuuucuucagcuacgcccau

SEQ ID NO: 13383 - RNA, 22 nt, Homo sapiens
cagccaguagaucgggaggaug

SEQ ID NO: 13384 - RNA, 22 nt, Homo sapiens
auagcuucaaucuauuggcuag

SEQ ID NO: 13385 - RNA, 22 nt, Homo sapiens
agcaguuucucuaacagcuggg

SEQ ID NO: 13386 - RNA, 22 nt, Homo sapiens
uaaagcugaaggggaagaacug

SEQ ID NO: 13387 - RNA, 22 nt, Homo sapiens
ugggaaauggagauagggugca

SEQ ID NO: 13388 - RNA, 22 nt, Homo sapiens
gccuccuauuucagauucucac

SEQ ID NO: 13389 - RNA, 22 nt, Homo sapiens
uucuccuaauuuuucucacagc

SEQ ID NO: 13390 - RNA, 22 nt, Homo sapiens
ugugagaguguuuuagggagag

SEQ ID NO: 13391 - RNA, 22 nt, Homo sapiens
ugaaaccuggauauuuuagggu

SEQ ID NO: 13392 - RNA, 22 nt, Homo sapiens
uaaaguauuuaccagguuucau

SEQ ID NO: 13393 - RNA, 22 nt, Homo sapiens
aacuuaugggguuuagcuuuua

SEQ ID NO: 13394 - RNA, 22 nt, Homo sapiens
guugagugaaucccauguugcu

SEQ ID NO: 13395 - RNA, 22 nt, Homo sapiens
uaauuguaggucaagucugcuu

SEQ ID NO: 13396 - RNA, 22 nt, Homo sapiens
cagaccagaucuaaaauuaggc

SEQ ID NO: 13397 - RNA, 22 nt, Homo sapiens
uaauuguaggucaagucugcuu

SEQ ID NO: 13398 - RNA, 22 nt, Homo sapiens
cagaccagaucuaaaauuaggc

SEQ ID NO: 13399 - RNA, 21 nt, Homo sapiens
agagguaguagguugcauagu

SEQ ID NO: 13400 - RNA, 22 nt, Homo sapiens
cuauacgaccugcugccuuucu

SEQ ID NO: 13401 - RNA, 22 nt, Homo sapiens
ucauuuuacaggcagaccuguc

SEQ ID NO: 13402 - RNA, 22 nt, Homo sapiens
cuuggguuuucuccuguaguuu

SEQ ID NO: 13403 - RNA, 22 nt, Homo sapiens
ugggaguuguagucugccuugu

SEQ ID NO: 13404 - RNA, 17 nt, Homo sapiens
gaagacuacgguuccca

SEQ ID NO: 13405 - RNA, 22 nt, Homo sapiens
ucuggagucagaaugucugguu

SEQ ID NO: 13406 - RNA, 22 nt, Homo sapiens
gugggacuuccguuuugucucc

SEQ ID NO: 13407 - RNA, 22 nt, Homo sapiens
uggcuuuucauuauaaauuuug

SEQ ID NO: 13408 - RNA, 22 nt, Homo sapiens
uguucugauuuaaugaggccau

SEQ ID NO: 13409 - RNA, 22 nt, Homo sapiens
gagguuuucuggguuucuguuu

SEQ ID NO: 13410 - RNA, 19 nt, Homo sapiens
aacacaccugguuaaccuc

SEQ ID NO: 13411 - RNA, 22 nt, Homo sapiens
agccagaguucaucaguuaagg

SEQ ID NO: 13412 - RNA, 22 nt, Homo sapiens
uaacugauggacucuagcaguc

SEQ ID NO: 13413 - RNA, 22 nt, Homo sapiens
uacguuguguguaucugaaguu

SEQ ID NO: 13414 - RNA, 22 nt, Homo sapiens
ucuucagauccacacucguggu

SEQ ID NO: 13415 - RNA, 22 nt, Homo sapiens
gaguccuuucccugucucccuc

SEQ ID NO: 13416 - RNA, 16 nt, Homo sapiens
agggaggggagggcuc

SEQ ID NO: 13417 - RNA, 22 nt, Homo sapiens
uaggcagguggaggagugaagg

SEQ ID NO: 13418 - RNA, 22 nt, Homo sapiens
uucagcccuucccuguuuucau

SEQ ID NO: 13419 - RNA, 22 nt, Homo sapiens
aagauuuccccccgcccccauu

SEQ ID NO: 13420 - RNA, 22 nt, Homo sapiens
ugguggggaggggggcaggucc

SEQ ID NO: 13421 - RNA, 22 nt, Homo sapiens
uugcuuuucucuaguugguaau

SEQ ID NO: 13422 - RNA, 22 nt, Homo sapiens
acuggcuuuggaaaagcuauau

SEQ ID NO: 13423 - RNA, 22 nt, Homo sapiens
uaccauggaguuuggagugaga

SEQ ID NO: 13424 - RNA, 22 nt, Homo sapiens
ucucacuucugagcucugguua

SEQ ID NO: 13425 - RNA, 22 nt, Homo sapiens
uuuggucaugaaugucagugug

SEQ ID NO: 13426 - RNA, 22 nt, Homo sapiens
uugacgaucauguacuuuuaug

SEQ ID NO: 13427 - RNA, 22 nt, Homo sapiens
uuuuagugugggcugcuuugaa

SEQ ID NO: 13428 - RNA, 22 nt, Homo sapiens
aacaggggcucacaguaaugcu

SEQ ID NO: 13429 - RNA, 22 nt, Homo sapiens
uguugucuuucuucuggcaguu

SEQ ID NO: 13430 - RNA, 22 nt, Homo sapiens
cagucaggaagagaaguaaaga

SEQ ID NO: 13431 - RNA, 22 nt, Homo sapiens
gguggccaggugcauaucuugg

SEQ ID NO: 13432 - RNA, 22 nt, Homo sapiens
ugggaaugccuacugguuaccu

SEQ ID NO: 13433 - RNA, 22 nt, Homo sapiens
gguggccaggugcauaucuugg

SEQ ID NO: 13434 - RNA, 22 nt, Homo sapiens
ugggaaugccuacugguuaccu

SEQ ID NO: 13435 - RNA, 22 nt, Homo sapiens
gguggccaggugcauaucuugg

SEQ ID NO: 13436 - RNA, 22 nt, Homo sapiens
ugggaaugccuacugguuaccu

SEQ ID NO: 13437 - RNA, 22 nt, Homo sapiens
gguggccaggugcauaucuugg

SEQ ID NO: 13438 - RNA, 22 nt, Homo sapiens
ugggaaugccuacugguuaccu

SEQ ID NO: 13439 - RNA, 22 nt, Homo sapiens
ucagguggccaggugcauaucu

SEQ ID NO: 13440 - RNA, 22 nt, Homo sapiens
gaaugccuacugguuaccucgg

SEQ ID NO: 13441 - RNA, 22 nt, Homo sapiens
ucugagaaaggcaggagaucua

SEQ ID NO: 13442 - RNA, 22 nt, Homo sapiens
uagagcuccaccucccucaggg

SEQ ID NO: 13443 - RNA, 22 nt, Homo sapiens
uggagugggggaaggaguguua

SEQ ID NO: 13444 - RNA, 22 nt, Homo sapiens
auuccaguccccacuguguccu

SEQ ID NO: 13445 - RNA, 22 nt, Homo sapiens
uguugacaauaaagucuaccau

SEQ ID NO: 13446 - RNA, 22 nt, Homo sapiens
uggugauuauuuugcucaauau

SEQ ID NO: 13447 - RNA, 22 nt, Homo sapiens
uaaacauucuuccucugaggca

SEQ ID NO: 13448 - RNA, 19 nt, Homo sapiens
ccuagagaggaauuguuua

SEQ ID NO: 13449 - RNA, 22 nt, Homo sapiens
ucacagugaaccggucucuuuu

SEQ ID NO: 13450 - RNA, 22 nt, Homo sapiens
uucggggccguagcacugucug

SEQ ID NO: 13451 - RNA, 22 nt, Homo sapiens
aggaggguaucaggugagguug

SEQ ID NO: 13452 - RNA, 22 nt, Homo sapiens
aaaaaugucugauacuccugga

SEQ ID NO: 13453 - RNA, 22 nt, Homo sapiens
aggaggguaucaggugagguug

SEQ ID NO: 13454 - RNA, 22 nt, Homo sapiens
aaaaaugucugauacuccugga

SEQ ID NO: 13455 - RNA, 22 nt, Homo sapiens
uuaaauugcuacaguaauucaa

SEQ ID NO: 13456 - RNA, 19 nt, Homo sapiens
guuacuguggauuuuuaag

SEQ ID NO: 13457 - RNA, 22 nt, Homo sapiens
gccucuaggauggggagggaaa

SEQ ID NO: 13458 - RNA, 22 nt, Homo sapiens
uccugcucucugcucaugggug

SEQ ID NO: 13459 - RNA, 22 nt, Homo sapiens
uggguuuuuggucuccccagga

SEQ ID NO: 13460 - RNA, 21 nt, Homo sapiens
cugggagggagaucagcccac

SEQ ID NO: 13461 - RNA, 22 nt, Homo sapiens
agauuucauuugcuaugcuuuc

SEQ ID NO: 13462 - RNA, 22 nt, Homo sapiens
gcauuguaggcagguguucuuu

SEQ ID NO: 13463 - RNA, 22 nt, Homo sapiens
gagcugguaaaauggaaccaaa

SEQ ID NO: 13464 - RNA, 22 nt, Homo sapiens
uugguccccuucaaccagcugu

SEQ ID NO: 13465 - RNA, 22 nt, Homo sapiens
ucacucuacacagauagaaugg

SEQ ID NO: 13466 - RNA, 22 nt, Homo sapiens
ucagguuauugguggggguaag

SEQ ID NO: 13467 - RNA, 22 nt, Homo sapiens
ugaauuuugcccacaaugggcu

SEQ ID NO: 13468 - RNA, 22 nt, Homo sapiens
gccaccugugggaguaauuagu

SEQ ID NO: 13469 - RNA, 22 nt, Homo sapiens
uguggaauuagucuuuguccca

SEQ ID NO: 13470 - RNA, 22 nt, Homo sapiens
gacaauaugacuauuccauuua

SEQ ID NO: 13471 - RNA, 22 nt, Homo sapiens
ugggugcucauggagcagauua

SEQ ID NO: 13472 - RNA, 22 nt, Homo sapiens
acuugguccuugggcacuauug

SEQ ID NO: 13473 - RNA, 22 nt, Homo sapiens
gguuuucuggaaaauaggcccu

SEQ ID NO: 13474 - RNA, 22 nt, Homo sapiens
gacuauuuuccugaaaauuaga

SEQ ID NO: 13475 - RNA, 22 nt, Homo sapiens
uguugaucucaagauuuacucc

SEQ ID NO: 13476 - RNA, 22 nt, Homo sapiens
ugggagaauuugaaguuaaaau

SEQ ID NO: 13477 - RNA, 22 nt, Homo sapiens
uccucuuuuggcaccuuccucu

SEQ ID NO: 13478 - RNA, 18 nt, Homo sapiens
gagaggugagcugagggg

SEQ ID NO: 13479 - RNA, 22 nt, Homo sapiens
ccuuuucucuauggguaaggca

SEQ ID NO: 13480 - RNA, 22 nt, Homo sapiens
guuccuugauagagagaaggga

SEQ ID NO: 13481 - RNA, 22 nt, Homo sapiens
cauuuccaaagugucuuuuaag

SEQ ID NO: 13482 - RNA, 22 nt, Homo sapiens
ugacucuuaucuacaggacacu

SEQ ID NO: 13483 - RNA, 22 nt, Homo sapiens
agcucccccagugccuucugcu

SEQ ID NO: 13484 - RNA, 20 nt, Homo sapiens
aaaaggcacuggggugggcu

SEQ ID NO: 13485 - RNA, 22 nt, Homo sapiens
uugcuaaugugcauaggaauuc

SEQ ID NO: 13486 - RNA, 22 nt, Homo sapiens
uuccugugcacauuagggauca

SEQ ID NO: 13487 - RNA, 22 nt, Homo sapiens
aggaggggcagccagccacugu

SEQ ID NO: 13488 - RNA, 22 nt, Homo sapiens
cugagggcggugccucucuucu

SEQ ID NO: 13489 - RNA, 22 nt, Homo sapiens
aacagauagaggcucccaugua

SEQ ID NO: 13490 - RNA, 22 nt, Homo sapiens
guguuuguuaucuaucuguugu

SEQ ID NO: 13491 - RNA, 22 nt, Homo sapiens
gguggcugguacugacggaggg

SEQ ID NO: 13492 - RNA, 22 nt, Homo sapiens
cuuccguuucccucacuauucc

SEQ ID NO: 13493 - RNA, 22 nt, Homo sapiens
ggguugaggcggaugucggcgg

SEQ ID NO: 13494 - RNA, 22 nt, Homo sapiens
uguccucguccgccucgaacuc

SEQ ID NO: 13495 - RNA, 22 nt, Homo sapiens
uccaguacauggggcaccgugg

SEQ ID NO: 13496 - RNA, 22 nt, Homo sapiens
cugcuccagggucugcuggaga

SEQ ID NO: 13497 - RNA, 22 nt, Homo sapiens
gaggagcugggcagcugucaug

SEQ ID NO: 13498 - RNA, 22 nt, Homo sapiens
ugugucccucccagcuccuucc

SEQ ID NO: 13499 - RNA, 22 nt, Homo sapiens
uggcuaccuggcugaaauaaau

SEQ ID NO: 13500 - RNA, 22 nt, Homo sapiens
uuuuaaauuuuucuugcucugu

SEQ ID NO: 13501 - RNA, 22 nt, Homo sapiens
ugauuaaaagcuaugugugaua

SEQ ID NO: 13502 - RNA, 22 nt, Homo sapiens
aucaauauuuggcauggauugg

SEQ ID NO: 13503 - RNA, 22 nt, Homo sapiens
uugaugaucaguggacauggca

SEQ ID NO: 13504 - RNA, 22 nt, Homo sapiens
caugucacauauggucaucgaa

SEQ ID NO: 13505 - RNA, 22 nt, Homo sapiens
uuacauuuuauugagaaauguc

SEQ ID NO: 13506 - RNA, 22 nt, Homo sapiens
cauugucaguaaaaguuguaau

SEQ ID NO: 13507 - RNA, 22 nt, Homo sapiens
uuuaaucaaagaacuggguguu

SEQ ID NO: 13508 - RNA, 22 nt, Homo sapiens
cccaguuuugcuugauguuggg

SEQ ID NO: 13509 - RNA, 22 nt, Homo sapiens
aacaguuggaagggccuggauc

SEQ ID NO: 13510 - RNA, 22 nt, Homo sapiens
ucuuuggacuuuccaauuuguu

SEQ ID NO: 13511 - RNA, 22 nt, Homo sapiens
uggggucgggcaggagggccgg

SEQ ID NO: 13512 - RNA, 22 nt, Homo sapiens
ucuaccuccugcccuucccacc

SEQ ID NO: 13513 - RNA, 22 nt, Homo sapiens
uuaaaucucuuauuugcuguaa

SEQ ID NO: 13514 - RNA, 22 nt, Homo sapiens
uaugguauguauaagagguauu

SEQ ID NO: 13515 - RNA, 22 nt, Homo sapiens
uuguagguaaauacccaaggga

SEQ ID NO: 13516 - RNA, 22 nt, Homo sapiens
uaaggaaauuuaccuacaagag

SEQ ID NO: 13517 - RNA, 22 nt, Homo sapiens
cagugcaauguuaaaagggcau

SEQ ID NO: 13518 - RNA, 22 nt, Homo sapiens
ucuuuucacauugugcuacugu

SEQ ID NO: 13519 - RNA, 22 nt, Homo sapiens
acacuccacaggagacuaacau

SEQ ID NO: 13520 - RNA, 22 nt, Homo sapiens
guguagguuuccuggguugucc

SEQ ID NO: 13521 - RNA, 22 nt, Homo sapiens
uccaaugugccugucuuuuucu

SEQ ID NO: 13522 - RNA, 22 nt, Homo sapiens
gauugacaaggaagcauuggaa

SEQ ID NO: 13523 - RNA, 22 nt, Homo sapiens
uggggacucaaggauggaucuu

SEQ ID NO: 13524 - RNA, 22 nt, Homo sapiens
agucuaucuuauuguccuuuag

SEQ ID NO: 13525 - RNA, 22 nt, Homo sapiens
gggugugcggcugagggcagag

SEQ ID NO: 13526 - RNA, 22 nt, Homo sapiens
ucuguccucggcugcugcacuc

SEQ ID NO: 13527 - RNA, 22 nt, Homo sapiens
caggcagcaggagcccugcucg

SEQ ID NO: 13528 - RNA, 20 nt, Homo sapiens
gcuguggccuugcuggucug

SEQ ID NO: 13529 - RNA, 22 nt, Homo sapiens
ugaggugugggugguugguuuc

SEQ ID NO: 13530 - RNA, 22 nt, Homo sapiens
ugcaagcuccuuacauccacag

SEQ ID NO: 13531 - RNA, 22 nt, Homo sapiens
aauggggcccagagcucucaag

SEQ ID NO: 13532 - RNA, 22 nt, Homo sapiens
ugggacuggcccuuggcuccag

SEQ ID NO: 13533 - RNA, 22 nt, Homo sapiens
uggguucacucauugcuuuuuc

SEQ ID NO: 13534 - RNA, 22 nt, Homo sapiens
gaagcaaggaagagcucaacaa

SEQ ID NO: 13535 - RNA, 22 nt, Homo sapiens
acgccuugcagggaugcaguga

SEQ ID NO: 13536 - RNA, 22 nt, Homo sapiens
uucuuguaucccucaaggcugu

SEQ ID NO: 13537 - RNA, 22 nt, Homo sapiens
gaaggugggggcuggaugcuuu

SEQ ID NO: 13538 - RNA, 22 nt, Homo sapiens
augcaggccacccccagccuuc

SEQ ID NO: 13539 - RNA, 22 nt, Homo sapiens
cuggcuucugcacacggacggg

SEQ ID NO: 13540 - RNA, 22 nt, Homo sapiens
ugaaagugugugaaaguuauug

SEQ ID NO: 13541 - RNA, 22 nt, Homo sapiens
gggcuccugaugcucuccagau

SEQ ID NO: 13542 - RNA, 22 nt, Homo sapiens
ucugagaugggcuucgggaguc

SEQ ID NO: 13543 - RNA, 22 nt, Homo sapiens
agguaagggcugcagguucucu

SEQ ID NO: 13544 - RNA, 22 nt, Homo sapiens
gguggccucacccuuccaguuc

SEQ ID NO: 13545 - RNA, 22 nt, Homo sapiens
gcucccgguguccugcaaacgu

SEQ ID NO: 13546 - RNA, 22 nt, Homo sapiens
cagugugugugggauggggcug

SEQ ID NO: 13547 - RNA, 22 nt, Homo sapiens
uggcgguggagagagggaaugu

SEQ ID NO: 13548 - RNA, 22 nt, Homo sapiens
uugucucuuucauaccguucac

SEQ ID NO: 13549 - RNA, 22 nt, Homo sapiens
uuaccagugugggaacggcuuu

SEQ ID NO: 13550 - RNA, 22 nt, Homo sapiens
gccccccacaucuggucaauua

SEQ ID NO: 13551 - RNA, 22 nt, Homo sapiens
ucacagggcugcugugaguuaa

SEQ ID NO: 13552 - RNA, 22 nt, Homo sapiens
uggcacacaguaagcccuaagu

SEQ ID NO: 13553 - RNA, 22 nt, Homo sapiens
ugcgggguccggugcagcucau

SEQ ID NO: 13554 - RNA, 22 nt, Homo sapiens
ggcauucgccggcgucgucaug

SEQ ID NO: 13555 - RNA, 22 nt, Homo sapiens
uuuucuguuucagaaaggacag

SEQ ID NO: 13556 - RNA, 22 nt, Homo sapiens
ucagguauucuggaacagagaa

SEQ ID NO: 13557 - RNA, 22 nt, Homo sapiens
accccggccucccugaacuuug

SEQ ID NO: 13558 - RNA, 22 nt, Homo sapiens
caagggucagggccgaagggag

SEQ ID NO: 13559 - RNA, 22 nt, Homo sapiens
uguggauggcugggaagagguu

SEQ ID NO: 13560 - RNA, 22 nt, Homo sapiens
agcuuccuuccucauccccauc

SEQ ID NO: 13561 - RNA, 22 nt, Homo sapiens
uuacaugucugacagagcuaga

SEQ ID NO: 13562 - RNA, 22 nt, Homo sapiens
uuuggcucugaucagauagagu

SEQ ID NO: 13563 - RNA, 22 nt, Homo sapiens
gcccccgggaaggguuguuguc

SEQ ID NO: 13564 - RNA, 19 nt, Homo sapiens
uagcagcuuccuguggggc

SEQ ID NO: 13565 - RNA, 22 nt, Homo sapiens
gaggaggugaagauuuuggggg

SEQ ID NO: 13566 - RNA, 22 nt, Homo sapiens
uuuccaaguuucauccuuaucc

SEQ ID NO: 13567 - RNA, 22 nt, Homo sapiens
uaggcugagcucaggguucagg

SEQ ID NO: 13568 - RNA, 22 nt, Homo sapiens
ggauccuguaagggcugagccu

SEQ ID NO: 13569 - RNA, 22 nt, Homo sapiens
ggcuucagcagcacugaacauu

SEQ ID NO: 13570 - RNA, 22 nt, Homo sapiens
ugaaucucaggcugugaagucc

SEQ ID NO: 13571 - RNA, 22 nt, Homo sapiens
caggcaggugucccgggcauca

SEQ ID NO: 13572 - RNA, 22 nt, Homo sapiens
cugcugggacuccugcucugcc

SEQ ID NO: 13573 - RNA, 22 nt, Homo sapiens
ucccccugguugcuauguuggg

SEQ ID NO: 13574 - RNA, 18 nt, Homo sapiens
cagagagaccagugggga

SEQ ID NO: 13575 - RNA, 22 nt, Homo sapiens
uagagauagcugcagccaccua

SEQ ID NO: 13576 - RNA, 22 nt, Homo sapiens
ggagcgagcagcuauuugcuag

SEQ ID NO: 13577 - RNA, 22 nt, Homo sapiens
acaaccuucuagggcacagacg

SEQ ID NO: 13578 - RNA, 22 nt, Homo sapiens
uuagguuucagaagggugcugg

SEQ ID NO: 13579 - RNA, 22 nt, Homo sapiens
ugggcuuccugaaucuauugag

SEQ ID NO: 13580 - RNA, 22 nt, Homo sapiens
ucacuagaugugagacccaggg

SEQ ID NO: 13581 - RNA, 22 nt, Homo sapiens
acucgagagaguagcaaucaca

SEQ ID NO: 13582 - RNA, 20 nt, Homo sapiens
ugauugaaaccucuacgagu

SEQ ID NO: 13583 - RNA, 22 nt, Homo sapiens
aaggucucuucucaagaguucc

SEQ ID NO: 13584 - RNA, 22 nt, Homo sapiens
gauuaucugggaggcgacccug

SEQ ID NO: 13585 - RNA, 22 nt, Homo sapiens
cgagccuuuagggguaugagag

SEQ ID NO: 13586 - RNA, 19 nt, Homo sapiens
cgugcucucaaagagcucg

SEQ ID NO: 13587 - RNA, 22 nt, Homo sapiens
cacagugacuauucuaucagga

SEQ ID NO: 13588 - RNA, 22 nt, Homo sapiens
ucuggauagagagucaguggug

SEQ ID NO: 13589 - RNA, 22 nt, Homo sapiens
ucccuggcuuccuggagcucac

SEQ ID NO: 13590 - RNA, 22 nt, Homo sapiens
uggugcugcgggaacccagggu

SEQ ID NO: 13591 - RNA, 22 nt, Homo sapiens
ucagaucaauaucaaucaggag

SEQ ID NO: 13592 - RNA, 22 nt, Homo sapiens
ucuugauuggcauuuaccugag

SEQ ID NO: 13593 - RNA, 22 nt, Homo sapiens
agagcugauugauggcuuuuug

SEQ ID NO: 13594 - RNA, 22 nt, Homo sapiens
gaggccauuuucacagcuucug

SEQ ID NO: 13595 - RNA, 22 nt, Homo sapiens
ccccuccacagaauccagaauu

SEQ ID NO: 13596 - RNA, 22 nt, Homo sapiens
ucugguuuucugggagggcucu

SEQ ID NO: 13597 - RNA, 22 nt, Homo sapiens
uuugugcugccaguggaaagcc

SEQ ID NO: 13598 - RNA, 22 nt, Homo sapiens
gcccgcugagcagccgaacgcg

SEQ ID NO: 13599 - RNA, 22 nt, Homo sapiens
uggucaguagaauguuuugcuu

SEQ ID NO: 13600 - RNA, 22 nt, Homo sapiens
cauagaacagucuucugagcca

SEQ ID NO: 13601 - RNA, 22 nt, Homo sapiens
agggccuggagggcugcuggga

SEQ ID NO: 13602 - RNA, 22 nt, Homo sapiens
cccagcagccuuugcccccauc

SEQ ID NO: 13603 - RNA, 22 nt, Homo sapiens
ugcuuaaagaauggcuguccgu

SEQ ID NO: 13604 - RNA, 22 nt, Homo sapiens
gacaaccauuguuuuaguaucc

SEQ ID NO: 13605 - RNA, 22 nt, Homo sapiens
ggaauggucuaggggaucuugc

SEQ ID NO: 13606 - RNA, 22 nt, Homo sapiens
cuaggaucccccaagccccuuc

SEQ ID NO: 13607 - RNA, 22 nt, Homo sapiens
cccacaccuccguauaucacua

SEQ ID NO: 13608 - RNA, 22 nt, Homo sapiens
ugauauauaaugaggugaggga

SEQ ID NO: 13609 - RNA, 22 nt, Homo sapiens
agucaccaugaaggauggccug

SEQ ID NO: 13610 - RNA, 22 nt, Homo sapiens
gucguccuggcugugggcuacu

SEQ ID NO: 13611 - RNA, 22 nt, Homo sapiens
aggccaucugcagagaagaaag

SEQ ID NO: 13612 - RNA, 22 nt, Homo sapiens
uucuugucagcauuugguaggg

SEQ ID NO: 13613 - RNA, 22 nt, Homo sapiens
ccagaacagagcuucuauuuca

SEQ ID NO: 13614 - RNA, 22 nt, Homo sapiens
uguagcagguucuguugcugcu

SEQ ID NO: 13615 - RNA, 22 nt, Homo sapiens
uuuccuuuugggaucuugaugg

SEQ ID NO: 13616 - RNA, 22 nt, Homo sapiens
auaggguuccagaggaaaggaa

SEQ ID NO: 13617 - RNA, 22 nt, Homo sapiens
uggaauuguuccugggcuggug

SEQ ID NO: 13618 - RNA, 22 nt, Homo sapiens
uccauagcccaggaaugaccac

SEQ ID NO: 13619 - RNA, 22 nt, Homo sapiens
gccuccucauuggucugugucc

SEQ ID NO: 13620 - RNA, 19 nt, Homo sapiens
acagcagccagagugaggu

SEQ ID NO: 13621 - RNA, 22 nt, Homo sapiens
cagcaucagggucugccuugcg

SEQ ID NO: 13622 - RNA, 22 nt, Homo sapiens
agagcagggucccuguuguuuc

SEQ ID NO: 13623 - RNA, 22 nt, Homo sapiens
uccccagcacuggaggaggcac

SEQ ID NO: 13624 - RNA, 22 nt, Homo sapiens
uggcuccuccaugucugaggga

SEQ ID NO: 13625 - RNA, 22 nt, Homo sapiens
ggcacagcugccauccccugcc

SEQ ID NO: 13626 - RNA, 22 nt, Homo sapiens
ggaagggaguggggcugugcag

SEQ ID NO: 13627 - RNA, 22 nt, Homo sapiens
uuugagcuagacuccuccucca

SEQ ID NO: 13628 - RNA, 22 nt, Homo sapiens
gucuggaguagagucuagcugg

SEQ ID NO: 13629 - RNA, 22 nt, Homo sapiens
gcuguaaguacuuaggagggag

SEQ ID NO: 13630 - RNA, 22 nt, Homo sapiens
ucucucuuggguaucugagugu

SEQ ID NO: 13631 - RNA, 22 nt, Homo sapiens
uuuagaggggcguccccacucc

SEQ ID NO: 13632 - RNA, 22 nt, Homo sapiens
gaagcuggggguacccucuaac

SEQ ID NO: 13633 - RNA, 22 nt, Homo sapiens
ucggggucuuuuguuuugggau

SEQ ID NO: 13634 - RNA, 22 nt, Homo sapiens
ucccaugauggaaggccaugag

SEQ ID NO: 13635 - RNA, 22 nt, Homo sapiens
uuguucugauuugugcugggca

SEQ ID NO: 13636 - RNA, 22 nt, Homo sapiens
caccccagcacauuugacaagc

SEQ ID NO: 13637 - RNA, 22 nt, Homo sapiens
uguccagucauggggugcaggu

SEQ ID NO: 13638 - RNA, 22 nt, Homo sapiens
ugccgcuuggugcugggcuagu

SEQ ID NO: 13639 - RNA, 22 nt, Homo sapiens
uugugaaggauuuaggcuccac

SEQ ID NO: 13640 - RNA, 22 nt, Homo sapiens
uggggccugaaucacuuucagu

SEQ ID NO: 13641 - RNA, 22 nt, Homo sapiens
uugugaaggauuuaggcuccac

SEQ ID NO: 13642 - RNA, 22 nt, Homo sapiens
uggggccugaaucacuuucagu

SEQ ID NO: 13643 - RNA, 22 nt, Homo sapiens
uugugaaggauuuaggcuccac

SEQ ID NO: 13644 - RNA, 22 nt, Homo sapiens
uggggccugaaucacuuucagu

SEQ ID NO: 13645 - RNA, 22 nt, Homo sapiens
ucccuccagaggaggagggacu

SEQ ID NO: 13646 - RNA, 22 nt, Homo sapiens
uguuuuuccucuggcaugggag

SEQ ID NO: 13647 - RNA, 22 nt, Homo sapiens
uguuucaaaugugcucagggua

SEQ ID NO: 13648 - RNA, 22 nt, Homo sapiens
ccaugugcauauuuuaaacauu

SEQ ID NO: 13649 - RNA, 22 nt, Homo sapiens
acucccucuuugccccuugcug

SEQ ID NO: 13650 - RNA, 22 nt, Homo sapiens
gcauaggguggagugggugugc

SEQ ID NO: 13651 - RNA, 22 nt, Homo sapiens
ucuggcuucucccauccagcuc

SEQ ID NO: 13652 - RNA, 22 nt, Homo sapiens
gcuguguggugggaggcgaggg

SEQ ID NO: 13653 - RNA, 22 nt, Homo sapiens
ucagugaaccuucaccaaaccc

SEQ ID NO: 13654 - RNA, 19 nt, Homo sapiens
ugguggaggugcaccugac

SEQ ID NO: 13655 - RNA, 22 nt, Homo sapiens
augccuguuagcugcacugucu

SEQ ID NO: 13656 - RNA, 22 nt, Homo sapiens
caggguguaugcucagcaggca

SEQ ID NO: 13657 - RNA, 22 nt, Homo sapiens
ugugguuagaaauuaggagaau

SEQ ID NO: 13658 - RNA, 22 nt, Homo sapiens
ucugcuauuuuuuagccauaag

SEQ ID NO: 13659 - RNA, 22 nt, Homo sapiens
aggacugacauuccucggguua

SEQ ID NO: 13660 - RNA, 22 nt, Homo sapiens
aaucuuaaggaaugucaccuug

SEQ ID NO: 13661 - RNA, 22 nt, Homo sapiens
uggggagagacaggugugagcu

SEQ ID NO: 13662 - RNA, 22 nt, Homo sapiens
cucacaccugucuuguguucuu

SEQ ID NO: 13663 - RNA, 22 nt, Homo sapiens
uaacuauagaugcugggagaag

SEQ ID NO: 13664 - RNA, 22 nt, Homo sapiens
cucccagcaugcuauauagguu

SEQ ID NO: 13665 - RNA, 22 nt, Homo sapiens
uugugccaggaauugugcauau

SEQ ID NO: 13666 - RNA, 22 nt, Homo sapiens
uaugcauugacccugccaucaa

SEQ ID NO: 13667 - RNA, 22 nt, Homo sapiens
agaggagccugggcuggcgguc

SEQ ID NO: 13668 - RNA, 22 nt, Homo sapiens
ccuccgcgcccgcccucccucu

SEQ ID NO: 13669 - RNA, 22 nt, Homo sapiens
uucuucccuucucugcaggggc

SEQ ID NO: 13670 - RNA, 22 nt, Homo sapiens
ccuguggagauguagaugggag

SEQ ID NO: 13671 - RNA, 22 nt, Homo sapiens
gguuugagugcaggguguagga

SEQ ID NO: 13672 - RNA, 22 nt, Homo sapiens
cagggcccuugacucaagugcc

SEQ ID NO: 13673 - RNA, 22 nt, Homo sapiens
ugggcauuuuggggugggagaa

SEQ ID NO: 13674 - RNA, 22 nt, Homo sapiens
uccaaacuccaaaaugaauaug

SEQ ID NO: 13675 - RNA, 22 nt, Homo sapiens
uggggcccaugcccuuaagcag

SEQ ID NO: 13676 - RNA, 22 nt, Homo sapiens
uguugcggucaugggccauaaa

SEQ ID NO: 13677 - RNA, 22 nt, Homo sapiens
gguggggcccauggccuuacac

SEQ ID NO: 13678 - RNA, 22 nt, Homo sapiens
guuggggucaugggccaugaau

SEQ ID NO: 13679 - RNA, 22 nt, Homo sapiens
gguccuccccaggcuguccucc

SEQ ID NO: 13680 - RNA, 22 nt, Homo sapiens
gugacagccugggggacugggc

SEQ ID NO: 13681 - RNA, 22 nt, Homo sapiens
gccuccugcaagcucugaggcu

SEQ ID NO: 13682 - RNA, 22 nt, Homo sapiens
caucuuauagcuuaggaggcug

SEQ ID NO: 13683 - RNA, 22 nt, Homo sapiens
ugggauguuuauaggcaaguuu

SEQ ID NO: 13684 - RNA, 22 nt, Homo sapiens
acaccgcauugaauguccuaaa

SEQ ID NO: 13685 - RNA, 22 nt, Homo sapiens
uauucugauaucagcacuuugg

SEQ ID NO: 13686 - RNA, 22 nt, Homo sapiens
aaugcuguugauucagcuuauu

SEQ ID NO: 13687 - RNA, 22 nt, Homo sapiens
uuauccccaggcagagagcuca

SEQ ID NO: 13688 - RNA, 22 nt, Homo sapiens
gcucucugccugggaauaauuu

SEQ ID NO: 13689 - RNA, 22 nt, Homo sapiens
agaaugauaguuguuaaaaaua

SEQ ID NO: 13690 - RNA, 22 nt, Homo sapiens
uaauaauagcugucauuuguug

SEQ ID NO: 13691 - RNA, 22 nt, Homo sapiens
ugggggcaggagggagcuaaac

SEQ ID NO: 13692 - RNA, 21 nt, Homo sapiens
uaucucccuccuguuuuccca

SEQ ID NO: 13693 - RNA, 22 nt, Homo sapiens
ggaagguuaucagagggagaag

SEQ ID NO: 13694 - RNA, 22 nt, Homo sapiens
uuuuccuuuggcuuccuuccug

SEQ ID NO: 13695 - RNA, 22 nt, Homo sapiens
ucuuauuauuucagcaggaggg

SEQ ID NO: 13696 - RNA, 22 nt, Homo sapiens
ugccugcugaaagaugggaugg

SEQ ID NO: 13697 - RNA, 22 nt, Homo sapiens
gagggaauuugcagguuguuuu

SEQ ID NO: 13698 - RNA, 22 nt, Homo sapiens
agcaauuugagcaaguucuauc

SEQ ID NO: 13699 - RNA, 22 nt, Homo sapiens
uuaaaauuccaucugauuucug

SEQ ID NO: 13700 - RNA, 22 nt, Homo sapiens
gaaaucauauggaaguuuaacu

SEQ ID NO: 13701 - RNA, 22 nt, Homo sapiens
ugugaagugcuggguggcggcu

SEQ ID NO: 13702 - RNA, 22 nt, Homo sapiens
ccugcauggccucagcgcuugu

SEQ ID NO: 13703 - RNA, 22 nt, Homo sapiens
uaggagcuaggagcugcggauc

SEQ ID NO: 13704 - RNA, 22 nt, Homo sapiens
agccugcagcugagccucgagu

SEQ ID NO: 13705 - RNA, 22 nt, Homo sapiens
cggcauucuuccccacaauuaa

SEQ ID NO: 13706 - RNA, 22 nt, Homo sapiens
uaauuaguggggaagaauaucg

SEQ ID NO: 13707 - RNA, 22 nt, Homo sapiens
ucaguuugcugcacagauauuu

SEQ ID NO: 13708 - RNA, 22 nt, Homo sapiens
uugcuguggggcagacugugag

SEQ ID NO: 13709 - RNA, 22 nt, Homo sapiens
ggagccaggcguaggacagggc

SEQ ID NO: 13710 - RNA, 22 nt, Homo sapiens
ucugccugccgcuugcagcucc

SEQ ID NO: 13711 - RNA, 22 nt, Homo sapiens
uggccagaggugagagcugccc

SEQ ID NO: 13712 - RNA, 22 nt, Homo sapiens
cccacuuucaccaccuggccuc

SEQ ID NO: 13713 - RNA, 22 nt, Homo sapiens
uggccagaggugagagcugccc

SEQ ID NO: 13714 - RNA, 22 nt, Homo sapiens
cccacuuucaccaccuggccuc

SEQ ID NO: 13715 - RNA, 22 nt, Homo sapiens
uggccagaggugagagcugccc

SEQ ID NO: 13716 - RNA, 22 nt, Homo sapiens
cccacuuucaccaccuggccuc

SEQ ID NO: 13717 - RNA, 22 nt, Homo sapiens
aaacacaagagcaaggugcuga

SEQ ID NO: 13718 - RNA, 22 nt, Homo sapiens
ggcagcuuuuucuguguguuuu

SEQ ID NO: 13719 - RNA, 22 nt, Homo sapiens
ugcuuucaccaaggugccucug

SEQ ID NO: 13720 - RNA, 17 nt, Homo sapiens
uagcugguggcugagca

SEQ ID NO: 13721 - RNA, 22 nt, Homo sapiens
aacagagugacucacuacugaa

SEQ ID NO: 13722 - RNA, 22 nt, Homo sapiens
uaguggugaguugcuuuguuua

SEQ ID NO: 13723 - RNA, 22 nt, Homo sapiens
uguguugauuccaggggacacc

SEQ ID NO: 13724 - RNA, 22 nt, Homo sapiens
gguccccuggggucacacagug

SEQ ID NO: 13725 - RNA, 22 nt, Homo sapiens
gauuuaugggaaacuggcaauu

SEQ ID NO: 13726 - RNA, 22 nt, Homo sapiens
ugcuagccucagauuuaucccu

SEQ ID NO: 13727 - RNA, 22 nt, Homo sapiens
ugggccugugccuugucucugg

SEQ ID NO: 13728 - RNA, 22 nt, Homo sapiens
uggacagggcugagagcccuug

SEQ ID NO: 13729 - RNA, 22 nt, Homo sapiens
uuucacuccccuccccacugca

SEQ ID NO: 13730 - RNA, 22 nt, Homo sapiens
caggacuggggagcggaaggug

SEQ ID NO: 13731 - RNA, 22 nt, Homo sapiens
uuuguccauuauuauccuugag

SEQ ID NO: 13732 - RNA, 22 nt, Homo sapiens
uccaaggagaaaugggcaacag

SEQ ID NO: 13733 - RNA, 22 nt, Homo sapiens
gguccggggcucauauccuggg

SEQ ID NO: 13734 - RNA, 21 nt, Homo sapiens
caagugugauccccaaggacc

SEQ ID NO: 13735 - RNA, 22 nt, Homo sapiens
uggagcagguaggguggaggcc

SEQ ID NO: 13736 - RNA, 22 nt, Homo sapiens
ccucuucccuccuccugcuccg

SEQ ID NO: 13737 - RNA, 22 nt, Homo sapiens
ggugucacccaucacugggccc

SEQ ID NO: 13738 - RNA, 22 nt, Homo sapiens
gaacaggaugggugcucacuaa

SEQ ID NO: 13739 - RNA, 22 nt, Homo sapiens
uucacguuuguccauuuggaug

SEQ ID NO: 13740 - RNA, 22 nt, Homo sapiens
gcccaaauggauaaauuuaucu

SEQ ID NO: 13741 - RNA, 22 nt, Homo sapiens
ugucuggcagcuucgcucgggc

SEQ ID NO: 13742 - RNA, 22 nt, Homo sapiens
ccuugguggguugccagacauu

SEQ ID NO: 13743 - RNA, 22 nt, Homo sapiens
uaagcgcgaugcccucuccuag

SEQ ID NO: 13744 - RNA, 22 nt, Homo sapiens
uagggaggggauacgucugcuu

SEQ ID NO: 13745 - RNA, 22 nt, Homo sapiens
uggacucugugacacuguggua

SEQ ID NO: 13746 - RNA, 22 nt, Homo sapiens
ccacagugacacagaccucacu

SEQ ID NO: 13747 - RNA, 22 nt, Homo sapiens
uguuugaaagcuguugcccuca

SEQ ID NO: 13748 - RNA, 22 nt, Homo sapiens
gaguaacagcuuucaagauauu

SEQ ID NO: 13749 - RNA, 22 nt, Homo sapiens
ccguccauuacuggagacucug

SEQ ID NO: 13750 - RNA, 22 nt, Homo sapiens
gugucuccaguaguagacagaa

SEQ ID NO: 13751 - RNA, 22 nt, Homo sapiens
ugguuguggggaaaaugagaug

SEQ ID NO: 13752 - RNA, 22 nt, Homo sapiens
cugauuuuauuuuuuucacucc

SEQ ID NO: 13753 - RNA, 22 nt, Homo sapiens
ugccugaccucuauuucuuggg

SEQ ID NO: 13754 - RNA, 22 nt, Homo sapiens
aggaagagagguuggggccagu

SEQ ID NO: 13755 - RNA, 22 nt, Homo sapiens
uuucauagaagcaccaccuaug

SEQ ID NO: 13756 - RNA, 22 nt, Homo sapiens
uacaugguuguuuuuauggagc

SEQ ID NO: 13757 - RNA, 22 nt, Homo sapiens
cccauuugaugugguuugggcc

SEQ ID NO: 13758 - RNA, 22 nt, Homo sapiens
cuaaauguauuuuaagugggcu

SEQ ID NO: 13759 - RNA, 22 nt, Homo sapiens
ggccggcucaguggucagcgcu

SEQ ID NO: 13760 - RNA, 22 nt, Homo sapiens
gaggcguuggguggagcugccu

SEQ ID NO: 13761 - RNA, 22 nt, Homo sapiens
accugugcccuccaccagggaa

SEQ ID NO: 13762 - RNA, 22 nt, Homo sapiens
ccugcacagggggcugcaggcc

SEQ ID NO: 13763 - RNA, 22 nt, Homo sapiens
uugguaguuuggagccagaugu

SEQ ID NO: 13764 - RNA, 22 nt, Homo sapiens
gugcugguuucagauugucgug

SEQ ID NO: 13765 - RNA, 22 nt, Homo sapiens
uugcuuaagaucacagagcuaa

SEQ ID NO: 13766 - RNA, 22 nt, Homo sapiens
ucuagcucugauuuuaagggau

SEQ ID NO: 13767 - RNA, 22 nt, Homo sapiens
uugcuuaagaucacagagcuaa

SEQ ID NO: 13768 - RNA, 22 nt, Homo sapiens
ucuagcucugauuuuaagggau

SEQ ID NO: 13769 - RNA, 22 nt, Homo sapiens
ugcuguugugcuguacucuaca

SEQ ID NO: 13770 - RNA, 22 nt, Homo sapiens
ugcaguuuaaggcacaauuagc

SEQ ID NO: 13771 - RNA, 22 nt, Homo sapiens
ugggaggcagcaagaggcagcu

SEQ ID NO: 13772 - RNA, 22 nt, Homo sapiens
gucugucauccuguucaccucc

SEQ ID NO: 13773 - RNA, 22 nt, Homo sapiens
aagcucugcacacuuguggaca

SEQ ID NO: 13774 - RNA, 22 nt, Homo sapiens
uaugugcacacaaguguguguu

SEQ ID NO: 13775 - RNA, 22 nt, Homo sapiens
uugauuggagugaggggauacc

SEQ ID NO: 13776 - RNA, 22 nt, Homo sapiens
guccuccuggcuccaucacccc

SEQ ID NO: 13777 - RNA, 22 nt, Homo sapiens
uuugcuuuucaugcagugaagu

SEQ ID NO: 13778 - RNA, 22 nt, Homo sapiens
acagcugcaugaaaacaacuuu

SEQ ID NO: 13779 - RNA, 22 nt, Homo sapiens
augucugcaugaaucacacagg

SEQ ID NO: 13780 - RNA, 22 nt, Homo sapiens
ucugugauucaugcagaugcca

SEQ ID NO: 13781 - RNA, 22 nt, Homo sapiens
ucaaagcaacauugacaaaugg

SEQ ID NO: 13782 - RNA, 22 nt, Homo sapiens
uuuguuaaugcugcuuuuaaca

SEQ ID NO: 13783 - RNA, 22 nt, Homo sapiens
ugggucacagagcagauggucc

SEQ ID NO: 13784 - RNA, 22 nt, Homo sapiens
gaugugugcugugugccgggac

SEQ ID NO: 13785 - RNA, 22 nt, Homo sapiens
uuuuaggcaggugugauauuag

SEQ ID NO: 13786 - RNA, 22 nt, Homo sapiens
uaaaucacaccugccuuugaac

SEQ ID NO: 13787 - RNA, 23 nt, Homo sapiens
agcuacauugucugcuggguuuc

SEQ ID NO: 13788 - RNA, 22 nt, Homo sapiens
ccuggcauacaauguagauuuc

SEQ ID NO: 13789 - RNA, 22 nt, Homo sapiens
gaguccuguauuuguggaugau

SEQ ID NO: 13790 - RNA, 22 nt, Homo sapiens
uucugugagaugcagacuugac

SEQ ID NO: 13791 - RNA, 23 nt, Homo sapiens
aagccaggagagagugacaugac

SEQ ID NO: 13792 - RNA, 22 nt, Homo sapiens
ugcccucccaugucccuggcag

SEQ ID NO: 13793 - RNA, 22 nt, Homo sapiens
gacuggggaugggggugggcaa

SEQ ID NO: 13794 - RNA, 22 nt, Homo sapiens
ccucugugugaggugcucuggg

SEQ ID NO: 13795 - RNA, 22 nt, Homo sapiens
ugagagccucccaccugagacu

SEQ ID NO: 13796 - RNA, 22 nt, Homo sapiens
aucuggggcuggggucgcggcc

SEQ ID NO: 13797 - RNA, 22 nt, Homo sapiens
ccgggaccaaggccacggagcu

SEQ ID NO: 13798 - RNA, 22 nt, Homo sapiens
ucacuaaaucauaugggacuaa

SEQ ID NO: 13799 - RNA, 22 nt, Homo sapiens
uaucccaagauguauuugguga

SEQ ID NO: 13800 - RNA, 22 nt, Homo sapiens
uaugugccuuuggacuacaucg

SEQ ID NO: 13801 - RNA, 20 nt, Homo sapiens
gcaguccaugggcauauaca

SEQ ID NO: 13802 - RNA, 21 nt, Homo sapiens
gcaguccaugggcauauacac

SEQ ID NO: 13803 - RNA, 22 nt, Homo sapiens
caggagcugcugggggugcugg

SEQ ID NO: 13804 - RNA, 22 nt, Homo sapiens
cagcacccccauuucugcugcu

SEQ ID NO: 13805 - RNA, 22 nt, Homo sapiens
ugguaaugguucucuugcuaua

SEQ ID NO: 13806 - RNA, 21 nt, Homo sapiens
aaaccguuaccauuacugagu

SEQ ID NO: 13807 - RNA, 22 nt, Homo sapiens
aaaccguuaccauuacugaguu

SEQ ID NO: 13808 - RNA, 23 nt, Homo sapiens
aaaccguuaccauuacugaguuu

SEQ ID NO: 13809 - RNA, 23 nt, Homo sapiens
ggaaaccguuaccauuacugagu

SEQ ID NO: 13810 - RNA, 22 nt, Homo sapiens
uggauggagguugagagggcug

SEQ ID NO: 13811 - RNA, 22 nt, Homo sapiens
uuucucacucuccauucaccca

SEQ ID NO: 13812 - RNA, 22 nt, Homo sapiens
uggugacccugaggaugcacca

SEQ ID NO: 13813 - RNA, 22 nt, Homo sapiens
uguggcaucucagggagcuaga

SEQ ID NO: 13814 - RNA, 22 nt, Homo sapiens
uggccucuggcugucgccuccc

SEQ ID NO: 13815 - RNA, 22 nt, Homo sapiens
gaucgggugcaagcacagaggc

SEQ ID NO: 13816 - RNA, 22 nt, Homo sapiens
aacaauuccaccacuguggacg

SEQ ID NO: 13817 - RNA, 22 nt, Homo sapiens
ccacguaggauggaauugucua

SEQ ID NO: 13818 - RNA, 22 nt, Homo sapiens
agaggccugaagaagucauagc

SEQ ID NO: 13819 - RNA, 22 nt, Homo sapiens
ugugacuucuucaguccucugu

SEQ ID NO: 13820 - RNA, 22 nt, Homo sapiens
agguugccugucccaggugcac

SEQ ID NO: 13821 - RNA, 22 nt, Homo sapiens
uuucuuucugggauagggggcu

SEQ ID NO: 13822 - RNA, 22 nt, Homo sapiens
aucugaauuucuguuguuuucc

SEQ ID NO: 13823 - RNA, 22 nt, Homo sapiens
guugacagggauucagugauuc

SEQ ID NO: 13824 - RNA, 22 nt, Homo sapiens
acacugcaugggcuccgggaca

SEQ ID NO: 13825 - RNA, 22 nt, Homo sapiens
uccccggagggcccugcaggug

SEQ ID NO: 13826 - RNA, 22 nt, Homo sapiens
ugugcgggaggcugaguccagc

SEQ ID NO: 13827 - RNA, 22 nt, Homo sapiens
uuccacaggguuucccgcacgc

SEQ ID NO: 13828 - RNA, 22 nt, Homo sapiens
ugucugugcggaagacaaugug

SEQ ID NO: 13829 - RNA, 22 nt, Homo sapiens
auugucucugacaaggacacuc

SEQ ID NO: 13830 - RNA, 22 nt, Homo sapiens
gauagccuggucugggggagaa

SEQ ID NO: 13831 - RNA, 22 nt, Homo sapiens
ucucucucucuuaccucuaucu

SEQ ID NO: 13832 - RNA, 22 nt, Homo sapiens
ucuuacaccuagguaaagccuu

SEQ ID NO: 13833 - RNA, 22 nt, Homo sapiens
ucaggcugcuaagguguaagag

SEQ ID NO: 13834 - RNA, 22 nt, Homo sapiens
ugauuuuucugauaauuuggaa

SEQ ID NO: 13835 - RNA, 22 nt, Homo sapiens
uagacaucgucagaaaaaucau

SEQ ID NO: 13836 - RNA, 22 nt, Homo sapiens
ugagugaaguucugaacuuucc

SEQ ID NO: 13837 - RNA, 22 nt, Homo sapiens
aaaucaagaauuuuacuuaggu

SEQ ID NO: 13838 - RNA, 22 nt, Homo sapiens
uacaaagcagaaguauuuuuuu

SEQ ID NO: 13839 - RNA, 21 nt, Homo sapiens
gaaauacuuuuguuuaguaug

SEQ ID NO: 13840 - RNA, 22 nt, Homo sapiens
gaucccagaaucaaaucaggug

SEQ ID NO: 13841 - RNA, 22 nt, Homo sapiens
cccgauuugaucccgggaucuc

SEQ ID NO: 13842 - RNA, 22 nt, Homo sapiens
ucccaggguuccacgccuggcu

SEQ ID NO: 13843 - RNA, 22 nt, Homo sapiens
aaccagcaugaaaccuugagca

SEQ ID NO: 13844 - RNA, 22 nt, Homo sapiens
uguguaauauguuuaauauaug

SEQ ID NO: 13845 - RNA, 22 nt, Homo sapiens
uguauuugcaugugugcacaca

SEQ ID NO: 13846 - RNA, 22 nt, Homo sapiens
ugaagcaugcuuauaugucuug

SEQ ID NO: 13847 - RNA, 22 nt, Homo sapiens
ugagcauuagguguguuucaga

SEQ ID NO: 13848 - RNA, 22 nt, Homo sapiens
aggaggggaggggagguggaag

SEQ ID NO: 13849 - RNA, 22 nt, Homo sapiens
ucuaccuuaccuucuccucuau

SEQ ID NO: 13850 - RNA, 22 nt, Homo sapiens
aagaaauucacuccugggcuga

SEQ ID NO: 13851 - RNA, 22 nt, Homo sapiens
gccuaaagugaauuuuuauggc

SEQ ID NO: 13852 - RNA, 22 nt, Homo sapiens
aggucuuggaagaaguugcacc

SEQ ID NO: 13853 - RNA, 22 nt, Homo sapiens
guaaguuuccuccaggauccag

SEQ ID NO: 13854 - RNA, 22 nt, Homo sapiens
uuuuuguauuauuuuuggcuug

SEQ ID NO: 13855 - RNA, 22 nt, Homo sapiens
gccagugagugacagcagagac

SEQ ID NO: 13856 - RNA, 22 nt, Homo sapiens
ucaggcaugcagacagguuugg

SEQ ID NO: 13857 - RNA, 21 nt, Homo sapiens
uagacacugugugcuggauuu

SEQ ID NO: 13858 - RNA, 22 nt, Homo sapiens
aggucuuggaagaaguugcacc

SEQ ID NO: 13859 - RNA, 22 nt, Homo sapiens
ggucaguuuucuccaggaucca

SEQ ID NO: 13860 - RNA, 22 nt, Homo sapiens
aacccuaucacuuaggcacuau

SEQ ID NO: 13861 - RNA, 22 nt, Homo sapiens
uagugccuaggugacaggguug

SEQ ID NO: 13862 - RNA, 22 nt, Homo sapiens
agcagauuuucccaguaaguaa

SEQ ID NO: 13863 - RNA, 20 nt, Homo sapiens
ggcacuuuggggaagcugcu

SEQ ID NO: 13864 - RNA, 22 nt, Homo sapiens
uuccucuuucucugcucuuaac

SEQ ID NO: 13865 - RNA, 22 nt, Homo sapiens
agggagggcagguaggggaaaa

SEQ ID NO: 13866 - RNA, 22 nt, Homo sapiens
ccuccauggcuccaagaaaaac

SEQ ID NO: 13867 - RNA, 18 nt, Homo sapiens
ucuuauggggccaggggg

SEQ ID NO: 13868 - RNA, 22 nt, Homo sapiens
ggugcggccaagcagggaguca

SEQ ID NO: 13869 - RNA, 22 nt, Homo sapiens
ucacuccccgcuccgugccuag

SEQ ID NO: 13870 - RNA, 22 nt, Homo sapiens
ucuuuccccugggacguuuucu

SEQ ID NO: 13871 - RNA, 22 nt, Homo sapiens
aagcguccccgugagaggcccg

SEQ ID NO: 13872 - RNA, 22 nt, Homo sapiens
ugggagggggaaccgugggccc

SEQ ID NO: 13873 - RNA, 21 nt, Homo sapiens
ggccucaguuuccccaccugc

SEQ ID NO: 13874 - RNA, 22 nt, Homo sapiens
agggaagacuucguuagagagu

SEQ ID NO: 13875 - RNA, 19 nt, Homo sapiens
uccuuuaugaagucucccu

SEQ ID NO: 13876 - RNA, 22 nt, Homo sapiens
aguguacuguauauuuuaggca

SEQ ID NO: 13877 - RNA, 22 nt, Homo sapiens
ggcugguuuguauacagcacac

SEQ ID NO: 13878 - RNA, 22 nt, Homo sapiens
uucugguucacuagacugacac

SEQ ID NO: 13879 - RNA, 22 nt, Homo sapiens
uggaagguuagugguccagaaa

SEQ ID NO: 13880 - RNA, 22 nt, Homo sapiens
agaguuuuaucauacguggaua

SEQ ID NO: 13881 - RNA, 22 nt, Homo sapiens
uauccauguaugauacaacuca

SEQ ID NO: 13882 - RNA, 22 nt, Homo sapiens
uccauggacacgagagccccug

SEQ ID NO: 13883 - RNA, 22 nt, Homo sapiens
aggcugcugguguccaggggaa

SEQ ID NO: 13884 - RNA, 22 nt, Homo sapiens
ucauacuggauaucuuuccaca

SEQ ID NO: 13885 - RNA, 21 nt, Homo sapiens
uggggaaguguccagagugau

SEQ ID NO: 13886 - RNA, 22 nt, Homo sapiens
uuauggugccucuuuaaauguc

SEQ ID NO: 13887 - RNA, 22 nt, Homo sapiens
cguuuugggggcaucaucagac

SEQ ID NO: 13888 - RNA, 22 nt, Homo sapiens
aguggcuuggcugcacuacagg

SEQ ID NO: 13889 - RNA, 22 nt, Homo sapiens
uguggccuguggucaagucaga

SEQ ID NO: 13890 - RNA, 22 nt, Homo sapiens
aggguuuuguguuugcuggugc

SEQ ID NO: 13891 - RNA, 22 nt, Homo sapiens
ucaggcagacacaggacucacg

SEQ ID NO: 13892 - RNA, 22 nt, Homo sapiens
ucacuacuuaaucuaauuaguu

SEQ ID NO: 13893 - RNA, 22 nt, Homo sapiens
agagcuuaauuagauuaagcug

SEQ ID NO: 13894 - RNA, 22 nt, Homo sapiens
aaggcucugcacagcccccaga

SEQ ID NO: 13895 - RNA, 22 nt, Homo sapiens
uaggggcucccuuggguccuuc

SEQ ID NO: 13896 - RNA, 22 nt, Homo sapiens
auuggugagucacaauauauua

SEQ ID NO: 13897 - RNA, 22 nt, Homo sapiens
auuugugacucaugaagcuaaa

SEQ ID NO: 13898 - RNA, 22 nt, Homo sapiens
ugggaaagagaaagaacaagua

SEQ ID NO: 13899 - RNA, 18 nt, Homo sapiens
uguucugucuuucuccca

SEQ ID NO: 13900 - RNA, 22 nt, Homo sapiens
cacagaauagcacaauuuacaa

SEQ ID NO: 13901 - RNA, 22 nt, Homo sapiens
uaaauuggcuacuucuguuugg

SEQ ID NO: 13902 - RNA, 22 nt, Homo sapiens
aaggcccgaucgcaggcacucc

SEQ ID NO: 13903 - RNA, 22 nt, Homo sapiens
gagguggcuggauuuuggccua

SEQ ID NO: 13904 - RNA, 22 nt, Homo sapiens
gacuuccuggugccacagcuca

SEQ ID NO: 13905 - RNA, 22 nt, Homo sapiens
agagccaggcgugaggauuccc

SEQ ID NO: 13906 - RNA, 22 nt, Homo sapiens
cccaagagagcgaagguuggca

SEQ ID NO: 13907 - RNA, 21 nt, Homo sapiens
uuccacuuugcuucucugggu

SEQ ID NO: 13908 - RNA, 22 nt, Homo sapiens
aaaugagguugcaggggaaggg

SEQ ID NO: 13909 - RNA, 22 nt, Homo sapiens
cuccccccugcaaaacguugcu

SEQ ID NO: 13910 - RNA, 22 nt, Homo sapiens
acauauggcuaauaaccuauug

SEQ ID NO: 13911 - RNA, 22 nt, Homo sapiens
aauggguaauaaaagccauuua

SEQ ID NO: 13912 - RNA, 22 nt, Homo sapiens
aggcaaaacuugguugucagua

SEQ ID NO: 13913 - RNA, 22 nt, Homo sapiens
uuggcaaucagcauguuuaguc

SEQ ID NO: 13914 - RNA, 22 nt, Homo sapiens
uaguaucccaguuugcagccaa

SEQ ID NO: 13915 - RNA, 22 nt, Homo sapiens
cugcaaacugggacacuauuca

SEQ ID NO: 13916 - RNA, 22 nt, Homo sapiens
uccaucuugggauuccugaugu

SEQ ID NO: 13917 - RNA, 22 nt, Homo sapiens
uaugggggguccugggaggaga

SEQ ID NO: 13918 - RNA, 22 nt, Homo sapiens
ugggaggacagagggaggaagu

SEQ ID NO: 13919 - RNA, 22 nt, Homo sapiens
uuccccuucuuucugccccacc

SEQ ID NO: 13920 - RNA, 22 nt, Homo sapiens
uagauggcuuugaaugugugag

SEQ ID NO: 13921 - RNA, 22 nt, Homo sapiens
ucauuugccaaggccuccuaac

SEQ ID NO: 13922 - RNA, 22 nt, Homo sapiens
aguagauaagucaaggucugaa

SEQ ID NO: 13923 - RNA, 21 nt, Homo sapiens
agaccuuaaaauaucaacuga

SEQ ID NO: 13924 - RNA, 22 nt, Homo sapiens
aguagauaagucaaggucugaa

SEQ ID NO: 13925 - RNA, 21 nt, Homo sapiens
agaccuuaaaauaucaacuga

SEQ ID NO: 13926 - RNA, 22 nt, Homo sapiens
aguagauaagucaaggucugaa

SEQ ID NO: 13927 - RNA, 21 nt, Homo sapiens
agaccuuaaaauaucaacuga

SEQ ID NO: 13928 - RNA, 22 nt, Homo sapiens
gagaggggcgggaggagagcgg

SEQ ID NO: 13929 - RNA, 21 nt, Homo sapiens
gcucucuucccccucccucuu

SEQ ID NO: 13930 - RNA, 22 nt, Homo sapiens
uaaucucagagaaaggauagaa

SEQ ID NO: 13931 - RNA, 22 nt, Homo sapiens
uaucuuuucucugagagcaagg

SEQ ID NO: 13932 - RNA, 22 nt, Homo sapiens
uaacggugucuagaggaaggga

SEQ ID NO: 13933 - RNA, 22 nt, Homo sapiens
ucuuuugcucugaggcuguaca

SEQ ID NO: 13934 - RNA, 22 nt, Homo sapiens
accuuggacagaccugccaagu

SEQ ID NO: 13935 - RNA, 22 nt, Homo sapiens
cuuggcagguguugggaggccu

SEQ ID NO: 13936 - RNA, 22 nt, Homo sapiens
uggucuaucauuugggugggga

SEQ ID NO: 13937 - RNA, 22 nt, Homo sapiens
ggucccaaucugaggagacugg

SEQ ID NO: 13938 - RNA, 22 nt, Homo sapiens
uauuuguugaguaaaugaauca

SEQ ID NO: 13939 - RNA, 22 nt, Homo sapiens
ucauucauucaucaaauauuca

SEQ ID NO: 13940 - RNA, 22 nt, Homo sapiens
uccaaacgugcuguuuccacau

SEQ ID NO: 13941 - RNA, 22 nt, Homo sapiens
gagggacagcacuguugggaga

SEQ ID NO: 13942 - RNA, 22 nt, Homo sapiens
uuauagauagaugccauuguac

SEQ ID NO: 13943 - RNA, 22 nt, Homo sapiens
uacaaugccaucuaucuuuaag

SEQ ID NO: 13944 - RNA, 22 nt, Homo sapiens
uaaauuccuggcauuucugcuu

SEQ ID NO: 13945 - RNA, 22 nt, Homo sapiens
cugaaacugcaggaauucauga

SEQ ID NO: 13946 - RNA, 22 nt, Homo sapiens
ugugggaggaaggagccuggga

SEQ ID NO: 13947 - RNA, 22 nt, Homo sapiens
uggggcuucuauuccccugcgc

SEQ ID NO: 13948 - RNA, 22 nt, Homo sapiens
caaagaaauaucauggcaucag

SEQ ID NO: 13949 - RNA, 22 nt, Homo sapiens
uggaugucaggauaucucugug

SEQ ID NO: 13950 - RNA, 22 nt, Homo sapiens
agucccuuuaacucacagcccc

SEQ ID NO: 13951 - RNA, 22 nt, Homo sapiens
gcugggaguugggggauauuca

SEQ ID NO: 13952 - RNA, 22 nt, Homo sapiens
uucuuuuaggaaaagauuugua

SEQ ID NO: 13953 - RNA, 22 nt, Homo sapiens
aguguuuuucuacaagaagaga

SEQ ID NO: 13954 - RNA, 22 nt, Homo sapiens
agaggccaggacuggacucaga

SEQ ID NO: 13955 - RNA, 22 nt, Homo sapiens
gacucugaagguccugccccug

SEQ ID NO: 13956 - RNA, 22 nt, Homo sapiens
agaggccaggacuggacucaga

SEQ ID NO: 13957 - RNA, 22 nt, Homo sapiens
gacucugaagguccugccccug

SEQ ID NO: 13958 - RNA, 22 nt, Homo sapiens
uugaccugagagguaaauauug

SEQ ID NO: 13959 - RNA, 22 nt, Homo sapiens
ucaauauuugccucaaagaaua

SEQ ID NO: 13960 - RNA, 22 nt, Homo sapiens
cgugggggugagcucugaggac

SEQ ID NO: 13961 - RNA, 22 nt, Homo sapiens
uccucagagagcaccacccugu

SEQ ID NO: 13962 - RNA, 22 nt, Homo sapiens
uucaaccccauccuccaccccu

SEQ ID NO: 13963 - RNA, 19 nt, Homo sapiens
agggguggggagggugagg

SEQ ID NO: 13964 - RNA, 22 nt, Homo sapiens
ucagggauuuggccaaagucag

SEQ ID NO: 13965 - RNA, 22 nt, Homo sapiens
ucugacuuuggcaaguucuuca

SEQ ID NO: 13966 - RNA, 22 nt, Homo sapiens
uuucucugagggacagaguggu

SEQ ID NO: 13967 - RNA, 22 nt, Homo sapiens
caacaucuguucuuucagaagu

SEQ ID NO: 13968 - RNA, 22 nt, Homo sapiens
agcagaggauggcaguuccaca

SEQ ID NO: 13969 - RNA, 22 nt, Homo sapiens
ugugggauugauguaaugcuua

SEQ ID NO: 13970 - RNA, 22 nt, Homo sapiens
uggcaggcagugcccugggcaa

SEQ ID NO: 13971 - RNA, 22 nt, Homo sapiens
ccccugggcgcucacuucagcu

SEQ ID NO: 13972 - RNA, 22 nt, Homo sapiens
ugacugaguuugugaagggcug

SEQ ID NO: 13973 - RNA, 22 nt, Homo sapiens
ucuuucugcauuaucagucaug

SEQ ID NO: 13974 - RNA, 22 nt, Homo sapiens
ugagccccaggcuucaguugag

SEQ ID NO: 13975 - RNA, 22 nt, Homo sapiens
uaguccaagccuggauuucagu

SEQ ID NO: 13976 - RNA, 22 nt, Homo sapiens
aauaauugauuaggggucaccg

SEQ ID NO: 13977 - RNA, 22 nt, Homo sapiens
uggagagucacuaguuagugcu

SEQ ID NO: 13978 - RNA, 22 nt, Homo sapiens
ugagcaugcacgauggggcucg

SEQ ID NO: 13979 - RNA, 22 nt, Homo sapiens
caagagccucggcguccucgcc

SEQ ID NO: 13980 - RNA, 22 nt, Homo sapiens
gaguuauaaccuaguuuaacug

SEQ ID NO: 13981 - RNA, 20 nt, Homo sapiens
guuaaacuaggcuacaacuc

SEQ ID NO: 13982 - RNA, 22 nt, Homo sapiens
aucuccaucacccggcuccccu

SEQ ID NO: 13983 - RNA, 22 nt, Homo sapiens
aaugggguggugcauggagagg

SEQ ID NO: 13984 - RNA, 22 nt, Homo sapiens
agagaggcaccgcccucagccc

SEQ ID NO: 13985 - RNA, 22 nt, Homo sapiens
cucacaguggcuggcugccccu

SEQ ID NO: 13986 - RNA, 22 nt, Homo sapiens
ccugcccacccccagccuuguc

SEQ ID NO: 13987 - RNA, 22 nt, Homo sapiens
uuaggucugagggguggggaga

SEQ ID NO: 13988 - RNA, 22 nt, Homo sapiens
ugccccaucccuuaggcugugg

SEQ ID NO: 13989 - RNA, 22 nt, Homo sapiens
ucaguagugagagaaggggcau

SEQ ID NO: 13990 - RNA, 22 nt, Homo sapiens
ccuauuccuaaaugugcuccag

SEQ ID NO: 13991 - RNA, 22 nt, Homo sapiens
uggagcacauauaagaauaggg

SEQ ID NO: 13992 - RNA, 22 nt, Homo sapiens
agaccugucuauaaaagugaau

SEQ ID NO: 13993 - RNA, 22 nt, Homo sapiens
ucacuuuuauagauaggucugg

SEQ ID NO: 13994 - RNA, 22 nt, Homo sapiens
uugaccuccccuagaccuggcu

SEQ ID NO: 13995 - RNA, 22 nt, Homo sapiens
cuugagucugggaggucagagg

SEQ ID NO: 13996 - RNA, 22 nt, Homo sapiens
ggguuugugguucuucugcgcc

SEQ ID NO: 13997 - RNA, 22 nt, Homo sapiens
cucggaucuaggacuauacauc

SEQ ID NO: 13998 - RNA, 22 nt, Homo sapiens
cacuguucaguccuuuucaagu

SEQ ID NO: 13999 - RNA, 22 nt, Homo sapiens
uugccaaggacuggccaguggg

SEQ ID NO: 14000 - RNA, 22 nt, Homo sapiens
aacgauuugcagcuagagcaaa

SEQ ID NO: 14001 - RNA, 21 nt, Homo sapiens
uuacuggcugcaaagacguuu

SEQ ID NO: 14002 - RNA, 22 nt, Homo sapiens
uccaauguguuaaugagcaaug

SEQ ID NO: 14003 - RNA, 22 nt, Homo sapiens
cccugguaauugacacacaugg

SEQ ID NO: 14004 - RNA, 22 nt, Homo sapiens
acauaagagauauguuaaacua

SEQ ID NO: 14005 - RNA, 22 nt, Homo sapiens
uggcaagcaauuuucuuaugca

SEQ ID NO: 14006 - RNA, 22 nt, Homo sapiens
aggggagggggucuuuggggag

SEQ ID NO: 14007 - RNA, 21 nt, Homo sapiens
cagaaucggccccucgccccu

SEQ ID NO: 14008 - RNA, 22 nt, Homo sapiens
uaucuaaguuaggauaacuguc

SEQ ID NO: 14009 - RNA, 22 nt, Homo sapiens
aucaguuagauagcuugaugug

SEQ ID NO: 14010 - RNA, 22 nt, Homo sapiens
ggcugacucugugcugucacag

SEQ ID NO: 14011 - RNA, 21 nt, Homo sapiens
uguugcagcuggagcacaguc

SEQ ID NO: 14012 - RNA, 22 nt, Homo sapiens
gggguggcgagggagggguugu

SEQ ID NO: 14013 - RNA, 22 nt, Homo sapiens
cuuccccuccuucccuuucccc

SEQ ID NO: 14014 - RNA, 22 nt, Homo sapiens
uggugcggcagguuuuucaugc

SEQ ID NO: 14015 - RNA, 22 nt, Homo sapiens
ugaaaagugucugcugcauuuc

SEQ ID NO: 14016 - RNA, 22 nt, Homo sapiens
gagcaagcagaagagauggaga

SEQ ID NO: 14017 - RNA, 19 nt, Homo sapiens
uccauuuccugugaugcuc

SEQ ID NO: 14018 - RNA, 22 nt, Homo sapiens
aaaugguuuccuuggugucaaa

SEQ ID NO: 14019 - RNA, 22 nt, Homo sapiens
uuucgacauuaggaaaaugagu

SEQ ID NO: 14020 - RNA, 22 nt, Homo sapiens
cccccuuuuuaacucauguugu

SEQ ID NO: 14021 - RNA, 22 nt, Homo sapiens
uugcaugaauuaaagauggggu

SEQ ID NO: 14022 - RNA, 22 nt, Homo sapiens
ggcaccugccgccuuuucuguu

SEQ ID NO: 14023 - RNA, 22 nt, Homo sapiens
gguggauggggguagugugugg

SEQ ID NO: 14024 - RNA, 22 nt, Homo sapiens
caaggcgccgggccagcuucac

SEQ ID NO: 14025 - RNA, 22 nt, Homo sapiens
ugggcuggcccggccuuugcug

SEQ ID NO: 14026 - RNA, 22 nt, Homo sapiens
ggaccccuuccaggggguuaaa

SEQ ID NO: 14027 - RNA, 22 nt, Homo sapiens
uaauuuccuggagggagucccg

SEQ ID NO: 14028 - RNA, 22 nt, Homo sapiens
ggaccccuuccaggggguuaaa

SEQ ID NO: 14029 - RNA, 22 nt, Homo sapiens
uaauuuccuggagggagucccg

SEQ ID NO: 14030 - RNA, 22 nt, Homo sapiens
uuauucucgauuaucugauaaa

SEQ ID NO: 14031 - RNA, 22 nt, Homo sapiens
uaucaugugauugugauuaaaa

SEQ ID NO: 14032 - RNA, 22 nt, Homo sapiens
aggcccauuagauccuggccau

SEQ ID NO: 14033 - RNA, 22 nt, Homo sapiens
ucguggccaggaucuaggguuu

SEQ ID NO: 14034 - RNA, 22 nt, Homo sapiens
aggcccauuggauccuggccau

SEQ ID NO: 14035 - RNA, 22 nt, Homo sapiens
ucauggccaggaucuaggguuu

SEQ ID NO: 14036 - RNA, 17 nt, Homo sapiens
aggcaacuuuuguaguc

SEQ ID NO: 14037 - RNA, 22 nt, Homo sapiens
cagaaaauugggaggcuggagc

SEQ ID NO: 14038 - RNA, 22 nt, Homo sapiens
ggucuugccuuugauuguugau

SEQ ID NO: 14039 - RNA, 22 nt, Homo sapiens
ugcuaaugacgucugugguaaa

SEQ ID NO: 14040 - RNA, 22 nt, Homo sapiens
uaaucacaggcucaugauaagc

SEQ ID NO: 14041 - RNA, 22 nt, Homo sapiens
ucucaucugugaaaaagaacug

SEQ ID NO: 14042 - RNA, 22 nt, Homo sapiens
agucuauuuucaaagugagagg

SEQ ID NO: 14043 - RNA, 22 nt, Homo sapiens
ccuggggugggggcagagagau

SEQ ID NO: 14044 - RNA, 22 nt, Homo sapiens
uguuucugcagagcuggccugg

SEQ ID NO: 14045 - RNA, 22 nt, Homo sapiens
ccaccgucucugcacagaccuc

SEQ ID NO: 14046 - RNA, 22 nt, Homo sapiens
ggucugcagaggugggugaggg

SEQ ID NO: 14047 - RNA, 22 nt, Homo sapiens
aguguggggggcccaaggcugc

SEQ ID NO: 14048 - RNA, 22 nt, Homo sapiens
acguagccccccccagaccggc

SEQ ID NO: 14049 - RNA, 22 nt, Homo sapiens
ucaccacugugcuauagcucca

SEQ ID NO: 14050 - RNA, 22 nt, Homo sapiens
gaguaacugcugauggugagca

SEQ ID NO: 14051 - RNA, 22 nt, Homo sapiens
uagaaagaggguaugaguaaua

SEQ ID NO: 14052 - RNA, 20 nt, Homo sapiens
uagucauauccuugcucugc

SEQ ID NO: 14053 - RNA, 22 nt, Homo sapiens
uuauucaggcugugucagcagc

SEQ ID NO: 14054 - RNA, 22 nt, Homo sapiens
ugcugauacaccccaaaauaaa

SEQ ID NO: 14055 - RNA, 22 nt, Homo sapiens
ucggcucccugauggggcacag

SEQ ID NO: 14056 - RNA, 22 nt, Homo sapiens
gugccuccugcaggcggggcgg

SEQ ID NO: 14057 - RNA, 22 nt, Homo sapiens
aaugcugggagccaucuugaau

SEQ ID NO: 14058 - RNA, 22 nt, Homo sapiens
caaaauggcauucagcaaccuu

SEQ ID NO: 14059 - RNA, 22 nt, Homo sapiens
ugggcuuguugacugggcugga

SEQ ID NO: 14060 - RNA, 22 nt, Homo sapiens
uuggccuaguuggagcccccgg

SEQ ID NO: 14061 - RNA, 22 nt, Homo sapiens
aaggggugggggggagggguug

SEQ ID NO: 14062 - RNA, 22 nt, Homo sapiens
cuuccccuccuuccccuucucc

SEQ ID NO: 14063 - RNA, 22 nt, Homo sapiens
uauccacuacaccccgcugccu

SEQ ID NO: 14064 - RNA, 22 nt, Homo sapiens
caggguaguguaauggagagag

SEQ ID NO: 14065 - RNA, 22 nt, Homo sapiens
gcaagagcaggagcaggagucc

SEQ ID NO: 14066 - RNA, 22 nt, Homo sapiens
ggcucacugguuuucucuuauu

SEQ ID NO: 14067 - RNA, 22 nt, Homo sapiens
ucuacagaaacagcggcagguu

SEQ ID NO: 14068 - RNA, 22 nt, Homo sapiens
ccugcugcaugcucugugugau

SEQ ID NO: 14069 - RNA, 22 nt, Homo sapiens
uauaaucaggagaagagagugu

SEQ ID NO: 14070 - RNA, 22 nt, Homo sapiens
auucuccuuuccugagaacaau

SEQ ID NO: 14071 - RNA, 22 nt, Homo sapiens
uccgcggcuccgagggugcccg

SEQ ID NO: 14072 - RNA, 22 nt, Homo sapiens
ccgccccaggggcugcagggaa

SEQ ID NO: 14073 - RNA, 22 nt, Homo sapiens
uauuauuucgguuagggcuuuc

SEQ ID NO: 14074 - RNA, 22 nt, Homo sapiens
auauaaagucuuaaagaaaugg

SEQ ID NO: 14075 - RNA, 22 nt, Homo sapiens
uaaccucaagcuauggaaaaaa

SEQ ID NO: 14076 - RNA, 22 nt, Homo sapiens
uuuucauagccugaggaaggcc

SEQ ID NO: 14077 - RNA, 22 nt, Homo sapiens
agcacugaacgcagcauucuug

SEQ ID NO: 14078 - RNA, 22 nt, Homo sapiens
acugggugcugcguuucugugc

SEQ ID NO: 14079 - RNA, 22 nt, Homo sapiens
gggaagggcaagcagucuuuuc

SEQ ID NO: 14080 - RNA, 22 nt, Homo sapiens
gggggcugccccccgcccccca

SEQ ID NO: 14081 - RNA, 22 nt, Homo sapiens
ucucugucauucuaggcaagaa

SEQ ID NO: 14082 - RNA, 22 nt, Homo sapiens
ucuuggcugggguagagauaac

SEQ ID NO: 14083 - RNA, 22 nt, Homo sapiens
aaguuugcaaaggcagggaaga

SEQ ID NO: 14084 - RNA, 22 nt, Homo sapiens
ucccaaucuuagagaacuuccu

SEQ ID NO: 14085 - RNA, 22 nt, Homo sapiens
ucucucugcuggucuuuucccc

SEQ ID NO: 14086 - RNA, 22 nt, Homo sapiens
aagagaccagauuggaaggucu

SEQ ID NO: 14087 - RNA, 22 nt, Homo sapiens
uagugacaagaaugacuggaaa

SEQ ID NO: 14088 - RNA, 22 nt, Homo sapiens
uuucugucauugauuuuacuga

SEQ ID NO: 14089 - RNA, 22 nt, Homo sapiens
gaaagcaagccauucacuguca

SEQ ID NO: 14090 - RNA, 22 nt, Homo sapiens
acagggaauggcuuugcuuuau

SEQ ID NO: 14091 - RNA, 22 nt, Homo sapiens
gaggcagucugggcccugccca

SEQ ID NO: 14092 - RNA, 22 nt, Homo sapiens
gauagagcugggucugucugcc

SEQ ID NO: 14093 - RNA, 22 nt, Homo sapiens
ucaaaaaaaaugaugcaggcau

SEQ ID NO: 14094 - RNA, 22 nt, Homo sapiens
uggugcuuccauuguuuuaggu

SEQ ID NO: 14095 - RNA, 22 nt, Homo sapiens
uaaaauguuuccuaccauuuuu

SEQ ID NO: 14096 - RNA, 22 nt, Homo sapiens
guuugaaaugguggggagaggg

SEQ ID NO: 14097 - RNA, 22 nt, Homo sapiens
caagaguaagaagggaaaggaa

SEQ ID NO: 14098 - RNA, 22 nt, Homo sapiens
cugauucccagucaugcucucu

SEQ ID NO: 14099 - RNA, 17 nt, Homo sapiens
aaagcauaggugguuca

SEQ ID NO: 14100 - RNA, 22 nt, Homo sapiens
uuugaaacuugacagaugugug

SEQ ID NO: 14101 - RNA, 20 nt, Homo sapiens
cacaucugucaaauguuaaa

SEQ ID NO: 14102 - RNA, 22 nt, Homo sapiens
ugugcucuuuauccucaucugg

SEQ ID NO: 14103 - RNA, 22 nt, Homo sapiens
aggugggggugagaaaacagac

SEQ ID NO: 14104 - RNA, 22 nt, Homo sapiens
ucaucucuccacccaagcuggg

SEQ ID NO: 14105 - RNA, 22 nt, Homo sapiens
uggcuuggcaggaggaagaccu

SEQ ID NO: 14106 - RNA, 22 nt, Homo sapiens
uccaucucaauuuauuccuaga

SEQ ID NO: 14107 - RNA, 22 nt, Homo sapiens
uaggaauaaauugagguggauc

SEQ ID NO: 14108 - RNA, 22 nt, Homo sapiens
uggcuuucugguuuauggagca

SEQ ID NO: 14109 - RNA, 22 nt, Homo sapiens
ucguucucaugggccagaguca

SEQ ID NO: 14110 - RNA, 22 nt, Homo sapiens
cccuaggguggcccauaggaug

SEQ ID NO: 14111 - RNA, 22 nt, Homo sapiens
uccugaucugggcugcccgggg

SEQ ID NO: 14112 - RNA, 22 nt, Homo sapiens
aacugcagaugugaaauaggcu

SEQ ID NO: 14113 - RNA, 22 nt, Homo sapiens
uuuguuucucuucuguagugcu

SEQ ID NO: 14114 - RNA, 22 nt, Homo sapiens
aggugacaugaucucuugggug

SEQ ID NO: 14115 - RNA, 22 nt, Homo sapiens
acucaagauuucugucugccga

SEQ ID NO: 14116 - RNA, 22 nt, Homo sapiens
aggugugcaguaaauauuuguu

SEQ ID NO: 14117 - RNA, 22 nt, Homo sapiens
aaaugucuauugagcacccacu

SEQ ID NO: 14118 - RNA, 22 nt, Homo sapiens
acuccaaugauuuuaaaucacu

SEQ ID NO: 14119 - RNA, 22 nt, Homo sapiens
gcaauuuaaaauuacuggagug

SEQ ID NO: 14120 - RNA, 22 nt, Homo sapiens
cgagacauucuuaggaacaaug

SEQ ID NO: 14121 - RNA, 22 nt, Homo sapiens
uguuacauaaaagaaugucucu

SEQ ID NO: 14122 - RNA, 22 nt, Homo sapiens
ugccuucccccaggaauugcuc

SEQ ID NO: 14123 - RNA, 22 nt, Homo sapiens
guaauuacugggcuaggggcug

SEQ ID NO: 14124 - RNA, 22 nt, Homo sapiens
gggagccaggaaguauugaugu

SEQ ID NO: 14125 - RNA, 21 nt, Homo sapiens
gucaacacuugcugguuuccu

SEQ ID NO: 14126 - RNA, 22 nt, Homo sapiens
gucaacacuugcugguuuccuc

SEQ ID NO: 14127 - RNA, 22 nt, Homo sapiens
ucaacacuugcugguuuccucu

SEQ ID NO: 14128 - RNA, 22 nt, Homo sapiens
acagcaggugcuugggaaaggc

SEQ ID NO: 14129 - RNA, 22 nt, Homo sapiens
cuuucccaagccuugcuucccu

SEQ ID NO: 14130 - RNA, 22 nt, Homo sapiens
ugaaaggguugagaauagacuu

SEQ ID NO: 14131 - RNA, 22 nt, Homo sapiens
ucuaguucuuagacuucuuguc

SEQ ID NO: 14132 - RNA, 22 nt, Homo sapiens
uaaauuauuuacagugugcucg

SEQ ID NO: 14133 - RNA, 22 nt, Homo sapiens
uuguaagguaaauaauuuauaa

SEQ ID NO: 14134 - RNA, 22 nt, Homo sapiens
ggaacuucuaggaggcauggaa

SEQ ID NO: 14135 - RNA, 22 nt, Homo sapiens
cauuucuccuggaaggcuugag

SEQ ID NO: 14136 - RNA, 22 nt, Homo sapiens
agagguuuugguaaccauugca

SEQ ID NO: 14137 - RNA, 22 nt, Homo sapiens
uggaaguuauggugaccucugu

SEQ ID NO: 14138 - RNA, 22 nt, Homo sapiens
uuuaggguguggcaucugccau

SEQ ID NO: 14139 - RNA, 22 nt, Homo sapiens
gcaugugucgccuuuuauagca

SEQ ID NO: 14140 - RNA, 22 nt, Homo sapiens
uuguucaugucaccucuuuccc

SEQ ID NO: 14141 - RNA, 22 nt, Homo sapiens
agagaacugaaauggccagcca

SEQ ID NO: 14142 - RNA, 22 nt, Homo sapiens
ccuccccucccagccccacccc

SEQ ID NO: 14143 - RNA, 22 nt, Homo sapiens
agcuggggcuggaggggggcca

SEQ ID NO: 14144 - RNA, 22 nt, Homo sapiens
ugauaugcgguguguuucuucu

SEQ ID NO: 14145 - RNA, 22 nt, Homo sapiens
ugagaagcaaagaacugcacuu

SEQ ID NO: 14146 - RNA, 22 nt, Homo sapiens
uuugaaaggugcuuagaacauu

SEQ ID NO: 14147 - RNA, 22 nt, Homo sapiens
cuauguaagcacuuguuuaauu

SEQ ID NO: 14148 - RNA, 22 nt, Homo sapiens
uaggaggagggaggggcgacau

SEQ ID NO: 14149 - RNA, 22 nt, Homo sapiens
gucucucuuuccuccucaggaa

SEQ ID NO: 14150 - RNA, 22 nt, Homo sapiens
uaggaggagggaggggcgacau

SEQ ID NO: 14151 - RNA, 22 nt, Homo sapiens
gucucucuuuccuccucaggaa

SEQ ID NO: 14152 - RNA, 22 nt, Homo sapiens
uggggcuucuggugaguugagc

SEQ ID NO: 14153 - RNA, 22 nt, Homo sapiens
uuaugaugucaccagaaccccu

SEQ ID NO: 14154 - RNA, 22 nt, Homo sapiens
agguaugaaggugcaucagccu

SEQ ID NO: 14155 - RNA, 22 nt, Homo sapiens
ugggugagcacuuucaugcacu

SEQ ID NO: 14156 - RNA, 22 nt, Homo sapiens
ugcucaggccuuguggcugcug

SEQ ID NO: 14157 - RNA, 22 nt, Homo sapiens
aagagaagcaaggcucugaauu

SEQ ID NO: 14158 - RNA, 22 nt, Homo sapiens
ggcugcuguugguuguaacguu

SEQ ID NO: 14159 - RNA, 22 nt, Homo sapiens
cuugcugcuguacagcagcuca

SEQ ID NO: 14160 - RNA, 22 nt, Homo sapiens
uaggaggagagaagggcgacau

SEQ ID NO: 14161 - RNA, 22 nt, Homo sapiens
gucucucuuuccuccucaggaa

SEQ ID NO: 14162 - RNA, 22 nt, Homo sapiens
uucccuccccuucccucagcug

SEQ ID NO: 14163 - RNA, 22 nt, Homo sapiens
cagagggaggaauggagugggg

SEQ ID NO: 14164 - RNA, 22 nt, Homo sapiens
agaccaguuggagugguggacu

SEQ ID NO: 14165 - RNA, 22 nt, Homo sapiens
ucuacccccuuuucuggugacc

SEQ ID NO: 14166 - RNA, 22 nt, Homo sapiens
ccgucagggucaggccucucgg

SEQ ID NO: 14167 - RNA, 19 nt, Homo sapiens
ugaggggugagaccgaugg

SEQ ID NO: 14168 - RNA, 22 nt, Homo sapiens
uauuguguuuuugauggagugu

SEQ ID NO: 14169 - RNA, 22 nt, Homo sapiens
uccauucaaaaacacaaugcca

SEQ ID NO: 14170 - RNA, 22 nt, Homo sapiens
uccaggguccaggguccacaug

SEQ ID NO: 14171 - RNA, 22 nt, Homo sapiens
auguggacuuugcaucagggcc

SEQ ID NO: 14172 - RNA, 22 nt, Homo sapiens
aaaguacauaaauucuuucaaa

SEQ ID NO: 14173 - RNA, 22 nt, Homo sapiens
aaaggauuuauauacuucccua

SEQ ID NO: 14174 - RNA, 22 nt, Homo sapiens
gguccacucccaucuguuuucu

SEQ ID NO: 14175 - RNA, 22 nt, Homo sapiens
gagugcaggcugguggaauucg

SEQ ID NO: 14176 - RNA, 22 nt, Homo sapiens
ucaacuuucuuccucccccacu

SEQ ID NO: 14177 - RNA, 22 nt, Homo sapiens
ugggaggagguaggaaagcuaa

SEQ ID NO: 14178 - RNA, 22 nt, Homo sapiens
ccacaggugagugcugcugggg

SEQ ID NO: 14179 - RNA, 22 nt, Homo sapiens
cugaagggguucucccuguggg

SEQ ID NO: 14180 - RNA, 22 nt, Homo sapiens
aggguuuugucuguauuguuug

SEQ ID NO: 14181 - RNA, 22 nt, Homo sapiens
acagugccaggcagaugccagg

SEQ ID NO: 14182 - RNA, 22 nt, Homo sapiens
aguagagucagcagucaaacug

SEQ ID NO: 14183 - RNA, 22 nt, Homo sapiens
gugugcugcagauucuacugaa

SEQ ID NO: 14184 - RNA, 22 nt, Homo sapiens
gaggaaguggagaagauucagu

SEQ ID NO: 14185 - RNA, 22 nt, Homo sapiens
uguucucuuuucccuuuuacag

SEQ ID NO: 14186 - RNA, 22 nt, Homo sapiens
aggucccuggagguauugucag

SEQ ID NO: 14187 - RNA, 22 nt, Homo sapiens
aacauugcuuccagggauccug

SEQ ID NO: 14188 - RNA, 22 nt, Homo sapiens
uaggccauugguaauaauggug

SEQ ID NO: 14189 - RNA, 22 nt, Homo sapiens
uauuauuaauaccaauagccca

SEQ ID NO: 14190 - RNA, 22 nt, Homo sapiens
gguaggugagugaggguggggu

SEQ ID NO: 14191 - RNA, 22 nt, Homo sapiens
cccaucuucccugccuguccca

SEQ ID NO: 14192 - RNA, 22 nt, Homo sapiens
uccaggcagcauaauaaauaac

SEQ ID NO: 14193 - RNA, 22 nt, Homo sapiens
ggaguuuauuagagacugaugg

SEQ ID NO: 14194 - RNA, 22 nt, Homo sapiens
agccaguuccaagguccacagg

SEQ ID NO: 14195 - RNA, 20 nt, Homo sapiens
cugugggcuugggugggcug

SEQ ID NO: 14196 - RNA, 22 nt, Homo sapiens
uccaagacugaaaucaagguca

SEQ ID NO: 14197 - RNA, 22 nt, Homo sapiens
ccuugauuucacacuugggcua

SEQ ID NO: 14198 - RNA, 22 nt, Homo sapiens
agacuuuggcuucuugggcaaa

SEQ ID NO: 14199 - RNA, 22 nt, Homo sapiens
ugcucaagaagcugaagucugu

SEQ ID NO: 14200 - RNA, 22 nt, Homo sapiens
gaaugucaggcucugucaccuu

SEQ ID NO: 14201 - RNA, 22 nt, Homo sapiens
gugaaugggccugauugucuag

SEQ ID NO: 14202 - RNA, 22 nt, Homo sapiens
uugcuugaugauucauaguaag

SEQ ID NO: 14203 - RNA, 22 nt, Homo sapiens
uaaugugaguuaucuaaguaca

SEQ ID NO: 14204 - RNA, 22 nt, Homo sapiens
ugaacauucauuccaagguuag

SEQ ID NO: 14205 - RNA, 22 nt, Homo sapiens
ccugguuugggaaugguuccau

SEQ ID NO: 14206 - RNA, 22 nt, Homo sapiens
uagguggccuggagcuuugugg

SEQ ID NO: 14207 - RNA, 22 nt, Homo sapiens
cauggccuugggccgccuggag

SEQ ID NO: 14208 - RNA, 22 nt, Homo sapiens
ucacuuugaaaauagacuguuu

SEQ ID NO: 14209 - RNA, 22 nt, Homo sapiens
aguucuuuuucacagaugagau

SEQ ID NO: 14210 - RNA, 22 nt, Homo sapiens
uggagggagcccacauugggag

SEQ ID NO: 14211 - RNA, 22 nt, Homo sapiens
ucucccaaugaggccccgaagc

SEQ ID NO: 14212 - RNA, 22 nt, Homo sapiens
agcuucagagcacaucuguuca

SEQ ID NO: 14213 - RNA, 22 nt, Homo sapiens
ugaacacaaugugcucugugua

SEQ ID NO: 14214 - RNA, 22 nt, Homo sapiens
uuacauauguuuggcagaguuc

SEQ ID NO: 14215 - RNA, 21 nt, Homo sapiens
ugcacuugccagauaaguagc

SEQ ID NO: 14216 - RNA, 22 nt, Homo sapiens
uugugucaauaugcgaugaugu

SEQ ID NO: 14217 - RNA, 22 nt, Homo sapiens
uacccugcccuuuucacaagau

SEQ ID NO: 14218 - RNA, 22 nt, Homo sapiens
uuuguggggagagaggggggug

SEQ ID NO: 14219 - RNA, 22 nt, Homo sapiens
ugagccgaugcugcuccuuaau

SEQ ID NO: 14220 - RNA, 22 nt, Homo sapiens
cugggaggagcagccggcuggc

SEQ ID NO: 14221 - RNA, 22 nt, Homo sapiens
uuaggaaaaauaaaaggcagug

SEQ ID NO: 14222 - RNA, 22 nt, Homo sapiens
cucugccuuuugucccugacag

SEQ ID NO: 14223 - RNA, 22 nt, Homo sapiens
ugaauuugaggcgugggggugg

SEQ ID NO: 14224 - RNA, 22 nt, Homo sapiens
agacaucccagcuucuauuuau

SEQ ID NO: 14225 - RNA, 22 nt, Homo sapiens
uuugccauccuuaccuacagcc

SEQ ID NO: 14226 - RNA, 22 nt, Homo sapiens
gguuggaggucaguggcaaagu

SEQ ID NO: 14227 - RNA, 22 nt, Homo sapiens
ugagucacccaggugauaacau

SEQ ID NO: 14228 - RNA, 22 nt, Homo sapiens
uguuuuucuccuguaugacuca

SEQ ID NO: 14229 - RNA, 22 nt, Homo sapiens
uuggaagaucuuggcucuuuug

SEQ ID NO: 14230 - RNA, 22 nt, Homo sapiens
agagaacuaggaucaaccaaca

SEQ ID NO: 14231 - RNA, 22 nt, Homo sapiens
ccucauuaaauguuuguugaau

SEQ ID NO: 14232 - RNA, 22 nt, Homo sapiens
ucaacagacauuaauugggcgc

SEQ ID NO: 14233 - RNA, 22 nt, Homo sapiens
uggcugugaggguuuauaggau

SEQ ID NO: 14234 - RNA, 22 nt, Homo sapiens
uccuaacugaauacucacaguu

SEQ ID NO: 14235 - RNA, 22 nt, Homo sapiens
uuggcugaaugaacugcccccu

SEQ ID NO: 14236 - RNA, 22 nt, Homo sapiens
aguguguuuguucaugccagag

SEQ ID NO: 14237 - RNA, 22 nt, Homo sapiens
cggcacaucuuaauuguuacug

SEQ ID NO: 14238 - RNA, 22 nt, Homo sapiens
acugucgauuaugaugagucag

SEQ ID NO: 14239 - RNA, 22 nt, Homo sapiens
uuaugcugaccagcaaaaugcg

SEQ ID NO: 14240 - RNA, 22 nt, Homo sapiens
auggugcuguucagcauaacca

SEQ ID NO: 14241 - RNA, 22 nt, Homo sapiens
uccugaacaaacugugcaauaa

SEQ ID NO: 14242 - RNA, 22 nt, Homo sapiens
ugcagaguuuguucgggagaau

SEQ ID NO: 14243 - RNA, 22 nt, Homo sapiens
uaaucauauucuaguggugcua

SEQ ID NO: 14244 - RNA, 22 nt, Homo sapiens
agucccaaggaugugauuaucu

SEQ ID NO: 14245 - RNA, 22 nt, Homo sapiens
caugauuuauaaggcaggaggg

SEQ ID NO: 14246 - RNA, 22 nt, Homo sapiens
cucccuuguauaaaucauuuga

SEQ ID NO: 14247 - RNA, 22 nt, Homo sapiens
uuuuauggaagguguggggagc

SEQ ID NO: 14248 - RNA, 22 nt, Homo sapiens
ucccuacagccuccauaaaaac

SEQ ID NO: 14249 - RNA, 22 nt, Homo sapiens
uuuagcaacuagcuuuucuguu

SEQ ID NO: 14250 - RNA, 22 nt, Homo sapiens
uagaaaagcuacuggcuaaaaa

SEQ ID NO: 14251 - RNA, 22 nt, Homo sapiens
agccuuccaggagaaauggaga

SEQ ID NO: 14252 - RNA, 22 nt, Homo sapiens
uccaugccuccuagaaguuccg

SEQ ID NO: 14253 - RNA, 22 nt, Homo sapiens
gggcucuuccuucccugucaua

SEQ ID NO: 14254 - RNA, 21 nt, Homo sapiens
aacaacaggggaggaaagccc

SEQ ID NO: 14255 - RNA, 22 nt, Homo sapiens
ucguuuuuccucaaguccauua

SEQ ID NO: 14256 - RNA, 22 nt, Homo sapiens
guggaauugaggaagggcagaa

SEQ ID NO: 14257 - RNA, 22 nt, Homo sapiens
uucucuguuuuggccaugugug

SEQ ID NO: 14258 - RNA, 22 nt, Homo sapiens
cacauggccgaaacagagaagu

SEQ ID NO: 14259 - RNA, 22 nt, Homo sapiens
ggagacaggggcggggcggggg

SEQ ID NO: 14260 - RNA, 22 nt, Homo sapiens
ccugaagccccgccccuucucc

SEQ ID NO: 14261 - RNA, 22 nt, Homo sapiens
gagacacaaaauguggaaagaa

SEQ ID NO: 14262 - RNA, 20 nt, Homo sapiens
uccuuacauuuuguauuucu

SEQ ID NO: 14263 - RNA, 22 nt, Homo sapiens
ugcgguuuccuaugugggccaa

SEQ ID NO: 14264 - RNA, 22 nt, Homo sapiens
cugcucuauaggaaacccauug

SEQ ID NO: 14265 - RNA, 22 nt, Homo sapiens
caguaaaggcuuugaaguuuug

SEQ ID NO: 14266 - RNA, 22 nt, Homo sapiens
aaccucaaagcccuuacugcuu

SEQ ID NO: 14267 - RNA, 22 nt, Homo sapiens
gggcucuggggaggagcaggga

SEQ ID NO: 14268 - RNA, 18 nt, Homo sapiens
cccuccucucugcagccc

SEQ ID NO: 14269 - RNA, 22 nt, Homo sapiens
uauggggagggcucagucaggc

SEQ ID NO: 14270 - RNA, 22 nt, Homo sapiens
uauugagcccuuuccaugugcc

SEQ ID NO: 14271 - RNA, 22 nt, Homo sapiens
uuucaacuauuaccucuauuag

SEQ ID NO: 14272 - RNA, 22 nt, Homo sapiens
uaauagagguaguagcugaaau

SEQ ID NO: 14273 - RNA, 22 nt, Homo sapiens
aagaggaacuuaggagcuaaau

SEQ ID NO: 14274 - RNA, 22 nt, Homo sapiens
uuugcuccagaauguucuuuuc

SEQ ID NO: 14275 - RNA, 22 nt, Homo sapiens
agccgguggcacagucugcucu

SEQ ID NO: 14276 - RNA, 22 nt, Homo sapiens
ggucugagggugccacugacuc

SEQ ID NO: 14277 - RNA, 22 nt, Homo sapiens
ucaccugauuuccacccaccug

SEQ ID NO: 14278 - RNA, 22 nt, Homo sapiens
ugcagggauggaaauuaguggg

SEQ ID NO: 14279 - RNA, 22 nt, Homo sapiens
uaggcaguagcuugaguuauaa

SEQ ID NO: 14280 - RNA, 22 nt, Homo sapiens
gaggucucggaacugcugauug

SEQ ID NO: 14281 - RNA, 22 nt, Homo sapiens
gcaaccagaucagcuuuugaga

SEQ ID NO: 14282 - RNA, 22 nt, Homo sapiens
ucagcucagcugauuuuguugc

SEQ ID NO: 14283 - RNA, 22 nt, Homo sapiens
uuugggguaagggucuaggguu

SEQ ID NO: 14284 - RNA, 22 nt, Homo sapiens
cccuagacccucaccccaaagg

SEQ ID NO: 14285 - RNA, 22 nt, Homo sapiens
gguuuauaacuugaacaagagg

SEQ ID NO: 14286 - RNA, 22 nt, Homo sapiens
ucuugcuuaagccauaaauuuu

SEQ ID NO: 14287 - RNA, 22 nt, Homo sapiens
cagguaaaccaccaaaucucag

SEQ ID NO: 14288 - RNA, 22 nt, Homo sapiens
ugagauuugguaguuuaccuaa

SEQ ID NO: 14289 - RNA, 22 nt, Homo sapiens
cagguaaaccaccaaaucucag

SEQ ID NO: 14290 - RNA, 22 nt, Homo sapiens
ugagauuugguaguuuaccuaa

SEQ ID NO: 14291 - RNA, 22 nt, Homo sapiens
cagguaaaccgccaaaucucag

SEQ ID NO: 14292 - RNA, 22 nt, Homo sapiens
ugagauuuggcaguuuaccuaa

SEQ ID NO: 14293 - RNA, 22 nt, Homo sapiens
uggaaccauguccuugcuuuga

SEQ ID NO: 14294 - RNA, 22 nt, Homo sapiens
aaaugagaacauaguucugaua

SEQ ID NO: 14295 - RNA, 22 nt, Homo sapiens
cuucuaaguauucagauaguug

SEQ ID NO: 14296 - RNA, 22 nt, Homo sapiens
ugucuggauaucuuggaauuag

SEQ ID NO: 14297 - RNA, 22 nt, Homo sapiens
cgaggcagacaaaaguuggaag

SEQ ID NO: 14298 - RNA, 22 nt, Homo sapiens
ucuccugcuucagcuuugucuc

SEQ ID NO: 14299 - RNA, 22 nt, Homo sapiens
ucagagggcaaggaagcaaaga

SEQ ID NO: 14300 - RNA, 22 nt, Homo sapiens
ucuuugcuugccagcuccugaa

SEQ ID NO: 14301 - RNA, 22 nt, Homo sapiens
aauaaauagcuguugaguugcu

SEQ ID NO: 14302 - RNA, 22 nt, Homo sapiens
agugaugaacaguguuugaggg

SEQ ID NO: 14303 - RNA, 22 nt, Homo sapiens
ucagccugccguccacacucuc

SEQ ID NO: 14304 - RNA, 16 nt, Homo sapiens
gugcgauggcagcuga

SEQ ID NO: 14305 - RNA, 22 nt, Homo sapiens
uucuguguucugcguuuaaugc

SEQ ID NO: 14306 - RNA, 22 nt, Homo sapiens
auuacaccagcagcgagaggag

SEQ ID NO: 14307 - RNA, 22 nt, Homo sapiens
aguagucugcacauugguuagg

SEQ ID NO: 14308 - RNA, 23 nt, Homo sapiens
cccaguguuuagacuaucuguuc

SEQ ID NO: 14309 - RNA, 20 nt, Homo sapiens
aucgugcaucccuuuagagu

SEQ ID NO: 14310 - RNA, 22 nt, Homo sapiens
aucgugcaucccuuuagagugu

SEQ ID NO: 14311 - RNA, 23 nt, Homo sapiens
aucgugcaucccuuuagaguguu

SEQ ID NO: 14312 - RNA, 22 nt, Homo sapiens
ccucuagauggaagcacugucu

SEQ ID NO: 14313 - RNA, 22 nt, Homo sapiens
ucgugcaucccuuuagaguguu

SEQ ID NO: 14314 - RNA, 22 nt, Homo sapiens
gggcuggcuuuccucugguccu

SEQ ID NO: 14315 - RNA, 18 nt, Homo sapiens
uggagagaaaggcaguuc

SEQ ID NO: 14316 - RNA, 22 nt, Homo sapiens
aacauccugcauagugcugcca

SEQ ID NO: 14317 - RNA, 22 nt, Homo sapiens
uugcauauguaggaugucccau

SEQ ID NO: 14318 - RNA, 22 nt, Homo sapiens
gaacauccugcauagugcugcc

SEQ ID NO: 14319 - RNA, 22 nt, Homo sapiens
ugacauacugugccuuuuugau

SEQ ID NO: 14320 - RNA, 22 nt, Homo sapiens
aaauaucacagaauguccugua

SEQ ID NO: 14321 - RNA, 22 nt, Homo sapiens
ugcccaaggccccugggcuagc

SEQ ID NO: 14322 - RNA, 22 nt, Homo sapiens
gggccuaacccaggggucugca

SEQ ID NO: 14323 - RNA, 22 nt, Homo sapiens
uuccccuucucugcuuuguugu

SEQ ID NO: 14324 - RNA, 22 nt, Homo sapiens
uauaaggccugggagggcaggg

SEQ ID NO: 14325 - RNA, 22 nt, Homo sapiens
uccccacacuaguccggguccc

SEQ ID NO: 14326 - RNA, 22 nt, Homo sapiens
acccagacaaguauggggaauc

SEQ ID NO: 14327 - RNA, 22 nt, Homo sapiens
ucccuuccgcguagcuauguau

SEQ ID NO: 14328 - RNA, 22 nt, Homo sapiens
auacauagguagugagucauau

SEQ ID NO: 14329 - RNA, 22 nt, Homo sapiens
gagguugucugugaugaguucg

SEQ ID NO: 14330 - RNA, 21 nt, Homo sapiens
aauauaacacagauggccugu

SEQ ID NO: 14331 - RNA, 22 nt, Homo sapiens
ucgaggcugggcagucaggggg

SEQ ID NO: 14332 - RNA, 22 nt, Homo sapiens
uccuuugagcugggucuucaug

SEQ ID NO: 14333 - RNA, 22 nt, Homo sapiens
ucgaggcugggcagucaggggg

SEQ ID NO: 14334 - RNA, 22 nt, Homo sapiens
uccuuugagcugggucuucaug

SEQ ID NO: 14335 - RNA, 22 nt, Homo sapiens
uaguuaucauagcuucacuuaa

SEQ ID NO: 14336 - RNA, 22 nt, Homo sapiens
uaagugaaguuauguuaacuaa

SEQ ID NO: 14337 - RNA, 22 nt, Homo sapiens
ucugcucuccaucuccgugaca

SEQ ID NO: 14338 - RNA, 18 nt, Homo sapiens
cggggcuuggggacaggg

SEQ ID NO: 14339 - RNA, 22 nt, Homo sapiens
cgcaugcggggcgcggacgcuc

SEQ ID NO: 14340 - RNA, 22 nt, Homo sapiens
ggaccccgcgcgcgcgcgcgca

SEQ ID NO: 14341 - RNA, 22 nt, Homo sapiens
gcaggcggcuuagcagaggagg

SEQ ID NO: 14342 - RNA, 20 nt, Homo sapiens
uucccagccaggcccccugc

SEQ ID NO: 14343 - RNA, 22 nt, Homo sapiens
caaugagaacagcaccgcuugg

SEQ ID NO: 14344 - RNA, 22 nt, Homo sapiens
cagguggugguguucccauuuu

SEQ ID NO: 14345 - RNA, 22 nt, Homo sapiens
gcccccucccccaccugcaggc

SEQ ID NO: 14346 - RNA, 20 nt, Homo sapiens
ccuucaggaggggaaggggc

SEQ ID NO: 14347 - RNA, 22 nt, Homo sapiens
gaacaguaggcccucugaaggg

SEQ ID NO: 14348 - RNA, 21 nt, Homo sapiens
ccuuaaggggcugcuuuucuu

SEQ ID NO: 14349 - RNA, 22 nt, Homo sapiens
gagaggaagaaggucuggccuu

SEQ ID NO: 14350 - RNA, 22 nt, Homo sapiens
guuaacccuucuuuuccucuug

SEQ ID NO: 14351 - RNA, 22 nt, Homo sapiens
uacacguccuuacaagcagugc

SEQ ID NO: 14352 - RNA, 22 nt, Homo sapiens
cauugcaugcuaggaccuguag

SEQ ID NO: 14353 - RNA, 22 nt, Homo sapiens
ugccaucuguagguguuaugug

SEQ ID NO: 14354 - RNA, 22 nt, Homo sapiens
uauuucaccuauagauguaugc

SEQ ID NO: 14355 - RNA, 22 nt, Homo sapiens
gaaggcgguuccgguucgcggc

SEQ ID NO: 14356 - RNA, 19 nt, Homo sapiens
cccggccggaaaccccuuc

SEQ ID NO: 14357 - RNA, 22 nt, Homo sapiens
ucaugaagaguucuaacccuug

SEQ ID NO: 14358 - RNA, 22 nt, Homo sapiens
agugguuggagauucaucugug

SEQ ID NO: 14359 - RNA, 22 nt, Homo sapiens
ucagaugaugucaggcccaguu

SEQ ID NO: 14360 - RNA, 22 nt, Homo sapiens
gaacagggcucaucuucugaga

SEQ ID NO: 14361 - RNA, 22 nt, Homo sapiens
ucauuucucauuacugcccuug

SEQ ID NO: 14362 - RNA, 22 nt, Homo sapiens
guggguacaguggggagugacc

SEQ ID NO: 14363 - RNA, 22 nt, Homo sapiens
ugccucugccgcugccccaggg

SEQ ID NO: 14364 - RNA, 22 nt, Homo sapiens
ggggcagcucuggccagaggca

SEQ ID NO: 14365 - RNA, 23 nt, Homo sapiens
agcagcauuguacagggcuauga

SEQ ID NO: 14366 - RNA, 22 nt, Homo sapiens
ggcuucuuuacagugcugccuu

SEQ ID NO: 14367 - RNA, 22 nt, Homo sapiens
ucccacuucccuacuuccuucc

SEQ ID NO: 14368 - RNA, 17 nt, Homo sapiens
aggaacuaggaauggga

SEQ ID NO: 14369 - RNA, 22 nt, Homo sapiens
uuccgugaggucuuuggcaguu

SEQ ID NO: 14370 - RNA, 22 nt, Homo sapiens
gcuggaagaugaagaggagaga

SEQ ID NO: 14371 - RNA, 22 nt, Homo sapiens
ucuauuuaauucaaccucuaua

SEQ ID NO: 14372 - RNA, 22 nt, Homo sapiens
gagguugaauuagauagauuca

SEQ ID NO: 14373 - RNA, 22 nt, Homo sapiens
uuuuguguucuucuaguguaug

SEQ ID NO: 14374 - RNA, 22 nt, Homo sapiens
auguguuugaauggaagcacuu

SEQ ID NO: 14375 - RNA, 22 nt, Homo sapiens
ugggauggaugauugaugcugc

SEQ ID NO: 14376 - RNA, 22 nt, Homo sapiens
cucuggccuuaaucuuuuccug

SEQ ID NO: 14377 - RNA, 22 nt, Homo sapiens
ccucccggccagugaccccgcc

SEQ ID NO: 14378 - RNA, 22 nt, Homo sapiens
gcggggcucgcgcugggaaacu

SEQ ID NO: 14379 - RNA, 22 nt, Homo sapiens
gggaaaauaccugcuacaagau

SEQ ID NO: 14380 - RNA, 22 nt, Homo sapiens
ucugguagcagauauuuccccu

SEQ ID NO: 14381 - RNA, 22 nt, Homo sapiens
uauacaccugcuaugugugugg

SEQ ID NO: 14382 - RNA, 22 nt, Homo sapiens
uacacauaucagguguauacau

SEQ ID NO: 14383 - RNA, 22 nt, Homo sapiens
uaacaaguugaaaaaaaacuaa

SEQ ID NO: 14384 - RNA, 22 nt, Homo sapiens
guuuuuuuuaaauuuguuacag

SEQ ID NO: 14385 - RNA, 23 nt, Homo sapiens
cccaguguucagacuaccuguuc

SEQ ID NO: 14386 - RNA, 22 nt, Homo sapiens
uacaguagucugcacauugguu

SEQ ID NO: 14387 - RNA, 22 nt, Homo sapiens
ucagauuguauuguaauugucu

SEQ ID NO: 14388 - RNA, 22 nt, Homo sapiens
uuauaauacaaccugauaagug

SEQ ID NO: 14389 - RNA, 22 nt, Homo sapiens
ccgccugggccugccggcacac

SEQ ID NO: 14390 - RNA, 22 nt, Homo sapiens
ucugcccggcccgcccagcgcg

SEQ ID NO: 14391 - RNA, 22 nt, Homo sapiens
caggggacacuccugcuugggc

SEQ ID NO: 14392 - RNA, 22 nt, Homo sapiens
ucuaguaggaaugucccucugu

SEQ ID NO: 14393 - RNA, 23 nt, Homo sapiens
aaaagcuggguugagagggcgaa

SEQ ID NO: 14394 - RNA, 22 nt, Homo sapiens
uccgccuucucuucccgguucu

SEQ ID NO: 14395 - RNA, 22 nt, Homo sapiens
ggcagagcccggugccugugag

SEQ ID NO: 14396 - RNA, 22 nt, Homo sapiens
ucaaagcaggcuugggucuccc

SEQ ID NO: 14397 - RNA, 22 nt, Homo sapiens
agcaggcucuggugagacuguc

SEQ ID NO: 14398 - RNA, 22 nt, Homo sapiens
cacaguuccaggugcccugucc

SEQ ID NO: 14399 - RNA, 22 nt, Homo sapiens
cgcgcggugguggugggcuuug

SEQ ID NO: 14400 - RNA, 20 nt, Homo sapiens
agcucaccaaggcccugcgc

SEQ ID NO: 14401 - RNA, 22 nt, Homo sapiens
agacuucagcuucuugagcaaa

SEQ ID NO: 14402 - RNA, 22 nt, Homo sapiens
ugcccaagaagccaaagucugu

SEQ ID NO: 14403 - RNA, 22 nt, Homo sapiens
uccugaggagucccaaugugcu

SEQ ID NO: 14404 - RNA, 22 nt, Homo sapiens
ugaugcuugggaccccagagcu

SEQ ID NO: 14405 - RNA, 22 nt, Homo sapiens
ugcaagugugcugaacuguacu

SEQ ID NO: 14406 - RNA, 22 nt, Homo sapiens
caguucagugggcuugcugagg

SEQ ID NO: 14407 - RNA, 22 nt, Homo sapiens
ucaggguuccuacugacaaggg

SEQ ID NO: 14408 - RNA, 22 nt, Homo sapiens
cccuguggcagagcccugauca

SEQ ID NO: 14409 - RNA, 22 nt, Homo sapiens
cagcucucauuaugacauuuag

SEQ ID NO: 14410 - RNA, 22 nt, Homo sapiens
ugugugucauugagaccuuggc

SEQ ID NO: 14411 - RNA, 22 nt, Homo sapiens
ccagagcaggugccagaggagg

SEQ ID NO: 14412 - RNA, 22 nt, Homo sapiens
ccccucgucaaccugccugucu

SEQ ID NO: 14413 - RNA, 22 nt, Homo sapiens
uaagccuaucuauccaaauaug

SEQ ID NO: 14414 - RNA, 22 nt, Homo sapiens
uauuuagauagauaggcuuaac

SEQ ID NO: 14415 - RNA, 22 nt, Homo sapiens
ugggucagauguuuuaggucug

SEQ ID NO: 14416 - RNA, 22 nt, Homo sapiens
aggcucuggaugcaaaggaccc

SEQ ID NO: 14417 - RNA, 22 nt, Homo sapiens
aaugacacgaucacucccguug

SEQ ID NO: 14418 - RNA, 21 nt, Homo sapiens
aucgggaaugucguguccgcc

SEQ ID NO: 14419 - RNA, 22 nt, Homo sapiens
uaauuaccuaauuacaagcugu

SEQ ID NO: 14420 - RNA, 22 nt, Homo sapiens
cacuuguaauauuuuguaauua

SEQ ID NO: 14421 - RNA, 22 nt, Homo sapiens
cccugcccaaagcuccagcccu

SEQ ID NO: 14422 - RNA, 22 nt, Homo sapiens
gugcugagauugaggcuggggu

SEQ ID NO: 14423 - RNA, 22 nt, Homo sapiens
cacuuccuuuccuccuaccggu

SEQ ID NO: 14424 - RNA, 20 nt, Homo sapiens
cacuaaggaggggagaagug

SEQ ID NO: 14425 - RNA, 22 nt, Homo sapiens
uugaugacauuucauaacucau

SEQ ID NO: 14426 - RNA, 22 nt, Homo sapiens
ugaguuaugagguuaucaauca

SEQ ID NO: 14427 - RNA, 22 nt, Homo sapiens
ugccuagauauuuuagggguga

SEQ ID NO: 14428 - RNA, 22 nt, Homo sapiens
ccccacugugauuucuagguac

SEQ ID NO: 14429 - RNA, 22 nt, Homo sapiens
aaggcagggugggaggggagua

SEQ ID NO: 14430 - RNA, 22 nt, Homo sapiens
uauuuucuucuaucuugauuuc

SEQ ID NO: 14431 - RNA, 22 nt, Homo sapiens
uguuuccagggugacguagauu

SEQ ID NO: 14432 - RNA, 22 nt, Homo sapiens
ucucaccguuacccggggcaac

SEQ ID NO: 14433 - RNA, 22 nt, Homo sapiens
acucggaucugcccucuuuguc

SEQ ID NO: 14434 - RNA, 22 nt, Homo sapiens
uaaauagugcagucuccagcca

SEQ ID NO: 14435 - RNA, 22 nt, Homo sapiens
uggguaucgguuggugcaaaag

SEQ ID NO: 14436 - RNA, 22 nt, Homo sapiens
ucugcaccagccuucuaucugu

SEQ ID NO: 14437 - RNA, 22 nt, Homo sapiens
ucaucccuuccagucucugugg

SEQ ID NO: 14438 - RNA, 22 nt, Homo sapiens
acagugacuggaggucaaugaa

SEQ ID NO: 14439 - RNA, 22 nt, Homo sapiens
uguagcaggccagagaaugagg

SEQ ID NO: 14440 - RNA, 22 nt, Homo sapiens
ucucucugguccugcugcaacu

SEQ ID NO: 14441 - RNA, 22 nt, Homo sapiens
ugucuccagaggaugccaagca

SEQ ID NO: 14442 - RNA, 19 nt, Homo sapiens
uggauccucugauuggaca

SEQ ID NO: 14443 - RNA, 22 nt, Homo sapiens
ucauucccuauggaaucccuuc

SEQ ID NO: 14444 - RNA, 22 nt, Homo sapiens
gacugauuacuuuagggaaauu

SEQ ID NO: 14445 - RNA, 22 nt, Homo sapiens
ugccccagcacugugcucaugc

SEQ ID NO: 14446 - RNA, 22 nt, Homo sapiens
uaucagagacagcgccgggguu

SEQ ID NO: 14447 - RNA, 22 nt, Homo sapiens
ucuaucuuggaggauguuugug

SEQ ID NO: 14448 - RNA, 19 nt, Homo sapiens
uauucuucaacauuguaga

SEQ ID NO: 14449 - RNA, 22 nt, Homo sapiens
ucacacugcaagguggugcccu

SEQ ID NO: 14450 - RNA, 22 nt, Homo sapiens
gacauuggcugcgaugugugaa

SEQ ID NO: 14451 - RNA, 22 nt, Homo sapiens
ugcagggcccagguguccgggu

SEQ ID NO: 14452 - RNA, 22 nt, Homo sapiens
cggugacacucagggcccggcc

SEQ ID NO: 14453 - RNA, 22 nt, Homo sapiens
gguguccccugguccccuuucc

SEQ ID NO: 14454 - RNA, 22 nt, Homo sapiens
aaaagggaccagggaacaucug

SEQ ID NO: 14455 - RNA, 22 nt, Homo sapiens
uuucugugucagucucucuggu

SEQ ID NO: 14456 - RNA, 22 nt, Homo sapiens
ucagggcugugcacagaaggug

SEQ ID NO: 14457 - RNA, 22 nt, Homo sapiens
cacucaauaaaugucuguugaa

SEQ ID NO: 14458 - RNA, 22 nt, Homo sapiens
uucaacggguauuuauugagca

SEQ ID NO: 14459 - RNA, 22 nt, Homo sapiens
uccauguccuauguguuacugu

SEQ ID NO: 14460 - RNA, 22 nt, Homo sapiens
uauaguauauaggacacagaga

SEQ ID NO: 14461 - RNA, 22 nt, Homo sapiens
uuccucaucgagcccagggcug

SEQ ID NO: 14462 - RNA, 19 nt, Homo sapiens
ccucuggcuugaaagggaa

SEQ ID NO: 14463 - RNA, 22 nt, Homo sapiens
gcugggcuccuccguuugugcu

SEQ ID NO: 14464 - RNA, 22 nt, Homo sapiens
gagcggggauggcgagcagcug

SEQ ID NO: 14465 - RNA, 22 nt, Homo sapiens
agggcccucaacacgaucuucu

SEQ ID NO: 14466 - RNA, 22 nt, Homo sapiens
gauagccggguguugugggcuc

SEQ ID NO: 14467 - RNA, 22 nt, Homo sapiens
caucuccaguuagcaguacuga

SEQ ID NO: 14468 - RNA, 22 nt, Homo sapiens
ucaacacuguuggcggggaccu

SEQ ID NO: 14469 - RNA, 22 nt, Homo sapiens
ucaggacccagugagagaagga

SEQ ID NO: 14470 - RNA, 22 nt, Homo sapiens
uccuauuuugcuggggagagcu

SEQ ID NO: 14471 - RNA, 22 nt, Homo sapiens
cugcaggcauccugagcaggag

SEQ ID NO: 14472 - RNA, 22 nt, Homo sapiens
cugugcgggggcucugugaugc

SEQ ID NO: 14473 - RNA, 22 nt, Homo sapiens
caggacaugguucagccagggg

SEQ ID NO: 14474 - RNA, 22 nt, Homo sapiens
gugccucuggacuagucucugg

SEQ ID NO: 14475 - RNA, 22 nt, Homo sapiens
gccaugagcagaacagacugga

SEQ ID NO: 14476 - RNA, 22 nt, Homo sapiens
uccagcuguucaccucagcucu

SEQ ID NO: 14477 - RNA, 22 nt, Homo sapiens
agguggcaccuagcugcuauuu

SEQ ID NO: 14478 - RNA, 22 nt, Homo sapiens
gcaaacagcaggugccaccugg

SEQ ID NO: 14479 - RNA, 22 nt, Homo sapiens
ggcagugaaaaucaaugagagc

SEQ ID NO: 14480 - RNA, 22 nt, Homo sapiens
ccucacugacuuguacugucca

SEQ ID NO: 14481 - RNA, 22 nt, Homo sapiens
agugauugaaaggacguuuaga

SEQ ID NO: 14482 - RNA, 22 nt, Homo sapiens
uagacauccucucaauugcuuu

SEQ ID NO: 14483 - RNA, 22 nt, Homo sapiens
gauuauuuuguauauucaugaa

SEQ ID NO: 14484 - RNA, 22 nt, Homo sapiens
ucaggagaaugugcaguaaucc

SEQ ID NO: 14485 - RNA, 22 nt, Homo sapiens
gaaggagacggugaugaugggg

SEQ ID NO: 14486 - RNA, 22 nt, Homo sapiens
caucacaggcaccugucuccuu

SEQ ID NO: 14487 - RNA, 22 nt, Homo sapiens
ggcagggggccuggcugggaaa

SEQ ID NO: 14488 - RNA, 22 nt, Homo sapiens
uccuccucugcuaagccgccug

SEQ ID NO: 14489 - RNA, 22 nt, Homo sapiens
ugacaccaaaucauugggauga

SEQ ID NO: 14490 - RNA, 22 nt, Homo sapiens
auccacauguuugaugucaugc

SEQ ID NO: 14491 - RNA, 22 nt, Homo sapiens
gacaggcauucagucucugaga

SEQ ID NO: 14492 - RNA, 22 nt, Homo sapiens
ucauggacugaaaugacuguuu

SEQ ID NO: 14493 - RNA, 22 nt, Homo sapiens
ucauuacagacuuucauucuug

SEQ ID NO: 14494 - RNA, 22 nt, Homo sapiens
agaguggaaugucguguaaaaa

SEQ ID NO: 14495 - RNA, 22 nt, Homo sapiens
ucccauuauuacucuguuuuaa

SEQ ID NO: 14496 - RNA, 22 nt, Homo sapiens
aaacaaggcaaucaugggcaga

SEQ ID NO: 14497 - RNA, 22 nt, Homo sapiens
ucaagugcuucugggauuagga

SEQ ID NO: 14498 - RNA, 22 nt, Homo sapiens
uccccacucuggaagaacuuga

SEQ ID NO: 14499 - RNA, 22 nt, Homo sapiens
cccuggcauugccccuacgggu

SEQ ID NO: 14500 - RNA, 22 nt, Homo sapiens
cccccagggagugcccagggca

SEQ ID NO: 14501 - RNA, 22 nt, Homo sapiens
aggcaaggguuggacucugugg

SEQ ID NO: 14502 - RNA, 22 nt, Homo sapiens
cacagcugucuuccuuugcucu

SEQ ID NO: 14503 - RNA, 22 nt, Homo sapiens
caaagcugaagggcaggaugug

SEQ ID NO: 14504 - RNA, 22 nt, Homo sapiens
caccaucccucccuccaguagc

SEQ ID NO: 14505 - RNA, 22 nt, Homo sapiens
ugagugggagguuugugugaug

SEQ ID NO: 14506 - RNA, 22 nt, Homo sapiens
uacacuaaaaccccccaacuca

SEQ ID NO: 14507 - RNA, 22 nt, Homo sapiens
acccccaacccugcugccagag

SEQ ID NO: 14508 - RNA, 22 nt, Homo sapiens
gcuguggagggguugggggugc

SEQ ID NO: 14509 - RNA, 22 nt, Homo sapiens
ccaagggcagggacugcagagg

SEQ ID NO: 14510 - RNA, 22 nt, Homo sapiens
ccuuguagaccugccccacaga

SEQ ID NO: 14511 - RNA, 22 nt, Homo sapiens
cuggacuuagggucagaaggcc

SEQ ID NO: 14512 - RNA, 22 nt, Homo sapiens
ugggcucucugucccugagcca

SEQ ID NO: 14513 - RNA, 22 nt, Homo sapiens
uugacacaggcaggcucugggu

SEQ ID NO: 14514 - RNA, 21 nt, Homo sapiens
cccagagucuguuuuuuugac

SEQ ID NO: 14515 - RNA, 22 nt, Homo sapiens
ugacacucugaggaugugguuu

SEQ ID NO: 14516 - RNA, 20 nt, Homo sapiens
ccguguccucagaucucagg

SEQ ID NO: 14517 - RNA, 22 nt, Homo sapiens
ucugacacucucaggauguggg

SEQ ID NO: 14518 - RNA, 18 nt, Homo sapiens
augucuucagaucucagg

SEQ ID NO: 14519 - RNA, 22 nt, Homo sapiens
ucugacacucucaggauguggg

SEQ ID NO: 14520 - RNA, 18 nt, Homo sapiens
augucuucagaucucagg

SEQ ID NO: 14521 - RNA, 22 nt, Homo sapiens
ucugacacucucaggauguggg

SEQ ID NO: 14522 - RNA, 18 nt, Homo sapiens
augucuucagaucucagg

SEQ ID NO: 14523 - RNA, 22 nt, Homo sapiens
cagcaucugaucuuggcagugu

SEQ ID NO: 14524 - RNA, 22 nt, Homo sapiens
cugcacaaguucugguguccug

SEQ ID NO: 14525 - RNA, 22 nt, Homo sapiens
uaaguaggcugguugauuagga

SEQ ID NO: 14526 - RNA, 22 nt, Homo sapiens
uaaucuacuagucuguuuguua

SEQ ID NO: 14527 - RNA, 22 nt, Homo sapiens
ucacagcugcuuugcaguagag

SEQ ID NO: 14528 - RNA, 22 nt, Homo sapiens
ucugcuacaaaggagcagcauc

SEQ ID NO: 14529 - RNA, 22 nt, Homo sapiens
ugggucugucucaggccagucu

SEQ ID NO: 14530 - RNA, 22 nt, Homo sapiens
gucuggcucagggcaguccucu

SEQ ID NO: 14531 - RNA, 22 nt, Homo sapiens
cgcaaguucauucauugauuca

SEQ ID NO: 14532 - RNA, 22 nt, Homo sapiens
aucaaugaaugcaauguugugc

SEQ ID NO: 14533 - RNA, 22 nt, Homo sapiens
ucaaccagacuauuucuguuua

SEQ ID NO: 14534 - RNA, 16 nt, Homo sapiens
caggaauaguaguuga

SEQ ID NO: 14535 - RNA, 22 nt, Homo sapiens
ccuggauucacaucccuuacug

SEQ ID NO: 14536 - RNA, 22 nt, Homo sapiens
auacugagggugagucuggggc

SEQ ID NO: 14537 - RNA, 22 nt, Homo sapiens
ugaucaugucgggcaagaguag

SEQ ID NO: 14538 - RNA, 22 nt, Homo sapiens
ugcucuugauuauucaaggucu

SEQ ID NO: 14539 - RNA, 22 nt, Homo sapiens
uggaggacaggggaggccauug

SEQ ID NO: 14540 - RNA, 22 nt, Homo sapiens
aaugagcuugucugugccccga

SEQ ID NO: 14541 - RNA, 22 nt, Homo sapiens
cuuuggugacaggcaugugugg

SEQ ID NO: 14542 - RNA, 22 nt, Homo sapiens
caccagccugaucaucaaagca

SEQ ID NO: 14543 - RNA, 22 nt, Homo sapiens
ucaaaggagccccagugcuacu

SEQ ID NO: 14544 - RNA, 22 nt, Homo sapiens
ucccauuggggcuguuuuaugc

SEQ ID NO: 14545 - RNA, 22 nt, Homo sapiens
uaggcagagaggccauaagaau

SEQ ID NO: 14546 - RNA, 22 nt, Homo sapiens
uuuaugguccuuuccugccuua

SEQ ID NO: 14547 - RNA, 22 nt, Homo sapiens
uuucaguucuggugguuccggu

SEQ ID NO: 14548 - RNA, 22 nt, Homo sapiens
aacuguccaucaggauugugcu

SEQ ID NO: 14549 - RNA, 22 nt, Homo sapiens
gcagggagaguugcuuuccuuu

SEQ ID NO: 14550 - RNA, 22 nt, Homo sapiens
aggggggccugcaucucugccc

SEQ ID NO: 14551 - RNA, 22 nt, Homo sapiens
uccuccccgccgucgcgcccua

SEQ ID NO: 14552 - RNA, 22 nt, Homo sapiens
ggcuucagcgauggugcgaggg

SEQ ID NO: 14553 - RNA, 22 nt, Homo sapiens
ggugggcucggggcuccgagug

SEQ ID NO: 14554 - RNA, 22 nt, Homo sapiens
auucaagcucugacccacuuac

SEQ ID NO: 14555 - RNA, 22 nt, Homo sapiens
ucaucccuggauuggucaccuc

SEQ ID NO: 14556 - RNA, 22 nt, Homo sapiens
aaggugaccagaucuccaguaa

SEQ ID NO: 14557 - RNA, 22 nt, Homo sapiens
uccgcaaucaggcuuucauauu

SEQ ID NO: 14558 - RNA, 22 nt, Homo sapiens
ugugaauuccucauuguuaauu

SEQ ID NO: 14559 - RNA, 22 nt, Homo sapiens
uccuucccuucccagugagcuc

SEQ ID NO: 14560 - RNA, 22 nt, Homo sapiens
cacacgggaugggcagggagac

SEQ ID NO: 14561 - RNA, 22 nt, Homo sapiens
uggaccggagggaggcgguggg

SEQ ID NO: 14562 - RNA, 22 nt, Homo sapiens
ccugccgccuucuguccauucc

SEQ ID NO: 14563 - RNA, 22 nt, Homo sapiens
uggaccggagggaggcgguggg

SEQ ID NO: 14564 - RNA, 22 nt, Homo sapiens
ccugccgccuucuguccauucc

SEQ ID NO: 14565 - RNA, 22 nt, Homo sapiens
ucagaacaaaugccgguuccca

SEQ ID NO: 14566 - RNA, 21 nt, Homo sapiens
ugagaaccacgucugcucuga

SEQ ID NO: 14567 - RNA, 22 nt, Homo sapiens
ugagaaccacgucugcucugag

SEQ ID NO: 14568 - RNA, 22 nt, Homo sapiens
auggcuugcuaauuuaaagucc

SEQ ID NO: 14569 - RNA, 22 nt, Homo sapiens
uuuuauuauagacaauccacuu

SEQ ID NO: 14570 - RNA, 22 nt, Homo sapiens
ucuccagcuuuaacauggggcc

SEQ ID NO: 14571 - RNA, 22 nt, Homo sapiens
gugucagugugaaggcuggggu

SEQ ID NO: 14572 - RNA, 22 nt, Homo sapiens
ugcaggcugagugacccugggc

SEQ ID NO: 14573 - RNA, 22 nt, Homo sapiens
cucaguuuccucagcugcaaaa

SEQ ID NO: 14574 - RNA, 22 nt, Homo sapiens
ccccugcugcccagugugucug

SEQ ID NO: 14575 - RNA, 22 nt, Homo sapiens
agacuaugggcacagguuagcu

SEQ ID NO: 14576 - RNA, 22 nt, Homo sapiens
ggcuggcucugggccucagaca

SEQ ID NO: 14577 - RNA, 22 nt, Homo sapiens
ucugagcucagggccuggcccc

SEQ ID NO: 14578 - RNA, 22 nt, Homo sapiens
agagguuguaccuaaaguguuc

SEQ ID NO: 14579 - RNA, 22 nt, Homo sapiens
auguuucccgggcaaccucuuu

SEQ ID NO: 14580 - RNA, 22 nt, Homo sapiens
ucauagguuuuuucccccauuu

SEQ ID NO: 14581 - RNA, 22 nt, Homo sapiens
augggggaaggagagccugugu

SEQ ID NO: 14582 - RNA, 22 nt, Homo sapiens
acaaggcacauguguccugauc

SEQ ID NO: 14583 - RNA, 22 nt, Homo sapiens
ucccagauacugugucuuaacu

SEQ ID NO: 14584 - RNA, 22 nt, Homo sapiens
acaaugcccuuucucauuguua

SEQ ID NO: 14585 - RNA, 22 nt, Homo sapiens
cggugagaagggguguugucug

SEQ ID NO: 14586 - RNA, 22 nt, Homo sapiens
uucuacacagauaaucuguuau

SEQ ID NO: 14587 - RNA, 22 nt, Homo sapiens
uagacaaucuguguagagugcu

SEQ ID NO: 14588 - RNA, 22 nt, Homo sapiens
uguccuugcccgaugucccucc

SEQ ID NO: 14589 - RNA, 22 nt, Homo sapiens
augggagcggggugggggcagc

SEQ ID NO: 14590 - RNA, 22 nt, Homo sapiens
ucgcugcuccccaugacaggcu

SEQ ID NO: 14591 - RNA, 22 nt, Homo sapiens
gugugagcaugaggagcaguga

SEQ ID NO: 14592 - RNA, 22 nt, Homo sapiens
ucgcugcuccccaugacaggcu

SEQ ID NO: 14593 - RNA, 22 nt, Homo sapiens
gugugagcaugaggagcaguga

SEQ ID NO: 14594 - RNA, 22 nt, Homo sapiens
acagagcacauuguguucaugg

SEQ ID NO: 14595 - RNA, 22 nt, Homo sapiens
gaaugaacagaugugcucugaa

SEQ ID NO: 14596 - RNA, 22 nt, Homo sapiens
ugcccaacuccagaggacccug

SEQ ID NO: 14597 - RNA, 22 nt, Homo sapiens
cauucccuggaguugggcaauc

SEQ ID NO: 14598 - RNA, 22 nt, Homo sapiens
uccagaagccugccucagaugc

SEQ ID NO: 14599 - RNA, 22 nt, Homo sapiens
aucagggguagguguuuaggau

SEQ ID NO: 14600 - RNA, 22 nt, Homo sapiens
ucucuuuuucguuccccucucc

SEQ ID NO: 14601 - RNA, 22 nt, Homo sapiens
ggaggggggaaacaaggggagc

SEQ ID NO: 14602 - RNA, 22 nt, Homo sapiens
ucaauccuugguaaucuggcug

SEQ ID NO: 14603 - RNA, 20 nt, Homo sapiens
agccagagaaccauuguuga

SEQ ID NO: 14604 - RNA, 22 nt, Homo sapiens
ccuguguguguuuugccccagg

SEQ ID NO: 14605 - RNA, 22 nt, Homo sapiens
cuggguguccagcaccaccccc

SEQ ID NO: 14606 - RNA, 20 nt, Homo sapiens
uggcuccuggccucaagcaa

SEQ ID NO: 14607 - RNA, 22 nt, Homo sapiens
gguaggaagauuguuucaaauc

SEQ ID NO: 14608 - RNA, 22 nt, Homo sapiens
uugugacagucuucucauucau

SEQ ID NO: 14609 - RNA, 22 nt, Homo sapiens
gcuauuucacgacaccaggguu

SEQ ID NO: 14610 - RNA, 22 nt, Homo sapiens
agcugguguugugaaucaggcc

SEQ ID NO: 14611 - RNA, 22 nt, Homo sapiens
uuaggguaggaugguuguaggu

SEQ ID NO: 14612 - RNA, 22 nt, Homo sapiens
ccugccacuuccugccucaguc

SEQ ID NO: 14613 - RNA, 22 nt, Homo sapiens
uucucccaucauuucuccuucu

SEQ ID NO: 14614 - RNA, 22 nt, Homo sapiens
ugagagaaguggggugagaaga

SEQ ID NO: 14615 - RNA, 22 nt, Homo sapiens
gaugggaguuuguuauucagug

SEQ ID NO: 14616 - RNA, 22 nt, Homo sapiens
ugaaugaugagcucacaucugu

SEQ ID NO: 14617 - RNA, 22 nt, Homo sapiens
uaauugagaaugcaaucuacua

SEQ ID NO: 14618 - RNA, 22 nt, Homo sapiens
uuuuuggagcauuuuuaauuua

SEQ ID NO: 14619 - RNA, 22 nt, Homo sapiens
ugguacuucauguuaguugagg

SEQ ID NO: 14620 - RNA, 22 nt, Homo sapiens
uccuaacuaacaugauuugcua

SEQ ID NO: 14621 - RNA, 20 nt, Homo sapiens
aacacaccugguuaaccucu

SEQ ID NO: 14622 - RNA, 21 nt, Homo sapiens
aacacaccugguuaaccucuu

SEQ ID NO: 14623 - RNA, 22 nt, Homo sapiens
aacacaccugguuaaccucuuu

SEQ ID NO: 14624 - RNA, 19 nt, Homo sapiens
acacaccugguuaaccucu

SEQ ID NO: 14625 - RNA, 22 nt, Homo sapiens
cugggcagggcuccaggacaug

SEQ ID NO: 14626 - RNA, 22 nt, Homo sapiens
uccugggcccccugccccaccc

SEQ ID NO: 14627 - RNA, 22 nt, Homo sapiens
ccuaacuugaaagaggugcuaa

SEQ ID NO: 14628 - RNA, 17 nt, Homo sapiens
cacucuuucaucuuggg

SEQ ID NO: 14629 - RNA, 22 nt, Homo sapiens
ggggaaccggcccgggccucgg

SEQ ID NO: 14630 - RNA, 22 nt, Homo sapiens
cgaggcccucucggucccccgc

SEQ ID NO: 14631 - RNA, 22 nt, Homo sapiens
uuuaugacuaugucauucauaa

SEQ ID NO: 14632 - RNA, 22 nt, Homo sapiens
ugugaauuccuucugucauauc

SEQ ID NO: 14633 - RNA, 22 nt, Homo sapiens
uucccauuuguaccuuggaggu

SEQ ID NO: 14634 - RNA, 22 nt, Homo sapiens
cucacaggguauguagggaaca

SEQ ID NO: 14635 - RNA, 22 nt, Homo sapiens
aggaaacugaaguccagaaagg

SEQ ID NO: 14636 - RNA, 22 nt, Homo sapiens
uuucaggccucaguuuccuccu

SEQ ID NO: 14637 - RNA, 22 nt, Homo sapiens
ugcgugacguaggcuggcgugg

SEQ ID NO: 14638 - RNA, 22 nt, Homo sapiens
ccuugccggugcugccacguga

SEQ ID NO: 14639 - RNA, 22 nt, Homo sapiens
ugcgugacguaggcuggcgugg

SEQ ID NO: 14640 - RNA, 22 nt, Homo sapiens
ccuugccggugcugccacguga

SEQ ID NO: 14641 - RNA, 22 nt, Homo sapiens
uuccucccucgggccugauugg

SEQ ID NO: 14642 - RNA, 22 nt, Homo sapiens
cagcucccugaggaaaggaggg

SEQ ID NO: 14643 - RNA, 22 nt, Homo sapiens
ugggagaggguuguuuacuccu

SEQ ID NO: 14644 - RNA, 23 nt, Homo sapiens
uguaaacauccuacacucucagc

SEQ ID NO: 14645 - RNA, 22 nt, Homo sapiens
uuacuuccugggcaucuacaca

SEQ ID NO: 14646 - RNA, 22 nt, Homo sapiens
uguggggcuggggauaugacaa

SEQ ID NO: 14647 - RNA, 19 nt, Homo sapiens
gugccuacugagcugaaac

SEQ ID NO: 14648 - RNA, 21 nt, Homo sapiens
gugccuacugagcugaaacac

SEQ ID NO: 14649 - RNA, 24 nt, Homo sapiens
gugccuacugagcugaaacacagu

SEQ ID NO: 14650 - RNA, 22 nt, Homo sapiens
uuaaguuuaauuuaaagaaaac

SEQ ID NO: 14651 - RNA, 22 nt, Homo sapiens
ucuuuaaacuagacuuaagguc

SEQ ID NO: 14652 - RNA, 22 nt, Homo sapiens
uucuaaggaauaagaagggggu

SEQ ID NO: 14653 - RNA, 22 nt, Homo sapiens
uccuugauuucuccuuagagcu

SEQ ID NO: 14654 - RNA, 22 nt, Homo sapiens
uggcugagggagggagcgguga

SEQ ID NO: 14655 - RNA, 22 nt, Homo sapiens
cugcuucccuuccuuuccccag

SEQ ID NO: 14656 - RNA, 22 nt, Homo sapiens
ccuccugagcacaguccugggg

SEQ ID NO: 14657 - RNA, 22 nt, Homo sapiens
ucugggaucuguauuugggggg

SEQ ID NO: 14658 - RNA, 22 nt, Homo sapiens
agagagggccauggcaggaggg

SEQ ID NO: 14659 - RNA, 22 nt, Homo sapiens
uuucucuuguguguuccacuuu

SEQ ID NO: 14660 - RNA, 22 nt, Homo sapiens
ucacuucuuggaggcucagucu

SEQ ID NO: 14661 - RNA, 22 nt, Homo sapiens
aggugagcucuccgagaguggu

SEQ ID NO: 14662 - RNA, 22 nt, Homo sapiens
uugguuucucauuccucugguc

SEQ ID NO: 14663 - RNA, 22 nt, Homo sapiens
ugggcaggggugggggaucacg

SEQ ID NO: 14664 - RNA, 22 nt, Homo sapiens
uccuagcucacaccuaccuaga

SEQ ID NO: 14665 - RNA, 22 nt, Homo sapiens
ucuagguaugucugggcagguu

SEQ ID NO: 14666 - RNA, 22 nt, Homo sapiens
uccucuccacucuuguuuagau

SEQ ID NO: 14667 - RNA, 22 nt, Homo sapiens
ucuggauagggguggaguagaa

SEQ ID NO: 14668 - RNA, 22 nt, Homo sapiens
cacacggcuugccuuccucucc

SEQ ID NO: 14669 - RNA, 22 nt, Homo sapiens
gcuggggugggcagcugugucu

SEQ ID NO: 14670 - RNA, 22 nt, Homo sapiens
uccauuguuuuuaguccauucc

SEQ ID NO: 14671 - RNA, 22 nt, Homo sapiens
uguagaugcugaaacauggagg

SEQ ID NO: 14672 - RNA, 22 nt, Homo sapiens
aaggucuaacuaaaacacuccc

SEQ ID NO: 14673 - RNA, 16 nt, Homo sapiens
aguuuuuuggugccuu

SEQ ID NO: 14674 - RNA, 22 nt, Homo sapiens
gggaggagcaggcagaggcagu

SEQ ID NO: 14675 - RNA, 22 nt, Homo sapiens
uggcucugaagcuucuuccuua

SEQ ID NO: 14676 - RNA, 22 nt, Homo sapiens
uucagugggcagugaacacucc

SEQ ID NO: 14677 - RNA, 22 nt, Homo sapiens
aggaauccuugcuuauuggaug

SEQ ID NO: 14678 - RNA, 22 nt, Homo sapiens
ugaaggucuacugugugccagg

SEQ ID NO: 14679 - RNA, 22 nt, Homo sapiens
uuguacaugguaggcuuucauu

SEQ ID NO: 14680 - RNA, 22 nt, Homo sapiens
gggcugggcugggcuggguggg

SEQ ID NO: 14681 - RNA, 22 nt, Homo sapiens
cacugugccuguuguaaucccc

SEQ ID NO: 14682 - RNA, 22 nt, Homo sapiens
ccagugcuccuugguuauccuu

SEQ ID NO: 14683 - RNA, 22 nt, Homo sapiens
auaauaaugaaggagcucacug

SEQ ID NO: 14684 - RNA, 22 nt, Homo sapiens
ucacuggaguaccauuuagcaa

SEQ ID NO: 14685 - RNA, 22 nt, Homo sapiens
gcucaaugauaccccaguguuc

SEQ ID NO: 14686 - RNA, 22 nt, Homo sapiens
ucaccuugaggucgcacagcag

SEQ ID NO: 14687 - RNA, 22 nt, Homo sapiens
uugcuguggaccuugaguaagg

SEQ ID NO: 14688 - RNA, 22 nt, Homo sapiens
uagugauuuucauauuacauua

SEQ ID NO: 14689 - RNA, 22 nt, Homo sapiens
ucaugugauaggaaguuacuaa

SEQ ID NO: 14690 - RNA, 22 nt, Homo sapiens
gccggccccucccccacuuccg

SEQ ID NO: 14691 - RNA, 22 nt, Homo sapiens
ggcggggguaggggccgggaug

SEQ ID NO: 14692 - RNA, 22 nt, Homo sapiens
caauauuggcugugcugcucca

SEQ ID NO: 14693 - RNA, 21 nt, Homo sapiens
uagcagcacagaaauauuggc

SEQ ID NO: 14694 - RNA, 22 nt, Homo sapiens
uagcagcacagaaauauuggca

SEQ ID NO: 14695 - RNA, 22 nt, Homo sapiens
ugacugauugcuucuuguguuc

SEQ ID NO: 14696 - RNA, 22 nt, Homo sapiens
ccagacagcaaaucaguuguag

SEQ ID NO: 14697 - RNA, 22 nt, Homo sapiens
gggcuguguuggggaccugagc

SEQ ID NO: 14698 - RNA, 22 nt, Homo sapiens
uggggccuccccaaccugaccc

SEQ ID NO: 14699 - RNA, 22 nt, Homo sapiens
acuguguuacaccaaaggggaa

SEQ ID NO: 14700 - RNA, 22 nt, Homo sapiens
ucuucuugggugugaccagucu

SEQ ID NO: 14701 - RNA, 22 nt, Homo sapiens
uuccccgcgccgccggccccuc

SEQ ID NO: 14702 - RNA, 22 nt, Homo sapiens
ggcagccaggcagcugggguaa

SEQ ID NO: 14703 - RNA, 22 nt, Homo sapiens
uucacugguggcccauucaaau

SEQ ID NO: 14704 - RNA, 22 nt, Homo sapiens
ugaauggggcaccaauguacac

SEQ ID NO: 14705 - RNA, 22 nt, Homo sapiens
agcgcgcuuucugccucgcugg

SEQ ID NO: 14706 - RNA, 22 nt, Homo sapiens
aaccagccaagaaaguggcugu

SEQ ID NO: 14707 - RNA, 22 nt, Homo sapiens
uccuugaggaugaggauggggc

SEQ ID NO: 14708 - RNA, 22 nt, Homo sapiens
ugcacuccaccucguccugaga

SEQ ID NO: 14709 - RNA, 22 nt, Homo sapiens
uggaucucuggacuucugucug

SEQ ID NO: 14710 - RNA, 22 nt, Homo sapiens
cagcaguccaggugugauccug

SEQ ID NO: 14711 - RNA, 22 nt, Homo sapiens
gcgggcuugcuagcuuucuuga

SEQ ID NO: 14712 - RNA, 22 nt, Homo sapiens
ucugauacuggcaaucuugcca

SEQ ID NO: 14713 - RNA, 22 nt, Homo sapiens
agagagggauuuaauguuaauu

SEQ ID NO: 14714 - RNA, 22 nt, Homo sapiens
uaauauuaaauuccucucucuc

SEQ ID NO: 14715 - RNA, 22 nt, Homo sapiens
gaucccgggaucaaaucgggug

SEQ ID NO: 14716 - RNA, 22 nt, Homo sapiens
ccugauuugauucugggaucuc

SEQ ID NO: 14717 - RNA, 22 nt, Homo sapiens
gaguuugggucacacgugagcu

SEQ ID NO: 14718 - RNA, 22 nt, Homo sapiens
ucaugugugacccaaacugcug

SEQ ID NO: 14719 - RNA, 22 nt, Homo sapiens
gcacaggguuauaucgccagua

SEQ ID NO: 14720 - RNA, 19 nt, Homo sapiens
uggcgauauaaccaugugc

SEQ ID NO: 14721 - RNA, 22 nt, Homo sapiens
cagagucccaggggagcugugg

SEQ ID NO: 14722 - RNA, 22 nt, Homo sapiens
gucuuucuccuggggcugugca

SEQ ID NO: 14723 - RNA, 22 nt, Homo sapiens
uauguucugguucaguauauua

SEQ ID NO: 14724 - RNA, 22 nt, Homo sapiens
uguacugaaccagaauauauga

SEQ ID NO: 14725 - RNA, 22 nt, Homo sapiens
ucagggcagaggccacagagga

SEQ ID NO: 14726 - RNA, 22 nt, Homo sapiens
ucuagacuggcuucugcuguga

SEQ ID NO: 14727 - RNA, 22 nt, Homo sapiens
ggagggggaguuagagaggagg

SEQ ID NO: 14728 - RNA, 19 nt, Homo sapiens
uauuucugauuccacuucu

SEQ ID NO: 14729 - RNA, 22 nt, Homo sapiens
cacuugugugggugugaaggcg

SEQ ID NO: 14730 - RNA, 21 nt, Homo sapiens
ugagccacacccacaagagug

SEQ ID NO: 14731 - RNA, 22 nt, Homo sapiens
ucagcugccucugcuaugaccc

SEQ ID NO: 14732 - RNA, 22 nt, Homo sapiens
ucuggcauccugggggcagugg

SEQ ID NO: 14733 - RNA, 22 nt, Homo sapiens
ggaggcagagccagguccuccc

SEQ ID NO: 14734 - RNA, 22 nt, Homo sapiens
auguccugagcgucugucuugc

SEQ ID NO: 14735 - RNA, 22 nt, Homo sapiens
aggccucaguuggucauaaccu

SEQ ID NO: 14736 - RNA, 22 nt, Homo sapiens
aguccaugacacugaggccuga

SEQ ID NO: 14737 - RNA, 22 nt, Homo sapiens
ucaauuuuucuguggcuuaugu

SEQ ID NO: 14738 - RNA, 22 nt, Homo sapiens
ucaggccaucccagauaauuga

SEQ ID NO: 14739 - RNA, 22 nt, Homo sapiens
ugagugauaauagggucgugac

SEQ ID NO: 14740 - RNA, 22 nt, Homo sapiens
ccauguuccuugcauugucauc

SEQ ID NO: 14741 - RNA, 22 nt, Homo sapiens
ccgguucucccaagcccagcuc

SEQ ID NO: 14742 - RNA, 22 nt, Homo sapiens
agcuggguuugggauuugguga

SEQ ID NO: 14743 - RNA, 22 nt, Homo sapiens
uggcacagugcccccagcaagg

SEQ ID NO: 14744 - RNA, 22 nt, Homo sapiens
ugcuggugggcauaggugccag

SEQ ID NO: 14745 - RNA, 22 nt, Homo sapiens
gagcagggaccaggcgcuguga

SEQ ID NO: 14746 - RNA, 22 nt, Homo sapiens
uccagcuccuagcccuguugcc

SEQ ID NO: 14747 - RNA, 22 nt, Homo sapiens
uggcaaauaccaucugagauga

SEQ ID NO: 14748 - RNA, 22 nt, Homo sapiens
uguuucagauguauuugauagg

SEQ ID NO: 14749 - RNA, 22 nt, Homo sapiens
ugggguccauaccugcagcaag

SEQ ID NO: 14750 - RNA, 22 nt, Homo sapiens
uugcuguagggugacuccaagc

SEQ ID NO: 14751 - RNA, 22 nt, Homo sapiens
ugagcucuuguaaggugccaua

SEQ ID NO: 14752 - RNA, 22 nt, Homo sapiens
uggugccuugaaagagcugauu

SEQ ID NO: 14753 - RNA, 22 nt, Homo sapiens
ucagggaugcaggguguugguu

SEQ ID NO: 14754 - RNA, 22 nt, Homo sapiens
ccaggcugcacccugcuuuccu

SEQ ID NO: 14755 - RNA, 22 nt, Homo sapiens
acaguaggugccuacuaaacag

SEQ ID NO: 14756 - RNA, 22 nt, Homo sapiens
uuuagugagcaccugcugcaug

SEQ ID NO: 14757 - RNA, 22 nt, Homo sapiens
cccaggucugggguuggcucag

SEQ ID NO: 14758 - RNA, 22 nt, Homo sapiens
ugcaggcugagcuuaggcuggg

SEQ ID NO: 14759 - RNA, 22 nt, Homo sapiens
ugaccugugagggguugacagc

SEQ ID NO: 14760 - RNA, 22 nt, Homo sapiens
uggccugugccccagcagguga

SEQ ID NO: 14761 - RNA, 22 nt, Homo sapiens
uggguauauaguggcuuuccau

SEQ ID NO: 14762 - RNA, 22 nt, Homo sapiens
ugaaggaggucauuuauaccaa

SEQ ID NO: 14763 - RNA, 22 nt, Homo sapiens
ugggauuuucugccugagggug

SEQ ID NO: 14764 - RNA, 22 nt, Homo sapiens
acuccggcaggcuggaggugcc

SEQ ID NO: 14765 - RNA, 22 nt, Homo sapiens
ugucuugguaccucuuugaagu

SEQ ID NO: 14766 - RNA, 22 nt, Homo sapiens
uucaaaagcgguccaggaagau

SEQ ID NO: 14767 - RNA, 22 nt, Homo sapiens
ugagauacuauuggggagcaug

SEQ ID NO: 14768 - RNA, 22 nt, Homo sapiens
uguccccagaagggucucaggc

SEQ ID NO: 14769 - RNA, 22 nt, Homo sapiens
ccugcccagcccuccugcucug

SEQ ID NO: 14770 - RNA, 22 nt, Homo sapiens
aggcaggggcuggugcugggcg

SEQ ID NO: 14771 - RNA, 22 nt, Homo sapiens
caaugccuggcacauauuaggc

SEQ ID NO: 14772 - RNA, 22 nt, Homo sapiens
ugguaugugccaggcacuguuu

SEQ ID NO: 14773 - RNA, 22 nt, Homo sapiens
ggaggccgccugcaguuggcgc

SEQ ID NO: 14774 - RNA, 22 nt, Homo sapiens
ugccagccgcaaugccggccuc

SEQ ID NO: 14775 - RNA, 22 nt, Homo sapiens
uggcugcaaagggaacugguga

SEQ ID NO: 14776 - RNA, 22 nt, Homo sapiens
auauucaguuccccuuuguggc

SEQ ID NO: 14777 - RNA, 22 nt, Homo sapiens
gcagagccuaggccuuggaguc

SEQ ID NO: 14778 - RNA, 22 nt, Homo sapiens
ucacagggccuuggccuccucu

SEQ ID NO: 14779 - RNA, 22 nt, Homo sapiens
ucaggugacaaugucaggagcu

SEQ ID NO: 14780 - RNA, 22 nt, Homo sapiens
caccugacauugucaucugaga

SEQ ID NO: 14781 - RNA, 22 nt, Homo sapiens
ugcuguauuuugaaaaauuagg

SEQ ID NO: 14782 - RNA, 22 nt, Homo sapiens
cuaauuggcaaaagcaggacaa

SEQ ID NO: 14783 - RNA, 22 nt, Homo sapiens
ugaggccaccaggguacuauuc

SEQ ID NO: 14784 - RNA, 22 nt, Homo sapiens
ugguacccuggugacuuagaga

SEQ ID NO: 14785 - RNA, 22 nt, Homo sapiens
uuuaaugaggucucucgcuggc

SEQ ID NO: 14786 - RNA, 22 nt, Homo sapiens
ccuugagagacccggagagagg

SEQ ID NO: 14787 - RNA, 22 nt, Homo sapiens
ucaggugacaaugucaggagcu

SEQ ID NO: 14788 - RNA, 22 nt, Homo sapiens
caccugacauugucaucugaga

SEQ ID NO: 14789 - RNA, 22 nt, Homo sapiens
ugcagcccaguggugagguggg

SEQ ID NO: 14790 - RNA, 20 nt, Homo sapiens
ccucucuccgugggaugcag

SEQ ID NO: 14791 - RNA, 22 nt, Homo sapiens
uuacauccauaggcucugcuuc

SEQ ID NO: 14792 - RNA, 22 nt, Homo sapiens
agcagagccuauggagguauua

SEQ ID NO: 14793 - RNA, 22 nt, Homo sapiens
uagugcuucuggcauuucagag

SEQ ID NO: 14794 - RNA, 19 nt, Homo sapiens
uugaagccugaaggacugu

SEQ ID NO: 14795 - RNA, 22 nt, Homo sapiens
ccagggagguuaaguagcuugc

SEQ ID NO: 14796 - RNA, 19 nt, Homo sapiens
cgagccaccaccugccugg

SEQ ID NO: 14797 - RNA, 22 nt, Homo sapiens
ugagggaucaggaucuucuuuc

SEQ ID NO: 14798 - RNA, 22 nt, Homo sapiens
agcagauguuggucccuuuaga

SEQ ID NO: 14799 - RNA, 22 nt, Homo sapiens
ucuuuuguaaugacccuaacag

SEQ ID NO: 14800 - RNA, 22 nt, Homo sapiens
uauuuaggagucauuauuggag

SEQ ID NO: 14801 - RNA, 22 nt, Homo sapiens
ggaggcuguuguggagagggcc

SEQ ID NO: 14802 - RNA, 22 nt, Homo sapiens
cccagagucacgugguuuuuug

SEQ ID NO: 14803 - RNA, 22 nt, Homo sapiens
ccugcuaugccaacauauugcc

SEQ ID NO: 14804 - RNA, 21 nt, Homo sapiens
ggcaagaugcuggcauagcug

SEQ ID NO: 14805 - RNA, 22 nt, Homo sapiens
ucgcuguugcuaccucuccucg

SEQ ID NO: 14806 - RNA, 22 nt, Homo sapiens
uggggaggggggagcgaagcag

SEQ ID NO: 14807 - RNA, 22 nt, Homo sapiens
ugauugaaguuuugcuagcagg

SEQ ID NO: 14808 - RNA, 22 nt, Homo sapiens
ugggcaguggaauuugagugau

SEQ ID NO: 14809 - RNA, 22 nt, Homo sapiens
aggguuuguuuucgccuucugc

SEQ ID NO: 14810 - RNA, 22 nt, Homo sapiens
aggaggcgaagacacagccugg

SEQ ID NO: 14811 - RNA, 22 nt, Homo sapiens
gccuugccuggcccugggcaga

SEQ ID NO: 14812 - RNA, 20 nt, Homo sapiens
agcagccuggggaggagggc

SEQ ID NO: 14813 - RNA, 22 nt, Homo sapiens
ucucaggaauccucccagggaa

SEQ ID NO: 14814 - RNA, 22 nt, Homo sapiens
uccuugggaaugauuucaggug

SEQ ID NO: 14815 - RNA, 22 nt, Homo sapiens
uuuucaaacuagcaacaccuca

SEQ ID NO: 14816 - RNA, 22 nt, Homo sapiens
ggugcugcuaguuugaaagggc

SEQ ID NO: 14817 - RNA, 22 nt, Homo sapiens
gccuucccugcugagagcugcu

SEQ ID NO: 14818 - RNA, 22 nt, Homo sapiens
gcuuuggcucuagcagacagga

SEQ ID NO: 14819 - RNA, 22 nt, Homo sapiens
ucagggcucugccacaggggcu

SEQ ID NO: 14820 - RNA, 22 nt, Homo sapiens
ccuugucaguaggaacccugau

SEQ ID NO: 14821 - RNA, 22 nt, Homo sapiens
caucuguggaagugggagagaa

SEQ ID NO: 14822 - RNA, 22 nt, Homo sapiens
ucucugccuacuucacagagau

SEQ ID NO: 14823 - RNA, 22 nt, Homo sapiens
ucuggccacccgcggugcagca

SEQ ID NO: 14824 - RNA, 22 nt, Homo sapiens
ugggcuggggguggcaggcagc

SEQ ID NO: 14825 - RNA, 22 nt, Homo sapiens
uggaggaagcauggaauuugga

SEQ ID NO: 14826 - RNA, 22 nt, Homo sapiens
ucgaaucccugcuucuucacug

SEQ ID NO: 14827 - RNA, 22 nt, Homo sapiens
ugcaccuccaccaacaauucac

SEQ ID NO: 14828 - RNA, 22 nt, Homo sapiens
ugggguuuggugaagguucacu

SEQ ID NO: 14829 - RNA, 22 nt, Homo sapiens
aagggggauggugguggugagg

SEQ ID NO: 14830 - RNA, 22 nt, Homo sapiens
uggccauucaccagcuccucag

SEQ ID NO: 14831 - RNA, 22 nt, Homo sapiens
uaggugguuccccacgggggca

SEQ ID NO: 14832 - RNA, 22 nt, Homo sapiens
uuucccugggucuggagugccc

SEQ ID NO: 14833 - RNA, 22 nt, Homo sapiens
caggcugcuguaagccuugcaa

SEQ ID NO: 14834 - RNA, 22 nt, Homo sapiens
ugaaggcugaagcagccugugg

SEQ ID NO: 14835 - RNA, 22 nt, Homo sapiens
caggcugcuguaagccuugcaa

SEQ ID NO: 14836 - RNA, 22 nt, Homo sapiens
ugaaggcugaagcagcgugugg

SEQ ID NO: 14837 - RNA, 22 nt, Homo sapiens
uggaguggggucaggggagggc

SEQ ID NO: 14838 - RNA, 22 nt, Homo sapiens
cucuucuugggccuccugcacc

SEQ ID NO: 14839 - RNA, 22 nt, Homo sapiens
ugugacccuccaaagggaagaa

SEQ ID NO: 14840 - RNA, 19 nt, Homo sapiens
aacgcacuucccuuuagag

SEQ ID NO: 14841 - RNA, 20 nt, Homo sapiens
aacgcacuucccuuuagagu

SEQ ID NO: 14842 - RNA, 22 nt, Homo sapiens
aacgcacuucccuuuagagugu

SEQ ID NO: 14843 - RNA, 22 nt, Homo sapiens
ucuccaaagggaagaauuuucu

SEQ ID NO: 14844 - RNA, 19 nt, Homo sapiens
aacgcacuucccuuuagag

SEQ ID NO: 14845 - RNA, 20 nt, Homo sapiens
aacgcacuucccuuuagagu

SEQ ID NO: 14846 - RNA, 22 nt, Homo sapiens
aacgcacuucccuuuagagugu

SEQ ID NO: 14847 - RNA, 22 nt, Homo sapiens
gcacccgcauguccugguccuu

SEQ ID NO: 14848 - RNA, 22 nt, Homo sapiens
gcggccaggacagagguggagg

SEQ ID NO: 14849 - RNA, 22 nt, Homo sapiens
gcacccgcauguccugguccuu

SEQ ID NO: 14850 - RNA, 22 nt, Homo sapiens
gcggccaggacagagguggagg

SEQ ID NO: 14851 - RNA, 22 nt, Homo sapiens
uccacccugucccaggcccugu

SEQ ID NO: 14852 - RNA, 22 nt, Homo sapiens
cuaaaggcaaugagauugggug

SEQ ID NO: 14853 - RNA, 22 nt, Homo sapiens
uagauuuguugccuuuccugga

SEQ ID NO: 14854 - RNA, 22 nt, Homo sapiens
uccuggagagaaggaaacaaau

SEQ ID NO: 14855 - RNA, 20 nt, Homo sapiens
uuugccaaaugcgagaugag

SEQ ID NO: 14856 - RNA, 22 nt, Homo sapiens
ugaggagcugggagagagaaug

SEQ ID NO: 14857 - RNA, 22 nt, Homo sapiens
acucucucuccugcuucaucag

SEQ ID NO: 14858 - RNA, 22 nt, Homo sapiens
ugagguugaguguguacauuua

SEQ ID NO: 14859 - RNA, 22 nt, Homo sapiens
uggguguauucauucaccugcu

SEQ ID NO: 14860 - RNA, 22 nt, Homo sapiens
caaucgaggaagacuuccuggu

SEQ ID NO: 14861 - RNA, 22 nt, Homo sapiens
uaggaagucuuccuugguugca

SEQ ID NO: 14862 - RNA, 22 nt, Homo sapiens
aaauaugccuauaggaaucaaa

SEQ ID NO: 14863 - RNA, 22 nt, Homo sapiens
uagaugcuuauaggcauauuag

SEQ ID NO: 14864 - RNA, 22 nt, Homo sapiens
ucugugucuguuggucuuacuu

SEQ ID NO: 14865 - RNA, 22 nt, Homo sapiens
agggagaccaaccuugcagaua

SEQ ID NO: 14866 - RNA, 22 nt, Homo sapiens
ucucucuguuggcuucugugcu

SEQ ID NO: 14867 - RNA, 22 nt, Homo sapiens
gcacgggagcaccaagagggca

SEQ ID NO: 14868 - RNA, 22 nt, Homo sapiens
aagguggagaugagaggcuucu

SEQ ID NO: 14869 - RNA, 22 nt, Homo sapiens
agugccuuuucccuacugccuc

SEQ ID NO: 14870 - RNA, 22 nt, Homo sapiens
uggacaagugugguugugagau

SEQ ID NO: 14871 - RNA, 22 nt, Homo sapiens
cauuaacaaucuaugcuuccug

SEQ ID NO: 14872 - RNA, 22 nt, Homo sapiens
aggucuuggaagauguugcacc

SEQ ID NO: 14873 - RNA, 22 nt, Homo sapiens
ggucaguuuccuccaggaucca

SEQ ID NO: 14874 - RNA, 22 nt, Homo sapiens
uuugugugguuugacagcuaug

SEQ ID NO: 14875 - RNA, 22 nt, Homo sapiens
uagugauuaaaccuccauaaau

SEQ ID NO: 14876 - RNA, 22 nt, Homo sapiens
gagaugauaaaaaguuuuguau

SEQ ID NO: 14877 - RNA, 22 nt, Homo sapiens
caaagcuuugagucagcaucuu

SEQ ID NO: 14878 - RNA, 22 nt, Homo sapiens
ucccagggucugagagucccaa

SEQ ID NO: 14879 - RNA, 22 nt, Homo sapiens
uagggaucugagacuugggggu

SEQ ID NO: 14880 - RNA, 22 nt, Homo sapiens
ucuugacagcuucauuuucagg

SEQ ID NO: 14881 - RNA, 21 nt, Homo sapiens
aaaauugagcugcccaaagag

SEQ ID NO: 14882 - RNA, 22 nt, Homo sapiens
uccaugcugugcaucuugauga

SEQ ID NO: 14883 - RNA, 22 nt, Homo sapiens
acaaggguggcacaguggggga

SEQ ID NO: 14884 - RNA, 22 nt, Homo sapiens
uucugccucugaccuggagggg

SEQ ID NO: 14885 - RNA, 22 nt, Homo sapiens
aguacccugaaggaggggcagg

SEQ ID NO: 14886 - RNA, 22 nt, Homo sapiens
ugaggggcagaaugugaucagg

SEQ ID NO: 14887 - RNA, 22 nt, Homo sapiens
cccugguuuguacucccccacc

SEQ ID NO: 14888 - RNA, 22 nt, Homo sapiens
cuggcccucucugcccuuccgu

SEQ ID NO: 14889 - RNA, 22 nt, Homo sapiens
ggggggcaggaggggcucaggg

SEQ ID NO: 14890 - RNA, 22 nt, Homo sapiens
uucacggaaaauugaaggcuug

SEQ ID NO: 14891 - RNA, 22 nt, Homo sapiens
acacaguaacaauuuuccgcua

SEQ ID NO: 14892 - RNA, 22 nt, Homo sapiens
cgugcuuaaaaacacagagagu

SEQ ID NO: 14893 - RNA, 22 nt, Homo sapiens
ucucuggucauugagcauaucc

SEQ ID NO: 14894 - RNA, 22 nt, Homo sapiens
cccgacaucuccugcccacuuc

SEQ ID NO: 14895 - RNA, 22 nt, Homo sapiens
gcagguggggaggagaagggga

SEQ ID NO: 14896 - RNA, 22 nt, Homo sapiens
uuucccucagagcuugaaggcu

SEQ ID NO: 14897 - RNA, 22 nt, Homo sapiens
caacaagucuggggagaaaagg

SEQ ID NO: 14898 - RNA, 22 nt, Homo sapiens
uggaggcuggggagcgagccug

SEQ ID NO: 14899 - RNA, 22 nt, Homo sapiens
gucgcucccuccagcugcagga

SEQ ID NO: 14900 - RNA, 22 nt, Homo sapiens
ggcccaccuuccccgguguaca

SEQ ID NO: 14901 - RNA, 22 nt, Homo sapiens
uauauuccagaggguagggcug

SEQ ID NO: 14902 - RNA, 22 nt, Homo sapiens
caggccauauugugcugccuca

SEQ ID NO: 14903 - RNA, 22 nt, Homo sapiens
uagcagcacauaaugguuugug

SEQ ID NO: 14904 - RNA, 22 nt, Homo sapiens
ugaagauguagugaugggaauu

SEQ ID NO: 14905 - RNA, 21 nt, Homo sapiens
ucuccuucaucucugcuuuac

SEQ ID NO: 14906 - RNA, 22 nt, Homo sapiens
ccagguaguggucuguggcuac

SEQ ID NO: 14907 - RNA, 22 nt, Homo sapiens
cuacugucugcuuccacugccu

SEQ ID NO: 14908 - RNA, 22 nt, Homo sapiens
aggaggccugcaccuuaagugg

SEQ ID NO: 14909 - RNA, 22 nt, Homo sapiens
aagugagucuguggguuccccu

SEQ ID NO: 14910 - RNA, 22 nt, Homo sapiens
aaauugcuguugugccgcaguc

SEQ ID NO: 14911 - RNA, 22 nt, Homo sapiens
ugagugcacagauagcaauaag

SEQ ID NO: 14912 - RNA, 22 nt, Homo sapiens
ugugugugugugugcaaugggu

SEQ ID NO: 14913 - RNA, 22 nt, Homo sapiens
cccacacgcauuuauauacagu

SEQ ID NO: 14914 - RNA, 22 nt, Homo sapiens
uucuucauagugccacuuccuu

SEQ ID NO: 14915 - RNA, 22 nt, Homo sapiens
gaaagagaaguggacgaugagg

SEQ ID NO: 14916 - RNA, 22 nt, Homo sapiens
caggcgucugucuacguggcuu

SEQ ID NO: 14917 - RNA, 22 nt, Homo sapiens
gucacgcggagagauggcuuug

SEQ ID NO: 14918 - RNA, 22 nt, Homo sapiens
gcccugcucccuccauuccccg

SEQ ID NO: 14919 - RNA, 15 nt, Homo sapiens
gggagaggggagggc

SEQ ID NO: 14920 - RNA, 22 nt, Homo sapiens
gaagcaugaaagcuuaggcaac

SEQ ID NO: 14921 - RNA, 22 nt, Homo sapiens
ugccccaggucuuuauucuugc

SEQ ID NO: 14922 - RNA, 22 nt, Homo sapiens
acuggaauauugauuuuucagu

SEQ ID NO: 14923 - RNA, 22 nt, Homo sapiens
uguaaaaaucaauauuucagua

SEQ ID NO: 14924 - RNA, 22 nt, Homo sapiens
uggaugccugcuggaugaugaa

SEQ ID NO: 14925 - RNA, 21 nt, Homo sapiens
ucuucacaucuacagaguuca

SEQ ID NO: 14926 - RNA, 22 nt, Homo sapiens
uuagcucuuggaguugcugaaa

SEQ ID NO: 14927 - RNA, 22 nt, Homo sapiens
ucugcaauuccacaagcugacu

SEQ ID NO: 14928 - RNA, 22 nt, Homo sapiens
agagagacugggugguugaggg

SEQ ID NO: 14929 - RNA, 22 nt, Homo sapiens
cucuccucguccuguuucuuuu

SEQ ID NO: 14930 - RNA, 22 nt, Homo sapiens
cagaugaaaggaaggcaugauu

SEQ ID NO: 14931 - RNA, 22 nt, Homo sapiens
ucgugccucuccuuuucauuua

SEQ ID NO: 14932 - RNA, 22 nt, Homo sapiens
agggggcggggagcacaugcgg

SEQ ID NO: 14933 - RNA, 22 nt, Homo sapiens
ugugcugggugcucugcucuca

SEQ ID NO: 14934 - RNA, 22 nt, Homo sapiens
gagcagugaagggauuuccuca

SEQ ID NO: 14935 - RNA, 22 nt, Homo sapiens
ucugaggagcucuguucacucu

SEQ ID NO: 14936 - RNA, 22 nt, Homo sapiens
gauguaagugcugaaguucugu

SEQ ID NO: 14937 - RNA, 22 nt, Homo sapiens
gaacugaagguacugucauugu

SEQ ID NO: 14938 - RNA, 22 nt, Homo sapiens
uugguuuucagcuucacuggau

SEQ ID NO: 14939 - RNA, 22 nt, Homo sapiens
uugugacccuggggaccauaug

SEQ ID NO: 14940 - RNA, 22 nt, Homo sapiens
uauggacauaacuggggcgcug

SEQ ID NO: 14941 - RNA, 22 nt, Homo sapiens
agugagccccaguaugucuuaa

SEQ ID NO: 14942 - RNA, 22 nt, Homo sapiens
agggaaaucagaucagugccgu

SEQ ID NO: 14943 - RNA, 22 nt, Homo sapiens
cugcaacucaucuguuuccuuc

SEQ ID NO: 14944 - RNA, 18 nt, Homo sapiens
ugcuuccuuucagagggu

SEQ ID NO: 14945 - RNA, 22 nt, Homo sapiens
uagagaauagggaagagcugug

SEQ ID NO: 14946 - RNA, 22 nt, Homo sapiens
uccagcuucuauuauuuuucuu

SEQ ID NO: 14947 - RNA, 22 nt, Homo sapiens
uaguguacgauggcucccuggc

SEQ ID NO: 14948 - RNA, 22 nt, Homo sapiens
gggaaccaagcguccacugugc

SEQ ID NO: 14949 - RNA, 22 nt, Homo sapiens
uaguguacgauggcucccuggc

SEQ ID NO: 14950 - RNA, 22 nt, Homo sapiens
gggaaccaagcguccacugugc

SEQ ID NO: 14951 - RNA, 22 nt, Homo sapiens
uuacagggcugguuugucaaac

SEQ ID NO: 14952 - RNA, 20 nt, Homo sapiens
acaagaaaccaguuauguaa

SEQ ID NO: 14953 - RNA, 22 nt, Homo sapiens
ucauuuuugugauguugcagcu

SEQ ID NO: 14954 - RNA, 20 nt, Homo sapiens
uugcauagucacaaaaguga

SEQ ID NO: 14955 - RNA, 22 nt, Homo sapiens
ugcucauugcaugggcugugua

SEQ ID NO: 14956 - RNA, 22 nt, Homo sapiens
uacccagagcaugcagugugaa

SEQ ID NO: 14957 - RNA, 22 nt, Homo sapiens
uuggcugacacauuaguuuauu

SEQ ID NO: 14958 - RNA, 22 nt, Homo sapiens
uaaauuucugugccagccaaga

SEQ ID NO: 14959 - RNA, 22 nt, Homo sapiens
uucucccuguuucuuccugcua

SEQ ID NO: 14960 - RNA, 22 nt, Homo sapiens
gcagaggguaggacggggaaag

SEQ ID NO: 14961 - RNA, 22 nt, Homo sapiens
gacucuagcugccaaaggcgcu

SEQ ID NO: 14962 - RNA, 22 nt, Homo sapiens
cgcuuugcucagccaguguaga

SEQ ID NO: 14963 - RNA, 22 nt, Homo sapiens
ugagcuaugcagaugcuuugau

SEQ ID NO: 14964 - RNA, 22 nt, Homo sapiens
uaagacaucugcacuagcuuga

SEQ ID NO: 14965 - RNA, 22 nt, Homo sapiens
uuuauguuauucugauaaugac

SEQ ID NO: 14966 - RNA, 22 nt, Homo sapiens
auucugagaauaacauaaaugc

SEQ ID NO: 14967 - RNA, 22 nt, Homo sapiens
ucucggguucacuccuuuccug

SEQ ID NO: 14968 - RNA, 22 nt, Homo sapiens
ggaagggggugccugagugcca

SEQ ID NO: 14969 - RNA, 22 nt, Homo sapiens
ucauggcuucugucuuggaaac

SEQ ID NO: 14970 - RNA, 22 nt, Homo sapiens
uauuuaagacaggaaccaggag

SEQ ID NO: 14971 - RNA, 22 nt, Homo sapiens
ugaagcggagcaaagguauaag

SEQ ID NO: 14972 - RNA, 22 nt, Homo sapiens
uuucaccuuugcccagcuguug

SEQ ID NO: 14973 - RNA, 22 nt, Homo sapiens
gagaguugagucuggacguccc

SEQ ID NO: 14974 - RNA, 21 nt, Homo sapiens
ugauuguccaaacgcaauucu

SEQ ID NO: 14975 - RNA, 22 nt, Homo sapiens
gggaagagugggaggugaacag

SEQ ID NO: 14976 - RNA, 22 nt, Homo sapiens
uugcugccucccaccuuccucu

SEQ ID NO: 14977 - RNA, 22 nt, Homo sapiens
uuuugggagcuggccguaggca

SEQ ID NO: 14978 - RNA, 22 nt, Homo sapiens
ucugcagucagaggccaggagc

SEQ ID NO: 14979 - RNA, 22 nt, Homo sapiens
uuuucugucagcugccugacag

SEQ ID NO: 14980 - RNA, 22 nt, Homo sapiens
ugucagaggugacaggggccac

SEQ ID NO: 14981 - RNA, 22 nt, Homo sapiens
ucccauaucucguuuccaccaa

SEQ ID NO: 14982 - RNA, 22 nt, Homo sapiens
uggaaacaaaauauuggagcua

SEQ ID NO: 14983 - RNA, 22 nt, Homo sapiens
uaguagcuuguauuaaagagac

SEQ ID NO: 14984 - RNA, 22 nt, Homo sapiens
ucuuuaauacgagcuacuauug

SEQ ID NO: 14985 - RNA, 22 nt, Homo sapiens
ccucggaagauaacuauacaac

SEQ ID NO: 14986 - RNA, 22 nt, Homo sapiens
ugagguaguagguugugugguu

SEQ ID NO: 14987 - RNA, 22 nt, Homo sapiens
cauuuuaaauggcgagaacagu

SEQ ID NO: 14988 - RNA, 22 nt, Homo sapiens
uaagauguaaucucauuuggaa

SEQ ID NO: 14989 - RNA, 22 nt, Homo sapiens
ggaguugaggguguucuugcag

SEQ ID NO: 14990 - RNA, 22 nt, Homo sapiens
ugcccucuuuuccucugagaac

SEQ ID NO: 14991 - RNA, 22 nt, Homo sapiens
uuaauguaccuuauuauuccau

SEQ ID NO: 14992 - RNA, 20 nt, Homo sapiens
gaaucaauaagguacuuaac

SEQ ID NO: 14993 - RNA, 22 nt, Homo sapiens
gcugggaaggcaaagggacguu

SEQ ID NO: 14994 - RNA, 22 nt, Homo sapiens
uucccuuugucauccuaugccu

SEQ ID NO: 14995 - RNA, 22 nt, Homo sapiens
cauuauuguuccuuagaaccau

SEQ ID NO: 14996 - RNA, 22 nt, Homo sapiens
ggaaggaaggaacagucauggg

SEQ ID NO: 14997 - RNA, 22 nt, Homo sapiens
gcacuaacuccaaaagugugga

SEQ ID NO: 14998 - RNA, 22 nt, Homo sapiens
cacacuuuaggaguuaaugcca

SEQ ID NO: 14999 - RNA, 22 nt, Homo sapiens
ugagucauacaggagaaaaaca

SEQ ID NO: 15000 - RNA, 22 nt, Homo sapiens
uuaucaccugggugacucagga

SEQ ID NO: 15001 - RNA, 22 nt, Homo sapiens
uccucuagcauccucaugcccg

SEQ ID NO: 15002 - RNA, 22 nt, Homo sapiens
caggcauggugcugggugcugg

SEQ ID NO: 15003 - RNA, 22 nt, Homo sapiens
uagcauaauuaagucuuauguu

SEQ ID NO: 15004 - RNA, 22 nt, Homo sapiens
cuaauaugcgauuauguuuagg

SEQ ID NO: 15005 - RNA, 22 nt, Homo sapiens
aagaggaacuuaggagcuaaau

SEQ ID NO: 15006 - RNA, 22 nt, Homo sapiens
uuugcuccagaauguucuuuuc

SEQ ID NO: 15007 - RNA, 22 nt, Homo sapiens
ugauuguuuacagcuaagucuc

SEQ ID NO: 15008 - RNA, 22 nt, Homo sapiens
gcugcugguuauguagaaaauu

SEQ ID NO: 15009 - RNA, 22 nt, Homo sapiens
uuuuccacucuguuuaucugac

SEQ ID NO: 15010 - RNA, 22 nt, Homo sapiens
gauaaugagagagugggauauu

SEQ ID NO: 15011 - RNA, 22 nt, Homo sapiens
uggucugugcuucuagguacaa

SEQ ID NO: 15012 - RNA, 22 nt, Homo sapiens
uguauacagaagccauggauug

SEQ ID NO: 15013 - RNA, 22 nt, Homo sapiens
ucuuucgccuucugacuguucu

SEQ ID NO: 15014 - RNA, 21 nt, Homo sapiens
caguccaggaagguguaagag

SEQ ID NO: 15015 - RNA, 22 nt, Homo sapiens
uucuugacugcuuaggaaugca

SEQ ID NO: 15016 - RNA, 22 nt, Homo sapiens
cauucugagcaauuaagaaguu

SEQ ID NO: 15017 - RNA, 22 nt, Homo sapiens
agcuuaaauuucuguuuuuuuu

SEQ ID NO: 15018 - RNA, 22 nt, Homo sapiens
gaagaggagagauugagcugug

SEQ ID NO: 15019 - RNA, 22 nt, Homo sapiens
cagauucgauucuaggggaaua

SEQ ID NO: 15020 - RNA, 22 nt, Homo sapiens
uacccuguagaaccgaauuugu

SEQ ID NO: 15021 - RNA, 22 nt, Homo sapiens
aggagaggggauuuuguuaccu

SEQ ID NO: 15022 - RNA, 22 nt, Homo sapiens
uagguaauauauuuccuccucu

SEQ ID NO: 15023 - RNA, 22 nt, Homo sapiens
ugugugggguuaugugugugug

SEQ ID NO: 15024 - RNA, 22 nt, Homo sapiens
cccccacaccggccccaccacc

SEQ ID NO: 15025 - RNA, 21 nt, Homo sapiens
cuacaaagggaagcacuuucu

SEQ ID NO: 15026 - RNA, 22 nt, Homo sapiens
cuacaaagggaagcacuuucuc

SEQ ID NO: 15027 - RNA, 21 nt, Homo sapiens
gaaggcgcuucccuuuggagu

SEQ ID NO: 15028 - RNA, 22 nt, Homo sapiens
ugguuuuugacauugauauaca

SEQ ID NO: 15029 - RNA, 22 nt, Homo sapiens
uauguuauaugucaagaagcuu

SEQ ID NO: 15030 - RNA, 22 nt, Homo sapiens
ugggcuucguggggaucaagcu

SEQ ID NO: 15031 - RNA, 22 nt, Homo sapiens
gaaucccgaacccugccuagga

SEQ ID NO: 15032 - RNA, 22 nt, Homo sapiens
ugauucucuuuauuuucugcau

SEQ ID NO: 15033 - RNA, 22 nt, Homo sapiens
gcccagaguggagagagacuug

SEQ ID NO: 15034 - RNA, 22 nt, Homo sapiens
ggccaccaggguuccauuuaga

SEQ ID NO: 15035 - RNA, 22 nt, Homo sapiens
uaacugguacucugguagccug

SEQ ID NO: 15036 - RNA, 22 nt, Homo sapiens
gagacugagggcuaccccgggg

SEQ ID NO: 15037 - RNA, 22 nt, Homo sapiens
ucuggcaguagauccagucucu

SEQ ID NO: 15038 - RNA, 22 nt, Homo sapiens
uugggaacauuuugcauguaua

SEQ ID NO: 15039 - RNA, 22 nt, Homo sapiens
uuuuugcgauguguuccuaaua

SEQ ID NO: 15040 - RNA, 20 nt, Homo sapiens
uuuugcgauguguuccuaau

SEQ ID NO: 15041 - RNA, 22 nt, Homo sapiens
uuuugcgauguguuccuaauau

SEQ ID NO: 15042 - RNA, 22 nt, Homo sapiens
uucuccagauggcgagacugug

SEQ ID NO: 15043 - RNA, 22 nt, Homo sapiens
caccucuuccacuggaguguaa

SEQ ID NO: 15044 - RNA, 22 nt, Homo sapiens
ggauggagagaugcagucaagg

SEQ ID NO: 15045 - RNA, 21 nt, Homo sapiens
ugaccucaccucuuccucucc

SEQ ID NO: 15046 - RNA, 22 nt, Homo sapiens
uaaagcaaugagacugauuguc

SEQ ID NO: 15047 - RNA, 23 nt, Homo sapiens
uccgucucaguuacuuuauagcc

SEQ ID NO: 15048 - RNA, 22 nt, Homo sapiens
ucuuccucauccucauccagcu

SEQ ID NO: 15049 - RNA, 22 nt, Homo sapiens
gaugagagugaggaugagaagg

SEQ ID NO: 15050 - RNA, 22 nt, Homo sapiens
ccugucagucugaaagcucaga

SEQ ID NO: 15051 - RNA, 22 nt, Homo sapiens
uggcuacuucaggcuggcaguu

SEQ ID NO: 15052 - RNA, 22 nt, Homo sapiens
uccucauagaauugauagcuuu

SEQ ID NO: 15053 - RNA, 22 nt, Homo sapiens
agauuaucgauuccugaaaggg

SEQ ID NO: 15054 - RNA, 22 nt, Homo sapiens
ugcgugcgcacacgggccugca

SEQ ID NO: 15055 - RNA, 22 nt, Homo sapiens
uauaugcaugugugagugcgcu

SEQ ID NO: 15056 - RNA, 22 nt, Homo sapiens
ucucuucccuuagauguaaaau

SEQ ID NO: 15057 - RNA, 20 nt, Homo sapiens
auuuuacauaaggguagagg

SEQ ID NO: 15058 - RNA, 22 nt, Homo sapiens
uaugguuuggauuugagugauu

SEQ ID NO: 15059 - RNA, 22 nt, Homo sapiens
auuucucucaagcaaaucuaug

SEQ ID NO: 15060 - RNA, 22 nt, Homo sapiens
uggggaggagggugaagacaga

SEQ ID NO: 15061 - RNA, 22 nt, Homo sapiens
aacuucaucuagacucccuggg

SEQ ID NO: 15062 - RNA, 22 nt, Homo sapiens
uuuuauugcuacuguucauuga

SEQ ID NO: 15063 - RNA, 22 nt, Homo sapiens
acgauggacaugcaguacaaca

SEQ ID NO: 15064 - RNA, 22 nt, Homo sapiens
gaaaucuuucuuccuuuucucu

SEQ ID NO: 15065 - RNA, 22 nt, Homo sapiens
gaaauuggagggaggggcauug

SEQ ID NO: 15066 - RNA, 22 nt, Homo sapiens
caucccuugcaugguggagggu

SEQ ID NO: 15067 - RNA, 22 nt, Homo sapiens
cucccacaugcaggguuugcag

SEQ ID NO: 15068 - RNA, 22 nt, Homo sapiens
cgcucuugggggagggauggac

SEQ ID NO: 15069 - RNA, 22 nt, Homo sapiens
caucucuuucucuccacgagcg

SEQ ID NO: 15070 - RNA, 21 nt, Homo sapiens
gagugccuucuuuuggagcgu

SEQ ID NO: 15071 - RNA, 23 nt, Homo sapiens
uucuccaaaagaaagcacuuucu

SEQ ID NO: 15072 - RNA, 24 nt, Homo sapiens
uucuccaaaagaaagcacuuucug

SEQ ID NO: 15073 - RNA, 21 nt, Homo sapiens
gagugccuucuuuuggagcgu

SEQ ID NO: 15074 - RNA, 23 nt, Homo sapiens
uucuccaaaagaaagcacuuucu

SEQ ID NO: 15075 - RNA, 24 nt, Homo sapiens
uucuccaaaagaaagcacuuucug

SEQ ID NO: 15076 - RNA, 22 nt, Homo sapiens
aaagugccuccuuuuagagugu

SEQ ID NO: 15077 - RNA, 23 nt, Homo sapiens
auucuccaaaagggagcacuuuc

SEQ ID NO: 15078 - RNA, 21 nt, Homo sapiens
uucuccaaaagggagcacuuu

SEQ ID NO: 15079 - RNA, 22 nt, Homo sapiens
uucuccaaaagggagcacuuuc

SEQ ID NO: 15080 - RNA, 22 nt, Homo sapiens
gagaauggggccucuuagacuc

SEQ ID NO: 15081 - RNA, 22 nt, Homo sapiens
guccugggauuugcccuuuucu

SEQ ID NO: 15082 - RNA, 22 nt, Homo sapiens
uccaagcagaaucacgugagag

SEQ ID NO: 15083 - RNA, 22 nt, Homo sapiens
ucauguggucauugcuggcccu

SEQ ID NO: 15084 - RNA, 22 nt, Homo sapiens
uggaaaccauagcugucuccug

SEQ ID NO: 15085 - RNA, 22 nt, Homo sapiens
cugggagagaguuccuuucugc

SEQ ID NO: 15086 - RNA, 22 nt, Homo sapiens
ucaguaacaaagauucauccuu

SEQ ID NO: 15087 - RNA, 22 nt, Homo sapiens
aggagaaucuuugucacuuagu

SEQ ID NO: 15088 - RNA, 22 nt, Homo sapiens
uuuuucuagugguugcaugauu

SEQ ID NO: 15089 - RNA, 22 nt, Homo sapiens
uaaaucugcacccacugaaaau

SEQ ID NO: 15090 - RNA, 22 nt, Homo sapiens
ccauuguuucuauuaaaggucu

SEQ ID NO: 15091 - RNA, 21 nt, Homo sapiens
agaccuguaaugaaacauggu

SEQ ID NO: 15092 - RNA, 22 nt, Homo sapiens
aauaacaaaaggaccuuguucu

SEQ ID NO: 15093 - RNA, 22 nt, Homo sapiens
aacaagguccuugaguauaaag

SEQ ID NO: 15094 - RNA, 22 nt, Homo sapiens
ugggauggggguugagaaggag

SEQ ID NO: 15095 - RNA, 20 nt, Homo sapiens
uuccuucucccucucuucua

SEQ ID NO: 15096 - RNA, 22 nt, Homo sapiens
uggcuucgagccuuugcccuga

SEQ ID NO: 15097 - RNA, 22 nt, Homo sapiens
ugggaggcaggggcuggagggc

SEQ ID NO: 15098 - RNA, 22 nt, Homo sapiens
uucuauccuccuguacucauca

SEQ ID NO: 15099 - RNA, 22 nt, Homo sapiens
ugagugcuugauagauagaggu

SEQ ID NO: 15100 - RNA, 21 nt, Homo sapiens
aucacauugccagggauuacc

SEQ ID NO: 15101 - RNA, 22 nt, Homo sapiens
uuggguuccuggcaugcugauu

SEQ ID NO: 15102 - RNA, 22 nt, Homo sapiens
aucacauugccagggauuacca

SEQ ID NO: 15103 - RNA, 22 nt, Homo sapiens
uggccugcacugacuagggcag

SEQ ID NO: 15104 - RNA, 22 nt, Homo sapiens
ccuagcucuagcaaggcuggcc

SEQ ID NO: 15105 - RNA, 22 nt, Homo sapiens
ucaggccuugguaaauccucuc

SEQ ID NO: 15106 - RNA, 22 nt, Homo sapiens
ggggaggccaaggccugggugc

SEQ ID NO: 15107 - RNA, 22 nt, Homo sapiens
ccugcucuuccuucccuauauu

SEQ ID NO: 15108 - RNA, 18 nt, Homo sapiens
aaauggggagaaggcagg

SEQ ID NO: 15109 - RNA, 22 nt, Homo sapiens
gcugcggacaacauggacccaa

SEQ ID NO: 15110 - RNA, 22 nt, Homo sapiens
gggagucugugcugcugagccc

SEQ ID NO: 15111 - RNA, 22 nt, Homo sapiens
uccuggugcaguguuccgaaau

SEQ ID NO: 15112 - RNA, 22 nt, Homo sapiens
ucauuagcaugggcacagggga

SEQ ID NO: 15113 - RNA, 22 nt, Homo sapiens
uggugacucuuauuuccaggua

SEQ ID NO: 15114 - RNA, 22 nt, Homo sapiens
cuggaaaguauggaguuguuac

SEQ ID NO: 15115 - RNA, 22 nt, Homo sapiens
ugcagcugguggagucuggggg

SEQ ID NO: 15116 - RNA, 22 nt, Homo sapiens
ccugagacucuccugugcagcc

SEQ ID NO: 15117 - RNA, 22 nt, Homo sapiens
ugacaugcugggguggggagaa

SEQ ID NO: 15118 - RNA, 22 nt, Homo sapiens
ucuuccugaccgaccaguuguu

SEQ ID NO: 15119 - RNA, 22 nt, Homo sapiens
ggauaaucacacuccuggggua

SEQ ID NO: 15120 - RNA, 22 nt, Homo sapiens
aaucucucaggaguguaauuau

SEQ ID NO: 15121 - RNA, 22 nt, Homo sapiens
uggcgguaguccagcuggggcg

SEQ ID NO: 15122 - RNA, 22 nt, Homo sapiens
ccagcucggaccccugccacgc

SEQ ID NO: 15123 - RNA, 22 nt, Homo sapiens
uugauauuuuaaggucugagac

SEQ ID NO: 15124 - RNA, 22 nt, Homo sapiens
ucagaccuugacuuaucuacug

SEQ ID NO: 15125 - RNA, 22 nt, Homo sapiens
uugauauuuuaaggucugagac

SEQ ID NO: 15126 - RNA, 22 nt, Homo sapiens
ucagaccuugacuuaucuacug

SEQ ID NO: 15127 - RNA, 22 nt, Homo sapiens
uugauauuuuaaggucugagac

SEQ ID NO: 15128 - RNA, 22 nt, Homo sapiens
ucagaccuugacuuaucuacug

SEQ ID NO: 15129 - RNA, 22 nt, Homo sapiens
ugcccuggugaaggccaggguc

SEQ ID NO: 15130 - RNA, 22 nt, Homo sapiens
cugaccacugccaggguaccgg

SEQ ID NO: 15131 - RNA, 22 nt, Homo sapiens
ucugucuuaccugguacuguuu

SEQ ID NO: 15132 - RNA, 22 nt, Homo sapiens
cuaggucccugguagguaugga

SEQ ID NO: 15133 - RNA, 22 nt, Homo sapiens
agcuucuuucauacccccaaau

SEQ ID NO: 15134 - RNA, 22 nt, Homo sapiens
uuuguggguuaaugaaugaguc

SEQ ID NO: 15135 - RNA, 22 nt, Homo sapiens
uauugucuugucuggauccaga

SEQ ID NO: 15136 - RNA, 22 nt, Homo sapiens
uggugaggagugggacgagggc

SEQ ID NO: 15137 - RNA, 22 nt, Homo sapiens
cgugccacuugauagcucuguc

SEQ ID NO: 15138 - RNA, 22 nt, Homo sapiens
uggauggagccaaggcuuggag

SEQ ID NO: 15139 - RNA, 22 nt, Homo sapiens
uuuugucaccauggcaacuggu

SEQ ID NO: 15140 - RNA, 22 nt, Homo sapiens
ucaguugucaugguaacaugau

SEQ ID NO: 15141 - RNA, 22 nt, Homo sapiens
aacugguuguguuagaagcugc

SEQ ID NO: 15142 - RNA, 22 nt, Homo sapiens
gggcuucugguacauucauucu

SEQ ID NO: 15143 - RNA, 22 nt, Homo sapiens
uccgucucccgcuugcaguagg

SEQ ID NO: 15144 - RNA, 22 nt, Homo sapiens
ugugcugcgaguacgagccgga

SEQ ID NO: 15145 - RNA, 22 nt, Homo sapiens
uaaucaugaggcaagacagugu

SEQ ID NO: 15146 - RNA, 22 nt, Homo sapiens
aguucugcugccugaugauucc

SEQ ID NO: 15147 - RNA, 22 nt, Homo sapiens
ugguguaauuaaagugauuucu

SEQ ID NO: 15148 - RNA, 22 nt, Homo sapiens
gaaauuacgaaguuaggccaga

SEQ ID NO: 15149 - RNA, 22 nt, Homo sapiens
uaacuauacaaucuacugucuu

SEQ ID NO: 15150 - RNA, 22 nt, Homo sapiens
ugagguaguagguuguauaguu

SEQ ID NO: 15151 - RNA, 22 nt, Homo sapiens
uucuguccucccaugccagagg

SEQ ID NO: 15152 - RNA, 22 nt, Homo sapiens
cucuggagggaggaaggcaaag

SEQ ID NO: 15153 - RNA, 22 nt, Homo sapiens
ccucagcuguguucuugguauc

SEQ ID NO: 15154 - RNA, 22 nt, Homo sapiens
ugcagaggggacagugggaguc

SEQ ID NO: 15155 - RNA, 22 nt, Homo sapiens
uauucuucuccaagaaggaugc

SEQ ID NO: 15156 - RNA, 22 nt, Homo sapiens
cugccuuucuuugagagagagu

SEQ ID NO: 15157 - RNA, 22 nt, Homo sapiens
uccucuaauuuuccuaagcaca

SEQ ID NO: 15158 - RNA, 22 nt, Homo sapiens
uggauuugaggaguaaggggau

SEQ ID NO: 15159 - RNA, 22 nt, Homo sapiens
gcccuucugaagaguugagcau

SEQ ID NO: 15160 - RNA, 22 nt, Homo sapiens
uguuugucuauauagaaguggu

SEQ ID NO: 15161 - RNA, 22 nt, Homo sapiens
agggccuguuuucccgguggcu

SEQ ID NO: 15162 - RNA, 22 nt, Homo sapiens
cccccggguaaagcagcccaug

SEQ ID NO: 15163 - RNA, 22 nt, Homo sapiens
agggccuguuuucccgguggcu

SEQ ID NO: 15164 - RNA, 22 nt, Homo sapiens
cccccggguaaagcagcccaug

SEQ ID NO: 15165 - RNA, 22 nt, Homo sapiens
agggccuguuuucccgguggcu

SEQ ID NO: 15166 - RNA, 22 nt, Homo sapiens
cccccggguaaagcagcccaug

SEQ ID NO: 15167 - RNA, 22 nt, Homo sapiens
agggccuguuuucccgguggcu

SEQ ID NO: 15168 - RNA, 22 nt, Homo sapiens
cccccggguaaagcagcccaug

SEQ ID NO: 15169 - RNA, 22 nt, Homo sapiens
agggccuguuuucccgguggcu

SEQ ID NO: 15170 - RNA, 22 nt, Homo sapiens
cccccggguaaagcagcccaug

SEQ ID NO: 15171 - RNA, 22 nt, Homo sapiens
agggccuguuuucccgguggcu

SEQ ID NO: 15172 - RNA, 22 nt, Homo sapiens
cccccggguaaagcagcccaug

SEQ ID NO: 15173 - RNA, 22 nt, Homo sapiens
agggccuguuuucccgguggcu

SEQ ID NO: 15174 - RNA, 22 nt, Homo sapiens
cccccggguaaagcagcccaug

SEQ ID NO: 15175 - RNA, 22 nt, Homo sapiens
agggccuguuuucccgguggcu

SEQ ID NO: 15176 - RNA, 22 nt, Homo sapiens
cccccggguaaagcagcccaug

SEQ ID NO: 15177 - RNA, 22 nt, Homo sapiens
uagagguggagcgaaguggggc

SEQ ID NO: 15178 - RNA, 22 nt, Homo sapiens
ccacuuccugcuccucccuccc

SEQ ID NO: 15179 - RNA, 22 nt, Homo sapiens
ggaaaugcuaaguuauuuauag

SEQ ID NO: 15180 - RNA, 22 nt, Homo sapiens
ugcuacaaauagcuuagcaucu

SEQ ID NO: 15181 - RNA, 22 nt, Homo sapiens
agcccccauuugugaaggugcu

SEQ ID NO: 15182 - RNA, 22 nt, Homo sapiens
ugagguacucacaaauggggcu

SEQ ID NO: 15183 - RNA, 22 nt, Homo sapiens
ugugucucuugggauaauccag

SEQ ID NO: 15184 - RNA, 22 nt, Homo sapiens
uuuuauguuaucccccagagaa

SEQ ID NO: 15185 - RNA, 22 nt, Homo sapiens
gcacaugugagggauauuaucu

SEQ ID NO: 15186 - RNA, 22 nt, Homo sapiens
gaaauuaauauugcucacuugc

SEQ ID NO: 15187 - RNA, 22 nt, Homo sapiens
cagacacuguaggugagagcug

SEQ ID NO: 15188 - RNA, 22 nt, Homo sapiens
cagcuuucacacagugcucuag

SEQ ID NO: 15189 - RNA, 21 nt, Homo sapiens
ccacaccguaucugacacuuu

SEQ ID NO: 15190 - RNA, 22 nt, Homo sapiens
ugaagguguucaugaugcgguc

SEQ ID NO: 15191 - RNA, 22 nt, Homo sapiens
ccauauuuuuuaaaguguuguc

SEQ ID NO: 15192 - RNA, 22 nt, Homo sapiens
cauuccugcucgaaaagaugug

SEQ ID NO: 15193 - RNA, 22 nt, Homo sapiens
cagcuuggcuaaagugauaggc

SEQ ID NO: 15194 - RNA, 18 nt, Homo sapiens
gccuuucauuuccaguug

SEQ ID NO: 15195 - RNA, 22 nt, Homo sapiens
agaggugguccguggcgcguuc

SEQ ID NO: 15196 - RNA, 22 nt, Homo sapiens
gcacauuacacggucgaccucu

SEQ ID NO: 15197 - RNA, 22 nt, Homo sapiens
uuaucuuggaacuugguauggg

SEQ ID NO: 15198 - RNA, 22 nt, Homo sapiens
cugcuaagccucuaaggugaga

SEQ ID NO: 15199 - RNA, 22 nt, Homo sapiens
gagaauaggauggaaaggggug

SEQ ID NO: 15200 - RNA, 19 nt, Homo sapiens
ccuuuucacauguuuucuc

SEQ ID NO: 15201 - RNA, 22 nt, Homo sapiens
ucagugagucugggggugugug

SEQ ID NO: 15202 - RNA, 22 nt, Homo sapiens
cauauccccggauuuucuagug

SEQ ID NO: 15203 - RNA, 22 nt, Homo sapiens
ucuauggggacugauguccuga

SEQ ID NO: 15204 - RNA, 22 nt, Homo sapiens
ccagacaucagugcccguggca

SEQ ID NO: 15205 - RNA, 22 nt, Homo sapiens
uccgguuaaccaccuuggagac

SEQ ID NO: 15206 - RNA, 22 nt, Homo sapiens
uccaacgguguguuauuagguu

SEQ ID NO: 15207 - RNA, 22 nt, Homo sapiens
acucaaaaugggggcgcuuucc

SEQ ID NO: 15208 - RNA, 23 nt, Homo sapiens
gaagugcuucgauuuuggggugu

SEQ ID NO: 15209 - RNA, 22 nt, Homo sapiens
acaaagugcuucccuuuagagu

SEQ ID NO: 15210 - RNA, 24 nt, Homo sapiens
acaaagugcuucccuuuagagugu

SEQ ID NO: 15211 - RNA, 23 nt, Homo sapiens
caaagugccucccuuuagagugu

SEQ ID NO: 15212 - RNA, 22 nt, Homo sapiens
acaaagugcuucccuuuagagu

SEQ ID NO: 15213 - RNA, 22 nt, Homo sapiens
ugguggcuuuggcgcugguggc

SEQ ID NO: 15214 - RNA, 22 nt, Homo sapiens
cccggagcugaagccucucugu

SEQ ID NO: 15215 - RNA, 22 nt, Homo sapiens
uggugaucaggucugaacaggg

SEQ ID NO: 15216 - RNA, 21 nt, Homo sapiens
uuccucucaggcuuucccacu

SEQ ID NO: 15217 - RNA, 22 nt, Homo sapiens
uaauuuuuucacacuggcaccc

SEQ ID NO: 15218 - RNA, 20 nt, Homo sapiens
gguguuaguccuaacaauua

SEQ ID NO: 15219 - RNA, 22 nt, Homo sapiens
aaguacauguugcucaacagcc

SEQ ID NO: 15220 - RNA, 22 nt, Homo sapiens
gguugacagcagcaugaacuac

SEQ ID NO: 15221 - RNA, 22 nt, Homo sapiens
uaggugaauucuagggucaaua

SEQ ID NO: 15222 - RNA, 22 nt, Homo sapiens
ucaugcucuagaauaaaccuaa

SEQ ID NO: 15223 - RNA, 22 nt, Homo sapiens
aguuuaggugaauucuaggguc

SEQ ID NO: 15224 - RNA, 22 nt, Homo sapiens
ucuagaauaaaccuaaauuuuu

SEQ ID NO: 15225 - RNA, 22 nt, Homo sapiens
ucaggauguaguuucaagggug

SEQ ID NO: 15226 - RNA, 22 nt, Homo sapiens
ccuucuuugaaacucgcugauu

SEQ ID NO: 15227 - RNA, 22 nt, Homo sapiens
ugacauuguuguugcucugcug

SEQ ID NO: 15228 - RNA, 22 nt, Homo sapiens
gcacagcacagcggugacucag

SEQ ID NO: 15229 - RNA, 22 nt, Homo sapiens
uagagcaauguguaggagaggc

SEQ ID NO: 15230 - RNA, 22 nt, Homo sapiens
cugcuuaaacacaugcuuucug

SEQ ID NO: 15231 - RNA, 22 nt, Homo sapiens
uggagggugugaauugaagauu

SEQ ID NO: 15232 - RNA, 22 nt, Homo sapiens
ucuuuuccucacuccuuccuuc

SEQ ID NO: 15233 - RNA, 22 nt, Homo sapiens
cuguacaaccuucuagcuuucc

SEQ ID NO: 15234 - RNA, 22 nt, Homo sapiens
ugagguaguagguuguaugguu

SEQ ID NO: 15235 - RNA, 22 nt, Homo sapiens
ugcugaggggcagagaucagac

SEQ ID NO: 15236 - RNA, 22 nt, Homo sapiens
acugguaucucuuccucugggu

SEQ ID NO: 15237 - RNA, 22 nt, Homo sapiens
ggcuuucccugagggaagguag

SEQ ID NO: 15238 - RNA, 22 nt, Homo sapiens
uuugccuucccagggaucggcc

SEQ ID NO: 15239 - RNA, 22 nt, Homo sapiens
ucugucucuccuugcuuuucuc

SEQ ID NO: 15240 - RNA, 22 nt, Homo sapiens
gagaggaaggacggacacagga

SEQ ID NO: 15241 - RNA, 22 nt, Homo sapiens
uauauaaauccuuucagacuac

SEQ ID NO: 15242 - RNA, 22 nt, Homo sapiens
uuugaaagaauuuauguacuuu

SEQ ID NO: 15243 - RNA, 22 nt, Homo sapiens
agcauuuucugccugggugcua

SEQ ID NO: 15244 - RNA, 22 nt, Homo sapiens
gaaaucaagguugaauugugcu

SEQ ID NO: 15245 - RNA, 22 nt, Homo sapiens
ggagagcccucagugugacccc

SEQ ID NO: 15246 - RNA, 22 nt, Homo sapiens
guuucagcacugaggaguuuuc

SEQ ID NO: 15247 - RNA, 23 nt, Homo sapiens
caucuggagguaagaagcacuuu

SEQ ID NO: 15248 - RNA, 18 nt, Homo sapiens
ugcuuccuuucagagggu

SEQ ID NO: 15249 - RNA, 22 nt, Homo sapiens
cuccuacauauuagcauuaaca

SEQ ID NO: 15250 - RNA, 22 nt, Homo sapiens
uuaaugcuaaucgugauagggg

SEQ ID NO: 15251 - RNA, 22 nt, Homo sapiens
ucccagcuuaguauuauuuuua

SEQ ID NO: 15252 - RNA, 22 nt, Homo sapiens
uagaaauaaugcugaaugguga

SEQ ID NO: 15253 - RNA, 22 nt, Homo sapiens
ggcaguggaagcugucugaggc

SEQ ID NO: 15254 - RNA, 21 nt, Homo sapiens
ucaugcaguuucuuaucugcc

SEQ ID NO: 15255 - RNA, 22 nt, Homo sapiens
uauauauccugcagcucaugcu

SEQ ID NO: 15256 - RNA, 22 nt, Homo sapiens
uaugggucgggauauauuuagu

SEQ ID NO: 15257 - RNA, 22 nt, Homo sapiens
uugcauccauguuaaagaggaa

SEQ ID NO: 15258 - RNA, 22 nt, Homo sapiens
uccuuuggggaauggaaacaau

SEQ ID NO: 15259 - RNA, 22 nt, Homo sapiens
uuuaaugggauuggcagauugc

SEQ ID NO: 15260 - RNA, 20 nt, Homo sapiens
ugccaacucucuucuuugag

SEQ ID NO: 15261 - RNA, 22 nt, Homo sapiens
cauacucuuagagacugggguc

SEQ ID NO: 15262 - RNA, 22 nt, Homo sapiens
gcccagcucuuucagggagugu

SEQ ID NO: 15263 - RNA, 22 nt, Homo sapiens
cccugggcgcucagcaguucug

SEQ ID NO: 15264 - RNA, 22 nt, Homo sapiens
aggagcggggcagccugagggu

SEQ ID NO: 15265 - RNA, 22 nt, Homo sapiens
cccugggcgcucagcaguucug

SEQ ID NO: 15266 - RNA, 22 nt, Homo sapiens
aggagcggggcagccugagggu

SEQ ID NO: 15267 - RNA, 22 nt, Homo sapiens
cccugggcgcucagcaguucug

SEQ ID NO: 15268 - RNA, 22 nt, Homo sapiens
aggagcggggcagccugagggu

SEQ ID NO: 15269 - RNA, 22 nt, Homo sapiens
cccugggcgcucagcaguucug

SEQ ID NO: 15270 - RNA, 22 nt, Homo sapiens
aggagcggggcagccugagggu

SEQ ID NO: 15271 - RNA, 22 nt, Homo sapiens
cccugggcgcucagcaguucug

SEQ ID NO: 15272 - RNA, 22 nt, Homo sapiens
aggagcggggcagccugagggu

SEQ ID NO: 15273 - RNA, 22 nt, Homo sapiens
ggagguacgaggaggcaucugg

SEQ ID NO: 15274 - RNA, 21 nt, Homo sapiens
uccuuguuuccuugaucuuuc

SEQ ID NO: 15275 - RNA, 22 nt, Homo sapiens
ccacuuagcuauucaguuccau

SEQ ID NO: 15276 - RNA, 19 nt, Homo sapiens
gaagagagcagcagggugg

SEQ ID NO: 15277 - RNA, 22 nt, Homo sapiens
ucuuuuuggcuuuuugcuuccu

SEQ ID NO: 15278 - RNA, 22 nt, Homo sapiens
gaucaaauaagcuguauaagag

SEQ ID NO: 15279 - RNA, 22 nt, Homo sapiens
gguuuuaggcaggugugauauu

SEQ ID NO: 15280 - RNA, 19 nt, Homo sapiens
ucacaccugcccuugaacc

SEQ ID NO: 15281 - RNA, 22 nt, Homo sapiens
ucaaaauguggucaaguauugu

SEQ ID NO: 15282 - RNA, 22 nt, Homo sapiens
caacacuugaccacauccugag

SEQ ID NO: 15283 - RNA, 22 nt, Homo sapiens
uucuguaaguuacaagagaguu

SEQ ID NO: 15284 - RNA, 22 nt, Homo sapiens
augcaauucucuucuugcaaaa

SEQ ID NO: 15285 - RNA, 22 nt, Homo sapiens
uuguaagugcuagagcgaggaa

SEQ ID NO: 15286 - RNA, 22 nt, Homo sapiens
uuccucccucuggugccugagc

SEQ ID NO: 15287 - RNA, 22 nt, Homo sapiens
ugauuccacuuuuuccccagag

SEQ ID NO: 15288 - RNA, 22 nt, Homo sapiens
uggguggagggagggaucagga

SEQ ID NO: 15289 - RNA, 22 nt, Homo sapiens
uaagcugauuccacuuuuucca

SEQ ID NO: 15290 - RNA, 22 nt, Homo sapiens
uggguggaggggggaucaggag

SEQ ID NO: 15291 - RNA, 22 nt, Homo sapiens
agagucuugucaaauuagccuu

SEQ ID NO: 15292 - RNA, 22 nt, Homo sapiens
gccuuaauuugacaaggcuuuc

SEQ ID NO: 15293 - RNA, 22 nt, Homo sapiens
gugcagcuggggaaacuuaacu

SEQ ID NO: 15294 - RNA, 22 nt, Homo sapiens
ucccguuuccaucagcugcuca

SEQ ID NO: 15295 - RNA, 22 nt, Homo sapiens
caggaucucagauacacuccug

SEQ ID NO: 15296 - RNA, 22 nt, Homo sapiens
aggaugccucuggauccccacc

SEQ ID NO: 15297 - RNA, 22 nt, Homo sapiens
agcccuucaugcccagaucuga

SEQ ID NO: 15298 - RNA, 22 nt, Homo sapiens
guuucuggguaugcaggguuua

SEQ ID NO: 15299 - RNA, 22 nt, Homo sapiens
ucauagcuaggccuucuuaagu

SEQ ID NO: 15300 - RNA, 22 nt, Homo sapiens
uguacauuuaagagguucuuga

SEQ ID NO: 15301 - RNA, 22 nt, Homo sapiens
gaacccuaucaauauugucucu

SEQ ID NO: 15302 - RNA, 22 nt, Homo sapiens
aguagugcaauauugcuuauag

SEQ ID NO: 15303 - RNA, 22 nt, Homo sapiens
ugcggaauugcuugagugaacu

SEQ ID NO: 15304 - RNA, 22 nt, Homo sapiens
acgguucacucaaguaaagcag

SEQ ID NO: 15305 - RNA, 22 nt, Homo sapiens
acugccccaucuuaucccuccu

SEQ ID NO: 15306 - RNA, 22 nt, Homo sapiens
gcagggggugagguaauggcca

SEQ ID NO: 15307 - RNA, 22 nt, Homo sapiens
uugcauauuauaugugccuuau

SEQ ID NO: 15308 - RNA, 22 nt, Homo sapiens
uaagugcacuguaagugcagga

SEQ ID NO: 15309 - RNA, 22 nt, Homo sapiens
gggauggucuaggggauccugu

SEQ ID NO: 15310 - RNA, 22 nt, Homo sapiens
ggauccccuaagacccuuccuu

SEQ ID NO: 15311 - RNA, 22 nt, Homo sapiens
aaacuugguggugacagcagua

SEQ ID NO: 15312 - RNA, 22 nt, Homo sapiens
ucccucuguuccugccaauuug

SEQ ID NO: 15313 - RNA, 22 nt, Homo sapiens
uccuuucagcuguuaaccgacc

SEQ ID NO: 15314 - RNA, 22 nt, Homo sapiens
gugugguagcaguugagaggaa

SEQ ID NO: 15315 - RNA, 22 nt, Homo sapiens
gaucuuuuuauuuacccuguua

SEQ ID NO: 15316 - RNA, 22 nt, Homo sapiens
caacggguaaaugaaaaacucu

SEQ ID NO: 15317 - RNA, 22 nt, Homo sapiens
caaucagagagcagcuuuuaug

SEQ ID NO: 15318 - RNA, 22 nt, Homo sapiens
uuggcuagcugcuuucucuugg

SEQ ID NO: 15319 - RNA, 22 nt, Homo sapiens
uauucaagaugcgggagucuuu

SEQ ID NO: 15320 - RNA, 22 nt, Homo sapiens
agacuccucuaucuagaauaug

SEQ ID NO: 15321 - RNA, 22 nt, Homo sapiens
ucaguuucauacauuaucugca

SEQ ID NO: 15322 - RNA, 22 nt, Homo sapiens
cagaugauauuugaagcuagga

SEQ ID NO: 15323 - RNA, 22 nt, Homo sapiens
gggugaucuucacguaagccug

SEQ ID NO: 15324 - RNA, 22 nt, Homo sapiens
cacacgggcagcggaggaacca

SEQ ID NO: 15325 - RNA, 22 nt, Homo sapiens
uggaguugggggauuuuaugca

SEQ ID NO: 15326 - RNA, 22 nt, Homo sapiens
uaaaaucucccaacucuggccg

SEQ ID NO: 15327 - RNA, 22 nt, Homo sapiens
caggcgugcauggguagaggcu

SEQ ID NO: 15328 - RNA, 22 nt, Homo sapiens
ccuuccucgggcaccccuccug

SEQ ID NO: 15329 - RNA, 22 nt, Homo sapiens
uacuccuggguggaccagauag

SEQ ID NO: 15330 - RNA, 22 nt, Homo sapiens
ucugaguccacuaggauuuggc

SEQ ID NO: 15331 - RNA, 22 nt, Homo sapiens
caacuaugcaggcagacugagu

SEQ ID NO: 15332 - RNA, 22 nt, Homo sapiens
ucauucuuguuugcuuugguua

SEQ ID NO: 15333 - RNA, 22 nt, Homo sapiens
uaauuuuuuaaugaugugugcu

SEQ ID NO: 15334 - RNA, 22 nt, Homo sapiens
auguacaucaugauaaauuaag

SEQ ID NO: 15335 - RNA, 22 nt, Homo sapiens
caccaauauuacugugcugcuu

SEQ ID NO: 15336 - RNA, 22 nt, Homo sapiens
uagcagcacguaaauauuggcg

SEQ ID NO: 15337 - RNA, 22 nt, Homo sapiens
uuccuucccuaagauucccaac

SEQ ID NO: 15338 - RNA, 20 nt, Homo sapiens
guuggggaugaggucaggaa

SEQ ID NO: 15339 - RNA, 22 nt, Homo sapiens
ucacggcugugauggaaggaau

SEQ ID NO: 15340 - RNA, 22 nt, Homo sapiens
uccuccauuuagccguguggcc

SEQ ID NO: 15341 - RNA, 22 nt, Homo sapiens
ugggcagugucugcuccugaua

SEQ ID NO: 15342 - RNA, 22 nt, Homo sapiens
ugucaggaacagaagugccccc

SEQ ID NO: 15343 - RNA, 22 nt, Homo sapiens
ucaugggaggcacugcuggagc

SEQ ID NO: 15344 - RNA, 22 nt, Homo sapiens
uccugguagugugcccaugggg

SEQ ID NO: 15345 - RNA, 22 nt, Homo sapiens
uguuuucauuucuucauccuug

SEQ ID NO: 15346 - RNA, 21 nt, Homo sapiens
gggaagaggaaagaaugaaca

SEQ ID NO: 15347 - RNA, 22 nt, Homo sapiens
uuggcaaucgucuccauuuuua

SEQ ID NO: 15348 - RNA, 22 nt, Homo sapiens
aaauagaggggauugucaguuc

SEQ ID NO: 15349 - RNA, 22 nt, Homo sapiens
cagacuccucauccagugcucc

SEQ ID NO: 15350 - RNA, 19 nt, Homo sapiens
gacauuggguggcugucug

SEQ ID NO: 15351 - RNA, 22 nt, Homo sapiens
ugguggucuacggcuggucugu

SEQ ID NO: 15352 - RNA, 22 nt, Homo sapiens
cugggccaccaugaccuacccg

SEQ ID NO: 15353 - RNA, 22 nt, Homo sapiens
ccgcccaggcucugcgccgcga

SEQ ID NO: 15354 - RNA, 22 nt, Homo sapiens
ucuggugagagacuggaugugu

SEQ ID NO: 15355 - RNA, 22 nt, Homo sapiens
acugcuucugcaucucaucagc

SEQ ID NO: 15356 - RNA, 22 nt, Homo sapiens
gcugcugggcuggaagcugugc

SEQ ID NO: 15357 - RNA, 22 nt, Homo sapiens
cccucucugcuacauuucuugg

SEQ ID NO: 15358 - RNA, 20 nt, Homo sapiens
ccaugaauguaguuuggggg

SEQ ID NO: 15359 - RNA, 22 nt, Homo sapiens
aguagaaaaucugacacaagag

SEQ ID NO: 15360 - RNA, 22 nt, Homo sapiens
ucucguauuagauuuuuacuuc

SEQ ID NO: 15361 - RNA, 22 nt, Homo sapiens
caggugagguucuugggagccu

SEQ ID NO: 15362 - RNA, 23 nt, Homo sapiens
ucccugagacccuuuaaccugug

SEQ ID NO: 15363 - RNA, 22 nt, Homo sapiens
gccacacaaauguaaggcauua

SEQ ID NO: 15364 - RNA, 22 nt, Homo sapiens
uguaugcuugccauuuaaaaug

SEQ ID NO: 15365 - RNA, 22 nt, Homo sapiens
aguucagggaguuuacaagucu

SEQ ID NO: 15366 - RNA, 22 nt, Homo sapiens
gacaguaaccuuucuggucuuu

SEQ ID NO: 15367 - RNA, 23 nt, Homo sapiens
uauggcuuuuuauuccuauguga

SEQ ID NO: 15368 - RNA, 22 nt, Homo sapiens
uguagggauggaagccaugaaa

SEQ ID NO: 15369 - RNA, 22 nt, Homo sapiens
uuuggaaacaguucacugguuu

SEQ ID NO: 15370 - RNA, 22 nt, Homo sapiens
agaccagggacuguccaagcug

SEQ ID NO: 15371 - RNA, 22 nt, Homo sapiens
aacacuucacaggauaaugcuu

SEQ ID NO: 15372 - RNA, 22 nt, Homo sapiens
agcauuauccuguaaagugcug

SEQ ID NO: 15373 - RNA, 22 nt, Homo sapiens
ucagaucuuaagcaacuugagg

SEQ ID NO: 15374 - RNA, 22 nt, Homo sapiens
ucaaguugcuucagacaauguu

SEQ ID NO: 15375 - RNA, 22 nt, Homo sapiens
cagccagggagggagcacagcc

SEQ ID NO: 15376 - RNA, 22 nt, Homo sapiens
ugugcuucuucaagcuggucug

SEQ ID NO: 15377 - RNA, 22 nt, Homo sapiens
cagcagaucuccaugaaacuca

SEQ ID NO: 15378 - RNA, 22 nt, Homo sapiens
agugcauggagaucugcuacac

SEQ ID NO: 15379 - RNA, 22 nt, Homo sapiens
uggggggcagaagccuaaggcu

SEQ ID NO: 15380 - RNA, 22 nt, Homo sapiens
cuucaugcugcugucccuuuuc

SEQ ID NO: 15381 - RNA, 22 nt, Homo sapiens
ugcaacgaaccugagccacuga

SEQ ID NO: 15382 - RNA, 22 nt, Homo sapiens
guggcacauguuuguugugagg

SEQ ID NO: 15383 - RNA, 22 nt, Homo sapiens
ggacuugggcgucaguauucug

SEQ ID NO: 15384 - RNA, 18 nt, Homo sapiens
agucugauguuugagucu

SEQ ID NO: 15385 - RNA, 22 nt, Homo sapiens
ugcucucucucaggacuuccau

SEQ ID NO: 15386 - RNA, 22 nt, Homo sapiens
aggucucugaggucagagggug

SEQ ID NO: 15387 - RNA, 22 nt, Homo sapiens
ucuugacagaaauguuuuaaau

SEQ ID NO: 15388 - RNA, 22 nt, Homo sapiens
uuagucauuuugacaagacugg

SEQ ID NO: 15389 - RNA, 22 nt, Homo sapiens
gagauauagcagugaggacaau

SEQ ID NO: 15390 - RNA, 22 nt, Homo sapiens
uuauucauuguugaauccucag

SEQ ID NO: 15391 - RNA, 22 nt, Homo sapiens
acggcccuucagucugcgcagu

SEQ ID NO: 15392 - RNA, 22 nt, Homo sapiens
uggcgagaugaaaggcgccggg

SEQ ID NO: 15393 - RNA, 22 nt, Homo sapiens
uggcaggugagggguggggggu

SEQ ID NO: 15394 - RNA, 22 nt, Homo sapiens
aagcccagccucaagcuugcug

SEQ ID NO: 15395 - RNA, 22 nt, Homo sapiens
ggcuggggcugaggucugucca

SEQ ID NO: 15396 - RNA, 22 nt, Homo sapiens
cugggcaaccuggccaagucuc

SEQ ID NO: 15397 - RNA, 22 nt, Homo sapiens
ugacucagggagcagcucugug

SEQ ID NO: 15398 - RNA, 22 nt, Homo sapiens
auagcuguuucuugagauuugg

SEQ ID NO: 15399 - RNA, 22 nt, Homo sapiens
ugggguaggauguguucucguu

SEQ ID NO: 15400 - RNA, 22 nt, Homo sapiens
cgagaaaacauauccgucucca

SEQ ID NO: 15401 - RNA, 22 nt, Homo sapiens
ugggguaggauguguucucguu

SEQ ID NO: 15402 - RNA, 22 nt, Homo sapiens
cgagaaaacauauccgucucca

SEQ ID NO: 15403 - RNA, 22 nt, Homo sapiens
ugggguaggauguguucucguu

SEQ ID NO: 15404 - RNA, 22 nt, Homo sapiens
cgagaaaacauauccgucucca

SEQ ID NO: 15405 - RNA, 22 nt, Homo sapiens
agugaggcacuucccuucucca

SEQ ID NO: 15406 - RNA, 22 nt, Homo sapiens
agaagggggaugccuaccuuga

SEQ ID NO: 15407 - RNA, 22 nt, Homo sapiens
gguucuggggaguuuguggggc

SEQ ID NO: 15408 - RNA, 21 nt, Homo sapiens
ccacacacccuucuuggaacu

SEQ ID NO: 15409 - RNA, 22 nt, Homo sapiens
ggcugaggagcacagagaggga

SEQ ID NO: 15410 - RNA, 22 nt, Homo sapiens
uccuuucuuguuuacuucuuuu

SEQ ID NO: 15411 - RNA, 22 nt, Homo sapiens
ucugaaauuggcugguucccau

SEQ ID NO: 15412 - RNA, 22 nt, Homo sapiens
uggcagcacaguauauuuugga

SEQ ID NO: 15413 - RNA, 22 nt, Homo sapiens
agccauguguuccacaggccuc

SEQ ID NO: 15414 - RNA, 22 nt, Homo sapiens
gggcacugugacauguggcucc

SEQ ID NO: 15415 - RNA, 22 nt, Homo sapiens
ugggguguguccuggucucagg

SEQ ID NO: 15416 - RNA, 22 nt, Homo sapiens
cccgagcugggcaggccugggc

SEQ ID NO: 15417 - RNA, 22 nt, Homo sapiens
uuaggugcuggaugaucucuga

SEQ ID NO: 15418 - RNA, 20 nt, Homo sapiens
ucagggcucacagugccuaa

SEQ ID NO: 15419 - RNA, 22 nt, Homo sapiens
caaacacaggugucuuucugac

SEQ ID NO: 15420 - RNA, 22 nt, Homo sapiens
uagaaagauauuuggucuuugc

SEQ ID NO: 15421 - RNA, 22 nt, Homo sapiens
ugcccccucccccuuccgcugu

SEQ ID NO: 15422 - RNA, 22 nt, Homo sapiens
cacggaucagggagggagggug

SEQ ID NO: 15423 - RNA, 22 nt, Homo sapiens
gaacauugugugauucagucag

SEQ ID NO: 15424 - RNA, 22 nt, Homo sapiens
gcugaacacauuucugucacua

SEQ ID NO: 15425 - RNA, 22 nt, Homo sapiens
cugcgcaagcuacugccuugcu

SEQ ID NO: 15426 - RNA, 21 nt, Homo sapiens
ugagguaguaguuugugcugu

SEQ ID NO: 15427 - RNA, 22 nt, Homo sapiens
gcuaacaagacccugaacugcu

SEQ ID NO: 15428 - RNA, 22 nt, Homo sapiens
gagcuuaguguuuugucagcuu

SEQ ID NO: 15429 - RNA, 22 nt, Homo sapiens
ggugguggggcccuggcgucag

SEQ ID NO: 15430 - RNA, 22 nt, Homo sapiens
ccagccagggcccauugucacc

SEQ ID NO: 15431 - RNA, 22 nt, Homo sapiens
ugggggcggggcggguaggccg

SEQ ID NO: 15432 - RNA, 22 nt, Homo sapiens
gccgggaccgcgaccccgcccc

SEQ ID NO: 15433 - RNA, 22 nt, Homo sapiens
ucccacccaccugcccguggua

SEQ ID NO: 15434 - RNA, 22 nt, Homo sapiens
ugcugggggugggggguagacu

SEQ ID NO: 15435 - RNA, 22 nt, Homo sapiens
uaggggcuccaggcaggggacc

SEQ ID NO: 15436 - RNA, 22 nt, Homo sapiens
ugacugccuggauguggccccu

SEQ ID NO: 15437 - RNA, 22 nt, Homo sapiens
uguacacauuugaaagguugau

SEQ ID NO: 15438 - RNA, 22 nt, Homo sapiens
ugaaugcacggauguguaugaa

SEQ ID NO: 15439 - RNA, 20 nt, Homo sapiens
aacgcgcuucccuauagagg

SEQ ID NO: 15440 - RNA, 21 nt, Homo sapiens
aacgcgcuucccuauagaggg

SEQ ID NO: 15441 - RNA, 20 nt, Homo sapiens
cucuagagggaagcgcuuuc

SEQ ID NO: 15442 - RNA, 24 nt, Homo sapiens
cucuagagggaagcgcuuucuguu

SEQ ID NO: 15443 - RNA, 23 nt, Homo sapiens
gaacgcgcuucccuauagagggu

SEQ ID NO: 15444 - RNA, 21 nt, Homo sapiens
aaagcgcuucucuuuagagga

SEQ ID NO: 15445 - RNA, 21 nt, Homo sapiens
cucuagagggaagcacuuucu

SEQ ID NO: 15446 - RNA, 23 nt, Homo sapiens
cucuagagggaagcacuuucucu

SEQ ID NO: 15447 - RNA, 19 nt, Homo sapiens
gaaagcgcuucucuuuaga

SEQ ID NO: 15448 - RNA, 20 nt, Homo sapiens
ucuagagggaagcacuuucu

SEQ ID NO: 15449 - RNA, 22 nt, Homo sapiens
gagcuuggaguccagcugggca

SEQ ID NO: 15450 - RNA, 22 nt, Homo sapiens
uuuagccuuaccuucagguugc

SEQ ID NO: 15451 - RNA, 22 nt, Homo sapiens
uuuuauguguagcuuuaaaagg

SEQ ID NO: 15452 - RNA, 20 nt, Homo sapiens
cuuuuaaagcuacuuuaaaa

SEQ ID NO: 15453 - RNA, 22 nt, Homo sapiens
ugaacucaugcguuugaguuga

SEQ ID NO: 15454 - RNA, 22 nt, Homo sapiens
uaacacaaguguaugagcucau

SEQ ID NO: 15455 - RNA, 22 nt, Homo sapiens
uuuccgggaucugcaugugccu

SEQ ID NO: 15456 - RNA, 22 nt, Homo sapiens
gccuugugcaggucuuggaguu

SEQ ID NO: 15457 - RNA, 22 nt, Homo sapiens
ucuguuguugcugugcguccug

SEQ ID NO: 15458 - RNA, 21 nt, Homo sapiens
auguucaguaaaaguugguga

SEQ ID NO: 15459 - RNA, 22 nt, Homo sapiens
ucucccugggaaugaugaccuu

SEQ ID NO: 15460 - RNA, 22 nt, Homo sapiens
ggcgucacucccaguugcuugg

SEQ ID NO: 15461 - RNA, 22 nt, Homo sapiens
ugaguuuugguuucuuggaguu

SEQ ID NO: 15462 - RNA, 22 nt, Homo sapiens
aacuaguaaaccaugucucauu

SEQ ID NO: 15463 - RNA, 22 nt, Homo sapiens
ugcuauguuuugccuagaacuu

SEQ ID NO: 15464 - RNA, 22 nt, Homo sapiens
uucuaggcagaauguagcagaa

SEQ ID NO: 15465 - RNA, 22 nt, Homo sapiens
caaauuggugcagcaaaguggu

SEQ ID NO: 15466 - RNA, 21 nt, Homo sapiens
cuacucgcuguauuuuuuugg

SEQ ID NO: 15467 - RNA, 22 nt, Homo sapiens
uggguggaacauguuucaugcu

SEQ ID NO: 15468 - RNA, 22 nt, Homo sapiens
ucagcaaagcgugucuccccac

SEQ ID NO: 15469 - RNA, 22 nt, Homo sapiens
cugggagguggauguuuacuuc

SEQ ID NO: 15470 - RNA, 22 nt, Homo sapiens
uguaaacauccuacacucagcu

SEQ ID NO: 15471 - RNA, 22 nt, Homo sapiens
ugauuucuuccacuugggcaug

SEQ ID NO: 15472 - RNA, 22 nt, Homo sapiens
guuaugucuauggaagugucac

SEQ ID NO: 15473 - RNA, 22 nt, Homo sapiens
uugauagucuccuagccuguga

SEQ ID NO: 15474 - RNA, 22 nt, Homo sapiens
caugcauaggaguuugucacca

SEQ ID NO: 15475 - RNA, 22 nt, Homo sapiens
uuccagagacaguucacacuac

SEQ ID NO: 15476 - RNA, 22 nt, Homo sapiens
uacuguggaacugcuucuggug

SEQ ID NO: 15477 - RNA, 22 nt, Homo sapiens
uguucuugguuuuggagauaca

SEQ ID NO: 15478 - RNA, 22 nt, Homo sapiens
uguauucuuucaaacuugagaa

SEQ ID NO: 15479 - RNA, 22 nt, Homo sapiens
uggcacuuuacuuccucaggag

SEQ ID NO: 15480 - RNA, 22 nt, Homo sapiens
ucuuguggggugaggugccucu

SEQ ID NO: 15481 - RNA, 22 nt, Homo sapiens
ggugguuuccuuuugucuccuu

SEQ ID NO: 15482 - RNA, 19 nt, Homo sapiens
gguggcaguaggaucuacc

SEQ ID NO: 15483 - RNA, 22 nt, Homo sapiens
ugggcacugccuguggcaccca

SEQ ID NO: 15484 - RNA, 22 nt, Homo sapiens
ggaccccgggaagugcucagua

SEQ ID NO: 15485 - RNA, 22 nt, Homo sapiens
accuuuucaagcuccaagaguu

SEQ ID NO: 15486 - RNA, 21 nt, Homo sapiens
cuuuuacagcauugggagggu

SEQ ID NO: 15487 - RNA, 22 nt, Homo sapiens
uccuuauuucucuucuucugau

SEQ ID NO: 15488 - RNA, 22 nt, Homo sapiens
uagaacaggaagagggauaagg

SEQ ID NO: 15489 - RNA, 22 nt, Homo sapiens
ucuucuggucuaaggucuucug

SEQ ID NO: 15490 - RNA, 22 nt, Homo sapiens
gaagugccauagaugagugaaa

SEQ ID NO: 15491 - RNA, 22 nt, Homo sapiens
uucagugauuccgauuccaaac

SEQ ID NO: 15492 - RNA, 22 nt, Homo sapiens
uuugaaucggcaucgagcuuac

SEQ ID NO: 15493 - RNA, 22 nt, Homo sapiens
aguggagaugcuguuacuuuug

SEQ ID NO: 15494 - RNA, 22 nt, Homo sapiens
uguaacagcaacuccaugugga

SEQ ID NO: 15495 - RNA, 22 nt, Homo sapiens
ucuucuugugccuuguccacag

SEQ ID NO: 15496 - RNA, 22 nt, Homo sapiens
uggggacaccgcaggaaguacu

SEQ ID NO: 15497 - RNA, 22 nt, Homo sapiens
ugguuugaccucuugaucccuc

SEQ ID NO: 15498 - RNA, 22 nt, Homo sapiens
aggggugcaagaggccaguggc

SEQ ID NO: 15499 - RNA, 22 nt, Homo sapiens
uccccuuaccaggcuccuccuu

SEQ ID NO: 15500 - RNA, 20 nt, Homo sapiens
ggaggggucuggagugggga

SEQ ID NO: 15501 - RNA, 22 nt, Homo sapiens
ccucacguccuuccugauaggc

SEQ ID NO: 15502 - RNA, 22 nt, Homo sapiens
ucuguuugggaaggguguucag

SEQ ID NO: 15503 - RNA, 22 nt, Homo sapiens
gccaguucccauuguagaaugc

SEQ ID NO: 15504 - RNA, 21 nt, Homo sapiens
uaccauuuugcaguggcuggu

SEQ ID NO: 15505 - RNA, 22 nt, Homo sapiens
uaacucugauccgcugugagga

SEQ ID NO: 15506 - RNA, 22 nt, Homo sapiens
ucuggcagugggccacaguggu

SEQ ID NO: 15507 - RNA, 22 nt, Homo sapiens
uagagucagcaggugguaauca

SEQ ID NO: 15508 - RNA, 22 nt, Homo sapiens
uuagccaccugcuguuuucuuc

SEQ ID NO: 15509 - RNA, 22 nt, Homo sapiens
uggcacagguagaauuucuggg

SEQ ID NO: 15510 - RNA, 22 nt, Homo sapiens
ugggauuuuaccuuggccaucu

SEQ ID NO: 15511 - RNA, 22 nt, Homo sapiens
gggaucuuuuuuuccuucucca

SEQ ID NO: 15512 - RNA, 22 nt, Homo sapiens
ugggcaggugggaggauccugg

SEQ ID NO: 15513 - RNA, 22 nt, Homo sapiens
uuguagcuucucaagcaagguu

SEQ ID NO: 15514 - RNA, 22 nt, Homo sapiens
cugggugugcuagaggcuacaa

SEQ ID NO: 15515 - RNA, 22 nt, Homo sapiens
uacuccagagggcgucacucau

SEQ ID NO: 15516 - RNA, 23 nt, Homo sapiens
ugauuguagccuuuuggaguaga

SEQ ID NO: 15517 - RNA, 22 nt, Homo sapiens
gcacaaaggcagugcuaauuac

SEQ ID NO: 15518 - RNA, 22 nt, Homo sapiens
ggaaagcacuguuuuuugugau

SEQ ID NO: 15519 - RNA, 22 nt, Homo sapiens
ugauuccacucuuuccacagac

SEQ ID NO: 15520 - RNA, 22 nt, Homo sapiens
uggguggagggagggaucagaa

SEQ ID NO: 15521 - RNA, 22 nt, Homo sapiens
ggacucccuccaggaaauuaaa

SEQ ID NO: 15522 - RNA, 22 nt, Homo sapiens
uaacccccuggaagggguccca

SEQ ID NO: 15523 - RNA, 22 nt, Homo sapiens
ggacucccuccaggaaauuaaa

SEQ ID NO: 15524 - RNA, 22 nt, Homo sapiens
uaacccccuggaagggguccca

SEQ ID NO: 15525 - RNA, 22 nt, Homo sapiens
ugcgugugugauaugccucugc

SEQ ID NO: 15526 - RNA, 22 nt, Homo sapiens
augugggagugucacaugcugc

SEQ ID NO: 15527 - RNA, 22 nt, Homo sapiens
accugguuucauuuccagcaca

SEQ ID NO: 15528 - RNA, 22 nt, Homo sapiens
ugcugggaagugggaaaagggg

SEQ ID NO: 15529 - RNA, 22 nt, Homo sapiens
ugucugcuauucauaaacugcu

SEQ ID NO: 15530 - RNA, 22 nt, Homo sapiens
uaguuugugacauaagcagaac

SEQ ID NO: 15531 - RNA, 22 nt, Homo sapiens
cagggacagcaaaggggugcuc

SEQ ID NO: 15532 - RNA, 22 nt, Homo sapiens
uucccuuugucauccuucgccu

SEQ ID NO: 15533 - RNA, 22 nt, Homo sapiens
gaagggauuauaauuugauaau

SEQ ID NO: 15534 - RNA, 22 nt, Homo sapiens
uauauguuauggucccuucuaa

SEQ ID NO: 15535 - RNA, 22 nt, Homo sapiens
aacccguagauccgaacuugug

SEQ ID NO: 15536 - RNA, 22 nt, Homo sapiens
aagcuuguaucuauagguaugu

SEQ ID NO: 15537 - RNA, 22 nt, Homo sapiens
uggucaagagugucaagugugc

SEQ ID NO: 15538 - RNA, 22 nt, Homo sapiens
ugcgcagaugcacucugaccac

SEQ ID NO: 15539 - RNA, 22 nt, Homo sapiens
uuguggcuccugguugcuagga

SEQ ID NO: 15540 - RNA, 22 nt, Homo sapiens
uacuaagcaacaggagccuguu

SEQ ID NO: 15541 - RNA, 22 nt, Homo sapiens
ugugcugcgcagaugugccugc

SEQ ID NO: 15542 - RNA, 22 nt, Homo sapiens
cuguaggucuggccguagccac

SEQ ID NO: 15543 - RNA, 22 nt, Homo sapiens
uugucuuuguucccgggacuca

SEQ ID NO: 15544 - RNA, 20 nt, Homo sapiens
uggcuuccuggggauggcaa

SEQ ID NO: 15545 - RNA, 22 nt, Homo sapiens
uuagaggaaaucuguugcuggg

SEQ ID NO: 15546 - RNA, 22 nt, Homo sapiens
agcaauuuuauuuccucuucuc

SEQ ID NO: 15547 - RNA, 22 nt, Homo sapiens
ugacauggcugccgcaggcagg

SEQ ID NO: 15548 - RNA, 22 nt, Homo sapiens
uggagccuccggguguggccau

SEQ ID NO: 15549 - RNA, 22 nt, Homo sapiens
ugcuuuguuuccaaaagccuga

SEQ ID NO: 15550 - RNA, 22 nt, Homo sapiens
uggaggccugggggcagagggg

SEQ ID NO: 15551 - RNA, 22 nt, Homo sapiens
uugggaauaguugaggguuuag

SEQ ID NO: 15552 - RNA, 22 nt, Homo sapiens
ugaaucccuaacuuuucccauc

SEQ ID NO: 15553 - RNA, 22 nt, Homo sapiens
uuagaucaguaguugguaaggg

SEQ ID NO: 15554 - RNA, 22 nt, Homo sapiens
caggccaacuggcugaucucaa

SEQ ID NO: 15555 - RNA, 22 nt, Homo sapiens
ugauguuugugacucuuuuggc

SEQ ID NO: 15556 - RNA, 22 nt, Homo sapiens
agagcggguagaggaucuuuag

SEQ ID NO: 15557 - RNA, 22 nt, Homo sapiens
uuaaccucucuggaccucuuug

SEQ ID NO: 15558 - RNA, 22 nt, Homo sapiens
augaaggggucuaggagguguc

SEQ ID NO: 15559 - RNA, 22 nt, Homo sapiens
uacauucuuuucccuggguaca

SEQ ID NO: 15560 - RNA, 22 nt, Homo sapiens
accacagggaagccaaaaugua

SEQ ID NO: 15561 - RNA, 22 nt, Homo sapiens
ugcggaugcgguauaaagacag

SEQ ID NO: 15562 - RNA, 22 nt, Homo sapiens
uccuuguuuccacagcugcagg

SEQ ID NO: 15563 - RNA, 22 nt, Homo sapiens
uaggguagauuuaagucgaugu

SEQ ID NO: 15564 - RNA, 22 nt, Homo sapiens
auaagcuuaaauguucccuaau

SEQ ID NO: 15565 - RNA, 22 nt, Homo sapiens
ugaggauuuaaugggacucauu

SEQ ID NO: 15566 - RNA, 22 nt, Homo sapiens
uauugucccaauagaugcucau

SEQ ID NO: 15567 - RNA, 22 nt, Homo sapiens
uuucucucuggacuuauucuuu

SEQ ID NO: 15568 - RNA, 22 nt, Homo sapiens
gggaaugggcagaugagaauuu

SEQ ID NO: 15569 - RNA, 22 nt, Homo sapiens
uuuuugcaucuugggcauugcu

SEQ ID NO: 15570 - RNA, 22 nt, Homo sapiens
cagugcccagagagcaucuguu

SEQ ID NO: 15571 - RNA, 22 nt, Homo sapiens
uggacgcugcagccagugucua

SEQ ID NO: 15572 - RNA, 22 nt, Homo sapiens
uggacgcuggcuguagcaacca

SEQ ID NO: 15573 - RNA, 22 nt, Homo sapiens
uauaggaaaccagauguaaaua

SEQ ID NO: 15574 - RNA, 22 nt, Homo sapiens
uuuacaucugacauucuugcau

SEQ ID NO: 15575 - RNA, 22 nt, Homo sapiens
gaggcagagaugaguaagacag

SEQ ID NO: 15576 - RNA, 22 nt, Homo sapiens
ucuuauucaucucugcuugccu

SEQ ID NO: 15577 - RNA, 22 nt, Homo sapiens
uuugguucuguuccaccucaaa

SEQ ID NO: 15578 - RNA, 22 nt, Homo sapiens
uggguguggcaaagccaaagaa

SEQ ID NO: 15579 - RNA, 22 nt, Homo sapiens
acuguacucuuauagccaucug

SEQ ID NO: 15580 - RNA, 22 nt, Homo sapiens
gauuguguaaggguacaguugu

SEQ ID NO: 15581 - RNA, 22 nt, Homo sapiens
acuguacucuuauagccaucug

SEQ ID NO: 15582 - RNA, 22 nt, Homo sapiens
gauuguguaaggguacaguugu

SEQ ID NO: 15583 - RNA, 22 nt, Homo sapiens
acuguacucuuauagccaucug

SEQ ID NO: 15584 - RNA, 22 nt, Homo sapiens
gauuguguaaggguacaguugu

SEQ ID NO: 15585 - RNA, 22 nt, Homo sapiens
acuguacucuuauagccaucug

SEQ ID NO: 15586 - RNA, 22 nt, Homo sapiens
gauuguguaaggguacaguugu

SEQ ID NO: 15587 - RNA, 22 nt, Homo sapiens
acuguacucuuauagccaucug

SEQ ID NO: 15588 - RNA, 22 nt, Homo sapiens
gauuguguaaggguacaguugu

SEQ ID NO: 15589 - RNA, 22 nt, Homo sapiens
acuguacucuuauagccaucug

SEQ ID NO: 15590 - RNA, 22 nt, Homo sapiens
gauuguguaaggguacaguugu

SEQ ID NO: 15591 - RNA, 22 nt, Homo sapiens
acuguacucuuauagccaucug

SEQ ID NO: 15592 - RNA, 22 nt, Homo sapiens
gauuguguaaggguacaguugu

SEQ ID NO: 15593 - RNA, 22 nt, Homo sapiens
ugaucucaauuauuuucauagc

SEQ ID NO: 15594 - RNA, 22 nt, Homo sapiens
gguacaaaugguugggauuauu

SEQ ID NO: 15595 - RNA, 22 nt, Homo sapiens
ggauucccagcugucugcauga

SEQ ID NO: 15596 - RNA, 17 nt, Homo sapiens
aggcagcugggguaucc

SEQ ID NO: 15597 - RNA, 22 nt, Homo sapiens
gggcagaggggacuggcagcca

SEQ ID NO: 15598 - RNA, 20 nt, Homo sapiens
cuucuggucccuucuaguuc

SEQ ID NO: 15599 - RNA, 22 nt, Homo sapiens
ucuuuucauuaauagaaguuaa

SEQ ID NO: 15600 - RNA, 22 nt, Homo sapiens
acuucuguuaacuaaaagacag

SEQ ID NO: 15601 - RNA, 22 nt, Homo sapiens
acuguacucuucuagccaucug

SEQ ID NO: 15602 - RNA, 22 nt, Homo sapiens
gauuguguaaggguacaguugu

SEQ ID NO: 15603 - RNA, 22 nt, Homo sapiens
acuguacucuucuagccaucug

SEQ ID NO: 15604 - RNA, 22 nt, Homo sapiens
gauuguguaaggguacaguugu

SEQ ID NO: 15605 - RNA, 22 nt, Homo sapiens
acaggcuauuuuuggaguugug

SEQ ID NO: 15606 - RNA, 20 nt, Homo sapiens
caagccagaaauagugcugu

SEQ ID NO: 15607 - RNA, 22 nt, Homo sapiens
uggacuuggagucaggaggccu

SEQ ID NO: 15608 - RNA, 22 nt, Homo sapiens
ccugaccugcucugguccacug

SEQ ID NO: 15609 - RNA, 22 nt, Homo sapiens
ugccuacauguuacagugguga

SEQ ID NO: 15610 - RNA, 22 nt, Homo sapiens
ugccccacugugauuucuaggu

SEQ ID NO: 15611 - RNA, 22 nt, Homo sapiens
ugaguuggaaaguaagguuguc

SEQ ID NO: 15612 - RNA, 22 nt, Homo sapiens
gcccuccuuucugucucaggcu

SEQ ID NO: 15613 - RNA, 22 nt, Homo sapiens
uguguauguuuguguauugcuu

SEQ ID NO: 15614 - RNA, 22 nt, Homo sapiens
guuuccauaugcauacauagug

SEQ ID NO: 15615 - RNA, 22 nt, Homo sapiens
ugguuucacaugguggcuuaga

SEQ ID NO: 15616 - RNA, 22 nt, Homo sapiens
ucuagcaccauuugaaaucagu

SEQ ID NO: 15617 - RNA, 22 nt, Homo sapiens
cugguuucacaugguggcuuag

SEQ ID NO: 15618 - RNA, 23 nt, Homo sapiens
cugguuucacaugguggcuuaga

SEQ ID NO: 15619 - RNA, 24 nt, Homo sapiens
cugguuucacaugguggcuuagau

SEQ ID NO: 15620 - RNA, 22 nt, Homo sapiens
ucaaaugaggcugggagaggca

SEQ ID NO: 15621 - RNA, 22 nt, Homo sapiens
ccucuucuagccucguuugauu

SEQ ID NO: 15622 - RNA, 22 nt, Homo sapiens
cggggguaucgcugugggggag

SEQ ID NO: 15623 - RNA, 22 nt, Homo sapiens
ccuccccaacgcacacccccgc

SEQ ID NO: 15624 - RNA, 22 nt, Homo sapiens
aggagaaaggaaggaacagggg

SEQ ID NO: 15625 - RNA, 22 nt, Homo sapiens
uuguucucaucuuucuucuuuu

SEQ ID NO: 15626 - RNA, 22 nt, Homo sapiens
ucagugagccaucugugcucag

SEQ ID NO: 15627 - RNA, 22 nt, Homo sapiens
ggggcacuaugggcucucugga

SEQ ID NO: 15628 - RNA, 22 nt, Homo sapiens
agagcugcuuggagagccuucc

SEQ ID NO: 15629 - RNA, 22 nt, Homo sapiens
aaggaggaguucuaagccuuug

SEQ ID NO: 15630 - RNA, 22 nt, Homo sapiens
uggucuuuuuuaucugcucauu

SEQ ID NO: 15631 - RNA, 22 nt, Homo sapiens
ugaggaacauaacucagauaaa

SEQ ID NO: 15632 - RNA, 22 nt, Homo sapiens
ucaggacaguaggcucaccuga

SEQ ID NO: 15633 - RNA, 22 nt, Homo sapiens
ucagggagccacgugauccuga

SEQ ID NO: 15634 - RNA, 22 nt, Homo sapiens
ugguagaaggagggaagaggcu

SEQ ID NO: 15635 - RNA, 22 nt, Homo sapiens
uguuuucuccuuuccugcccuc

SEQ ID NO: 15636 - RNA, 22 nt, Homo sapiens
uuucaggaguacauuuucacuu

SEQ ID NO: 15637 - RNA, 22 nt, Homo sapiens
guagaaaugcauuacuccuaga

SEQ ID NO: 15638 - RNA, 22 nt, Homo sapiens
caggaacauagggcgacaccca

SEQ ID NO: 15639 - RNA, 20 nt, Homo sapiens
guguuggacuauguuacuug

SEQ ID NO: 15640 - RNA, 22 nt, Homo sapiens
gcuuuugacugggugucuaagg

SEQ ID NO: 15641 - RNA, 17 nt, Homo sapiens
acaaucaguuagaaagc

SEQ ID NO: 15642 - RNA, 22 nt, Homo sapiens
caauaauguuugugcagugcua

SEQ ID NO: 15643 - RNA, 22 nt, Homo sapiens
uaguacuguuuguaauuguuga

SEQ ID NO: 15644 - RNA, 22 nt, Homo sapiens
uggaggagagugagggaaugau

SEQ ID NO: 15645 - RNA, 22 nt, Homo sapiens
acuuuuacacucuuguucucac

SEQ ID NO: 15646 - RNA, 22 nt, Homo sapiens
ggccccagauguuugaaagacu

SEQ ID NO: 15647 - RNA, 21 nt, Homo sapiens
uaaucaauccauuugguggcc

SEQ ID NO: 15648 - RNA, 22 nt, Homo sapiens
ucccagaccacaguccuuugaa

SEQ ID NO: 15649 - RNA, 22 nt, Homo sapiens
uugcuaagggugaugauggggc

SEQ ID NO: 15650 - RNA, 22 nt, Homo sapiens
ucaaagacacuuuggggaccac

SEQ ID NO: 15651 - RNA, 22 nt, Homo sapiens
ucaucaggguggucuuuggaca

SEQ ID NO: 15652 - RNA, 22 nt, Homo sapiens
ccagaaagccugggacaaagcc

SEQ ID NO: 15653 - RNA, 22 nt, Homo sapiens
gauucauucucaggcuuccugg

SEQ ID NO: 15654 - RNA, 22 nt, Homo sapiens
ccagaaagccugggacaaagcc

SEQ ID NO: 15655 - RNA, 22 nt, Homo sapiens
gauucauucucaggcuuccugg

SEQ ID NO: 15656 - RNA, 22 nt, Homo sapiens
uguauucagucuuccagaucgc

SEQ ID NO: 15657 - RNA, 22 nt, Homo sapiens
uggucucgaugacugugcauau

SEQ ID NO: 15658 - RNA, 22 nt, Homo sapiens
acuuucaaguacccagagguuu

SEQ ID NO: 15659 - RNA, 22 nt, Homo sapiens
agccuggaguacugagagaucu

SEQ ID NO: 15660 - RNA, 22 nt, Homo sapiens
uggacuuucaaguacccagagg

SEQ ID NO: 15661 - RNA, 19 nt, Homo sapiens
uggaguacugaaagaucua

SEQ ID NO: 15662 - RNA, 22 nt, Homo sapiens
ugcugaccugcccagggugugu

SEQ ID NO: 15663 - RNA, 22 nt, Homo sapiens
cccacuccuaggcuggccagca

SEQ ID NO: 15664 - RNA, 22 nt, Homo sapiens
uagguccaagauuccaggucuu

SEQ ID NO: 15665 - RNA, 22 nt, Homo sapiens
ggauuuagaucuaaggacuuaa

SEQ ID NO: 15666 - RNA, 22 nt, Homo sapiens
agggacgggacgcggugcagug

SEQ ID NO: 15667 - RNA, 22 nt, Homo sapiens
uauugcacucgucccggccucc

SEQ ID NO: 15668 - RNA, 22 nt, Homo sapiens
ucagcugccuggagugggugag

SEQ ID NO: 15669 - RNA, 22 nt, Homo sapiens
ugccccacccccagccagcugc

SEQ ID NO: 15670 - RNA, 22 nt, Homo sapiens
gcccgaccgcgccggcccgcac

SEQ ID NO: 15671 - RNA, 21 nt, Homo sapiens
gcugcgggcugcggucagggc

SEQ ID NO: 15672 - RNA, 22 nt, Homo sapiens
ucacaucuaaggaugaagacua

SEQ ID NO: 15673 - RNA, 21 nt, Homo sapiens
agucuucagauuagauaguga

SEQ ID NO: 15674 - RNA, 22 nt, Homo sapiens
caagauuuaucucauucucuga

SEQ ID NO: 15675 - RNA, 22 nt, Homo sapiens
uagagagccauaaauuucagcu

SEQ ID NO: 15676 - RNA, 22 nt, Homo sapiens
ugcgugccccggccacccccgg

SEQ ID NO: 15677 - RNA, 22 nt, Homo sapiens
cgcgggguggcuggggcuacgu

SEQ ID NO: 15678 - RNA, 22 nt, Homo sapiens
uguucucacucuuucugcuguu

SEQ ID NO: 15679 - RNA, 22 nt, Homo sapiens
cugcagaaugaugagaauacag

SEQ ID NO: 15680 - RNA, 22 nt, Homo sapiens
aggggccagguacccucaguuc

SEQ ID NO: 15681 - RNA, 20 nt, Homo sapiens
ugauggcacucuggcacccu

SEQ ID NO: 15682 - RNA, 22 nt, Homo sapiens
gguuucuguaaaugugggucag

SEQ ID NO: 15683 - RNA, 22 nt, Homo sapiens
acccagauuuccgcagacaacc

SEQ ID NO: 15684 - RNA, 22 nt, Homo sapiens
cagguggguuggugggcaaggg

SEQ ID NO: 15685 - RNA, 22 nt, Homo sapiens
cugcccagcccccaacccagag

SEQ ID NO: 15686 - RNA, 22 nt, Homo sapiens
uuguagagacaggaccugagga

SEQ ID NO: 15687 - RNA, 22 nt, Homo sapiens
uuagaccuguuucucugccaga

SEQ ID NO: 15688 - RNA, 22 nt, Homo sapiens
uaagagaauuaauguuugggug

SEQ ID NO: 15689 - RNA, 22 nt, Homo sapiens
aguucacauaaauucucucauu

SEQ ID NO: 15690 - RNA, 22 nt, Homo sapiens
uaagugggugggcaugggaacu

SEQ ID NO: 15691 - RNA, 22 nt, Homo sapiens
gcccugugacucccauccgcuc

SEQ ID NO: 15692 - RNA, 22 nt, Homo sapiens
ugccucaagggaaaugaggaga

SEQ ID NO: 15693 - RNA, 22 nt, Homo sapiens
uccacauuucccccuagaggug

SEQ ID NO: 15694 - RNA, 22 nt, Homo sapiens
uguaagggucuguguggaugca

SEQ ID NO: 15695 - RNA, 22 nt, Homo sapiens
cguccacccagacugugcagcc

SEQ ID NO: 15696 - RNA, 22 nt, Homo sapiens
ucugcaggucagugugcagcug

SEQ ID NO: 15697 - RNA, 22 nt, Homo sapiens
gcugguacaccuugccugucag

SEQ ID NO: 15698 - RNA, 22 nt, Homo sapiens
gagcugugugagcaguggugug

SEQ ID NO: 15699 - RNA, 22 nt, Homo sapiens
cacaucugcagcuuaggucccc

SEQ ID NO: 15700 - RNA, 22 nt, Homo sapiens
ccuucugcagucaacacagccc

SEQ ID NO: 15701 - RNA, 22 nt, Homo sapiens
ggcugugucugggcagaugggg

SEQ ID NO: 15702 - RNA, 22 nt, Homo sapiens
ccuucugcagucaacacagccc

SEQ ID NO: 15703 - RNA, 22 nt, Homo sapiens
ggcugugucugggcagaugggg

SEQ ID NO: 15704 - RNA, 22 nt, Homo sapiens
ggaccaucccagccucucagug

SEQ ID NO: 15705 - RNA, 22 nt, Homo sapiens
acucagaugcugaugguccuuc

SEQ ID NO: 15706 - RNA, 22 nt, Homo sapiens
uggccuugaagcuccccccaac

SEQ ID NO: 15707 - RNA, 22 nt, Homo sapiens
uggggguggccucaggagccau

SEQ ID NO: 15708 - RNA, 22 nt, Homo sapiens
ugcacuccuugcagcauucugg

SEQ ID NO: 15709 - RNA, 22 nt, Homo sapiens
gaugcgagguaaggaaugugcu

SEQ ID NO: 15710 - RNA, 22 nt, Homo sapiens
cagucauucuucucacccucca

SEQ ID NO: 15711 - RNA, 22 nt, Homo sapiens
agggagagauggaguuagauua

SEQ ID NO: 15712 - RNA, 22 nt, Homo sapiens
uauucucuuuaguaucucugug

SEQ ID NO: 15713 - RNA, 22 nt, Homo sapiens
ccauguauuauagagaauagga

SEQ ID NO: 15714 - RNA, 22 nt, Homo sapiens
ugggacugacaucauagacaug

SEQ ID NO: 15715 - RNA, 22 nt, Homo sapiens
uaaaguuuuugacagucuugaa

SEQ ID NO: 15716 - RNA, 22 nt, Homo sapiens
uggguaauggaggcggugacug

SEQ ID NO: 15717 - RNA, 22 nt, Homo sapiens
ucgccccuauagaacucaaccc

SEQ ID NO: 15718 - RNA, 22 nt, Homo sapiens
ucuauccucagcaucaugaaac

SEQ ID NO: 15719 - RNA, 22 nt, Homo sapiens
uucugucuugcugcuggggugg

SEQ ID NO: 15720 - RNA, 22 nt, Homo sapiens
agagcuuagcugauuggugaac

SEQ ID NO: 15721 - RNA, 21 nt, Homo sapiens
uucacaguggcuaaguucugc

SEQ ID NO: 15722 - RNA, 22 nt, Homo sapiens
uccuuaucauagggcuguccuu

SEQ ID NO: 15723 - RNA, 22 nt, Homo sapiens
gagauagcccagggauaagggg

SEQ ID NO: 15724 - RNA, 22 nt, Homo sapiens
ggaacccucgggguuuuccucu

SEQ ID NO: 15725 - RNA, 22 nt, Homo sapiens
gggaaggaggcuccagggcuuu

SEQ ID NO: 15726 - RNA, 22 nt, Homo sapiens
agaaggacaguguguuuguugg

SEQ ID NO: 15727 - RNA, 22 nt, Homo sapiens
acaaaugcgucuguccuggcug

SEQ ID NO: 15728 - RNA, 22 nt, Homo sapiens
ggcaggacuggacacggagaca

SEQ ID NO: 15729 - RNA, 22 nt, Homo sapiens
gcuuccugcuccauccugaccu

SEQ ID NO: 15730 - RNA, 22 nt, Homo sapiens
auuaaaagcugcuuugaaucca

SEQ ID NO: 15731 - RNA, 22 nt, Homo sapiens
auuugaggcuagaauuuaacaa

SEQ ID NO: 15732 - RNA, 22 nt, Homo sapiens
ucaacggucuaucuucugaaua

SEQ ID NO: 15733 - RNA, 22 nt, Homo sapiens
ugugcagaagguagaauguuga

SEQ ID NO: 15734 - RNA, 22 nt, Homo sapiens
cuggcuauuugggucucaucug

SEQ ID NO: 15735 - RNA, 22 nt, Homo sapiens
gugauucacucaaguaccagug

SEQ ID NO: 15736 - RNA, 22 nt, Homo sapiens
uggugaagaggggaaagaagaa

SEQ ID NO: 15737 - RNA, 22 nt, Homo sapiens
uccuuucuccucugaaccacuc

SEQ ID NO: 15738 - RNA, 22 nt, Homo sapiens
aguuccugagguuuucugugcc

SEQ ID NO: 15739 - RNA, 22 nt, Homo sapiens
aacacagagaauaacaggacuu

SEQ ID NO: 15740 - RNA, 22 nt, Homo sapiens
uaacuuuucaguuugcaagcag

SEQ ID NO: 15741 - RNA, 22 nt, Homo sapiens
uugcagacugaucagagauggu

SEQ ID NO: 15742 - RNA, 22 nt, Homo sapiens
gcuggcuguccucugugaagau

SEQ ID NO: 15743 - RNA, 18 nt, Homo sapiens
ucuuugaggcagcucagu

SEQ ID NO: 15744 - RNA, 22 nt, Homo sapiens
uguggucguuuuuguggagggu

SEQ ID NO: 15745 - RNA, 22 nt, Homo sapiens
ucuuccuaauggaugccuacaa

SEQ ID NO: 15746 - RNA, 22 nt, Homo sapiens
gcaggagaaagcgcuaugguca

SEQ ID NO: 15747 - RNA, 22 nt, Homo sapiens
accauuagcuaucucucugacc

SEQ ID NO: 15748 - RNA, 22 nt, Homo sapiens
gcaggagaaagcgcuaugguca

SEQ ID NO: 15749 - RNA, 22 nt, Homo sapiens
accauuagcuaucucucugacc

SEQ ID NO: 15750 - RNA, 22 nt, Homo sapiens
ccggcggucggcgacuucugcu

SEQ ID NO: 15751 - RNA, 22 nt, Homo sapiens
gguugugugcuggccgcuggga

SEQ ID NO: 15752 - RNA, 22 nt, Homo sapiens
cuggcccaaggcuuugggggcu

SEQ ID NO: 15753 - RNA, 22 nt, Homo sapiens
gcuccugccuuguggcugucuc

SEQ ID NO: 15754 - RNA, 22 nt, Homo sapiens
gcccucaccgcuacuccuuuca

SEQ ID NO: 15755 - RNA, 22 nt, Homo sapiens
gagguaaagauggggagggcua

SEQ ID NO: 15756 - RNA, 22 nt, Homo sapiens
uuggccaccacaccuaccccuu

SEQ ID NO: 15757 - RNA, 22 nt, Homo sapiens
augggugauggguguggugucc

SEQ ID NO: 15758 - RNA, 22 nt, Homo sapiens
cagggagguccugggggcaggg

SEQ ID NO: 15759 - RNA, 22 nt, Homo sapiens
cggcccccagcacccgccccuu

SEQ ID NO: 15760 - RNA, 22 nt, Homo sapiens
cccauccucacagucucagucu

SEQ ID NO: 15761 - RNA, 22 nt, Homo sapiens
gacugagauuguagacuuggcu

SEQ ID NO: 15762 - RNA, 22 nt, Homo sapiens
ugaggcaagucccugccuggcc

SEQ ID NO: 15763 - RNA, 22 nt, Homo sapiens
ccaggcacgauuuccacauggc

SEQ ID NO: 15764 - RNA, 22 nt, Homo sapiens
uaagguaucugccaccccugua

SEQ ID NO: 15765 - RNA, 22 nt, Homo sapiens
gggguggcacugugccuuguuc

SEQ ID NO: 15766 - RNA, 22 nt, Homo sapiens
gccccucugcaguaguuaugcc

SEQ ID NO: 15767 - RNA, 20 nt, Homo sapiens
uagagcggcugcgagcgggc

SEQ ID NO: 15768 - RNA, 22 nt, Homo sapiens
uccugcucuucagguucuccca

SEQ ID NO: 15769 - RNA, 22 nt, Homo sapiens
guauggagccugggggcaggga

SEQ ID NO: 15770 - RNA, 22 nt, Homo sapiens
agcacuggccugggagucaggg

SEQ ID NO: 15771 - RNA, 22 nt, Homo sapiens
ucugucacugacccgggcaagu

SEQ ID NO: 15772 - RNA, 22 nt, Homo sapiens
cagggacaacuccauucguaga

SEQ ID NO: 15773 - RNA, 22 nt, Homo sapiens
ucuagaaugggggcuccuuccg

SEQ ID NO: 15774 - RNA, 23 nt, Homo sapiens
aacauucaacgcugucggugagu

SEQ ID NO: 15775 - RNA, 22 nt, Homo sapiens
accaucgaccguugauuguacc

SEQ ID NO: 15776 - RNA, 22 nt, Homo sapiens
uggcauacaguaggugcucagu

SEQ ID NO: 15777 - RNA, 22 nt, Homo sapiens
agcucugacugugugccuggua

SEQ ID NO: 15778 - RNA, 22 nt, Homo sapiens
uccugagacuuccgccagcccc

SEQ ID NO: 15779 - RNA, 22 nt, Homo sapiens
gguggguggaggugucuccagg

SEQ ID NO: 15780 - RNA, 22 nt, Homo sapiens
agagccccugagcugcaugugg

SEQ ID NO: 15781 - RNA, 22 nt, Homo sapiens
gccagcuggggagggguucugg

SEQ ID NO: 15782 - RNA, 22 nt, Homo sapiens
ggcugggcggagguggggucag

SEQ ID NO: 15783 - RNA, 22 nt, Homo sapiens
aaccgcgcccccgcucagccuc

SEQ ID NO: 15784 - RNA, 22 nt, Homo sapiens
acgagguuaugauuggcaugac

SEQ ID NO: 15785 - RNA, 22 nt, Homo sapiens
uugccauaguuauagccaugau

SEQ ID NO: 15786 - RNA, 22 nt, Homo sapiens
aaaaagaggauugcuauuuugg

SEQ ID NO: 15787 - RNA, 22 nt, Homo sapiens
caagauaccaccuuuuuuacca

SEQ ID NO: 15788 - RNA, 22 nt, Homo sapiens
ucacuggaggucaguggagcac

SEQ ID NO: 15789 - RNA, 22 nt, Homo sapiens
gugcccugggccuuccaggaca

SEQ ID NO: 15790 - RNA, 22 nt, Homo sapiens
aggcuuagucaaucagacucaa

SEQ ID NO: 15791 - RNA, 22 nt, Homo sapiens
ugauuuuuggaucugagcugca

SEQ ID NO: 15792 - RNA, 22 nt, Homo sapiens
uggggccuucggguccuguggg

SEQ ID NO: 15793 - RNA, 22 nt, Homo sapiens
gagcaggaccuguagggccugc

SEQ ID NO: 15794 - RNA, 22 nt, Homo sapiens
ugcuuacccucccugcaguaag

SEQ ID NO: 15795 - RNA, 22 nt, Homo sapiens
uuacuucaggggagguuuguga

SEQ ID NO: 15796 - RNA, 22 nt, Homo sapiens
ugcucucaggaaggaguauagu

SEQ ID NO: 15797 - RNA, 22 nt, Homo sapiens
cauacuccuuuuugaaaguugc

SEQ ID NO: 15798 - RNA, 22 nt, Homo sapiens
ucuguuacuacgcaccacccuu

SEQ ID NO: 15799 - RNA, 22 nt, Homo sapiens
gugguuguggaggugacagaac

SEQ ID NO: 15800 - RNA, 22 nt, Homo sapiens
ugagaguuggcagccucagaaa

SEQ ID NO: 15801 - RNA, 22 nt, Homo sapiens
uucugggcugugaaacgcucuc

SEQ ID NO: 15802 - RNA, 22 nt, Homo sapiens
gccaaaccagaucauucaggcc

SEQ ID NO: 15803 - RNA, 22 nt, Homo sapiens
ccuaaauauucugguuuggcug

SEQ ID NO: 15804 - RNA, 22 nt, Homo sapiens
uucuccaacuguccuccccaca

SEQ ID NO: 15805 - RNA, 22 nt, Homo sapiens
cgggaaggcagugggaggaacu

SEQ ID NO: 15806 - RNA, 22 nt, Homo sapiens
ggggugcuaucugugauugagg

SEQ ID NO: 15807 - RNA, 24 nt, Homo sapiens
ucucacacagaaaucgcacccguc

SEQ ID NO: 15808 - RNA, 22 nt, Homo sapiens
ugcauguuuagugacacaaucc

SEQ ID NO: 15809 - RNA, 22 nt, Homo sapiens
uuguaucacuaaacaugugaca

SEQ ID NO: 15810 - RNA, 22 nt, Homo sapiens
uucugugggcggguacaaacac

SEQ ID NO: 15811 - RNA, 22 nt, Homo sapiens
aucuguagcugucuguggaggg

SEQ ID NO: 15812 - RNA, 22 nt, Homo sapiens
agggaacagaggaggggccgac

SEQ ID NO: 15813 - RNA, 22 nt, Homo sapiens
uuggucuuuccuucucccuacu

SEQ ID NO: 15814 - RNA, 22 nt, Homo sapiens
uuggggaucaugguuauauucc

SEQ ID NO: 15815 - RNA, 22 nt, Homo sapiens
aaaaaugacucugguccuuuuc

SEQ ID NO: 15816 - RNA, 22 nt, Homo sapiens
aagcggcccuuguguguuggug

SEQ ID NO: 15817 - RNA, 22 nt, Homo sapiens
ccacacgcgcaggggccaggcu

SEQ ID NO: 15818 - RNA, 22 nt, Homo sapiens
ccuccuucucagccccagcucc

SEQ ID NO: 15819 - RNA, 22 nt, Homo sapiens
gggaguugggagcagagagggg

SEQ ID NO: 15820 - RNA, 22 nt, Homo sapiens
uauuuaaaaugucugaauuggg

SEQ ID NO: 15821 - RNA, 22 nt, Homo sapiens
caaauuagcuuuuuaaauagaa

SEQ ID NO: 15822 - RNA, 22 nt, Homo sapiens
uuccagagccuguggucucccu

SEQ ID NO: 15823 - RNA, 22 nt, Homo sapiens
ucuugggagccagcucucuggg

SEQ ID NO: 15824 - RNA, 22 nt, Homo sapiens
ggaagugggccuucacaauguc

SEQ ID NO: 15825 - RNA, 22 nt, Homo sapiens
gacuauugaaggccacuuccug

SEQ ID NO: 15826 - RNA, 22 nt, Homo sapiens
ggucuuguccuuuuuuggcuuc

SEQ ID NO: 15827 - RNA, 20 nt, Homo sapiens
cugggagaggacagauggcc

SEQ ID NO: 15828 - RNA, 22 nt, Homo sapiens
gguuauuuaggguuaccaccug

SEQ ID NO: 15829 - RNA, 22 nt, Homo sapiens
gauggcaagccugaguaacugc

SEQ ID NO: 15830 - RNA, 22 nt, Homo sapiens
caguccccuccccagccccgac

SEQ ID NO: 15831 - RNA, 16 nt, Homo sapiens
cggggagggggugcug

SEQ ID NO: 15832 - RNA, 22 nt, Homo sapiens
aggaggcuucuggaucuuucca

SEQ ID NO: 15833 - RNA, 22 nt, Homo sapiens
uaaagaugcaaucaggccuccu

SEQ ID NO: 15834 - RNA, 22 nt, Homo sapiens
aggaggcuucuggaucuuucca

SEQ ID NO: 15835 - RNA, 22 nt, Homo sapiens
uaaggaugcaaucaggccuccu

SEQ ID NO: 15836 - RNA, 22 nt, Homo sapiens
ucugugaggcagggcugucuuc

SEQ ID NO: 15837 - RNA, 22 nt, Homo sapiens
gagaccagucgugucucagacg

SEQ ID NO: 15838 - RNA, 22 nt, Homo sapiens
uagggguggggcaaaggggcau

SEQ ID NO: 15839 - RNA, 22 nt, Homo sapiens
ucuccucuguccucaccccuuu

SEQ ID NO: 15840 - RNA, 22 nt, Homo sapiens
ugagcaggcgggaggccuggca

SEQ ID NO: 15841 - RNA, 22 nt, Homo sapiens
acagccucaugcccgcucagaa

SEQ ID NO: 15842 - RNA, 22 nt, Homo sapiens
uggcuggucaaacggaaccaag

SEQ ID NO: 15843 - RNA, 21 nt, Homo sapiens
uugguccccuucaaccagcua

SEQ ID NO: 15844 - RNA, 22 nt, Homo sapiens
cccugucucacuauguuaagug

SEQ ID NO: 15845 - RNA, 22 nt, Homo sapiens
cuuaacacaggaggcaagguaa

SEQ ID NO: 15846 - RNA, 22 nt, Homo sapiens
aaauggucugguugcugagugg

SEQ ID NO: 15847 - RNA, 22 nt, Homo sapiens
uuuagcagccaagucuauuuua

SEQ ID NO: 15848 - RNA, 22 nt, Homo sapiens
uauauguuuguuggcuaauaaa

SEQ ID NO: 15849 - RNA, 22 nt, Homo sapiens
uuggcagacaagcccauacccu

SEQ ID NO: 15850 - RNA, 22 nt, Homo sapiens
ugcagaagucccaggacuggca

SEQ ID NO: 15851 - RNA, 22 nt, Homo sapiens
ccagccuggggacucugccaag

SEQ ID NO: 15852 - RNA, 22 nt, Homo sapiens
gagcugguaaaauggaaccaaa

SEQ ID NO: 15853 - RNA, 22 nt, Homo sapiens
uugguccccuucaaccagcugu

SEQ ID NO: 15854 - RNA, 22 nt, Homo sapiens
aguuugaggaucuaagacagau

SEQ ID NO: 15855 - RNA, 22 nt, Homo sapiens
uauugucuuaggucuuacaaaa

SEQ ID NO: 15856 - RNA, 22 nt, Homo sapiens
ucugagggcaagugccuggggc

SEQ ID NO: 15857 - RNA, 22 nt, Homo sapiens
ucucaggcagcucugccuccca

SEQ ID NO: 15858 - RNA, 22 nt, Homo sapiens
aucacuaacuccacugccauca

SEQ ID NO: 15859 - RNA, 23 nt, Homo sapiens
uaggcagugucauuagcugauug

SEQ ID NO: 15860 - RNA, 21 nt, Homo sapiens
aaucacuaacuccacugccau

SEQ ID NO: 15861 - RNA, 23 nt, Homo sapiens
aggcagugucauuagcugauugu

SEQ ID NO: 15862 - RNA, 22 nt, Homo sapiens
caaucacuaacuccacugccau

SEQ ID NO: 15863 - RNA, 23 nt, Homo sapiens
caaucacuaacuccacugccauc

SEQ ID NO: 15864 - RNA, 22 nt, Homo sapiens
gcuuggcagggcuugugaugcg

SEQ ID NO: 15865 - RNA, 21 nt, Homo sapiens
ucgcuugcccucgccccaagu

SEQ ID NO: 15866 - RNA, 22 nt, Homo sapiens
aagcgcgaugcccucuccuaga

SEQ ID NO: 15867 - RNA, 22 nt, Homo sapiens
uagggaggggauacgucugcuu

SEQ ID NO: 15868 - RNA, 22 nt, Homo sapiens
uagacuucugcagaggcuagcu

SEQ ID NO: 15869 - RNA, 22 nt, Homo sapiens
ugagucucuguaggacucucag

SEQ ID NO: 15870 - RNA, 22 nt, Homo sapiens
uggggaacuccacgucuuggga

SEQ ID NO: 15871 - RNA, 22 nt, Homo sapiens
uccagcgugugcagcuccuccu

SEQ ID NO: 15872 - RNA, 22 nt, Homo sapiens
ggugcgugucaggguccugggg

SEQ ID NO: 15873 - RNA, 22 nt, Homo sapiens
ccagguccuggugcggacagcc

SEQ ID NO: 15874 - RNA, 22 nt, Homo sapiens
gggugggggacuggugaaggag

SEQ ID NO: 15875 - RNA, 22 nt, Homo sapiens
ugcucucacugguuacucaucu

SEQ ID NO: 15876 - RNA, 22 nt, Homo sapiens
ucccuuuucucuuacauuuuuu

SEQ ID NO: 15877 - RNA, 22 nt, Homo sapiens
ggaaugaagaagugaaggggug

SEQ ID NO: 15878 - RNA, 22 nt, Homo sapiens
gaauuucccguggcaucugaua

SEQ ID NO: 15879 - RNA, 22 nt, Homo sapiens
uagaugccaugggaauauugug

SEQ ID NO: 15880 - RNA, 22 nt, Homo sapiens
uauucccuccacauuggucagc

SEQ ID NO: 15881 - RNA, 22 nt, Homo sapiens
uugaacagggugggggaaugga

SEQ ID NO: 15882 - RNA, 22 nt, Homo sapiens
ugcaggaacacaaugagucuca

SEQ ID NO: 15883 - RNA, 22 nt, Homo sapiens
uggauuccugguuccuacagca

SEQ ID NO: 15884 - RNA, 22 nt, Homo sapiens
uggggucuggaguggugggggu

SEQ ID NO: 15885 - RNA, 22 nt, Homo sapiens
caccgccaggccaggcccugag

SEQ ID NO: 15886 - RNA, 22 nt, Homo sapiens
agaaaagaggaaagaaagcacu

SEQ ID NO: 15887 - RNA, 22 nt, Homo sapiens
ugcuugcaagucuuuuguuucc

SEQ ID NO: 15888 - RNA, 22 nt, Homo sapiens
gauggaaagcuugaggucaacc

SEQ ID NO: 15889 - RNA, 22 nt, Homo sapiens
agguagacugaaguucugucau

SEQ ID NO: 15890 - RNA, 22 nt, Homo sapiens
caggcagcacuuccuuucugug

SEQ ID NO: 15891 - RNA, 22 nt, Homo sapiens
cucaggcgggaaguaggcuggg

SEQ ID NO: 15892 - RNA, 22 nt, Homo sapiens
aguccaugucuaggugaagagc

SEQ ID NO: 15893 - RNA, 22 nt, Homo sapiens
cagcuuugccauagcauggacu

SEQ ID NO: 15894 - RNA, 22 nt, Homo sapiens
ccugggucugggcuuuaggcca

SEQ ID NO: 15895 - RNA, 22 nt, Homo sapiens
uggucuuuagcagggccugggc

SEQ ID NO: 15896 - RNA, 22 nt, Homo sapiens
gcgcaguggugcgaggaugagc

SEQ ID NO: 15897 - RNA, 22 nt, Homo sapiens
ucgcucgcgcacucugcggcug

SEQ ID NO: 15898 - RNA, 22 nt, Homo sapiens
ucaaaagugacuccagcaucug

SEQ ID NO: 15899 - RNA, 22 nt, Homo sapiens
auguaacuggggucacuguuuu

SEQ ID NO: 15900 - RNA, 22 nt, Homo sapiens
ugcuccggaaggaccacauaag

SEQ ID NO: 15901 - RNA, 22 nt, Homo sapiens
uggauugguccugccugagcau

SEQ ID NO: 15902 - RNA, 22 nt, Homo sapiens
agcuucccucacuuuccaccuc

SEQ ID NO: 15903 - RNA, 22 nt, Homo sapiens
guggcaggugggucugaggcug

SEQ ID NO: 15904 - RNA, 22 nt, Homo sapiens
uagacucuggucucuagagcuc

SEQ ID NO: 15905 - RNA, 22 nt, Homo sapiens
ccuagagacagggagucuggcu

SEQ ID NO: 15906 - RNA, 22 nt, Homo sapiens
uggcccuggggcaggaggguac

SEQ ID NO: 15907 - RNA, 22 nt, Homo sapiens
gccccucugaccucagagccga

SEQ ID NO: 15908 - RNA, 22 nt, Homo sapiens
caccagccucuggggaggggag

SEQ ID NO: 15909 - RNA, 22 nt, Homo sapiens
cuccagcccaggggcaggugac

SEQ ID NO: 15910 - RNA, 22 nt, Homo sapiens
caccagccucuggggaggggag

SEQ ID NO: 15911 - RNA, 22 nt, Homo sapiens
cuccagcccgggggcaggugac

SEQ ID NO: 15912 - RNA, 22 nt, Homo sapiens
gagaggugggggcgaugggguu

SEQ ID NO: 15913 - RNA, 22 nt, Homo sapiens
cuccagcucacuccccucucuu

SEQ ID NO: 15914 - RNA, 22 nt, Homo sapiens
agaccaggggcccgggacauga

SEQ ID NO: 15915 - RNA, 22 nt, Homo sapiens
ucucuuccaggccccugugguu

SEQ ID NO: 15916 - RNA, 22 nt, Homo sapiens
ucuguggauauguucucucuuc

SEQ ID NO: 15917 - RNA, 22 nt, Homo sapiens
aagagaaauauuuccauggaag

SEQ ID NO: 15918 - RNA, 22 nt, Homo sapiens
uccauccaugcucuacugucaa

SEQ ID NO: 15919 - RNA, 22 nt, Homo sapiens
caguggaggguggcugggagug

SEQ ID NO: 15920 - RNA, 22 nt, Homo sapiens
uggaggaggcucuggggcugcc

SEQ ID NO: 15921 - RNA, 22 nt, Homo sapiens
ggagccuccaguauccuccucu

SEQ ID NO: 15922 - RNA, 22 nt, Homo sapiens
gguggguccccccuggagcugc

SEQ ID NO: 15923 - RNA, 22 nt, Homo sapiens
aggcuucuugggugggcucucc

SEQ ID NO: 15924 - RNA, 22 nt, Homo sapiens
caucuuccaguacaguguugga

SEQ ID NO: 15925 - RNA, 22 nt, Homo sapiens
uaacacugucugguaaagaugg

SEQ ID NO: 15926 - RNA, 22 nt, Homo sapiens
uguccucugcagugggacgggg

SEQ ID NO: 15927 - RNA, 22 nt, Homo sapiens
guugucccauugcagagccugg

SEQ ID NO: 15928 - RNA, 22 nt, Homo sapiens
ggagagaccuugucauacugua

SEQ ID NO: 15929 - RNA, 22 nt, Homo sapiens
uugcaagagaagguuucucugu

SEQ ID NO: 15930 - RNA, 22 nt, Homo sapiens
uuccccaggacagucuggggua

SEQ ID NO: 15931 - RNA, 22 nt, Homo sapiens
uaccugaggguccggggaacag

SEQ ID NO: 15932 - RNA, 22 nt, Homo sapiens
uuccccaggacagucuggggua

SEQ ID NO: 15933 - RNA, 22 nt, Homo sapiens
uacuugaggguccggggaacag

SEQ ID NO: 15934 - RNA, 22 nt, Homo sapiens
uugcauugauuugugucucaca

SEQ ID NO: 15935 - RNA, 22 nt, Homo sapiens
uguuggucacaaaucaaugcua

SEQ ID NO: 15936 - RNA, 19 nt, Homo sapiens
ggcggcggcggcgacucug

SEQ ID NO: 15937 - RNA, 22 nt, Homo sapiens
uuugaauaauuaucugaaauaa

SEQ ID NO: 15938 - RNA, 22 nt, Homo sapiens
uuucagguauuuauucaaaguc

SEQ ID NO: 15939 - RNA, 22 nt, Homo sapiens
ugaaaucaagaugcaagaguug

SEQ ID NO: 15940 - RNA, 22 nt, Homo sapiens
ucuugcauuuugauuuuggucu

SEQ ID NO: 15941 - RNA, 22 nt, Homo sapiens
ucuugguugaucauggacucua

SEQ ID NO: 15942 - RNA, 22 nt, Homo sapiens
aguuuaugaccaacugaggcca

SEQ ID NO: 15943 - RNA, 22 nt, Homo sapiens
acauuucucugauuuguggcca

SEQ ID NO: 15944 - RNA, 22 nt, Homo sapiens
gcuguuaaucagggaaaugcca

SEQ ID NO: 15945 - RNA, 22 nt, Homo sapiens
gaaauacaaaauguaaggagac

SEQ ID NO: 15946 - RNA, 22 nt, Homo sapiens
uucuuuccacauuuugugucuc

SEQ ID NO: 15947 - RNA, 22 nt, Homo sapiens
uaggugguuuagaguaugugga

SEQ ID NO: 15948 - RNA, 22 nt, Homo sapiens
cuacuagacuguaaaucgcuug

SEQ ID NO: 15949 - RNA, 22 nt, Homo sapiens
ucccuggagguaauuauugacc

SEQ ID NO: 15950 - RNA, 22 nt, Homo sapiens
ucaauauuuaccucuuaggcca

SEQ ID NO: 15951 - RNA, 22 nt, Homo sapiens
gaucaagaacuucagggacccu

SEQ ID NO: 15952 - RNA, 22 nt, Homo sapiens
ggcucccuggacuucucagauu

SEQ ID NO: 15953 - RNA, 22 nt, Homo sapiens
ccuaggugugcuccgguggggg

SEQ ID NO: 15954 - RNA, 22 nt, Homo sapiens
uccuuccaggagcacaccaggg

SEQ ID NO: 15955 - RNA, 22 nt, Homo sapiens
ucauuucaaugauacuacuaag

SEQ ID NO: 15956 - RNA, 22 nt, Homo sapiens
uggugguaucauugaaauaaca

SEQ ID NO: 15957 - RNA, 22 nt, Homo sapiens
caaauuuagguaacagucugua

SEQ ID NO: 15958 - RNA, 22 nt, Homo sapiens
cagccuguuaccuauauuuggg

SEQ ID NO: 15959 - RNA, 22 nt, Homo sapiens
uuucuauuccugugggcuuucu

SEQ ID NO: 15960 - RNA, 22 nt, Homo sapiens
ggaggcccacaggccuggcccc

SEQ ID NO: 15961 - RNA, 22 nt, Homo sapiens
uacuuuacgggaucauagacuu

SEQ ID NO: 15962 - RNA, 22 nt, Homo sapiens
aaucagugauccuauaaaguga

SEQ ID NO: 15963 - RNA, 22 nt, Homo sapiens
uuuauaugcauguauuacuaau

SEQ ID NO: 15964 - RNA, 22 nt, Homo sapiens
uacaaguaauauagcauguaaa

SEQ ID NO: 15965 - RNA, 22 nt, Homo sapiens
ugcaaggaagcucucucugcca

SEQ ID NO: 15966 - RNA, 22 nt, Homo sapiens
uggguugacagcucccuugugu

SEQ ID NO: 15967 - RNA, 22 nt, Homo sapiens
aaaggaggccugauuggggggc

SEQ ID NO: 15968 - RNA, 22 nt, Homo sapiens
cccccggucagguucagccagc

SEQ ID NO: 15969 - RNA, 22 nt, Homo sapiens
aaacgaggcuagaagaggcagu

SEQ ID NO: 15970 - RNA, 22 nt, Homo sapiens
ugccucucccagccucauuuga

SEQ ID NO: 15971 - RNA, 22 nt, Homo sapiens
uguguuuucucgcuauuuauca

SEQ ID NO: 15972 - RNA, 22 nt, Homo sapiens
augacuaauggaaaauacaaug

SEQ ID NO: 15973 - RNA, 22 nt, Homo sapiens
aaccguggcuuucgauuguuac

SEQ ID NO: 15974 - RNA, 22 nt, Homo sapiens
uaacagucuacagccauggucg

SEQ ID NO: 15975 - RNA, 22 nt, Homo sapiens
agcugagucaguauggaaaauu

SEQ ID NO: 15976 - RNA, 22 nt, Homo sapiens
aguuccaucugucucaucugcu

SEQ ID NO: 15977 - RNA, 22 nt, Homo sapiens
uaacauuauacagagaggacag

SEQ ID NO: 15978 - RNA, 22 nt, Homo sapiens
ugcccuuucuauaugauguaau

SEQ ID NO: 15979 - RNA, 22 nt, Homo sapiens
accaguugugguugggguugga

SEQ ID NO: 15980 - RNA, 22 nt, Homo sapiens
ccaguuuuaggcaaagcuguga

SEQ ID NO: 15981 - RNA, 22 nt, Homo sapiens
uaucucuaagcccuuggucaau

SEQ ID NO: 15982 - RNA, 21 nt, Homo sapiens
acuauguucuuagggaaggag

SEQ ID NO: 15983 - RNA, 22 nt, Homo sapiens
uggagacuucuaggaaaucagc

SEQ ID NO: 15984 - RNA, 22 nt, Homo sapiens
ugcuuguucuuggaaauuuccu

SEQ ID NO: 15985 - RNA, 22 nt, Homo sapiens
aacaagucacagccggccucau

SEQ ID NO: 15986 - RNA, 22 nt, Homo sapiens
uggaagacuagugauuuuguug

SEQ ID NO: 15987 - RNA, 22 nt, Homo sapiens
uccaggugauacauucaguggc

SEQ ID NO: 15988 - RNA, 22 nt, Homo sapiens
uuacugaauguauugcuuggac

SEQ ID NO: 15989 - RNA, 22 nt, Homo sapiens
uuaaacuacaaaacucuuucga

SEQ ID NO: 15990 - RNA, 22 nt, Homo sapiens
uucagagauuugaguuuaagaa

SEQ ID NO: 15991 - RNA, 22 nt, Homo sapiens
aguugcagauaguaaguaaguu

SEQ ID NO: 15992 - RNA, 22 nt, Homo sapiens
aucaauucacugcugcagccuu

SEQ ID NO: 15993 - RNA, 22 nt, Homo sapiens
cgaacaaacucugcaaugcuuu

SEQ ID NO: 15994 - RNA, 22 nt, Homo sapiens
acuuauugcacaguuuguucag

SEQ ID NO: 15995 - RNA, 22 nt, Homo sapiens
auauucaggagauucuaccuaa

SEQ ID NO: 15996 - RNA, 22 nt, Homo sapiens
ggaagagucucuggauaguagc

SEQ ID NO: 15997 - RNA, 22 nt, Homo sapiens
ucuauaaguuuuaagucaggca

SEQ ID NO: 15998 - RNA, 22 nt, Homo sapiens
uguguuucuuaaagauuauaga

SEQ ID NO: 15999 - RNA, 22 nt, Homo sapiens
ggggacaggagggcgccggauc

SEQ ID NO: 16000 - RNA, 20 nt, Homo sapiens
auccuuuugccuccugcccc

SEQ ID NO: 16001 - RNA, 22 nt, Homo sapiens
gcccuucuggaaccuucugcaa

SEQ ID NO: 16002 - RNA, 22 nt, Homo sapiens
ugaggaggaggugcgggaaagg

SEQ ID NO: 16003 - RNA, 22 nt, Homo sapiens
uugacaaagugugccugucauu

SEQ ID NO: 16004 - RNA, 22 nt, Homo sapiens
ggacaggugacauguucuucaa

SEQ ID NO: 16005 - RNA, 22 nt, Homo sapiens
uuauccuccaaaauaggccagu

SEQ ID NO: 16006 - RNA, 20 nt, Homo sapiens
guuuuacugggaggagaagu

SEQ ID NO: 16007 - RNA, 22 nt, Homo sapiens
uaguucccaagugaauaaacua

SEQ ID NO: 16008 - RNA, 22 nt, Homo sapiens
uaguuuaacaaaagggaaucag

SEQ ID NO: 16009 - RNA, 22 nt, Homo sapiens
ugccugaagguuuagucuaaga

SEQ ID NO: 16010 - RNA, 22 nt, Homo sapiens
cacuuaugacuaaaaguaggca

SEQ ID NO: 16011 - RNA, 22 nt, Homo sapiens
cgggaagggggaggguuggagc

SEQ ID NO: 16012 - RNA, 22 nt, Homo sapiens
uuccagcugucucaguguccug

SEQ ID NO: 16013 - RNA, 22 nt, Homo sapiens
cccgacagugccuccucuccuc

SEQ ID NO: 16014 - RNA, 22 nt, Homo sapiens
aggagaggaggcauuuaggaaa

SEQ ID NO: 16015 - RNA, 22 nt, Homo sapiens
ucuuacuacagggcaacccuuu

SEQ ID NO: 16016 - RNA, 22 nt, Homo sapiens
aggguagaccaugugguaguaa

SEQ ID NO: 16017 - RNA, 21 nt, Homo sapiens
cccagauaauggcacucucaa

SEQ ID NO: 16018 - RNA, 21 nt, Homo sapiens
uugaaaggcuauuucuugguc

SEQ ID NO: 16019 - RNA, 22 nt, Homo sapiens
uacucugugggagggaggagau

SEQ ID NO: 16020 - RNA, 22 nt, Homo sapiens
uauuccuccuucauacuugcag

SEQ ID NO: 16021 - RNA, 22 nt, Homo sapiens
aucaugugugguuguguguuug

SEQ ID NO: 16022 - RNA, 22 nt, Homo sapiens
gggcauuguuagacaugacauu

SEQ ID NO: 16023 - RNA, 22 nt, Homo sapiens
gcuuagcucaugaacuguaggc

SEQ ID NO: 16024 - RNA, 22 nt, Homo sapiens
ccugguaguaaaugaguagagc

SEQ ID NO: 16025 - RNA, 22 nt, Homo sapiens
uucaaucacuaaguaaauuuac

SEQ ID NO: 16026 - RNA, 22 nt, Homo sapiens
guauuuacuaagugguaaauau

SEQ ID NO: 16027 - RNA, 22 nt, Homo sapiens
auagaggugacagguuaggaua

SEQ ID NO: 16028 - RNA, 22 nt, Homo sapiens
ucuaugaucuguugucucuggu

SEQ ID NO: 16029 - RNA, 22 nt, Homo sapiens
uagcagggcaggcuggcacccc

SEQ ID NO: 16030 - RNA, 22 nt, Homo sapiens
ggucccaccugcuccugcaggc

SEQ ID NO: 16031 - RNA, 22 nt, Homo sapiens
ugaaucauuagaacauuucuga

SEQ ID NO: 16032 - RNA, 22 nt, Homo sapiens
cuaaaaguucuggaaugauuuc

SEQ ID NO: 16033 - RNA, 22 nt, Homo sapiens
aagaucaccuaggaaguggguc

SEQ ID NO: 16034 - RNA, 22 nt, Homo sapiens
ggccauauucuagggauuuauc

SEQ ID NO: 16035 - RNA, 22 nt, Homo sapiens
cgucuucaugaagcuccuaagg

SEQ ID NO: 16036 - RNA, 22 nt, Homo sapiens
uuagggagcuucaugagagagc

SEQ ID NO: 16037 - RNA, 22 nt, Homo sapiens
acugauaggcauugcuggcuga

SEQ ID NO: 16038 - RNA, 22 nt, Homo sapiens
gccaguaccugcucaucagggu

SEQ ID NO: 16039 - RNA, 22 nt, Homo sapiens
uuuucuaacacggaagcugcau

SEQ ID NO: 16040 - RNA, 22 nt, Homo sapiens
gugcccuuuuguggaggaggcu

SEQ ID NO: 16041 - RNA, 22 nt, Homo sapiens
cccaggccucgcuuccccagcc

SEQ ID NO: 16042 - RNA, 22 nt, Homo sapiens
uuuaggggaucgagggcuggcg

SEQ ID NO: 16043 - RNA, 22 nt, Homo sapiens
uuuauggcaauuugcaucguua

SEQ ID NO: 16044 - RNA, 22 nt, Homo sapiens
ugaaacaaauugccauaaaaug

SEQ ID NO: 16045 - RNA, 22 nt, Homo sapiens
uuaugucccucccuccagucca

SEQ ID NO: 16046 - RNA, 21 nt, Homo sapiens
gcuuggagggcuggacaagcc

SEQ ID NO: 16047 - RNA, 22 nt, Homo sapiens
gccgcccgggagggggcguggg

SEQ ID NO: 16048 - RNA, 22 nt, Homo sapiens
cgaagcccccggcccggcggcg

SEQ ID NO: 16049 - RNA, 22 nt, Homo sapiens
acugugucugguccacaguagg

SEQ ID NO: 16050 - RNA, 22 nt, Homo sapiens
ugcuggagaggccaguuacggg

SEQ ID NO: 16051 - RNA, 22 nt, Homo sapiens
aguacauguuguucaaaagcca

SEQ ID NO: 16052 - RNA, 22 nt, Homo sapiens
ggucaagagcagcaugagcuau

SEQ ID NO: 16053 - RNA, 22 nt, Homo sapiens
uuaaugcucauuuggcucugca

SEQ ID NO: 16054 - RNA, 22 nt, Homo sapiens
cuuaggccaaauggcgcaucaa

SEQ ID NO: 16055 - RNA, 22 nt, Homo sapiens
aguggcuggguuuggacggcaa

SEQ ID NO: 16056 - RNA, 22 nt, Homo sapiens
uguccaauucuagauuacacug

SEQ ID NO: 16057 - RNA, 22 nt, Homo sapiens
ucacgccaggaggaaaaauagu

SEQ ID NO: 16058 - RNA, 22 nt, Homo sapiens
uguuauuccccuugcuguggug

SEQ ID NO: 16059 - RNA, 22 nt, Homo sapiens
uuaaagauagauggcauuguac

SEQ ID NO: 16060 - RNA, 22 nt, Homo sapiens
uacaauggcaucuaucuauaau

SEQ ID NO: 16061 - RNA, 22 nt, Homo sapiens
ucugucuguauccccacugggg

SEQ ID NO: 16062 - RNA, 22 nt, Homo sapiens
caggagagcggggauguaggca

SEQ ID NO: 16063 - RNA, 22 nt, Homo sapiens
acuguccuuccuggaggugugc

SEQ ID NO: 16064 - RNA, 22 nt, Homo sapiens
ugccuucugggaagagaggccu

SEQ ID NO: 16065 - RNA, 22 nt, Homo sapiens
cagaagccgacugccccucugg

SEQ ID NO: 16066 - RNA, 18 nt, Homo sapiens
agggcaggccuggcucug

SEQ ID NO: 16067 - RNA, 22 nt, Homo sapiens
uaagaguugagguugaacuggg

SEQ ID NO: 16068 - RNA, 22 nt, Homo sapiens
cugguucauauccaucuuugug

SEQ ID NO: 16069 - RNA, 22 nt, Homo sapiens
ggaaagagcacuggacugggaa

SEQ ID NO: 16070 - RNA, 21 nt, Homo sapiens
agaucuaguccuggcucuucc

SEQ ID NO: 16071 - RNA, 22 nt, Homo sapiens
uaagccaaggucugaagucuga

SEQ ID NO: 16072 - RNA, 22 nt, Homo sapiens
gucucagaccuuaaaaugucaa

SEQ ID NO: 16073 - RNA, 22 nt, Homo sapiens
aggcuggcagggggaggaaaaa

SEQ ID NO: 16074 - RNA, 22 nt, Homo sapiens
uuuccucccuuuccgucucugc

SEQ ID NO: 16075 - RNA, 22 nt, Homo sapiens
uuucagcuacuaccucuauuag

SEQ ID NO: 16076 - RNA, 22 nt, Homo sapiens
uaauagagguaauaguugaaau

SEQ ID NO: 16077 - RNA, 22 nt, Homo sapiens
gaccaucccuagccuuaacccu

SEQ ID NO: 16078 - RNA, 22 nt, Homo sapiens
agagguugggguggagguaucc

SEQ ID NO: 16079 - RNA, 22 nt, Homo sapiens
uaggauuuugcacuuaguccag

SEQ ID NO: 16080 - RNA, 22 nt, Homo sapiens
ugguuuuagugcagaaucucug

SEQ ID NO: 16081 - RNA, 22 nt, Homo sapiens
ucgcaguuuuguugugccacca

SEQ ID NO: 16082 - RNA, 21 nt, Homo sapiens
ugcagcacaaccaaacaguga

SEQ ID NO: 16083 - RNA, 22 nt, Homo sapiens
ugugaccucuggccucucccaa

SEQ ID NO: 16084 - RNA, 15 nt, Homo sapiens
gaaggcugaggcaca

SEQ ID NO: 16085 - RNA, 22 nt, Homo sapiens
uugcagauguguugcuaauugu

SEQ ID NO: 16086 - RNA, 22 nt, Homo sapiens
guuaggcuuaugucuguaguuu

SEQ ID NO: 16087 - RNA, 22 nt, Homo sapiens
gauaugcacauguacacaugca

SEQ ID NO: 16088 - RNA, 22 nt, Homo sapiens
cauguaugcaugugcacgugca

SEQ ID NO: 16089 - RNA, 22 nt, Homo sapiens
cuuucagucggauguuugcagc

SEQ ID NO: 16090 - RNA, 22 nt, Homo sapiens
uguaaacauccucgacuggaag

SEQ ID NO: 16091 - RNA, 19 nt, Homo sapiens
cuuucagucggauguuugc

SEQ ID NO: 16092 - RNA, 21 nt, Homo sapiens
cuuucagucggauguuugcag

SEQ ID NO: 16093 - RNA, 22 nt, Homo sapiens
uauguaacaugguccacuaacu

SEQ ID NO: 16094 - RNA, 19 nt, Homo sapiens
ugguagacuauggaacgua

SEQ ID NO: 16095 - RNA, 20 nt, Homo sapiens
ugguagacuauggaacguag

SEQ ID NO: 16096 - RNA, 21 nt, Homo sapiens
ugguagacuauggaacguagg

SEQ ID NO: 16097 - RNA, 22 nt, Homo sapiens
aauguguagcaaaagacagaau

SEQ ID NO: 16098 - RNA, 21 nt, Homo sapiens
gugucuuuugcucugcaguca

SEQ ID NO: 16099 - RNA, 22 nt, Homo sapiens
aauguguagcaaaagacagaau

SEQ ID NO: 16100 - RNA, 21 nt, Homo sapiens
gugucuuuugcucugcaguca

SEQ ID NO: 16101 - RNA, 22 nt, Homo sapiens
agcauuuauuugaggcaggaag

SEQ ID NO: 16102 - RNA, 22 nt, Homo sapiens
ucaugccucucugucaauguug

SEQ ID NO: 16103 - RNA, 22 nt, Homo sapiens
aagacggaaaugaggcuugccu

SEQ ID NO: 16104 - RNA, 22 nt, Homo sapiens
gacaaaccucauuuccuuucug

SEQ ID NO: 16105 - RNA, 22 nt, Homo sapiens
uucaggccaccggggugcuguu

SEQ ID NO: 16106 - RNA, 22 nt, Homo sapiens
ugguaccauggggaccccaaag

SEQ ID NO: 16107 - RNA, 22 nt, Homo sapiens
ucaucgccagccaaccacgacg

SEQ ID NO: 16108 - RNA, 21 nt, Homo sapiens
cgcugauuggcugccgagacc

SEQ ID NO: 16109 - RNA, 22 nt, Homo sapiens
gcugcugacucugauugccauu

SEQ ID NO: 16110 - RNA, 22 nt, Homo sapiens
acaggcaguuggagguuguagc

SEQ ID NO: 16111 - RNA, 22 nt, Homo sapiens
agugcgccucgggugagcaugc

SEQ ID NO: 16112 - RNA, 22 nt, Homo sapiens
ugucacucggcucggcccacua

SEQ ID NO: 16113 - RNA, 22 nt, Homo sapiens
ccagaccgaguggggugagggc

SEQ ID NO: 16114 - RNA, 22 nt, Homo sapiens
gcucucgccucuucgucaggga

SEQ ID NO: 16115 - RNA, 17 nt, Homo sapiens
acacucaaacugcugac

SEQ ID NO: 16116 - RNA, 22 nt, Homo sapiens
uuuuaucuaauaaaucugauaa

SEQ ID NO: 16117 - RNA, 22 nt, Homo sapiens
gauacucggauauuagaugaau

SEQ ID NO: 16118 - RNA, 22 nt, Homo sapiens
gcagcucccacucacucugggc

SEQ ID NO: 16119 - RNA, 22 nt, Homo sapiens
cagggaguggaaaggagcugaa

SEQ ID NO: 16120 - RNA, 22 nt, Homo sapiens
ggaaugaggccguggcccugca

SEQ ID NO: 16121 - RNA, 22 nt, Homo sapiens
gaggucucggccuucauucaca

SEQ ID NO: 16122 - RNA, 22 nt, Homo sapiens
gcccucucccaagccaccuacc

SEQ ID NO: 16123 - RNA, 22 nt, Homo sapiens
ggguagggguuggggguggcug

SEQ ID NO: 16124 - RNA, 22 nt, Homo sapiens
ucgcuggauuccgacaaaggga

SEQ ID NO: 16125 - RNA, 22 nt, Homo sapiens
uccuuuauuuggaccuggugcg

SEQ ID NO: 16126 - RNA, 22 nt, Homo sapiens
ugcuuuucugggaggaccagaa

SEQ ID NO: 16127 - RNA, 22 nt, Homo sapiens
ucugguccucccaaaaagaagc

SEQ ID NO: 16128 - RNA, 22 nt, Homo sapiens
gagauggggagagccccugaug

SEQ ID NO: 16129 - RNA, 22 nt, Homo sapiens
uggggggcuccuuccacauuuu

SEQ ID NO: 16130 - RNA, 22 nt, Homo sapiens
ugcagcaggcugccggagccgc

SEQ ID NO: 16131 - RNA, 22 nt, Homo sapiens
gaucucgguaguucaguagcac

SEQ ID NO: 16132 - RNA, 22 nt, Homo sapiens
acagguggguucuucagagcug

SEQ ID NO: 16133 - RNA, 22 nt, Homo sapiens
gacucuccgaaccucacuuucc

SEQ ID NO: 16134 - RNA, 22 nt, Homo sapiens
gggggccgugggugccugucaa

SEQ ID NO: 16135 - RNA, 22 nt, Homo sapiens
ucuggcagagcccagcaucuug

SEQ ID NO: 16136 - RNA, 22 nt, Homo sapiens
accaucaccuucccuccuuauc

SEQ ID NO: 16137 - RNA, 22 nt, Homo sapiens
uaaagggggagagguggggggg

SEQ ID NO: 16138 - RNA, 22 nt, Homo sapiens
ucagagcuugggaagauaacua

SEQ ID NO: 16139 - RNA, 22 nt, Homo sapiens
guuaucaucucuggcucugauc

SEQ ID NO: 16140 - RNA, 22 nt, Homo sapiens
cgggaagcgggcagccuccgcc

SEQ ID NO: 16141 - RNA, 22 nt, Homo sapiens
gacccggaggcacccgcuuccc

SEQ ID NO: 16142 - RNA, 22 nt, Homo sapiens
ucuuaguggaucauggacccua

SEQ ID NO: 16143 - RNA, 22 nt, Homo sapiens
gaguuuaugaccaacugagucc

SEQ ID NO: 16144 - RNA, 22 nt, Homo sapiens
cccaaggucaaaugggcugguc

SEQ ID NO: 16145 - RNA, 22 nt, Homo sapiens
agcucaucuuggcucuugguua

SEQ ID NO: 16146 - RNA, 22 nt, Homo sapiens
uccuugcugccuuaaacuaacc

SEQ ID NO: 16147 - RNA, 22 nt, Homo sapiens
uuagugaagggcagcagggacu

SEQ ID NO: 16148 - RNA, 22 nt, Homo sapiens
ucaggauaucugggagcuacuu

SEQ ID NO: 16149 - RNA, 22 nt, Homo sapiens
aaugcuaccccagugucuuuga

SEQ ID NO: 16150 - RNA, 22 nt, Homo sapiens
accccagccauuuugaggagcc

SEQ ID NO: 16151 - RNA, 22 nt, Homo sapiens
gaguuccuagaggugccugagg

SEQ ID NO: 16152 - RNA, 22 nt, Homo sapiens
caggccugucuugcucgcccuu

SEQ ID NO: 16153 - RNA, 22 nt, Homo sapiens
agggugggcuagacucuucccc

SEQ ID NO: 16154 - RNA, 22 nt, Homo sapiens
uuggacacauguccuccuccug

SEQ ID NO: 16155 - RNA, 22 nt, Homo sapiens
aggaagacuuguguuggacccc

SEQ ID NO: 16156 - RNA, 22 nt, Homo sapiens
gcagagccagggucugagcggg

SEQ ID NO: 16157 - RNA, 22 nt, Homo sapiens
ugcccugggcccugggucgucc

SEQ ID NO: 16158 - RNA, 22 nt, Homo sapiens
gaggacugggcuggugaugagu

SEQ ID NO: 16159 - RNA, 16 nt, Homo sapiens
uugccagccaagcuuc

SEQ ID NO: 16160 - RNA, 22 nt, Homo sapiens
aucgucaccacgccccaagacc

SEQ ID NO: 16161 - RNA, 22 nt, Homo sapiens
guuugcaggcgugggggaaggg

SEQ ID NO: 16162 - RNA, 22 nt, Homo sapiens
uagggaaugauacauaaaccau

SEQ ID NO: 16163 - RNA, 22 nt, Homo sapiens
uggcuuuauguaucaucuccac

SEQ ID NO: 16164 - RNA, 22 nt, Homo sapiens
uggcaggggcuccgucuuggcu

SEQ ID NO: 16165 - RNA, 22 nt, Homo sapiens
aagccagccugagcuccuccuc

SEQ ID NO: 16166 - RNA, 22 nt, Homo sapiens
uuuucugccaggagggaacacu

SEQ ID NO: 16167 - RNA, 22 nt, Homo sapiens
uuuuuucuccaaacagaaaucu

SEQ ID NO: 16168 - RNA, 22 nt, Homo sapiens
uggaagcucaaaucccaauucu

SEQ ID NO: 16169 - RNA, 22 nt, Homo sapiens
gagguugggguauguuuccgga

SEQ ID NO: 16170 - RNA, 22 nt, Homo sapiens
uugcuguucacuugaaugagga

SEQ ID NO: 16171 - RNA, 22 nt, Homo sapiens
ucagucaaguggacagaaauac

SEQ ID NO: 16172 - RNA, 22 nt, Homo sapiens
agguuggaguuuccacaguggu

SEQ ID NO: 16173 - RNA, 22 nt, Homo sapiens
cccugugggaagcucccuccca

SEQ ID NO: 16174 - RNA, 22 nt, Homo sapiens
ggaggugggagagggucucaga

SEQ ID NO: 16175 - RNA, 22 nt, Homo sapiens
ugcaaccccuuccaucuccuug

SEQ ID NO: 16176 - RNA, 22 nt, Homo sapiens
uaauaugucuaaugauugcuaa

SEQ ID NO: 16177 - RNA, 22 nt, Homo sapiens
gcagucauuaggcacauuagca

SEQ ID NO: 16178 - RNA, 22 nt, Homo sapiens
uccaaguguggacagagcucau

SEQ ID NO: 16179 - RNA, 19 nt, Homo sapiens
gcucucuccacacccugga

SEQ ID NO: 16180 - RNA, 22 nt, Homo sapiens
ugggagauaaugaauuguugga

SEQ ID NO: 16181 - RNA, 22 nt, Homo sapiens
ucagcaauuuguuccauuccca

SEQ ID NO: 16182 - RNA, 22 nt, Homo sapiens
ugccugguuauuccucaggcua

SEQ ID NO: 16183 - RNA, 22 nt, Homo sapiens
ugcacugaggaaguacugaagg

SEQ ID NO: 16184 - RNA, 22 nt, Homo sapiens
agagggugccagagguuggggc

SEQ ID NO: 16185 - RNA, 22 nt, Homo sapiens
gugcucccucuggucgucuugg

SEQ ID NO: 16186 - RNA, 22 nt, Homo sapiens
uagagaggccggugggagaugc

SEQ ID NO: 16187 - RNA, 22 nt, Homo sapiens
aucuccuucccacuucuuagga

SEQ ID NO: 16188 - RNA, 22 nt, Homo sapiens
uacuccuucuguccugugguag

SEQ ID NO: 16189 - RNA, 22 nt, Homo sapiens
ugccacaagacagaacaagcug

SEQ ID NO: 16190 - RNA, 22 nt, Homo sapiens
gguuccuuaucuguucacaauc

SEQ ID NO: 16191 - RNA, 22 nt, Homo sapiens
uaggagcagauaauggacccac

SEQ ID NO: 16192 - RNA, 22 nt, Homo sapiens
auuugcauacacaaucaggcau

SEQ ID NO: 16193 - RNA, 22 nt, Homo sapiens
cccaauugugcauguaaagacg

SEQ ID NO: 16194 - RNA, 22 nt, Homo sapiens
gcauuguguuuuugaauggagc

SEQ ID NO: 16195 - RNA, 22 nt, Homo sapiens
uccaucaaaaacacaauagcac

SEQ ID NO: 16196 - RNA, 22 nt, Homo sapiens
gugcccccaggcccccucagcu

SEQ ID NO: 16197 - RNA, 22 nt, Homo sapiens
ggugggggcgcugggcggcggc

SEQ ID NO: 16198 - RNA, 22 nt, Homo sapiens
cggguaccuggccaggccccuu

SEQ ID NO: 16199 - RNA, 22 nt, Homo sapiens
ggucuggccggguccccccucu

SEQ ID NO: 16200 - RNA, 22 nt, Homo sapiens
aagcugccaguugaagaacugu

SEQ ID NO: 16201 - RNA, 22 nt, Homo sapiens
uaguucuucaguggcaagcuuu

SEQ ID NO: 16202 - RNA, 22 nt, Homo sapiens
uuugaagaagggagagagaucu

SEQ ID NO: 16203 - RNA, 22 nt, Homo sapiens
agucucucaccuucucagaaaa

SEQ ID NO: 16204 - RNA, 22 nt, Homo sapiens
gcugggcuucccaccacugcaa

SEQ ID NO: 16205 - RNA, 22 nt, Homo sapiens
uuuguggugaauggcuuccggc

SEQ ID NO: 16206 - RNA, 22 nt, Homo sapiens
uuccaguuuggugcaauaaauu

SEQ ID NO: 16207 - RNA, 22 nt, Homo sapiens
uuuguuuugcucugggcuggga

SEQ ID NO: 16208 - RNA, 22 nt, Homo sapiens
uuuucccauuagcaaaaugagg

SEQ ID NO: 16209 - RNA, 22 nt, Homo sapiens
uauaagugugaugggaaugaau

SEQ ID NO: 16210 - RNA, 22 nt, Homo sapiens
aaaugggcccacacauuggagc

SEQ ID NO: 16211 - RNA, 22 nt, Homo sapiens
cuuugaucugugugcccaucuc

SEQ ID NO: 16212 - RNA, 22 nt, Homo sapiens
gaaagggaaugacccaguuaga

SEQ ID NO: 16213 - RNA, 22 nt, Homo sapiens
uuuugguuggguguuuucuccc

SEQ ID NO: 16214 - RNA, 22 nt, Homo sapiens
aaagaaccugggccgauaguua

SEQ ID NO: 16215 - RNA, 22 nt, Homo sapiens
aucauaucuuggcuugguucua

SEQ ID NO: 16216 - RNA, 22 nt, Homo sapiens
aaucucucacccauggccugaa

SEQ ID NO: 16217 - RNA, 22 nt, Homo sapiens
cagaucaugggaaggagaaugu

SEQ ID NO: 16218 - RNA, 22 nt, Homo sapiens
ggagacucacagaaggcccaag

SEQ ID NO: 16219 - RNA, 22 nt, Homo sapiens
uccuguggcuuuuugaguuuug

SEQ ID NO: 16220 - RNA, 22 nt, Homo sapiens
uggucaguagagugcuccucaa

SEQ ID NO: 16221 - RNA, 22 nt, Homo sapiens
gggaguuccuuguugaccagaa

SEQ ID NO: 16222 - RNA, 22 nt, Homo sapiens
agggcuuggagaaugauggauc

SEQ ID NO: 16223 - RNA, 22 nt, Homo sapiens
gcuaucucuccacugcccccca

SEQ ID NO: 16224 - RNA, 22 nt, Homo sapiens
gggccacuuacuccugcugucc

SEQ ID NO: 16225 - RNA, 22 nt, Homo sapiens
agagccaggggugguggcugau

SEQ ID NO: 16226 - RNA, 22 nt, Homo sapiens
gggaaaggaagucugugaggaa

SEQ ID NO: 16227 - RNA, 20 nt, Homo sapiens
uccucagagaacucccuccc

SEQ ID NO: 16228 - RNA, 22 nt, Homo sapiens
acuggagagaugccugcgugga

SEQ ID NO: 16229 - RNA, 22 nt, Homo sapiens
uucacgguuucuucucagggug

SEQ ID NO: 16230 - RNA, 22 nt, Homo sapiens
agucugcaaugaccuauaguaa

SEQ ID NO: 16231 - RNA, 22 nt, Homo sapiens
uuacuaucgggcauuagaugcu

SEQ ID NO: 16232 - RNA, 22 nt, Homo sapiens
ugggaagcuauuucugggucua

SEQ ID NO: 16233 - RNA, 22 nt, Homo sapiens
gaggccaggaaaguuacuuaga

SEQ ID NO: 16234 - RNA, 22 nt, Homo sapiens
aggcugaugaguuugguuuuug

SEQ ID NO: 16235 - RNA, 22 nt, Homo sapiens
gagcuagacuuugucaggaggc

SEQ ID NO: 16236 - RNA, 22 nt, Homo sapiens
ggccuccuccuccccuuauucu

SEQ ID NO: 16237 - RNA, 22 nt, Homo sapiens
aaaacaaggggugaggugggug

SEQ ID NO: 16238 - RNA, 22 nt, Homo sapiens
aaaaaaaauacaagcugccaua

SEQ ID NO: 16239 - RNA, 22 nt, Homo sapiens
uagcagcuuguauuuauauuuu

SEQ ID NO: 16240 - RNA, 22 nt, Homo sapiens
aucuuucaauuccuccagcccu

SEQ ID NO: 16241 - RNA, 22 nt, Homo sapiens
gcuggagggauuggaaggaggc

SEQ ID NO: 16242 - RNA, 22 nt, Homo sapiens
ugauggugccuaagucauuuag

SEQ ID NO: 16243 - RNA, 22 nt, Homo sapiens
gaaagauggcugcaccauuuuc

SEQ ID NO: 16244 - RNA, 22 nt, Homo sapiens
ucccagaauggggagagugcag

SEQ ID NO: 16245 - RNA, 22 nt, Homo sapiens
uguacuuuuccuaguuucagga

SEQ ID NO: 16246 - RNA, 17 nt, Homo sapiens
agcugguguugugaauc

SEQ ID NO: 16247 - RNA, 22 nt, Homo sapiens
gcuauuucacgacaccaggguu

SEQ ID NO: 16248 - RNA, 22 nt, Homo sapiens
agcuucagaugaguuguucuca

SEQ ID NO: 16249 - RNA, 22 nt, Homo sapiens
aguuacggcucauaaaccugga

SEQ ID NO: 16250 - RNA, 22 nt, Homo sapiens
agggccucaaugacucaguccc

SEQ ID NO: 16251 - RNA, 22 nt, Homo sapiens
gagcuggucaugaaggcucucu

SEQ ID NO: 16252 - RNA, 22 nt, Homo sapiens
gaaaacuguggcuacauuguga

SEQ ID NO: 16253 - RNA, 22 nt, Homo sapiens
caguguggcuuaugggaagucc

SEQ ID NO: 16254 - RNA, 22 nt, Homo sapiens
gaaaacuguggcuacauuguga

SEQ ID NO: 16255 - RNA, 22 nt, Homo sapiens
caguguggcuuaugggaagucc

SEQ ID NO: 16256 - RNA, 22 nt, Homo sapiens
aaaacagaugggcaauauccag

SEQ ID NO: 16257 - RNA, 22 nt, Homo sapiens
ucgguauugcccaucugcuucu

SEQ ID NO: 16258 - RNA, 22 nt, Homo sapiens
ugauggggcugcaugguuagcg

SEQ ID NO: 16259 - RNA, 22 nt, Homo sapiens
gguguccauggcauccccauuu

SEQ ID NO: 16260 - RNA, 22 nt, Homo sapiens
acugguugccuuuugcugaguu

SEQ ID NO: 16261 - RNA, 22 nt, Homo sapiens
cucaguuaacaggaaucaguga

SEQ ID NO: 16262 - RNA, 22 nt, Homo sapiens
aaguaacagcaucuccacugga

SEQ ID NO: 16263 - RNA, 22 nt, Homo sapiens
acauggaguugcuguuacacuu

SEQ ID NO: 16264 - RNA, 22 nt, Homo sapiens
ugcucuaagaagguugaccugc

SEQ ID NO: 16265 - RNA, 22 nt, Homo sapiens
agguuggaauucuuuugagcag

SEQ ID NO: 16266 - RNA, 22 nt, Homo sapiens
gagguggcuuugggaugugcca

SEQ ID NO: 16267 - RNA, 22 nt, Homo sapiens
gcaucuccugccagcugucucc

SEQ ID NO: 16268 - RNA, 22 nt, Homo sapiens
uaaaacuaaguaccuugaaggg

SEQ ID NO: 16269 - RNA, 22 nt, Homo sapiens
ucuucaaggcaauuuguuuuaa

SEQ ID NO: 16270 - RNA, 22 nt, Homo sapiens
gggcacuuuuggcaucccucca

SEQ ID NO: 16271 - RNA, 22 nt, Homo sapiens
ggagaugcuaaagguaaccccu

SEQ ID NO: 16272 - RNA, 22 nt, Homo sapiens
uugccuguaucucauuuauccu

SEQ ID NO: 16273 - RNA, 22 nt, Homo sapiens
ggguaagugucuacaggcaaaa

SEQ ID NO: 16274 - RNA, 22 nt, Homo sapiens
ccaagauguuggcaggcuggga

SEQ ID NO: 16275 - RNA, 21 nt, Homo sapiens
cucucagcugcuggcacgggc

SEQ ID NO: 16276 - RNA, 22 nt, Homo sapiens
gagguagagccaggauucagau

SEQ ID NO: 16277 - RNA, 22 nt, Homo sapiens
ucagaguccaggcucuccugcu

SEQ ID NO: 16278 - RNA, 22 nt, Homo sapiens
gaugagggaggugggucugaau

SEQ ID NO: 16279 - RNA, 22 nt, Homo sapiens
ugggcucuccucucucagacag

SEQ ID NO: 16280 - RNA, 20 nt, Homo sapiens
auuccuagaaauuguucaua

SEQ ID NO: 16281 - RNA, 22 nt, Homo sapiens
uuaaacaauuccuagacaauau

SEQ ID NO: 16282 - RNA, 22 nt, Homo sapiens
caaauguuucugaauauccaca

SEQ ID NO: 16283 - RNA, 22 nt, Homo sapiens
ugaggauguuuagaaccuaugg

SEQ ID NO: 16284 - RNA, 22 nt, Homo sapiens
ucaguggggccagggccauguu

SEQ ID NO: 16285 - RNA, 22 nt, Homo sapiens
uuugugugugugcugguuucac

SEQ ID NO: 16286 - RNA, 22 nt, Homo sapiens
aagccugguugcaugcuaauga

SEQ ID NO: 16287 - RNA, 22 nt, Homo sapiens
cacucuuauuugcaacuggcuc

SEQ ID NO: 16288 - RNA, 22 nt, Homo sapiens
uucugaagugggaaaaccucaa

SEQ ID NO: 16289 - RNA, 22 nt, Homo sapiens
uuaguuuucucauuucuacaau

SEQ ID NO: 16290 - RNA, 22 nt, Homo sapiens
uuguuguacuuuuuuuuuuguu

SEQ ID NO: 16291 - RNA, 22 nt, Homo sapiens
caaaaaaaaaagcccaacccuu

SEQ ID NO: 16292 - RNA, 22 nt, Homo sapiens
uggaucggccugcaucucaaua

SEQ ID NO: 16293 - RNA, 22 nt, Homo sapiens
ucaaggugggaagggcuaauuu

SEQ ID NO: 16294 - RNA, 22 nt, Homo sapiens
acauggcuucugucuuggaaau

SEQ ID NO: 16295 - RNA, 22 nt, Homo sapiens
uauuuaagacaggaaccaggag

SEQ ID NO: 16296 - RNA, 22 nt, Homo sapiens
acauggcuucugucuuggaaau

SEQ ID NO: 16297 - RNA, 22 nt, Homo sapiens
uauuuaagacaggaaccaggag

SEQ ID NO: 16298 - RNA, 22 nt, Homo sapiens
uuccuuguacagacucugcuuc

SEQ ID NO: 16299 - RNA, 22 nt, Homo sapiens
cuaagucugugcccagaagaga

SEQ ID NO: 16300 - RNA, 22 nt, Homo sapiens
cgucugacuucuccugggauca

SEQ ID NO: 16301 - RNA, 22 nt, Homo sapiens
gucccacagaaaagacaggcaa

SEQ ID NO: 16302 - RNA, 22 nt, Homo sapiens
uugacuggauacagguguuugc

SEQ ID NO: 16303 - RNA, 22 nt, Homo sapiens
aaacgccuggaucuuugacagg

SEQ ID NO: 16304 - RNA, 22 nt, Homo sapiens
caggacuccccagcugcaguca

SEQ ID NO: 16305 - RNA, 20 nt, Homo sapiens
ugcagcuggaaggaagccug

SEQ ID NO: 16306 - RNA, 22 nt, Homo sapiens
ucagagucugcaucagguuaga

SEQ ID NO: 16307 - RNA, 22 nt, Homo sapiens
uaauuugaaagcagauuuugga

SEQ ID NO: 16308 - RNA, 22 nt, Homo sapiens
acucugguuuggggauggcaug

SEQ ID NO: 16309 - RNA, 22 nt, Homo sapiens
uguccauaaauaaacccggagc

SEQ ID NO: 16310 - RNA, 22 nt, Homo sapiens
ucucaaauacaccaggcauggc

SEQ ID NO: 16311 - RNA, 22 nt, Homo sapiens
agccuggugcauuugaagaaca

SEQ ID NO: 16312 - RNA, 22 nt, Homo sapiens
ugagggagcugaccuuucugug

SEQ ID NO: 16313 - RNA, 22 nt, Homo sapiens
acuagagaguagguucccuggu

SEQ ID NO: 16314 - RNA, 22 nt, Homo sapiens
ugaguugaguucugaacuuucc

SEQ ID NO: 16315 - RNA, 22 nt, Homo sapiens
aaaguuguuaacuuuacuuagg

SEQ ID NO: 16316 - RNA, 22 nt, Homo sapiens
caacaaaucccagucuaccuaa

SEQ ID NO: 16317 - RNA, 22 nt, Homo sapiens
uggaagacuagugauuuuguug

SEQ ID NO: 16318 - RNA, 22 nt, Homo sapiens
ggggguuauuuuuaauuggggu

SEQ ID NO: 16319 - RNA, 22 nt, Homo sapiens
cacucucuuagaugaaaacccu

SEQ ID NO: 16320 - RNA, 22 nt, Homo sapiens
uucugggagcacaggcugaacu

SEQ ID NO: 16321 - RNA, 22 nt, Homo sapiens
uuuagucuuugcucccagaauu

SEQ ID NO: 16322 - RNA, 22 nt, Homo sapiens
ccugucuuccacgcccucugcc

SEQ ID NO: 16323 - RNA, 22 nt, Homo sapiens
gaagagguguaggaagaaaggu

SEQ ID NO: 16324 - RNA, 22 nt, Homo sapiens
uugaaauguuuugcuugcucuu

SEQ ID NO: 16325 - RNA, 22 nt, Homo sapiens
augucagcaugcauuuuggcau

SEQ ID NO: 16326 - RNA, 22 nt, Homo sapiens
ugcuugugggaucuccccguug

SEQ ID NO: 16327 - RNA, 22 nt, Homo sapiens
guggcaggccauccuacaagca

SEQ ID NO: 16328 - RNA, 22 nt, Homo sapiens
agugcgggucgguucugcgugc

SEQ ID NO: 16329 - RNA, 22 nt, Homo sapiens
ccgccgauugacccgcgcuccg

SEQ ID NO: 16330 - RNA, 22 nt, Homo sapiens
uauugcacuauaaguuguaaug

SEQ ID NO: 16331 - RNA, 22 nt, Homo sapiens
uuauagucuaaaggucaaugcu

SEQ ID NO: 16332 - RNA, 22 nt, Homo sapiens
gggcaggcucgcuggcggcguc

SEQ ID NO: 16333 - RNA, 18 nt, Homo sapiens
ccucucucgaguucgccu

SEQ ID NO: 16334 - RNA, 22 nt, Homo sapiens
ugggaaggggaagguccucucc

SEQ ID NO: 16335 - RNA, 22 nt, Homo sapiens
gaguagucggcucccuccuuuc

SEQ ID NO: 16336 - RNA, 22 nt, Homo sapiens
ugccuuccuggcuacugggacu

SEQ ID NO: 16337 - RNA, 22 nt, Homo sapiens
ccccagaguguguaggaaggua

SEQ ID NO: 16338 - RNA, 22 nt, Homo sapiens
gcaguggggccagcucccgccc

SEQ ID NO: 16339 - RNA, 22 nt, Homo sapiens
ugaggagagcuguccggcugag

SEQ ID NO: 16340 - RNA, 22 nt, Homo sapiens
ggggcgcugcugcccaugggau

SEQ ID NO: 16341 - RNA, 22 nt, Homo sapiens
ucccaggaggugguggaggcca

SEQ ID NO: 16342 - RNA, 22 nt, Homo sapiens
ucucuguuccauuuuucuugcc

SEQ ID NO: 16343 - RNA, 22 nt, Homo sapiens
aagaacagaguugaauagaagg

SEQ ID NO: 16344 - RNA, 22 nt, Homo sapiens
uccuguggagcagggguauggg

SEQ ID NO: 16345 - RNA, 22 nt, Homo sapiens
cgucugcccaggcuccacaugu

SEQ ID NO: 16346 - RNA, 22 nt, Homo sapiens
aggcuggacacugggggcucgu

SEQ ID NO: 16347 - RNA, 22 nt, Homo sapiens
ugcucccucagggucccgcucu

SEQ ID NO: 16348 - RNA, 22 nt, Homo sapiens
uggaaauuaugaggguaggagg

SEQ ID NO: 16349 - RNA, 22 nt, Homo sapiens
uaaugcccuuaugguuacuacu

SEQ ID NO: 16350 - RNA, 22 nt, Homo sapiens
uaggaagcccgggugcugaggu

SEQ ID NO: 16351 - RNA, 22 nt, Homo sapiens
uguuggcgugcgaggccuccug

SEQ ID NO: 16352 - RNA, 22 nt, Homo sapiens
uucccaaguucaugucacuggg

SEQ ID NO: 16353 - RNA, 22 nt, Homo sapiens
uaagugagaugagagggacuga

SEQ ID NO: 16354 - RNA, 22 nt, Homo sapiens
uggagaacaugacgcugggcuc

SEQ ID NO: 16355 - RNA, 20 nt, Homo sapiens
agcccagcuauguggcccac

SEQ ID NO: 16356 - RNA, 22 nt, Homo sapiens
agagccuggggaggugagggga

SEQ ID NO: 16357 - RNA, 22 nt, Homo sapiens
ccuauaccugccccugggccag

SEQ ID NO: 16358 - RNA, 22 nt, Homo sapiens
uguuuugucacugucaacauca

SEQ ID NO: 16359 - RNA, 22 nt, Homo sapiens
gacugcuguuggaauggaaaau

SEQ ID NO: 16360 - RNA, 22 nt, Homo sapiens
ggaugggaggcaggacccuggc

SEQ ID NO: 16361 - RNA, 22 nt, Homo sapiens
gaguuggggccugacuguccua

SEQ ID NO: 16362 - RNA, 22 nt, Homo sapiens
uaaaggauauagaagguuuucc

SEQ ID NO: 16363 - RNA, 22 nt, Homo sapiens
aaccuucuguauccuuuauuuu

SEQ ID NO: 16364 - RNA, 22 nt, Homo sapiens
uaaaggauauagaagguuuucc

SEQ ID NO: 16365 - RNA, 22 nt, Homo sapiens
aaccuucuguauccuuuauuuu

SEQ ID NO: 16366 - RNA, 22 nt, Homo sapiens
agcagccaguuugauuguguug

SEQ ID NO: 16367 - RNA, 22 nt, Homo sapiens
acaugguuaacuucuggcuccc

SEQ ID NO: 16368 - RNA, 22 nt, Homo sapiens
aucggucuuggcgcuguauacu

SEQ ID NO: 16369 - RNA, 22 nt, Homo sapiens
gauggugcugggugcuggccug

SEQ ID NO: 16370 - RNA, 22 nt, Homo sapiens
cccuaagccuggcucuauccug

SEQ ID NO: 16371 - RNA, 22 nt, Homo sapiens
ggaagagcugggugcgaguggg

SEQ ID NO: 16372 - RNA, 22 nt, Homo sapiens
ugcuggaagaggcaggcaaugu

SEQ ID NO: 16373 - RNA, 22 nt, Homo sapiens
auugcauagcuugucuccuagu

SEQ ID NO: 16374 - RNA, 22 nt, Homo sapiens
ggccaacucugucugucuggug

SEQ ID NO: 16375 - RNA, 22 nt, Homo sapiens
cuggacgaugggguugaggccu

SEQ ID NO: 16376 - RNA, 22 nt, Homo sapiens
ucggucccucgggccagggcag

SEQ ID NO: 16377 - RNA, 22 nt, Homo sapiens
uacccuggugcguggggccgca

SEQ ID NO: 16378 - RNA, 22 nt, Homo sapiens
uuaauaugagccuccggauuag

SEQ ID NO: 16379 - RNA, 21 nt, Homo sapiens
ucaagacugaggcucauugac

SEQ ID NO: 16380 - RNA, 22 nt, Homo sapiens
auuguuucugaauuugagaaaa

SEQ ID NO: 16381 - RNA, 22 nt, Homo sapiens
ucuucuuaaguucuggaacagc

SEQ ID NO: 16382 - RNA, 22 nt, Homo sapiens
ucccaagugucuuggaccaggg

SEQ ID NO: 16383 - RNA, 22 nt, Homo sapiens
cugguccaaaauauuugggaaa

SEQ ID NO: 16384 - RNA, 22 nt, Homo sapiens
ucugugucuuccuucccugagg

SEQ ID NO: 16385 - RNA, 22 nt, Homo sapiens
ucaaugagggaaggacagagga

SEQ ID NO: 16386 - RNA, 22 nt, Homo sapiens
uucaguuugguuucccuuaucu

SEQ ID NO: 16387 - RNA, 22 nt, Homo sapiens
gaaugaggugaccagauggucc

SEQ ID NO: 16388 - RNA, 22 nt, Homo sapiens
ugggugggagagcuuuccugga

SEQ ID NO: 16389 - RNA, 22 nt, Homo sapiens
ucaggagccuuuuuccacccau

SEQ ID NO: 16390 - RNA, 22 nt, Homo sapiens
uauuucuuucuugcuugcucuc

SEQ ID NO: 16391 - RNA, 22 nt, Homo sapiens
agggagggggaagagcaagaca

SEQ ID NO: 16392 - RNA, 22 nt, Homo sapiens
uggagaggggagugggggagua

SEQ ID NO: 16393 - RNA, 22 nt, Homo sapiens
ugccuuccucuucacucccucc

SEQ ID NO: 16394 - RNA, 22 nt, Homo sapiens
ggggaagaaacugacaauaaga

SEQ ID NO: 16395 - RNA, 22 nt, Homo sapiens
ccugugcugucgguaucuccuu

SEQ ID NO: 16396 - RNA, 22 nt, Homo sapiens
aacacucacugggaccagccaa

SEQ ID NO: 16397 - RNA, 22 nt, Homo sapiens
ucugggcugucucagguguuca

SEQ ID NO: 16398 - RNA, 22 nt, Homo sapiens
ugcuguuagggggagaaggaac

SEQ ID NO: 16399 - RNA, 22 nt, Homo sapiens
uguuccuuucccuuuugcaugu

SEQ ID NO: 16400 - RNA, 22 nt, Homo sapiens
ugcuggguggcagauuacacag

SEQ ID NO: 16401 - RNA, 22 nt, Homo sapiens
ugagaauuugccacccagcuuc

SEQ ID NO: 16402 - RNA, 22 nt, Homo sapiens
uaagacaguucuguauauucuu

SEQ ID NO: 16403 - RNA, 22 nt, Homo sapiens
aagcauauagaaagguuuuggg

SEQ ID NO: 16404 - RNA, 22 nt, Homo sapiens
uagguaccucagggcaguguuc

SEQ ID NO: 16405 - RNA, 22 nt, Homo sapiens
acaagguccuuuggguacuuca

SEQ ID NO: 16406 - RNA, 22 nt, Homo sapiens
gccucccaagcugggccucccc

SEQ ID NO: 16407 - RNA, 22 nt, Homo sapiens
ccaggaacagaugugggaggcu

SEQ ID NO: 16408 - RNA, 22 nt, Homo sapiens
uagaguuuguaguguugggguc

SEQ ID NO: 16409 - RNA, 22 nt, Homo sapiens
guccccgucacacaaacuguaa

SEQ ID NO: 16410 - RNA, 22 nt, Homo sapiens
ugacucugcuuuaggggaagaa

SEQ ID NO: 16411 - RNA, 22 nt, Homo sapiens
uuccccuaaacaguaggugggg

SEQ ID NO: 16412 - RNA, 22 nt, Homo sapiens
uacuuacuccugucaauuucca

SEQ ID NO: 16413 - RNA, 22 nt, Homo sapiens
ggaauguuggcaggagaagaug

SEQ ID NO: 16414 - RNA, 22 nt, Homo sapiens
ugaguuuaugugaagagagggu

SEQ ID NO: 16415 - RNA, 22 nt, Homo sapiens
uuuccuucagaaaguucaaguc

SEQ ID NO: 16416 - RNA, 22 nt, Homo sapiens
aguggaugaggaaagcuuccca

SEQ ID NO: 16417 - RNA, 22 nt, Homo sapiens
ggaagauguuccagucucuuug

SEQ ID NO: 16418 - RNA, 22 nt, Homo sapiens
agugaggguagaggcaggagug

SEQ ID NO: 16419 - RNA, 22 nt, Homo sapiens
uagcuuuuugagcuauucucag

SEQ ID NO: 16420 - RNA, 22 nt, Homo sapiens
aauguauucaguuuugacuuug

SEQ ID NO: 16421 - RNA, 22 nt, Homo sapiens
cacagcaacugaauauauugcu

SEQ ID NO: 16422 - RNA, 22 nt, Homo sapiens
uacauaaaaauucccuggucac

SEQ ID NO: 16423 - RNA, 22 nt, Homo sapiens
ugaccaggggauuuuuguguag

SEQ ID NO: 16424 - RNA, 22 nt, Homo sapiens
cacaugcuucuuuauaucccca

SEQ ID NO: 16425 - RNA, 22 nt, Homo sapiens
uggaauguaaggaagugugugg

SEQ ID NO: 16426 - RNA, 22 nt, Homo sapiens
aguauaaaucuggauacuucau

SEQ ID NO: 16427 - RNA, 22 nt, Homo sapiens
ugaaguguccagauuuauacug

SEQ ID NO: 16428 - RNA, 22 nt, Homo sapiens
uuuauugaaagcaccuugggga

SEQ ID NO: 16429 - RNA, 22 nt, Homo sapiens
ccaugguguuauucaauagaua

SEQ ID NO: 16430 - RNA, 22 nt, Homo sapiens
ccucccccacgugguuguugcu

SEQ ID NO: 16431 - RNA, 22 nt, Homo sapiens
uagggaaguuuggauuggggga

SEQ ID NO: 16432 - RNA, 22 nt, Homo sapiens
ccaggcugcucuauucauguag

SEQ ID NO: 16433 - RNA, 22 nt, Homo sapiens
uaugaauggagugaccuggugc

SEQ ID NO: 16434 - RNA, 22 nt, Homo sapiens
cguggauuuuccucuaugauua

SEQ ID NO: 16435 - RNA, 22 nt, Homo sapiens
accauagaaggaaaaucuaccu

SEQ ID NO: 16436 - RNA, 22 nt, Homo sapiens
ucuucaaaugcaccaggcugga

SEQ ID NO: 16437 - RNA, 22 nt, Homo sapiens
augccugguguauuugagaaac

SEQ ID NO: 16438 - RNA, 22 nt, Homo sapiens
ugucaucuaucuucccaaagaa

SEQ ID NO: 16439 - RNA, 22 nt, Homo sapiens
uuuguggaaauccugggugaca

SEQ ID NO: 16440 - RNA, 22 nt, Homo sapiens
uugagggaagcauuucucccua

SEQ ID NO: 16441 - RNA, 22 nt, Homo sapiens
ucagagagagcuucucuuaaca

SEQ ID NO: 16442 - RNA, 22 nt, Homo sapiens
cagcgggguguaguggauagag

SEQ ID NO: 16443 - RNA, 22 nt, Homo sapiens
cuccauuacacuacccugccuc

SEQ ID NO: 16444 - RNA, 22 nt, Homo sapiens
uccauuacacuacccugccucu

SEQ ID NO: 16445 - RNA, 22 nt, Homo sapiens
uagcucgccaugugucucccug

SEQ ID NO: 16446 - RNA, 22 nt, Homo sapiens
ggguggaauguggugggagaau

SEQ ID NO: 16447 - RNA, 22 nt, Homo sapiens
ugaagccucucucucuuuaauu

SEQ ID NO: 16448 - RNA, 22 nt, Homo sapiens
aauuaauagagauaggcuucga

SEQ ID NO: 16449 - RNA, 22 nt, Homo sapiens
cagcuggggcccgagagauggu

SEQ ID NO: 16450 - RNA, 22 nt, Homo sapiens
ccucucugggccucaguuuccu

SEQ ID NO: 16451 - RNA, 22 nt, Homo sapiens
gccuaagagguaaauauugacu

SEQ ID NO: 16452 - RNA, 22 nt, Homo sapiens
ucaauaauuaccuccagggaca

SEQ ID NO: 16453 - RNA, 22 nt, Homo sapiens
ugaguuguaucauacauggaua

SEQ ID NO: 16454 - RNA, 22 nt, Homo sapiens
uauccacguaugauaaaacucu

SEQ ID NO: 16455 - RNA, 22 nt, Homo sapiens
ucagaugacaaugucaggugcu

SEQ ID NO: 16456 - RNA, 22 nt, Homo sapiens
cuccugacauugucaccugaga

SEQ ID NO: 16457 - RNA, 22 nt, Homo sapiens
ucagaugacaaugucaggugcu

SEQ ID NO: 16458 - RNA, 22 nt, Homo sapiens
cuccugacauugucaccugaga

SEQ ID NO: 16459 - RNA, 22 nt, Homo sapiens
ugaggcaauaacuugguuuucu

SEQ ID NO: 16460 - RNA, 22 nt, Homo sapiens
aacuggauuauuaccucauaaa

SEQ ID NO: 16461 - RNA, 22 nt, Homo sapiens
uauguucuugauuuucagguuu

SEQ ID NO: 16462 - RNA, 22 nt, Homo sapiens
cuaugaaacacaaagaccgagu

SEQ ID NO: 16463 - RNA, 22 nt, Homo sapiens
ugcggcagggggaucauuugca

SEQ ID NO: 16464 - RNA, 22 nt, Homo sapiens
aagugagucccgagugccgcgc

SEQ ID NO: 16465 - RNA, 22 nt, Homo sapiens
uuuucuuauuuguaaaauaggg

SEQ ID NO: 16466 - RNA, 22 nt, Homo sapiens
cuauuucacagaugaggagacu

SEQ ID NO: 16467 - RNA, 22 nt, Homo sapiens
cagagugguacuguggggggcc

SEQ ID NO: 16468 - RNA, 22 nt, Homo sapiens
ccccagcagcgggccacucucc

SEQ ID NO: 16469 - RNA, 22 nt, Homo sapiens
gggagaagcaauuuuaucuagg

SEQ ID NO: 16470 - RNA, 22 nt, Homo sapiens
ucagauaagauagcgucugccc

SEQ ID NO: 16471 - RNA, 22 nt, Homo sapiens
ugccuguugaugugcaugucug

SEQ ID NO: 16472 - RNA, 22 nt, Homo sapiens
gacaagcaacauuagcaguagu

SEQ ID NO: 16473 - RNA, 22 nt, Homo sapiens
ugcaagagaaaauucugaugag

SEQ ID NO: 16474 - RNA, 22 nt, Homo sapiens
ucagaauuuccucuugcauauc

SEQ ID NO: 16475 - RNA, 22 nt, Homo sapiens
ugcuguuuuugggaaacugcag

SEQ ID NO: 16476 - RNA, 22 nt, Homo sapiens
ugguuuuccuggaugaggcauu

SEQ ID NO: 16477 - RNA, 22 nt, Homo sapiens
uccauucccuuugacgaucccu

SEQ ID NO: 16478 - RNA, 22 nt, Homo sapiens
auccuccaggggaaaagcucac

SEQ ID NO: 16479 - RNA, 22 nt, Homo sapiens
aucacuuuugugacuaugcaac

SEQ ID NO: 16480 - RNA, 22 nt, Homo sapiens
gcugcagaucacaaaaaugaca

SEQ ID NO: 16481 - RNA, 22 nt, Homo sapiens
uccccuacugaguccugagacc

SEQ ID NO: 16482 - RNA, 22 nt, Homo sapiens
guaggacucagaugaggggaug

SEQ ID NO: 16483 - RNA, 22 nt, Homo sapiens
uguuaaggaccuggaaaaaaaa

SEQ ID NO: 16484 - RNA, 22 nt, Homo sapiens
uuauuccaggugcuuagcaaug

SEQ ID NO: 16485 - RNA, 22 nt, Homo sapiens
uccagcaccuucuccuggauug

SEQ ID NO: 16486 - RNA, 22 nt, Homo sapiens
gucuuggggaucaggugcugga

SEQ ID NO: 16487 - RNA, 22 nt, Homo sapiens
caggcucggggugcuguucuag

SEQ ID NO: 16488 - RNA, 22 nt, Homo sapiens
gacuguugcagccucagagccu

SEQ ID NO: 16489 - RNA, 22 nt, Homo sapiens
ucuccuaccacuaguugugucc

SEQ ID NO: 16490 - RNA, 16 nt, Homo sapiens
cagcuguggugagaga

SEQ ID NO: 16491 - RNA, 22 nt, Homo sapiens
uagaaucugugcaaaaaucccu

SEQ ID NO: 16492 - RNA, 22 nt, Homo sapiens
ggauuuuugcacaaagagauuc

SEQ ID NO: 16493 - RNA, 21 nt, Homo sapiens
ugguucuagacuugccaacua

SEQ ID NO: 16494 - RNA, 22 nt, Homo sapiens
uuuggcaaugguagaacucaca

SEQ ID NO: 16495 - RNA, 22 nt, Homo sapiens
accagauucuucucauuguccu

SEQ ID NO: 16496 - RNA, 21 nt, Homo sapiens
gcaaugaugcggaucuuguga

SEQ ID NO: 16497 - RNA, 22 nt, Homo sapiens
ucuucacucuucugcugcuaga

SEQ ID NO: 16498 - RNA, 22 nt, Homo sapiens
uagacagcagagagagugcagg

SEQ ID NO: 16499 - RNA, 22 nt, Homo sapiens
agccaggggccggagugggagg

SEQ ID NO: 16500 - RNA, 21 nt, Homo sapiens
uuccacccugguccccugcug

SEQ ID NO: 16501 - RNA, 22 nt, Homo sapiens
uacugacuuugcaauaaagaag

SEQ ID NO: 16502 - RNA, 22 nt, Homo sapiens
ucuuuauugcaagguggguaau

SEQ ID NO: 16503 - RNA, 22 nt, Homo sapiens
agaauuugcaccuguuucuagc

SEQ ID NO: 16504 - RNA, 22 nt, Homo sapiens
cagaacgggagcuuguuacugg

SEQ ID NO: 16505 - RNA, 22 nt, Homo sapiens
cugcccucguugcccucagcaa

SEQ ID NO: 16506 - RNA, 22 nt, Homo sapiens
ugaggggcaaggaugggcaugc

SEQ ID NO: 16507 - RNA, 22 nt, Homo sapiens
ugagcgggucucugggccucag

SEQ ID NO: 16508 - RNA, 22 nt, Homo sapiens
caugagcuuugaagacccuuuc

SEQ ID NO: 16509 - RNA, 22 nt, Homo sapiens
gagccggaagaccaggguugaa

SEQ ID NO: 16510 - RNA, 18 nt, Homo sapiens
accuugggcuucuugcuu

SEQ ID NO: 16511 - RNA, 22 nt, Homo sapiens
caguugauuggaagaggaagga

SEQ ID NO: 16512 - RNA, 22 nt, Homo sapiens
uuucccuuccagcagcucccac

SEQ ID NO: 16513 - RNA, 22 nt, Homo sapiens
uugggaggaggaguugauaggu

SEQ ID NO: 16514 - RNA, 22 nt, Homo sapiens
ucuggguucccucccccaauug

SEQ ID NO: 16515 - RNA, 22 nt, Homo sapiens
cagccccuccccuccgccucgc

SEQ ID NO: 16516 - RNA, 22 nt, Homo sapiens
ccugggggggggaggguccugc

SEQ ID NO: 16517 - RNA, 22 nt, Homo sapiens
ugaaaccaaguaugggucgccu

SEQ ID NO: 16518 - RNA, 22 nt, Homo sapiens
gucucacccacgcuugauuuca

SEQ ID NO: 16519 - RNA, 22 nt, Homo sapiens
uucgaugaccauaugugacaug

SEQ ID NO: 16520 - RNA, 21 nt, Homo sapiens
cauguccacugaucaucaacc

SEQ ID NO: 16521 - RNA, 21 nt, Homo sapiens
uaaagcuagauaaccgaaagu

SEQ ID NO: 16522 - RNA, 23 nt, Homo sapiens
ucuuugguuaucuagcuguauga

SEQ ID NO: 16523 - RNA, 18 nt, Homo sapiens
cuagauaaccgaaaguaa

SEQ ID NO: 16524 - RNA, 22 nt, Homo sapiens
cuccuugaggguugaugcuggg

SEQ ID NO: 16525 - RNA, 22 nt, Homo sapiens
auccagcacaccaugaggaugc

SEQ ID NO: 16526 - RNA, 22 nt, Homo sapiens
ggcuuugugccccgggugcccc

SEQ ID NO: 16527 - RNA, 22 nt, Homo sapiens
gcaucuggcccacaaagcccgg

SEQ ID NO: 16528 - RNA, 22 nt, Homo sapiens
ucaccuuucuuuaucucuuuuu

SEQ ID NO: 16529 - RNA, 22 nt, Homo sapiens
acugaggggauauggaaaguga

SEQ ID NO: 16530 - RNA, 22 nt, Homo sapiens
ccuuucucaggcugaugugugc

SEQ ID NO: 16531 - RNA, 22 nt, Homo sapiens
aggccauguacuuggaaagcgg

SEQ ID NO: 16532 - RNA, 22 nt, Homo sapiens
ucagggcaugacuauuuguagu

SEQ ID NO: 16533 - RNA, 22 nt, Homo sapiens
ugcuccugguaccauguccugu

SEQ ID NO: 16534 - RNA, 22 nt, Homo sapiens
ccacgcugggcgagcugccccc

SEQ ID NO: 16535 - RNA, 21 nt, Homo sapiens
gggaagcuggccucagcuggg

SEQ ID NO: 16536 - RNA, 22 nt, Homo sapiens
cagagaccagucuccagugguu

SEQ ID NO: 16537 - RNA, 22 nt, Homo sapiens
aguguagacugaguucucuuug

SEQ ID NO: 16538 - RNA, 22 nt, Homo sapiens
ccguguucagcuccuccccgag

SEQ ID NO: 16539 - RNA, 22 nt, Homo sapiens
gggaggaagugugagcagagaa

SEQ ID NO: 16540 - RNA, 22 nt, Homo sapiens
uccccuacugaguccugagacc

SEQ ID NO: 16541 - RNA, 22 nt, Homo sapiens
guaggacucagaugagggaaug

SEQ ID NO: 16542 - RNA, 22 nt, Homo sapiens
aagaccccauuuaacuugaaac

SEQ ID NO: 16543 - RNA, 22 nt, Homo sapiens
gcuuucaaguuaaguggggccu

SEQ ID NO: 16544 - RNA, 22 nt, Homo sapiens
gggcacagauaaugguauaggg

SEQ ID NO: 16545 - RNA, 22 nt, Homo sapiens
uugugucauauuauuugcccuu

SEQ ID NO: 16546 - RNA, 22 nt, Homo sapiens
cucuuucugcuucacacauguc

SEQ ID NO: 16547 - RNA, 22 nt, Homo sapiens
auguauggaagcaaagauguca

SEQ ID NO: 16548 - RNA, 22 nt, Homo sapiens
uguucuagccaaaaaaguuugc

SEQ ID NO: 16549 - RNA, 22 nt, Homo sapiens
ucuuuuuuuuugcuggaacauu

SEQ ID NO: 16550 - RNA, 22 nt, Homo sapiens
ucccuccgccucuggccgcgcu

SEQ ID NO: 16551 - RNA, 22 nt, Homo sapiens
cgugugcuucuggcucagggcc

SEQ ID NO: 16552 - RNA, 22 nt, Homo sapiens
ugcaggugcccgugagcagggc

SEQ ID NO: 16553 - RNA, 22 nt, Homo sapiens
agcuugcucauggagacagcaa

SEQ ID NO: 16554 - RNA, 22 nt, Homo sapiens
agccagcuuguaaguccuggau

SEQ ID NO: 16555 - RNA, 22 nt, Homo sapiens
cgaggacuuuugugcugccugu

SEQ ID NO: 16556 - RNA, 22 nt, Homo sapiens
aagcagaagcccugauguuaag

SEQ ID NO: 16557 - RNA, 22 nt, Homo sapiens
gcuuagcacagggucugcuuca

SEQ ID NO: 16558 - RNA, 22 nt, Homo sapiens
ugggaccgggggccagggaggg

SEQ ID NO: 16559 - RNA, 22 nt, Homo sapiens
uccucggccgagcccgguccuc

SEQ ID NO: 16560 - RNA, 22 nt, Homo sapiens
gggccgggugauggaauaugag

SEQ ID NO: 16561 - RNA, 22 nt, Homo sapiens
uuuauuauuccauuuacucuga

SEQ ID NO: 16562 - RNA, 22 nt, Homo sapiens
ugauugguacgucuguggguag

SEQ ID NO: 16563 - RNA, 23 nt, Homo sapiens
ugauugguacgucuguggguaga

SEQ ID NO: 16564 - RNA, 22 nt, Homo sapiens
uccuccaguguggaaaaaaaau

SEQ ID NO: 16565 - RNA, 22 nt, Homo sapiens
uuuuuccauauuggaagagaaa

SEQ ID NO: 16566 - RNA, 22 nt, Homo sapiens
ccccaggggagggguggucggu

SEQ ID NO: 16567 - RNA, 22 nt, Homo sapiens
cagcugccccucugccccggga

SEQ ID NO: 16568 - RNA, 22 nt, Homo sapiens
uuuuccuacccacugcccaucu

SEQ ID NO: 16569 - RNA, 22 nt, Homo sapiens
ugcuggguggggugggggaacc

SEQ ID NO: 16570 - RNA, 22 nt, Homo sapiens
uccguuuauugagcacuuacug

SEQ ID NO: 16571 - RNA, 22 nt, Homo sapiens
uucaaagcgcuuucaugaauua

SEQ ID NO: 16572 - RNA, 22 nt, Homo sapiens
ugccaucugcccuggccaugcc

SEQ ID NO: 16573 - RNA, 22 nt, Homo sapiens
aaggccaggccagaugacaguc

SEQ ID NO: 16574 - RNA, 22 nt, Homo sapiens
cagagggagggagggagaaaga

SEQ ID NO: 16575 - RNA, 22 nt, Homo sapiens
uucgucuccccuucccucccau

SEQ ID NO: 16576 - RNA, 22 nt, Homo sapiens
gauagccgcgguucuagacuug

SEQ ID NO: 16577 - RNA, 22 nt, Homo sapiens
caaaguuaauuauggcucucuc

SEQ ID NO: 16578 - RNA, 22 nt, Homo sapiens
uuguugugcuuacaacagcugu

SEQ ID NO: 16579 - RNA, 22 nt, Homo sapiens
aaagcagcuuugcgugcagaac

SEQ ID NO: 16580 - RNA, 22 nt, Homo sapiens
auaucuguggauggaugaauuc

SEQ ID NO: 16581 - RNA, 22 nt, Homo sapiens
uuauuuguuuaccugauuauug

SEQ ID NO: 16582 - RNA, 22 nt, Homo sapiens
uggagugaucuggaccaggauu

SEQ ID NO: 16583 - RNA, 22 nt, Homo sapiens
auccuggaccagguacuuaauc

SEQ ID NO: 16584 - RNA, 22 nt, Homo sapiens
ugcugcauuugcaguccuuuaa

SEQ ID NO: 16585 - RNA, 22 nt, Homo sapiens
ugaaaagauugggaaugcagca

SEQ ID NO: 16586 - RNA, 23 nt, Homo sapiens
cccaguguucagacuaccuguuc

SEQ ID NO: 16587 - RNA, 22 nt, Homo sapiens
uacaguagucugcacauugguu

SEQ ID NO: 16588 - RNA, 22 nt, Homo sapiens
ugcccugcugccuggauggaaa

SEQ ID NO: 16589 - RNA, 19 nt, Homo sapiens
uuuauucagguggcaggca

SEQ ID NO: 16590 - RNA, 22 nt, Homo sapiens
ugccaauuugccccuuugcuga

SEQ ID NO: 16591 - RNA, 22 nt, Homo sapiens
ucuaaggggcaagcuuggugcc

SEQ ID NO: 16592 - RNA, 22 nt, Homo sapiens
uucucuuuccuucugggcucca

SEQ ID NO: 16593 - RNA, 22 nt, Homo sapiens
ugggucuggaggaaggagaggc

SEQ ID NO: 16594 - RNA, 22 nt, Homo sapiens
ugagcucccauaucuuacccuc

SEQ ID NO: 16595 - RNA, 18 nt, Homo sapiens
ggagauguggugauuuca

SEQ ID NO: 16596 - RNA, 22 nt, Homo sapiens
gcaucuggccuccugccugauu

SEQ ID NO: 16597 - RNA, 18 nt, Homo sapiens
aggugggggcacauaugu

SEQ ID NO: 16598 - RNA, 22 nt, Homo sapiens
gggcuucacuuaucucauccuu

SEQ ID NO: 16599 - RNA, 22 nt, Homo sapiens
aaggcaugggaagagaagucua

SEQ ID NO: 16600 - RNA, 22 nt, Homo sapiens
aguguuggagaccuucagggag

SEQ ID NO: 16601 - RNA, 22 nt, Homo sapiens
cugaaguguuaccagcauggag

SEQ ID NO: 16602 - RNA, 22 nt, Homo sapiens
ucacagaugacucuggaaagga

SEQ ID NO: 16603 - RNA, 22 nt, Homo sapiens
ucuccaggaguucccuggaagg

SEQ ID NO: 16604 - RNA, 22 nt, Homo sapiens
agaagaaugauguugggcugcc

SEQ ID NO: 16605 - RNA, 22 nt, Homo sapiens
guggcaccaaaauuuucugguu

SEQ ID NO: 16606 - RNA, 22 nt, Homo sapiens
ugggggaggaggucagugaggc

SEQ ID NO: 16607 - RNA, 22 nt, Homo sapiens
cucugauuuuucacuugccuca

SEQ ID NO: 16608 - RNA, 22 nt, Homo sapiens
ucguguacuuuuauauccuggc

SEQ ID NO: 16609 - RNA, 22 nt, Homo sapiens
cugggaggaggguggagccagc

SEQ ID NO: 16610 - RNA, 22 nt, Homo sapiens
uccugucccugucccugccccu

SEQ ID NO: 16611 - RNA, 22 nt, Homo sapiens
ggccaggggccaggggaggggg

SEQ ID NO: 16612 - RNA, 22 nt, Homo sapiens
ggugcugugacugaagagccug

SEQ ID NO: 16613 - RNA, 19 nt, Homo sapiens
caggcucugcuccaucgcc

SEQ ID NO: 16614 - RNA, 22 nt, Homo sapiens
uguucuaccuaaauagcucuga

SEQ ID NO: 16615 - RNA, 22 nt, Homo sapiens
gaguuguuuggguuggggauca

SEQ ID NO: 16616 - RNA, 22 nt, Homo sapiens
uauccuguggacagaugauaga

SEQ ID NO: 16617 - RNA, 22 nt, Homo sapiens
uuugucuuccacagguguaugg

SEQ ID NO: 16618 - RNA, 22 nt, Homo sapiens
uagaaagagcuguguaggacaa

SEQ ID NO: 16619 - RNA, 22 nt, Homo sapiens
uccaacauagaaacuuucuaua

SEQ ID NO: 16620 - RNA, 22 nt, Homo sapiens
agauugccaggcccacccucuu

SEQ ID NO: 16621 - RNA, 22 nt, Homo sapiens
guggggaugaggccuggggguu

SEQ ID NO: 16622 - RNA, 22 nt, Homo sapiens
gaggauuuggggggcuggagag

SEQ ID NO: 16623 - RNA, 22 nt, Homo sapiens
ugcuguagccugcaagguccua

SEQ ID NO: 16624 - RNA, 22 nt, Homo sapiens
aaugaguugggggguuuuagug

SEQ ID NO: 16625 - RNA, 22 nt, Homo sapiens
cacaaaccucccacucaguugu

SEQ ID NO: 16626 - RNA, 22 nt, Homo sapiens
ugggcucagggcaggggaaaug

SEQ ID NO: 16627 - RNA, 22 nt, Homo sapiens
uucccuucuaagagcugacgga

SEQ ID NO: 16628 - RNA, 22 nt, Homo sapiens
cagccauucuccugauacccuc

SEQ ID NO: 16629 - RNA, 22 nt, Homo sapiens
guuaucaggagaggaggcuccu

SEQ ID NO: 16630 - RNA, 22 nt, Homo sapiens
ucuagauucuaggauaguugcu

SEQ ID NO: 16631 - RNA, 22 nt, Homo sapiens
caauuuguuuuagacacaguag

SEQ ID NO: 16632 - RNA, 22 nt, Homo sapiens
uccauucagaggaagcuggggg

SEQ ID NO: 16633 - RNA, 22 nt, Homo sapiens
uccccuccuucccuggugucag

SEQ ID NO: 16634 - RNA, 22 nt, Homo sapiens
uuuuuguugagcagcugcauga

SEQ ID NO: 16635 - RNA, 22 nt, Homo sapiens
ugcagaugcuaaauuaaagaga

SEQ ID NO: 16636 - RNA, 22 nt, Homo sapiens
uccuuccccucugccuccgggc

SEQ ID NO: 16637 - RNA, 22 nt, Homo sapiens
uggagcagaggaggaagggcac

SEQ ID NO: 16638 - RNA, 22 nt, Homo sapiens
ccugucuucucugugggaucca

SEQ ID NO: 16639 - RNA, 22 nt, Homo sapiens
aucccaggacagggcagaccug

SEQ ID NO: 16640 - RNA, 22 nt, Homo sapiens
ugcagcccaguggcgagguggg

SEQ ID NO: 16641 - RNA, 22 nt, Homo sapiens
ccucucucccuggggugcagaa

SEQ ID NO: 16642 - RNA, 22 nt, Homo sapiens
uccucuguguguguccugcacu

SEQ ID NO: 16643 - RNA, 22 nt, Homo sapiens
ugagugacacaggcagagucca

SEQ ID NO: 16644 - RNA, 22 nt, Homo sapiens
ugucaaucauauugcuuuaugu

SEQ ID NO: 16645 - RNA, 22 nt, Homo sapiens
uauuguaaugcgauugauacaa

SEQ ID NO: 16646 - RNA, 22 nt, Homo sapiens
ugcccacacccaggggagcugc

SEQ ID NO: 16647 - RNA, 22 nt, Homo sapiens
cggcuccaccgggcaggggcac

SEQ ID NO: 16648 - RNA, 22 nt, Homo sapiens
gcauuaacuccuaaagugugga

SEQ ID NO: 16649 - RNA, 22 nt, Homo sapiens
cacacuuuuggaguuagugcca

SEQ ID NO: 16650 - RNA, 22 nt, Homo sapiens
uaacauauuuuucucaguaaag

SEQ ID NO: 16651 - RNA, 22 nt, Homo sapiens
ucacugagcuaauauguuaaag

SEQ ID NO: 16652 - RNA, 22 nt, Homo sapiens
acuccaagguaccugccagaua

SEQ ID NO: 16653 - RNA, 22 nt, Homo sapiens
uuugcaggcacucuggaguuuu

SEQ ID NO: 16654 - RNA, 22 nt, Homo sapiens
ggacaccagcggcggcagcccg

SEQ ID NO: 16655 - RNA, 22 nt, Homo sapiens
ggcggcacgcuccuggugcucc

SEQ ID NO: 16656 - RNA, 22 nt, Homo sapiens
ucaccaucacccggugcugggc

SEQ ID NO: 16657 - RNA, 22 nt, Homo sapiens
cuuggcacugggccgaugggcg

SEQ ID NO: 16658 - RNA, 22 nt, Homo sapiens
uaacaccagaccuuucaggccc

SEQ ID NO: 16659 - RNA, 20 nt, Homo sapiens
ccugacagauuugggauuaa

SEQ ID NO: 16660 - RNA, 22 nt, Homo sapiens
ugguggccgcgggagagccagc

SEQ ID NO: 16661 - RNA, 22 nt, Homo sapiens
uggugacauuuccggcugccag

SEQ ID NO: 16662 - RNA, 22 nt, Homo sapiens
gagcaccaggagcgugccgccc

SEQ ID NO: 16663 - RNA, 22 nt, Homo sapiens
gggcugccgccgcugguguccg

SEQ ID NO: 16664 - RNA, 22 nt, Homo sapiens
aguacauguuguucaaaagcca

SEQ ID NO: 16665 - RNA, 22 nt, Homo sapiens
ggucaagagcagcaugagcuau

SEQ ID NO: 16666 - RNA, 22 nt, Homo sapiens
uccacauaugcuuaguuuuugu

SEQ ID NO: 16667 - RNA, 22 nt, Homo sapiens
agaaacagaauauggugugaca

SEQ ID NO: 16668 - RNA, 22 nt, Homo sapiens
ggccuaauuucauuugauugaa

SEQ ID NO: 16669 - RNA, 22 nt, Homo sapiens
uccaugaucagcuguauuuggu

SEQ ID NO: 16670 - RNA, 22 nt, Homo sapiens
ggacagcuucucagaggaagug

SEQ ID NO: 16671 - RNA, 21 nt, Homo sapiens
caacuuccccucagaguuccc

SEQ ID NO: 16672 - RNA, 22 nt, Homo sapiens
ucacccccuagaccuuuaggcc

SEQ ID NO: 16673 - RNA, 22 nt, Homo sapiens
gaugacugugguguaggguggc

SEQ ID NO: 16674 - RNA, 22 nt, Homo sapiens
ccuguagaucugugccucucac

SEQ ID NO: 16675 - RNA, 22 nt, Homo sapiens
gcagagacaugugccuaugggg

SEQ ID NO: 16676 - RNA, 22 nt, Homo sapiens
cuuucagucagauguuugcugc

SEQ ID NO: 16677 - RNA, 22 nt, Homo sapiens
uguaaacauccccgacuggaag

SEQ ID NO: 16678 - RNA, 23 nt, Homo sapiens
uguaaacauccccgacuggaagc

SEQ ID NO: 16679 - RNA, 22 nt, Homo sapiens
cugauaugaguguggagauucc

SEQ ID NO: 16680 - RNA, 22 nt, Homo sapiens
agcuucacgcuuggaucuucuc

SEQ ID NO: 16681 - RNA, 22 nt, Homo sapiens
gcuggccccucccuccagggcu

SEQ ID NO: 16682 - RNA, 22 nt, Homo sapiens
ccuccaggaggggggugcugug

SEQ ID NO: 16683 - RNA, 22 nt, Homo sapiens
uccucaaggcagagaagggacu

SEQ ID NO: 16684 - RNA, 20 nt, Homo sapiens
gugccccuuccugcccagga

SEQ ID NO: 16685 - RNA, 22 nt, Homo sapiens
ccacauuguuuauaaguauaaa

SEQ ID NO: 16686 - RNA, 22 nt, Homo sapiens
uauacuuauaaauaaugugguu

SEQ ID NO: 16687 - RNA, 22 nt, Homo sapiens
uaaaguuguuuccaggcucugu

SEQ ID NO: 16688 - RNA, 22 nt, Homo sapiens
gaugccaggaaauaacuuucau

SEQ ID NO: 16689 - RNA, 22 nt, Homo sapiens
caagcauaucauuuuguuccug

SEQ ID NO: 16690 - RNA, 22 nt, Homo sapiens
aaugggacaagaugagaugaca

SEQ ID NO: 16691 - RNA, 22 nt, Homo sapiens
uauuucuucaggucugcagagu

SEQ ID NO: 16692 - RNA, 22 nt, Homo sapiens
ugagcggaauuggagagggaag

SEQ ID NO: 16693 - RNA, 22 nt, Homo sapiens
gguuuugauguuuugucauuca

SEQ ID NO: 16694 - RNA, 22 nt, Homo sapiens
augacaaaacauugaaaucuaa

SEQ ID NO: 16695 - RNA, 22 nt, Homo sapiens
gaaaagguauauggugggugga

SEQ ID NO: 16696 - RNA, 22 nt, Homo sapiens
cacuccuucccuaccuuuuuuu

SEQ ID NO: 16697 - RNA, 22 nt, Homo sapiens
uguaauuggggaaacugagguc

SEQ ID NO: 16698 - RNA, 22 nt, Homo sapiens
cuuacccaguuuccccaauugc

SEQ ID NO: 16699 - RNA, 22 nt, Homo sapiens
ugagaaaaaguggaaagaaggg

SEQ ID NO: 16700 - RNA, 22 nt, Homo sapiens
ccuuuauauugcauucuuucuu

SEQ ID NO: 16701 - RNA, 22 nt, Homo sapiens
uggcggggcagggugugggcac

SEQ ID NO: 16702 - RNA, 22 nt, Homo sapiens
ucccuggcccuguccugguggu

SEQ ID NO: 16703 - RNA, 22 nt, Homo sapiens
caugugcagugagaugggugcc

SEQ ID NO: 16704 - RNA, 22 nt, Homo sapiens
uacccugccucacugcauucuc

SEQ ID NO: 16705 - RNA, 22 nt, Homo sapiens
uagcaaaagaguccagagucug

SEQ ID NO: 16706 - RNA, 22 nt, Homo sapiens
gacuguggguuccugggcuggg

SEQ ID NO: 16707 - RNA, 22 nt, Homo sapiens
ugaaguucuaggagcuagucuu

SEQ ID NO: 16708 - RNA, 22 nt, Homo sapiens
gauuaggguuuggauuuuaucc

SEQ ID NO: 16709 - RNA, 22 nt, Homo sapiens
gcauuugcuggugguggcaggg

SEQ ID NO: 16710 - RNA, 22 nt, Homo sapiens
cugccaccacugccagguaucu

SEQ ID NO: 16711 - RNA, 22 nt, Homo sapiens
uuauauuuuguucuaaaaugug

SEQ ID NO: 16712 - RNA, 22 nt, Homo sapiens
cguuuuaagaucgagauauaaa

SEQ ID NO: 16713 - RNA, 22 nt, Homo sapiens
acacaagcucgugucugugggu

SEQ ID NO: 16714 - RNA, 22 nt, Homo sapiens
cacccguagaaccgaccuugcg

SEQ ID NO: 16715 - RNA, 22 nt, Homo sapiens
aagcucgugucuguggguccgu

SEQ ID NO: 16716 - RNA, 21 nt, Homo sapiens
uaaagcuagauaaccgaaagu

SEQ ID NO: 16717 - RNA, 23 nt, Homo sapiens
ucuuugguuaucuagcuguauga

SEQ ID NO: 16718 - RNA, 17 nt, Homo sapiens
cuagauaaccgaaagua

SEQ ID NO: 16719 - RNA, 22 nt, Homo sapiens
ugccccacugaagauggcuucc

SEQ ID NO: 16720 - RNA, 22 nt, Homo sapiens
gucauuaugguucagugaagca

SEQ ID NO: 16721 - RNA, 22 nt, Homo sapiens
caacacaccuauucaaggauuc

SEQ ID NO: 16722 - RNA, 22 nt, Homo sapiens
aauccuuggaaccuagguguga

SEQ ID NO: 16723 - RNA, 24 nt, Homo sapiens
aauccuuggaaccuaggugugagu

SEQ ID NO: 16724 - RNA, 22 nt, Homo sapiens
uguguuaguguggaugguguua

SEQ ID NO: 16725 - RNA, 22 nt, Homo sapiens
acaccauaagcagagcacaaaa

SEQ ID NO: 16726 - RNA, 22 nt, Homo sapiens
aaaugcauugagaguguugguu

SEQ ID NO: 16727 - RNA, 22 nt, Homo sapiens
uacaacacuuuuaauaugcauu

SEQ ID NO: 16728 - RNA, 22 nt, Homo sapiens
ucccuggggccagcccacacac

SEQ ID NO: 16729 - RNA, 22 nt, Homo sapiens
uguggguaagucuuggggaugg

SEQ ID NO: 16730 - RNA, 22 nt, Homo sapiens
ugcucuggcccagagcgcacgu

SEQ ID NO: 16731 - RNA, 22 nt, Homo sapiens
ugggcucugggccggaggcauc

SEQ ID NO: 16732 - RNA, 22 nt, Homo sapiens
gguggucuuggcuacggggucu

SEQ ID NO: 16733 - RNA, 22 nt, Homo sapiens
acccugaggcccaaccagcagc

SEQ ID NO: 16734 - RNA, 22 nt, Homo sapiens
ccagguucugugauacacuccg

SEQ ID NO: 16735 - RNA, 22 nt, Homo sapiens
ucagugcaugacagaacuuggg

SEQ ID NO: 16736 - RNA, 22 nt, Homo sapiens
caucacuggcaugauagaccau

SEQ ID NO: 16737 - RNA, 22 nt, Homo sapiens
uuccggucuaucgugucaaugc

SEQ ID NO: 16738 - RNA, 22 nt, Homo sapiens
caaaccagauuuggcuccaagu

SEQ ID NO: 16739 - RNA, 20 nt, Homo sapiens
uuggagccagacuuuauuug

SEQ ID NO: 16740 - RNA, 22 nt, Homo sapiens
ccagucuuccacugucccgccu

SEQ ID NO: 16741 - RNA, 22 nt, Homo sapiens
gcuugggacgagcuggaggaag

SEQ ID NO: 16742 - RNA, 22 nt, Homo sapiens
ugcaaggagggcauuggcuguu

SEQ ID NO: 16743 - RNA, 22 nt, Homo sapiens
acuucccggugcucuuggcagu

SEQ ID NO: 16744 - RNA, 22 nt, Homo sapiens
ugagaugaagcacuguagcuca

SEQ ID NO: 16745 - RNA, 22 nt, Homo sapiens
ugaggugcagugcugcaucucu

SEQ ID NO: 16746 - RNA, 22 nt, Homo sapiens
ucccggcgcgcgcuccccucug

SEQ ID NO: 16747 - RNA, 22 nt, Homo sapiens
agagugggagaaugugccaagg

SEQ ID NO: 16748 - RNA, 22 nt, Homo sapiens
augcaccugggcaaggauucug

SEQ ID NO: 16749 - RNA, 22 nt, Homo sapiens
ucgcauggccuccauccccucc

SEQ ID NO: 16750 - RNA, 22 nt, Homo sapiens
ggguuggaggccgggcuggaca

SEQ ID NO: 16751 - RNA, 22 nt, Homo sapiens
uugcuguuaggcccagggcugg

SEQ ID NO: 16752 - RNA, 22 nt, Homo sapiens
ucuccccugagcugacagcagg

SEQ ID NO: 16753 - RNA, 22 nt, Homo sapiens
cgccggggcucagccccaucuc

SEQ ID NO: 16754 - RNA, 22 nt, Homo sapiens
guuuggggcugagccuggugcc

SEQ ID NO: 16755 - RNA, 22 nt, Homo sapiens
ucagacuggccucucacuggug

SEQ ID NO: 16756 - RNA, 22 nt, Homo sapiens
agacagugucucagaggccauc

SEQ ID NO: 16757 - RNA, 22 nt, Homo sapiens
ccacugaaaauuugacauuguu

SEQ ID NO: 16758 - RNA, 22 nt, Homo sapiens
auaaugucuuaucccagugugu

SEQ ID NO: 16759 - RNA, 22 nt, Homo sapiens
uacuagccuaauacugugcuuu

SEQ ID NO: 16760 - RNA, 22 nt, Homo sapiens
aggcacagcauuaggcuaguaa

SEQ ID NO: 16761 - RNA, 22 nt, Homo sapiens
ugaguaggaagaccagaaagaa

SEQ ID NO: 16762 - RNA, 22 nt, Homo sapiens
cuuuuuggcuucuuauucacuc

SEQ ID NO: 16763 - RNA, 22 nt, Homo sapiens
ggccgcgcagccgcagagugcg

SEQ ID NO: 16764 - RNA, 22 nt, Homo sapiens
caccacugcgccugcgcggcgc

SEQ ID NO: 16765 - RNA, 21 nt, Homo sapiens
agugguuuuacccuaugguag

SEQ ID NO: 16766 - RNA, 22 nt, Homo sapiens
uaccacaggguagaaccacgga

SEQ ID NO: 16767 - RNA, 22 nt, Homo sapiens
uuccucaggcuaugaaaaaaua

SEQ ID NO: 16768 - RNA, 22 nt, Homo sapiens
uuuuuccauagcuugagguuac

SEQ ID NO: 16769 - RNA, 22 nt, Homo sapiens
uccucuccccgucuccauggcc

SEQ ID NO: 16770 - RNA, 22 nt, Homo sapiens
cccuggagccggcuggggcgga

SEQ ID NO: 16771 - RNA, 22 nt, Homo sapiens
ucuugcuggucucagaaauggg

SEQ ID NO: 16772 - RNA, 22 nt, Homo sapiens
caaugagaccagugcaggaagg

SEQ ID NO: 16773 - RNA, 22 nt, Homo sapiens
ggaaguggccuucaauaguccg

SEQ ID NO: 16774 - RNA, 22 nt, Homo sapiens
gacauugugaaggcccacuucc

SEQ ID NO: 16775 - RNA, 22 nt, Homo sapiens
ucaguuaacggaaaggggugug

SEQ ID NO: 16776 - RNA, 22 nt, Homo sapiens
caugccccacuguuaauugauu

SEQ ID NO: 16777 - RNA, 22 nt, Homo sapiens
cuaagcuaaggggcugucccau

SEQ ID NO: 16778 - RNA, 22 nt, Homo sapiens
gugggucccuuugguuucaucc

SEQ ID NO: 16779 - RNA, 22 nt, Homo sapiens
uccccagggccaguugagaggc

SEQ ID NO: 16780 - RNA, 22 nt, Homo sapiens
uccucgaaaggcccuggggcag

SEQ ID NO: 16781 - RNA, 22 nt, Homo sapiens
gcagcuugauggcugauggagg

SEQ ID NO: 16782 - RNA, 20 nt, Homo sapiens
uuacacgcagccauuacugc

SEQ ID NO: 16783 - RNA, 22 nt, Homo sapiens
gaaauucaugggccagauggaa

SEQ ID NO: 16784 - RNA, 22 nt, Homo sapiens
uccuacuggccugcaauuuucu

SEQ ID NO: 16785 - RNA, 22 nt, Homo sapiens
uuggggaaaacugacaggggag

SEQ ID NO: 16786 - RNA, 22 nt, Homo sapiens
cugcccugucgccucccugucc

SEQ ID NO: 16787 - RNA, 22 nt, Homo sapiens
ugcgugacguaggcuggcgugg

SEQ ID NO: 16788 - RNA, 22 nt, Homo sapiens
ccuugccggugcugccacguga

SEQ ID NO: 16789 - RNA, 22 nt, Homo sapiens
ugcgugacguaggcuggcgugg

SEQ ID NO: 16790 - RNA, 22 nt, Homo sapiens
ccuugccggugcugccacguga

SEQ ID NO: 16791 - RNA, 22 nt, Homo sapiens
aucacuguuuuuauguaaucag

SEQ ID NO: 16792 - RNA, 22 nt, Homo sapiens
ugaggguacuugaaagcaguug

SEQ ID NO: 16793 - RNA, 22 nt, Homo sapiens
gagaggaguaggcugauggugc

SEQ ID NO: 16794 - RNA, 22 nt, Homo sapiens
acuccuagaccuauuccugaac

SEQ ID NO: 16795 - RNA, 22 nt, Homo sapiens
uccugugcugugcaucuugaug

SEQ ID NO: 16796 - RNA, 22 nt, Homo sapiens
acaagggcagcacagugaggac

SEQ ID NO: 16797 - RNA, 22 nt, Homo sapiens
gcaugggcaaggccaugcagcu

SEQ ID NO: 16798 - RNA, 22 nt, Homo sapiens
ugcuccuggucugucucauguu

SEQ ID NO: 16799 - RNA, 22 nt, Homo sapiens
gggaggacagagguaugaguug

SEQ ID NO: 16800 - RNA, 22 nt, Homo sapiens
cucuugucucaauccuccucgu

SEQ ID NO: 16801 - RNA, 22 nt, Homo sapiens
ugauggggguuggggcgauggc

SEQ ID NO: 16802 - RNA, 22 nt, Homo sapiens
cccucccugaauuccuagagaa

SEQ ID NO: 16803 - RNA, 22 nt, Homo sapiens
cucugaguacauaauggcccuc

SEQ ID NO: 16804 - RNA, 22 nt, Homo sapiens
ggguuauguacacuucgggacc

SEQ ID NO: 16805 - RNA, 22 nt, Homo sapiens
cacuguacaggaaggcuccagg

SEQ ID NO: 16806 - RNA, 22 nt, Homo sapiens
caggaguuguccguauucugca

SEQ ID NO: 16807 - RNA, 22 nt, Homo sapiens
uuuugugccuauuugaaccuac

SEQ ID NO: 16808 - RNA, 22 nt, Homo sapiens
uuccagugaucagaaaggcaca

SEQ ID NO: 16809 - RNA, 22 nt, Homo sapiens
uccuuuaucacuugcugugaau

SEQ ID NO: 16810 - RNA, 22 nt, Homo sapiens
uacacagcaggggucaagggua

SEQ ID NO: 16811 - RNA, 22 nt, Homo sapiens
uccaucacugucuuucuugggc

SEQ ID NO: 16812 - RNA, 22 nt, Homo sapiens
uaguugcuugaaggcagugggg

SEQ ID NO: 16813 - RNA, 22 nt, Homo sapiens
uugcuuucucccuggccaggag

SEQ ID NO: 16814 - RNA, 22 nt, Homo sapiens
ucgccuggggugaagucauccu

SEQ ID NO: 16815 - RNA, 22 nt, Homo sapiens
ugccagaucagaauaguguauu

SEQ ID NO: 16816 - RNA, 22 nt, Homo sapiens
agacauuauuuuguuuguguua

SEQ ID NO: 16817 - RNA, 22 nt, Homo sapiens
ccucaagauggaagcaguuucu

SEQ ID NO: 16818 - RNA, 21 nt, Homo sapiens
aaagugcuuccuuuuugaggg

SEQ ID NO: 16819 - RNA, 22 nt, Homo sapiens
ucuguggccucuuagacacuga

SEQ ID NO: 16820 - RNA, 22 nt, Homo sapiens
ucgguucugagagccgcuuaga

SEQ ID NO: 16821 - RNA, 22 nt, Homo sapiens
caggggagggggaggaggcagu

SEQ ID NO: 16822 - RNA, 22 nt, Homo sapiens
ugcaaugcuuccuccucuucug

SEQ ID NO: 16823 - RNA, 22 nt, Homo sapiens
uagaaucucuuugugcaaaaau

SEQ ID NO: 16824 - RNA, 22 nt, Homo sapiens
ggauuuuugcacagauucuaga

SEQ ID NO: 16825 - RNA, 22 nt, Homo sapiens
ucuuucccagcccugcuugggu

SEQ ID NO: 16826 - RNA, 22 nt, Homo sapiens
aagccacguaggugggagacag

SEQ ID NO: 16827 - RNA, 22 nt, Homo sapiens
ucucucacuccagucagaguca

SEQ ID NO: 16828 - RNA, 22 nt, Homo sapiens
acucagucuggggugcagaauu

SEQ ID NO: 16829 - RNA, 22 nt, Homo sapiens
uccugagagccacaggcuggug

SEQ ID NO: 16830 - RNA, 22 nt, Homo sapiens
cagcccgugugcuccaggaaaa

SEQ ID NO: 16831 - RNA, 22 nt, Homo sapiens
ggcggggagggagcuguggcuu

SEQ ID NO: 16832 - RNA, 22 nt, Homo sapiens
agccccagccucccucccccag

SEQ ID NO: 16833 - RNA, 22 nt, Homo sapiens
ucaggggcgggagugugccuua

SEQ ID NO: 16834 - RNA, 22 nt, Homo sapiens
ggcaguuauucugugcccccac

SEQ ID NO: 16835 - RNA, 22 nt, Homo sapiens
aauuggcuccauuucagacccc

SEQ ID NO: 16836 - RNA, 22 nt, Homo sapiens
gaguccugaaggaaccauuuau

SEQ ID NO: 16837 - RNA, 22 nt, Homo sapiens
uuuccuuccagguuccuaaggc

SEQ ID NO: 16838 - RNA, 22 nt, Homo sapiens
cauuagacugccaggaagggcc

SEQ ID NO: 16839 - RNA, 22 nt, Homo sapiens
ugggcaucaagaaguccuguca

SEQ ID NO: 16840 - RNA, 22 nt, Homo sapiens
acagggaaucaggugucugcag

SEQ ID NO: 16841 - RNA, 22 nt, Homo sapiens
caaaggcuuuuagaggauguug

SEQ ID NO: 16842 - RNA, 22 nt, Homo sapiens
ugacaucauuuaaaagccuuuu

SEQ ID NO: 16843 - RNA, 22 nt, Homo sapiens
ggcuggggaagccagaaaccaa

SEQ ID NO: 16844 - RNA, 22 nt, Homo sapiens
guuucauggcuuguuaaguccc

SEQ ID NO: 16845 - RNA, 22 nt, Homo sapiens
cccuucugcugcaucuccugcu

SEQ ID NO: 16846 - RNA, 22 nt, Homo sapiens
ugaccaggggagagcagaagga

SEQ ID NO: 16847 - RNA, 23 nt, Homo sapiens
acuuuaacauggaagugcuuucu

SEQ ID NO: 16848 - RNA, 23 nt, Homo sapiens
uaagugcuuccauguuuuaguag

SEQ ID NO: 16849 - RNA, 22 nt, Homo sapiens
uccacuugaugacugucucgua

SEQ ID NO: 16850 - RNA, 20 nt, Homo sapiens
guguugaggcugucguugga

SEQ ID NO: 16851 - RNA, 22 nt, Homo sapiens
ccaggaagccugagaaugaauc

SEQ ID NO: 16852 - RNA, 22 nt, Homo sapiens
gcuuugucccaggcuuucuggu

SEQ ID NO: 16853 - RNA, 22 nt, Homo sapiens
accaggaagccugagaaugcuu

SEQ ID NO: 16854 - RNA, 22 nt, Homo sapiens
gcuuuguaccaggcuuucuggu

SEQ ID NO: 16855 - RNA, 22 nt, Homo sapiens
uggcaggagaguggguuugcca

SEQ ID NO: 16856 - RNA, 21 nt, Homo sapiens
uuugcccauucucuugacacu

SEQ ID NO: 16857 - RNA, 22 nt, Homo sapiens
uugcuuaugcacuucuccucag

SEQ ID NO: 16858 - RNA, 22 nt, Homo sapiens
ggcaggagugcauaaacagcua

SEQ ID NO: 16859 - RNA, 22 nt, Homo sapiens
ccagguggaacaggccguccug

SEQ ID NO: 16860 - RNA, 20 nt, Homo sapiens
gggagggcuuguucugcugg

SEQ ID NO: 16861 - RNA, 22 nt, Homo sapiens
uuggguaaggaaggagaaauug

SEQ ID NO: 16862 - RNA, 22 nt, Homo sapiens
cacaccuucccccuugcucaag

SEQ ID NO: 16863 - RNA, 22 nt, Homo sapiens
ucagauuuccagggacccacau

SEQ ID NO: 16864 - RNA, 21 nt, Homo sapiens
guguggcccuggaggugugag

SEQ ID NO: 16865 - RNA, 22 nt, Homo sapiens
agcuuuggggucagacagacug

SEQ ID NO: 16866 - RNA, 22 nt, Homo sapiens
agcugugugacuucaggcaaag

SEQ ID NO: 16867 - RNA, 22 nt, Homo sapiens
ugucauuuuugugaucugcagc

SEQ ID NO: 16868 - RNA, 20 nt, Homo sapiens
uugcauagucacaaaaguga

SEQ ID NO: 16869 - RNA, 22 nt, Homo sapiens
ccccuccuuugucucaggggug

SEQ ID NO: 16870 - RNA, 22 nt, Homo sapiens
uccaggugagcacaggaggggc

SEQ ID NO: 16871 - RNA, 22 nt, Homo sapiens
ccaaccauccccgugugucugg

SEQ ID NO: 16872 - RNA, 22 nt, Homo sapiens
uaggcacacuaggaugaguugg

SEQ ID NO: 16873 - RNA, 22 nt, Homo sapiens
uuuuuauuuuguuuuacugcuu

SEQ ID NO: 16874 - RNA, 22 nt, Homo sapiens
caggcuaacuggguggaaauga

SEQ ID NO: 16875 - RNA, 22 nt, Homo sapiens
uuuuuauuuuguuuuacugcuu

SEQ ID NO: 16876 - RNA, 22 nt, Homo sapiens
caggcuaacuggguggaaauga

SEQ ID NO: 16877 - RNA, 22 nt, Homo sapiens
aggcucugaggucccaggauuc

SEQ ID NO: 16878 - RNA, 22 nt, Homo sapiens
ggaccuaggacccucggagcug

SEQ ID NO: 16879 - RNA, 22 nt, Homo sapiens
uuuguucauggccccaucuugg

SEQ ID NO: 16880 - RNA, 22 nt, Homo sapiens
ugaaagggggucuuggaacagg

SEQ ID NO: 16881 - RNA, 22 nt, Homo sapiens
aggcugccugucacuuugggua

SEQ ID NO: 16882 - RNA, 22 nt, Homo sapiens
uacucaagugaggucucuuggg

SEQ ID NO: 16883 - RNA, 22 nt, Homo sapiens
aaggggcauuuagggcaguaga

SEQ ID NO: 16884 - RNA, 17 nt, Homo sapiens
ugcacuagaugcaccuu

SEQ ID NO: 16885 - RNA, 22 nt, Homo sapiens
ugaguuaaaugagaugccggug

SEQ ID NO: 16886 - RNA, 22 nt, Homo sapiens
ucaccggcauuucaaacuuaag

SEQ ID NO: 16887 - RNA, 22 nt, Homo sapiens
uggccugguggugauucuccag

SEQ ID NO: 16888 - RNA, 22 nt, Homo sapiens
gcugugaccaccaagccaggug

SEQ ID NO: 16889 - RNA, 22 nt, Homo sapiens
uggggguucuggauccaggugc

SEQ ID NO: 16890 - RNA, 22 nt, Homo sapiens
ccccugaugggccucgggacuc

SEQ ID NO: 16891 - RNA, 22 nt, Homo sapiens
uggugugaaagggacagagagg

SEQ ID NO: 16892 - RNA, 19 nt, Homo sapiens
uuucugucuuuucggauca

SEQ ID NO: 16893 - RNA, 22 nt, Homo sapiens
ggggaguaagucugguccaugu

SEQ ID NO: 16894 - RNA, 22 nt, Homo sapiens
acggucacagucugcuuucuuu

SEQ ID NO: 16895 - RNA, 22 nt, Homo sapiens
cgggcccuggauggcagcgcuc

SEQ ID NO: 16896 - RNA, 22 nt, Homo sapiens
gcgaggagccagcugggggccg

SEQ ID NO: 16897 - RNA, 22 nt, Homo sapiens
gagugucauuuaagccuuuugc

SEQ ID NO: 16898 - RNA, 20 nt, Homo sapiens
gcagauggcgaaaugagcuu

SEQ ID NO: 16899 - RNA, 22 nt, Homo sapiens
gcuccuccacuccagguccuug

SEQ ID NO: 16900 - RNA, 22 nt, Homo sapiens
agggcggaguagugaggagacc

SEQ ID NO: 16901 - RNA, 22 nt, Homo sapiens
ucagugcucccuggggaagggg

SEQ ID NO: 16902 - RNA, 22 nt, Homo sapiens
uccugccccaugagcugugaaa

SEQ ID NO: 16903 - RNA, 22 nt, Homo sapiens
uuccaggagagagagaggggug

SEQ ID NO: 16904 - RNA, 22 nt, Homo sapiens
cuuuuuucccacucuuggagga

SEQ ID NO: 16905 - RNA, 22 nt, Homo sapiens
ggaugccuugccaagugucuaa

SEQ ID NO: 16906 - RNA, 19 nt, Homo sapiens
acugcuuggccgagggucc

SEQ ID NO: 16907 - RNA, 22 nt, Homo sapiens
ccauguuucugaccacccucuu

SEQ ID NO: 16908 - RNA, 22 nt, Homo sapiens
acaguggaucgggaugcacugg

SEQ ID NO: 16909 - RNA, 22 nt, Homo sapiens
ucucuugugcuuucauagcagc

SEQ ID NO: 16910 - RNA, 22 nt, Homo sapiens
uauuacuaugaaggcuggaggg

SEQ ID NO: 16911 - RNA, 22 nt, Homo sapiens
ugugagacuuguucagggucau

SEQ ID NO: 16912 - RNA, 22 nt, Homo sapiens
ugagccagaaugagauuucagg

SEQ ID NO: 16913 - RNA, 22 nt, Homo sapiens
ugcccauuaguuuuuccauuag

SEQ ID NO: 16914 - RNA, 22 nt, Homo sapiens
uaaugggauuacuagcauggga

SEQ ID NO: 16915 - RNA, 22 nt, Homo sapiens
uacagguccuagcaugcaaugg

SEQ ID NO: 16916 - RNA, 22 nt, Homo sapiens
cacagagcacugcuuguaagga

SEQ ID NO: 16917 - RNA, 22 nt, Homo sapiens
gagagaggaagaugggagagcu

SEQ ID NO: 16918 - RNA, 21 nt, Homo sapiens
uuucuuaucucccuuuauccu

SEQ ID NO: 16919 - RNA, 22 nt, Homo sapiens
gagcauaugcagcagcggcugc

SEQ ID NO: 16920 - RNA, 22 nt, Homo sapiens
cagccugguugcaaugcugcug

SEQ ID NO: 16921 - RNA, 22 nt, Homo sapiens
gggggcuucucuugcugggcug

SEQ ID NO: 16922 - RNA, 22 nt, Homo sapiens
cuggcccgggagcagaggccug

SEQ ID NO: 16923 - RNA, 22 nt, Homo sapiens
gcggcaaaggcagggaacaggc

SEQ ID NO: 16924 - RNA, 22 nt, Homo sapiens
cccugguucugccugugagcug

SEQ ID NO: 16925 - RNA, 22 nt, Homo sapiens
uaguuuuuauuggucugaaugg

SEQ ID NO: 16926 - RNA, 22 nt, Homo sapiens
ucauucagccaacaaaauguuu

SEQ ID NO: 16927 - RNA, 22 nt, Homo sapiens
ggggcuugacuccucccugaga

SEQ ID NO: 16928 - RNA, 22 nt, Homo sapiens
ucucagaggagucauaccuaaa

SEQ ID NO: 16929 - RNA, 22 nt, Homo sapiens
gaacuauuguucacaauucuau

SEQ ID NO: 16930 - RNA, 22 nt, Homo sapiens
uagaauuguggcuacaaugagu

SEQ ID NO: 16931 - RNA, 22 nt, Homo sapiens
aggggaaauccauaagcuuugu

SEQ ID NO: 16932 - RNA, 22 nt, Homo sapiens
aaaguagauggauuuaguccag

SEQ ID NO: 16933 - RNA, 22 nt, Homo sapiens
uugauaugccaguaacaucuug

SEQ ID NO: 16934 - RNA, 22 nt, Homo sapiens
cuagaugugcuaguguauccag

SEQ ID NO: 16935 - RNA, 22 nt, Homo sapiens
ugggcacagcggcaacaugaua

SEQ ID NO: 16936 - RNA, 22 nt, Homo sapiens
ucacuggggccgcuauguugag

SEQ ID NO: 16937 - RNA, 22 nt, Homo sapiens
gaaauuuguggaauuuacucuc

SEQ ID NO: 16938 - RNA, 22 nt, Homo sapiens
aguguuuuuaacaggguuucca

SEQ ID NO: 16939 - RNA, 22 nt, Homo sapiens
ggacucuagacauucaggacag

SEQ ID NO: 16940 - RNA, 22 nt, Homo sapiens
ugcugcuucugaacuggggucc

SEQ ID NO: 16941 - RNA, 22 nt, Homo sapiens
auaagacgagcaaaaagcuugu

SEQ ID NO: 16942 - RNA, 22 nt, Homo sapiens
cgagcuuuuggcccggguuaua

SEQ ID NO: 16943 - RNA, 22 nt, Homo sapiens
guaauuuuuccaguguaccauu

SEQ ID NO: 16944 - RNA, 22 nt, Homo sapiens
guaagcugugaaauguuggcug

SEQ ID NO: 16945 - RNA, 22 nt, Homo sapiens
cagggcaggcaggccagcggcu

SEQ ID NO: 16946 - RNA, 22 nt, Homo sapiens
gucccugcccugugcccuggga

SEQ ID NO: 16947 - RNA, 22 nt, Homo sapiens
uuuaucuggugagaaacugcug

SEQ ID NO: 16948 - RNA, 22 nt, Homo sapiens
gcaguaguuuacugaguggacu

SEQ ID NO: 16949 - RNA, 22 nt, Homo sapiens
gccacucugcugccugucgggu

SEQ ID NO: 16950 - RNA, 22 nt, Homo sapiens
ccagagcgguuagcagagcugg

SEQ ID NO: 16951 - RNA, 22 nt, Homo sapiens
gaggcaguguugaaaaggagag

SEQ ID NO: 16952 - RNA, 22 nt, Homo sapiens
ucucccaucagccacuuccguc

SEQ ID NO: 16953 - RNA, 22 nt, Homo sapiens
uggaguagguggugcauugucc

SEQ ID NO: 16954 - RNA, 22 nt, Homo sapiens
ggcacugaguuaccugccccaa

SEQ ID NO: 16955 - RNA, 22 nt, Homo sapiens
ucuggccccuguugucugcaug

SEQ ID NO: 16956 - RNA, 22 nt, Homo sapiens
aaccaggcauaggggaaagauu

SEQ ID NO: 16957 - RNA, 22 nt, Homo sapiens
uggcuccccuugagauuggguu

SEQ ID NO: 16958 - RNA, 22 nt, Homo sapiens
cuccagaaucucagaggaagcg

SEQ ID NO: 16959 - RNA, 22 nt, Homo sapiens
uuucucugucagucucucuggu

SEQ ID NO: 16960 - RNA, 22 nt, Homo sapiens
ucagggcugugcacagaaggcg

SEQ ID NO: 16961 - RNA, 22 nt, Homo sapiens
uguguguuccagaggaguccug

SEQ ID NO: 16962 - RNA, 22 nt, Homo sapiens
gaccuccuuccugggaacaggu

SEQ ID NO: 16963 - RNA, 22 nt, Homo sapiens
ugccuucgcugcucagccugug

SEQ ID NO: 16964 - RNA, 22 nt, Homo sapiens
cagagcgugcugagcaagcgga

SEQ ID NO: 16965 - RNA, 22 nt, Homo sapiens
acagagggcuccucuaacuauu

SEQ ID NO: 16966 - RNA, 22 nt, Homo sapiens
aaaggauagggaggccucucag

SEQ ID NO: 16967 - RNA, 22 nt, Homo sapiens
ucuguugauaucuguagguucu

SEQ ID NO: 16968 - RNA, 22 nt, Homo sapiens
accccuagauaucaacauauag

SEQ ID NO: 16969 - RNA, 22 nt, Homo sapiens
uuucuucuucuauuuuccugga

SEQ ID NO: 16970 - RNA, 22 nt, Homo sapiens
ggaagagugggagaauuugggg

SEQ ID NO: 16971 - RNA, 22 nt, Homo sapiens
ugcauuuggcuaauuuucuuuu

SEQ ID NO: 16972 - RNA, 22 nt, Homo sapiens
aaagaaaauuggccuccaugga

SEQ ID NO: 16973 - RNA, 22 nt, Homo sapiens
uuccucaucgaucacggaauua

SEQ ID NO: 16974 - RNA, 22 nt, Homo sapiens
uuucagagcgacuugggagggg

SEQ ID NO: 16975 - RNA, 22 nt, Homo sapiens
ggccucuccccgggaggagaga

SEQ ID NO: 16976 - RNA, 22 nt, Homo sapiens
ucuccaauccggucagagccgu

SEQ ID NO: 16977 - RNA, 22 nt, Homo sapiens
aagguagauucuccuucuauga

SEQ ID NO: 16978 - RNA, 21 nt, Homo sapiens
aucauagaggaaaauccacgu

SEQ ID NO: 16979 - RNA, 22 nt, Homo sapiens
gaagggagcuggaaugggugua

SEQ ID NO: 16980 - RNA, 22 nt, Homo sapiens
ugccugaugccagcucucuuau

SEQ ID NO: 16981 - RNA, 22 nt, Homo sapiens
auuuggugggguuuuuuaaugu

SEQ ID NO: 16982 - RNA, 22 nt, Homo sapiens
cuuuaaaauaugccacugaagc

SEQ ID NO: 16983 - RNA, 22 nt, Homo sapiens
uccugccguagaaauguuggug

SEQ ID NO: 16984 - RNA, 22 nt, Homo sapiens
uuugaucauuuuuggggaagga

SEQ ID NO: 16985 - RNA, 23 nt, Homo sapiens
gugccuacugagcugauaucagu

SEQ ID NO: 16986 - RNA, 22 nt, Homo sapiens
uggcucaguucagcaggaacag

SEQ ID NO: 16987 - RNA, 22 nt, Homo sapiens
uguugugccuuagucccugccu

SEQ ID NO: 16988 - RNA, 22 nt, Homo sapiens
ugggagugaggacgagaggccc

SEQ ID NO: 16989 - RNA, 22 nt, Homo sapiens
cagaggcgcaaggcgccccucc

SEQ ID NO: 16990 - RNA, 22 nt, Homo sapiens
gcgggagcagccuucagugucu

SEQ ID NO: 16991 - RNA, 22 nt, Homo sapiens
ggagaggugaaggcugcccugg

SEQ ID NO: 16992 - RNA, 22 nt, Homo sapiens
gggaggagcguucacccuuucc

SEQ ID NO: 16993 - RNA, 22 nt, Homo sapiens
ugugugucuccacugugcuauu

SEQ ID NO: 16994 - RNA, 22 nt, Homo sapiens
aacaguacucggaggccagacu

SEQ ID NO: 16995 - RNA, 22 nt, Homo sapiens
uccucucucuuccugacacauu

SEQ ID NO: 16996 - RNA, 22 nt, Homo sapiens
auguugggaaggacaaagggug

SEQ ID NO: 16997 - RNA, 22 nt, Homo sapiens
ugggugucucagagucuccugg

SEQ ID NO: 16998 - RNA, 21 nt, Homo sapiens
ccagagagaccuagcaaccaa

SEQ ID NO: 16999 - RNA, 22 nt, Homo sapiens
uuuuauuccuuuccuugggcua

SEQ ID NO: 17000 - RNA, 22 nt, Homo sapiens
ccccugagggaaggaauagaau

SEQ ID NO: 17001 - RNA, 22 nt, Homo sapiens
gcccugaugugugucggcugga

SEQ ID NO: 17002 - RNA, 22 nt, Homo sapiens
acuggggcacauuagggaaggg

SEQ ID NO: 17003 - RNA, 22 nt, Homo sapiens
uucuguacauaaguaaucugau

SEQ ID NO: 17004 - RNA, 22 nt, Homo sapiens
gauuacuuauauacagaauguu

SEQ ID NO: 17005 - RNA, 22 nt, Homo sapiens
uaaugaagaaguuugcugugug

SEQ ID NO: 17006 - RNA, 22 nt, Homo sapiens
acaccagagcaacucccuucau

SEQ ID NO: 17007 - RNA, 22 nt, Homo sapiens
uggagagacagguggauauuuu

SEQ ID NO: 17008 - RNA, 22 nt, Homo sapiens
aaguuuuuaugugucucucugg

SEQ ID NO: 17009 - RNA, 22 nt, Homo sapiens
uagaggaaaagucccugagcau

SEQ ID NO: 17010 - RNA, 22 nt, Homo sapiens
ugccaggugcuuuccucuagag

SEQ ID NO: 17011 - RNA, 22 nt, Homo sapiens
agggaggaggaggcucagggac

SEQ ID NO: 17012 - RNA, 22 nt, Homo sapiens
ucugggccucagucuccccuuc

SEQ ID NO: 17013 - RNA, 22 nt, Homo sapiens
gagcgggagggcccagggugag

SEQ ID NO: 17014 - RNA, 22 nt, Homo sapiens
uccccggggucuugcugcugga

SEQ ID NO: 17015 - RNA, 22 nt, Homo sapiens
uuccaaguaugacauuuuagag

SEQ ID NO: 17016 - RNA, 22 nt, Homo sapiens
uaaaauaccagauuuggaaaac

SEQ ID NO: 17017 - RNA, 22 nt, Homo sapiens
ugauggugccuaagucauuuag

SEQ ID NO: 17018 - RNA, 22 nt, Homo sapiens
gaaagauggcugcaccguuuuc

SEQ ID NO: 17019 - RNA, 22 nt, Homo sapiens
ucagcaguggucagcccaggag

SEQ ID NO: 17020 - RNA, 22 nt, Homo sapiens
uguauugaaaaugcugcugggg

SEQ ID NO: 17021 - RNA, 22 nt, Homo sapiens
uccaguuacucugggacucguu

SEQ ID NO: 17022 - RNA, 22 nt, Homo sapiens
cagggagccugaguaacuggaa

SEQ ID NO: 17023 - RNA, 22 nt, Homo sapiens
ucugaaguugcaggagaagcuu

SEQ ID NO: 17024 - RNA, 20 nt, Homo sapiens
cuuuuccugcagcucaagga

SEQ ID NO: 17025 - RNA, 22 nt, Homo sapiens
ucuaggagagugugaacccugu

SEQ ID NO: 17026 - RNA, 22 nt, Homo sapiens
ggguccccaccuucuggagcuu

SEQ ID NO: 17027 - RNA, 22 nt, Homo sapiens
agggaguaacugaugguggaaa

SEQ ID NO: 17028 - RNA, 22 nt, Homo sapiens
uuaccgucaggcuauacucucc

SEQ ID NO: 17029 - RNA, 22 nt, Homo sapiens
uacagaaaguauugguaguuuc

SEQ ID NO: 17030 - RNA, 20 nt, Homo sapiens
aagcugcagugcuucaugua

SEQ ID NO: 17031 - RNA, 20 nt, Homo sapiens
acugcagugaaggcacuugu

SEQ ID NO: 17032 - RNA, 24 nt, Homo sapiens
caaagugcuuacagugcagguagu

SEQ ID NO: 17033 - RNA, 23 nt, Homo sapiens
caaagugcuuacagugcagguag

SEQ ID NO: 17034 - RNA, 22 nt, Homo sapiens
ugcucagcgcgccgcucguggc

SEQ ID NO: 17035 - RNA, 22 nt, Homo sapiens
ccgcggcggccgagcugagugu

SEQ ID NO: 17036 - RNA, 22 nt, Homo sapiens
cauugaacuaugcaggcuaacu

SEQ ID NO: 17037 - RNA, 22 nt, Homo sapiens
agucugucugcacagcaguggc

SEQ ID NO: 17038 - RNA, 22 nt, Homo sapiens
ugugggugucaggcagugagcu

SEQ ID NO: 17039 - RNA, 22 nt, Homo sapiens
cuacaugauuuguucccacaca

SEQ ID NO: 17040 - RNA, 22 nt, Homo sapiens
ugucuggugggaugagcggcaa

SEQ ID NO: 17041 - RNA, 22 nt, Homo sapiens
ugcccuucuccccauugaggca

SEQ ID NO: 17042 - RNA, 22 nt, Homo sapiens
gcuggaguggaugauagaggug

SEQ ID NO: 17043 - RNA, 22 nt, Homo sapiens
agcucgucagcuacuguaggug

SEQ ID NO: 17044 - RNA, 22 nt, Homo sapiens
gcuuuuccccuggaggauccuc

SEQ ID NO: 17045 - RNA, 22 nt, Homo sapiens
gaucgucaaagggaauggauca

SEQ ID NO: 17046 - RNA, 22 nt, Homo sapiens
cggcggccuguccccagugcuu

SEQ ID NO: 17047 - RNA, 22 nt, Homo sapiens
acaggauggggacagccgcccc

SEQ ID NO: 17048 - RNA, 22 nt, Homo sapiens
gaagauuuuuuuuuuuacuuuu

SEQ ID NO: 17049 - RNA, 22 nt, Homo sapiens
agggggaaaaagguaugucuuu

SEQ ID NO: 17050 - RNA, 22 nt, Homo sapiens
gacuggaggaggcauggagggu

SEQ ID NO: 17051 - RNA, 22 nt, Homo sapiens
ccccauggccuuucccgcauuc

SEQ ID NO: 17052 - RNA, 22 nt, Homo sapiens
gacuggaggaggcauggagggu

SEQ ID NO: 17053 - RNA, 22 nt, Homo sapiens
ccccauggccuuucccgcauuc

SEQ ID NO: 17054 - RNA, 22 nt, Homo sapiens
uggcuccacaggccagggugug

SEQ ID NO: 17055 - RNA, 22 nt, Homo sapiens
caccucagccauguggaggagg

SEQ ID NO: 17056 - RNA, 22 nt, Homo sapiens
ucacaugucuucucugugggau

SEQ ID NO: 17057 - RNA, 22 nt, Homo sapiens
uccuaagagagggcagauguga

SEQ ID NO: 17058 - RNA, 22 nt, Homo sapiens
uucuggaacccgagccucuggc

SEQ ID NO: 17059 - RNA, 22 nt, Homo sapiens
uaguggguuuggggucugggcu

SEQ ID NO: 17060 - RNA, 22 nt, Homo sapiens
caggaucagcaccaugaagauc

SEQ ID NO: 17061 - RNA, 22 nt, Homo sapiens
uggucaucaugaucugguuuuc

SEQ ID NO: 17062 - RNA, 22 nt, Homo sapiens
uuccuugcugguguccaaccuu

SEQ ID NO: 17063 - RNA, 22 nt, Homo sapiens
acguugugacagaagcaaugau

SEQ ID NO: 17064 - RNA, 22 nt, Homo sapiens
uggcuccacaggccagggugug

SEQ ID NO: 17065 - RNA, 22 nt, Homo sapiens
caccucagccauguggaggcgg

SEQ ID NO: 17066 - RNA, 22 nt, Homo sapiens
ggcugugucacuguggguauag

SEQ ID NO: 17067 - RNA, 22 nt, Homo sapiens
uccucacagugacacgagcccc

SEQ ID NO: 17068 - RNA, 22 nt, Homo sapiens
ucugcaauggagaaagugagac

SEQ ID NO: 17069 - RNA, 22 nt, Homo sapiens
ucugcuuacacuuuucauucgu

SEQ ID NO: 17070 - RNA, 22 nt, Homo sapiens
ugaggugccggcuggaguuucu

SEQ ID NO: 17071 - RNA, 22 nt, Homo sapiens
aaaaugcauuccggugggcacc

SEQ ID NO: 17072 - RNA, 22 nt, Homo sapiens
ucccgggaacucaucagucucc

SEQ ID NO: 17073 - RNA, 22 nt, Homo sapiens
gagacucacaaguuccugcaaa

SEQ ID NO: 17074 - RNA, 22 nt, Homo sapiens
gagcuggaggccuggugcuguu

SEQ ID NO: 17075 - RNA, 22 nt, Homo sapiens
gcugucaccucuucugguuucu

SEQ ID NO: 17076 - RNA, 22 nt, Homo sapiens
uccacuggcugccaugacccca

SEQ ID NO: 17077 - RNA, 22 nt, Homo sapiens
ugaagggcaaggagccagugga

SEQ ID NO: 17078 - RNA, 22 nt, Homo sapiens
uggauucuugccaguuuugcau

SEQ ID NO: 17079 - RNA, 22 nt, Homo sapiens
caaagcuggcaagaauccauag

SEQ ID NO: 17080 - RNA, 22 nt, Homo sapiens
uuugccuccaaaagaggacagu

SEQ ID NO: 17081 - RNA, 22 nt, Homo sapiens
uguccuuuguccugaggcacac

SEQ ID NO: 17082 - RNA, 22 nt, Homo sapiens
aacugccugaggccuaaaagac

SEQ ID NO: 17083 - RNA, 22 nt, Homo sapiens
ucuugccgggucucagcgcagu

SEQ ID NO: 17084 - RNA, 22 nt, Homo sapiens
ugaggguaggugggguggcugc

SEQ ID NO: 17085 - RNA, 22 nt, Homo sapiens
ggccacaucgccuaaccuucga

SEQ ID NO: 17086 - RNA, 22 nt, Homo sapiens
cagugggagacuggucauggau

SEQ ID NO: 17087 - RNA, 22 nt, Homo sapiens
ucccugacacucuccccauggg

SEQ ID NO: 17088 - RNA, 22 nt, Homo sapiens
cuguacagccuccuagcuuucc

SEQ ID NO: 17089 - RNA, 22 nt, Homo sapiens
ugagguaguagguuguauaguu

SEQ ID NO: 17090 - RNA, 22 nt, Homo sapiens
cccagagucuuggucuguuugc

SEQ ID NO: 17091 - RNA, 20 nt, Homo sapiens
gcagaucagggaagaguggg

SEQ ID NO: 17092 - RNA, 22 nt, Homo sapiens
ggugauggagagagacagagcu

SEQ ID NO: 17093 - RNA, 22 nt, Homo sapiens
uggccugucucuccucuguccu

SEQ ID NO: 17094 - RNA, 22 nt, Homo sapiens
ggugauggagagagacagcgcu

SEQ ID NO: 17095 - RNA, 22 nt, Homo sapiens
uggccugucucuccucuguccu

SEQ ID NO: 17096 - RNA, 22 nt, Homo sapiens
ggugauggagagagacagcgcu

SEQ ID NO: 17097 - RNA, 22 nt, Homo sapiens
uggccugucucuccucuguccu

SEQ ID NO: 17098 - RNA, 22 nt, Homo sapiens
cguguucacagcggaccuugau

SEQ ID NO: 17099 - RNA, 22 nt, Homo sapiens
uuaaggcacgcggugaaugcca

SEQ ID NO: 17100 - RNA, 21 nt, Homo sapiens
cguguucacagcggaccuuga

SEQ ID NO: 17101 - RNA, 20 nt, Homo sapiens
uaaggcacgcggugaaugcc

SEQ ID NO: 17102 - RNA, 22 nt, Homo sapiens
uguguccaguucuguuacauga

SEQ ID NO: 17103 - RNA, 22 nt, Homo sapiens
uguccucagcaggacacgacau

SEQ ID NO: 17104 - RNA, 22 nt, Homo sapiens
ugugucccucucugcauuaagu

SEQ ID NO: 17105 - RNA, 22 nt, Homo sapiens
gcauuuagugcaggacacacag

SEQ ID NO: 17106 - RNA, 22 nt, Homo sapiens
cgcagccgccugggucuucccc

SEQ ID NO: 17107 - RNA, 22 nt, Homo sapiens
gggaaucucaguggcugaaacu

SEQ ID NO: 17108 - RNA, 22 nt, Homo sapiens
caccauaugucauacuguagcu

SEQ ID NO: 17109 - RNA, 22 nt, Homo sapiens
aggcagugucagacagauggua

SEQ ID NO: 17110 - RNA, 21 nt, Homo sapiens
cauuauuacuuuugguacgcg

SEQ ID NO: 17111 - RNA, 21 nt, Homo sapiens
ucguaccgugaguaauaaugc

SEQ ID NO: 17112 - RNA, 22 nt, Homo sapiens
uggugugcuagaguacucgaag

SEQ ID NO: 17113 - RNA, 21 nt, Homo sapiens
gccgagacuagagucacaucc

SEQ ID NO: 17114 - RNA, 23 nt, Homo sapiens
gccgagacuagagucacauccug

SEQ ID NO: 17115 - RNA, 22 nt, Homo sapiens
gagcugaucgagagagccgucu

SEQ ID NO: 17116 - RNA, 22 nt, Homo sapiens
auagcuuagaguuugggucagc

SEQ ID NO: 17117 - RNA, 22 nt, Homo sapiens
gagcgcugcggggccuccacaa

SEQ ID NO: 17118 - RNA, 17 nt, Homo sapiens
auggcccuccaaagcuc

SEQ ID NO: 17119 - RNA, 22 nt, Homo sapiens
uacuccugcugucacugcaguu

SEQ ID NO: 17120 - RNA, 22 nt, Homo sapiens
gcaugcagugacagcaguuggg

SEQ ID NO: 17121 - RNA, 22 nt, Homo sapiens
ugcagcagggagaaggaagugg

SEQ ID NO: 17122 - RNA, 22 nt, Homo sapiens
uggcacuucucuccuuguaagu

SEQ ID NO: 17123 - RNA, 22 nt, Homo sapiens
uuguucugacaaucucuuuggc

SEQ ID NO: 17124 - RNA, 22 nt, Homo sapiens
agaggguuugggaagagcaaga

SEQ ID NO: 17125 - RNA, 22 nt, Homo sapiens
ugugccaggaagagccugcaug

SEQ ID NO: 17126 - RNA, 22 nt, Homo sapiens
guagccuuucucugaugcacag

SEQ ID NO: 17127 - RNA, 22 nt, Homo sapiens
ugcaguucgccaggcgcguucc

SEQ ID NO: 17128 - RNA, 22 nt, Homo sapiens
gggacgcccuuggggagcagag

SEQ ID NO: 17129 - RNA, 22 nt, Homo sapiens
gagagccagggaggagugaguu

SEQ ID NO: 17130 - RNA, 19 nt, Homo sapiens
agcucucuccuuccuucuc

SEQ ID NO: 17131 - RNA, 22 nt, Homo sapiens
uccagccauuucucuucuguca

SEQ ID NO: 17132 - RNA, 22 nt, Homo sapiens
ugccaggagggaaaguaaaugg

SEQ ID NO: 17133 - RNA, 22 nt, Homo sapiens
uuuccagcaggaauuacucuga

SEQ ID NO: 17134 - RNA, 22 nt, Homo sapiens
aguaauuucugcugaaaagguu

SEQ ID NO: 17135 - RNA, 22 nt, Homo sapiens
uaggagcaugugugggggugug

SEQ ID NO: 17136 - RNA, 22 nt, Homo sapiens
caccagcucauacaguucuaaa

SEQ ID NO: 17137 - RNA, 22 nt, Homo sapiens
uggguggagcggggcgggucgu

SEQ ID NO: 17138 - RNA, 22 nt, Homo sapiens
uacccgcuuuaucucuacccag

SEQ ID NO: 17139 - RNA, 22 nt, Homo sapiens
ugauguucuccccacgacuguc

SEQ ID NO: 17140 - RNA, 22 nt, Homo sapiens
caguccuggggaaacaccaaaa

SEQ ID NO: 17141 - RNA, 22 nt, Homo sapiens
gauggaaaguguguuccguugg

SEQ ID NO: 17142 - RNA, 22 nt, Homo sapiens
ucaauuacacucuuuucuuccu

SEQ ID NO: 17143 - RNA, 22 nt, Homo sapiens
ugggguuccaacaauuuucccg

SEQ ID NO: 17144 - RNA, 22 nt, Homo sapiens
ugguaaauuguuggaacuggag

SEQ ID NO: 17145 - RNA, 22 nt, Homo sapiens
uuguuaacugcacauuuuaugc

SEQ ID NO: 17146 - RNA, 22 nt, Homo sapiens
auuuagaauguguguaauaauu

SEQ ID NO: 17147 - RNA, 22 nt, Homo sapiens
aaaggauaaucucuggucacau

SEQ ID NO: 17148 - RNA, 22 nt, Homo sapiens
uguggccugggccgauuucuuu

SEQ ID NO: 17149 - RNA, 22 nt, Homo sapiens
uccuggucccuucauccucagc

SEQ ID NO: 17150 - RNA, 22 nt, Homo sapiens
ugagcagugaaggagaaaagga

SEQ ID NO: 17151 - RNA, 19 nt, Homo sapiens
gguccagaggggagauagg

SEQ ID NO: 17152 - RNA, 21 nt, Homo sapiens
uucuucucuauagaauaaaug

SEQ ID NO: 17153 - RNA, 22 nt, Homo sapiens
uuucaguaguuuagcccuaagg

SEQ ID NO: 17154 - RNA, 22 nt, Homo sapiens
uugguuagacauacugaagaua

SEQ ID NO: 17155 - RNA, 22 nt, Homo sapiens
gccggcucuaccauggggccuu

SEQ ID NO: 17156 - RNA, 22 nt, Homo sapiens
gggaccuuaugaaaguggaacg

SEQ ID NO: 17157 - RNA, 22 nt, Homo sapiens
ugcugugguaagcucuacacuu

SEQ ID NO: 17158 - RNA, 22 nt, Homo sapiens
ggugggagacgcuggagcagug

SEQ ID NO: 17159 - RNA, 22 nt, Homo sapiens
uugguccuucugaagcuucuuc

SEQ ID NO: 17160 - RNA, 22 nt, Homo sapiens
ugaggagcagagagggagcaug

SEQ ID NO: 17161 - RNA, 22 nt, Homo sapiens
uauacggccuccuagcuuuccc

SEQ ID NO: 17162 - RNA, 21 nt, Homo sapiens
ugagguaggagguuguauagu

SEQ ID NO: 17163 - RNA, 20 nt, Homo sapiens
auacggccuccuagcuuucc

SEQ ID NO: 17164 - RNA, 22 nt, Homo sapiens
cuauacggccuccuagcuuucc

SEQ ID NO: 17165 - RNA, 24 nt, Homo sapiens
cuauacggccuccuagcuuucccc

SEQ ID NO: 17166 - RNA, 22 nt, Homo sapiens
gagauggggguggccgaggcuu

SEQ ID NO: 17167 - RNA, 22 nt, Homo sapiens
gcuucggagcccuauuuucucc

SEQ ID NO: 17168 - RNA, 22 nt, Homo sapiens
caagguugaaucuagguaccug

SEQ ID NO: 17169 - RNA, 22 nt, Homo sapiens
ggugucuguauucaguuuguga

SEQ ID NO: 17170 - RNA, 22 nt, Homo sapiens
cgcugggggucauccuaucucu

SEQ ID NO: 17171 - RNA, 22 nt, Homo sapiens
gaaggguggccuccugaagugg

SEQ ID NO: 17172 - RNA, 22 nt, Homo sapiens
uaagugguccaggauuuguucu

SEQ ID NO: 17173 - RNA, 22 nt, Homo sapiens
aggcaacuccuggccacuguuc

SEQ ID NO: 17174 - RNA, 22 nt, Homo sapiens
acugauuucuuuugguguucag

SEQ ID NO: 17175 - RNA, 21 nt, Homo sapiens
uagcaccaucugaaaucgguu

SEQ ID NO: 17176 - RNA, 22 nt, Homo sapiens
uagugucccaguuugcagccuu

SEQ ID NO: 17177 - RNA, 22 nt, Homo sapiens
cugcaaacugggauacuauuca

SEQ ID NO: 17178 - RNA, 22 nt, Homo sapiens
uuguucagcagaugagcuuguu

SEQ ID NO: 17179 - RNA, 22 nt, Homo sapiens
caguucauuugauugaacuugg

SEQ ID NO: 17180 - RNA, 22 nt, Homo sapiens
uggcccaaggaggaggaaaggg

SEQ ID NO: 17181 - RNA, 22 nt, Homo sapiens
ucccuuuccuccccuuacuaug

SEQ ID NO: 17182 - RNA, 22 nt, Homo sapiens
agaagugccgggaacaagaggu

SEQ ID NO: 17183 - RNA, 22 nt, Homo sapiens
ucucuuuccugguuuccuucug

SEQ ID NO: 17184 - RNA, 22 nt, Homo sapiens
acgcucacuccguguccgcgac

SEQ ID NO: 17185 - RNA, 22 nt, Homo sapiens
agcgagccacgggagggagugu

SEQ ID NO: 17186 - RNA, 22 nt, Homo sapiens
uugccucauuucccuucuccuu

SEQ ID NO: 17187 - RNA, 22 nt, Homo sapiens
gaaaaggaaaaugagguaagga

SEQ ID NO: 17188 - RNA, 22 nt, Homo sapiens
uacuccaccuguaucuaaaaag

SEQ ID NO: 17189 - RNA, 22 nt, Homo sapiens
uuuuagauagagguggaguaug

SEQ ID NO: 17190 - RNA, 22 nt, Homo sapiens
ugaccuguugggcuaauggccu

SEQ ID NO: 17191 - RNA, 22 nt, Homo sapiens
cacauaaguccuccaguagguc

SEQ ID NO: 17192 - RNA, 22 nt, Homo sapiens
uccgggguucacgcucgggggu

SEQ ID NO: 17193 - RNA, 22 nt, Homo sapiens
cggcccgcgugaacccugggcc

SEQ ID NO: 17194 - RNA, 22 nt, Homo sapiens
uggaggcagaaauaggacuugu

SEQ ID NO: 17195 - RNA, 22 nt, Homo sapiens
aaagcgcuaauuucugccuucu

SEQ ID NO: 17196 - RNA, 22 nt, Homo sapiens
gggucagaaauccugcugucag

SEQ ID NO: 17197 - RNA, 22 nt, Homo sapiens
acuucaggauuucugaacuugu

SEQ ID NO: 17198 - RNA, 22 nt, Homo sapiens
ugcagugcugggggagguugug

SEQ ID NO: 17199 - RNA, 22 nt, Homo sapiens
caucccaccccagcacugccuu

SEQ ID NO: 17200 - RNA, 22 nt, Homo sapiens
uggggugcggcucugagggggu

SEQ ID NO: 17201 - RNA, 22 nt, Homo sapiens
cuucagcaagucgcauccccuc

SEQ ID NO: 17202 - RNA, 22 nt, Homo sapiens
uaguuucccaacuaauuauucu

SEQ ID NO: 17203 - RNA, 22 nt, Homo sapiens
aauaauuaguuuugaaacuaua

SEQ ID NO: 17204 - RNA, 22 nt, Homo sapiens
uggaugccauugauaugucuca

SEQ ID NO: 17205 - RNA, 20 nt, Homo sapiens
ggugauaucagugguuucca

SEQ ID NO: 17206 - RNA, 22 nt, Homo sapiens
caaauauagguaacaggcugua

SEQ ID NO: 17207 - RNA, 22 nt, Homo sapiens
cagacuguuaccuaaauuuggg

SEQ ID NO: 17208 - RNA, 22 nt, Homo sapiens
uccgggguucacgcucgggggu

SEQ ID NO: 17209 - RNA, 22 nt, Homo sapiens
cggcccgcgcgaacccugggcc

SEQ ID NO: 17210 - RNA, 22 nt, Homo sapiens
uggauguguaaugauuauguug

SEQ ID NO: 17211 - RNA, 22 nt, Homo sapiens
acaugguaaguauacaucccag

SEQ ID NO: 17212 - RNA, 22 nt, Homo sapiens
ggggucaguaggaaccuagggu

SEQ ID NO: 17213 - RNA, 20 nt, Homo sapiens
ugaucuuuucuugcugcccc

SEQ ID NO: 17214 - RNA, 22 nt, Homo sapiens
uuuuccuuagggaccuguguuu

SEQ ID NO: 17215 - RNA, 22 nt, Homo sapiens
agacagagaauuggggaagcag

SEQ ID NO: 17216 - RNA, 22 nt, Homo sapiens
cugcuuugguuuuggaggcagg

SEQ ID NO: 17217 - RNA, 22 nt, Homo sapiens
uguaguuuccaaaccacagaag

SEQ ID NO: 17218 - RNA, 22 nt, Homo sapiens
ugguuguugcccacaucuguuc

SEQ ID NO: 17219 - RNA, 22 nt, Homo sapiens
cagaguuggacaacaaccaagg

SEQ ID NO: 17220 - RNA, 22 nt, Homo sapiens
caggugagcuuccucgugugga

SEQ ID NO: 17221 - RNA, 22 nt, Homo sapiens
cacaugagaggcuguaccuguu

SEQ ID NO: 17222 - RNA, 22 nt, Homo sapiens
gagggagcugggagaguuugga

SEQ ID NO: 17223 - RNA, 22 nt, Homo sapiens
cuuugcuuucucuugcucucuc

SEQ ID NO: 17224 - RNA, 22 nt, Homo sapiens
uggggguccuaccuccgugucc

SEQ ID NO: 17225 - RNA, 22 nt, Homo sapiens
gcuacgauggugagaccccccu

SEQ ID NO: 17226 - RNA, 22 nt, Homo sapiens
ugggguggggagguggucuggg

SEQ ID NO: 17227 - RNA, 22 nt, Homo sapiens
cugggacuccuccccacuggac

SEQ ID NO: 17228 - RNA, 22 nt, Homo sapiens
cccgggcaaggauucugagagg

SEQ ID NO: 17229 - RNA, 21 nt, Homo sapiens
aauccuuugucccugggugag

SEQ ID NO: 17230 - RNA, 22 nt, Homo sapiens
aauccuuugucccugggugaga

SEQ ID NO: 17231 - RNA, 22 nt, Homo sapiens
uuuguggagagcagcugccgcc

SEQ ID NO: 17232 - RNA, 21 nt, Homo sapiens
gcuccagcugacuucacaauc

SEQ ID NO: 17233 - RNA, 22 nt, Homo sapiens
ggccaauaagaaugccagcucc

SEQ ID NO: 17234 - RNA, 22 nt, Homo sapiens
gcaguuggcuuucuucuggucu

SEQ ID NO: 17235 - RNA, 22 nt, Homo sapiens
uggacauuucccugaaggccug

SEQ ID NO: 17236 - RNA, 22 nt, Homo sapiens
ccuucaggaaaauguccauuua

SEQ ID NO: 17237 - RNA, 22 nt, Homo sapiens
uacaguauagaugauguacuag

SEQ ID NO: 17238 - RNA, 22 nt, Homo sapiens
ugggauaucaucauauacugua

SEQ ID NO: 17239 - RNA, 22 nt, Homo sapiens
gaggguugaggauuggaacuug

SEQ ID NO: 17240 - RNA, 22 nt, Homo sapiens
guucgaaucaaucauacccucu

SEQ ID NO: 17241 - RNA, 22 nt, Homo sapiens
ugcugccuccucccucugccca

SEQ ID NO: 17242 - RNA, 22 nt, Homo sapiens
ugcgagggggaggaggugcggc

SEQ ID NO: 17243 - RNA, 22 nt, Homo sapiens
uacagcaguucuguguauacau

SEQ ID NO: 17244 - RNA, 22 nt, Homo sapiens
uguagugcacucuacucugugu

SEQ ID NO: 17245 - RNA, 22 nt, Homo sapiens
ugagagcugucaauagaucugc

SEQ ID NO: 17246 - RNA, 22 nt, Homo sapiens
cagguucugcuuggcucuaguc

SEQ ID NO: 17247 - RNA, 22 nt, Homo sapiens
agacuguggcauuugcuggauu

SEQ ID NO: 17248 - RNA, 17 nt, Homo sapiens
agcaaaagcuauuguuu

SEQ ID NO: 17249 - RNA, 22 nt, Homo sapiens
uuuuauggcaauuuguuucauu

SEQ ID NO: 17250 - RNA, 22 nt, Homo sapiens
acgaugcaaauugccauaaagu

SEQ ID NO: 17251 - RNA, 22 nt, Homo sapiens
uuaucuuccauugccaaguccu

SEQ ID NO: 17252 - RNA, 21 nt, Homo sapiens
gaguuggcaggugagauguuc

SEQ ID NO: 17253 - RNA, 22 nt, Homo sapiens
cuuccucgguggcggaggggcc

SEQ ID NO: 17254 - RNA, 22 nt, Homo sapiens
ccuuccgcagccaucgaguuga

SEQ ID NO: 17255 - RNA, 22 nt, Homo sapiens
acucaguuggucauaaacucca

SEQ ID NO: 17256 - RNA, 22 nt, Homo sapiens
gguccaugauccacuaagaccu

SEQ ID NO: 17257 - RNA, 22 nt, Homo sapiens
accacugggguaccauuuggua

SEQ ID NO: 17258 - RNA, 22 nt, Homo sapiens
acucaauaguaccuuaguggcc

SEQ ID NO: 17259 - RNA, 22 nt, Homo sapiens
gagucggggacuugcaccugca

SEQ ID NO: 17260 - RNA, 22 nt, Homo sapiens
ucaaagcaagggcaagcucugc

SEQ ID NO: 17261 - RNA, 22 nt, Homo sapiens
gagucggggacuugcaccugca

SEQ ID NO: 17262 - RNA, 22 nt, Homo sapiens
ucaaagcaagggcaagcucugc

SEQ ID NO: 17263 - RNA, 22 nt, Homo sapiens
gagucggggacuugcaccugca

SEQ ID NO: 17264 - RNA, 22 nt, Homo sapiens
ucaaagcaagggcaagcucugc

SEQ ID NO: 17265 - RNA, 22 nt, Homo sapiens
uagcacugucuacucuggauuu

SEQ ID NO: 17266 - RNA, 22 nt, Homo sapiens
aaucgagggugaacugugcuag

SEQ ID NO: 17267 - RNA, 22 nt, Homo sapiens
ucuuugguauaucuggcuaggu

SEQ ID NO: 17268 - RNA, 22 nt, Homo sapiens
ugugcuggguaauucugagagu

SEQ ID NO: 17269 - RNA, 22 nt, Homo sapiens
ucuuucucuccucccugccauc

SEQ ID NO: 17270 - RNA, 17 nt, Homo sapiens
agggagguagaguagga

SEQ ID NO: 17271 - RNA, 22 nt, Homo sapiens
uccccacggcccugggcaggga

SEQ ID NO: 17272 - RNA, 22 nt, Homo sapiens
ccuccccggggccagagggcag

SEQ ID NO: 17273 - RNA, 22 nt, Homo sapiens
gccauuuuaagguuggaagcag

SEQ ID NO: 17274 - RNA, 22 nt, Homo sapiens
ugaucuggccuuuaagaggauc

SEQ ID NO: 17275 - RNA, 22 nt, Homo sapiens
gacuuacacacucugcccugcu

SEQ ID NO: 17276 - RNA, 21 nt, Homo sapiens
aaagggguggagggugugguu

SEQ ID NO: 17277 - RNA, 22 nt, Homo sapiens
ugcuuauuuucgugucuuagaa

SEQ ID NO: 17278 - RNA, 22 nt, Homo sapiens
gcugagacauggaguagagccu

SEQ ID NO: 17279 - RNA, 22 nt, Homo sapiens
ugggguuuucucugcauuuggu

SEQ ID NO: 17280 - RNA, 22 nt, Homo sapiens
uaggcugacagggacuacaccu

SEQ ID NO: 17281 - RNA, 22 nt, Homo sapiens
ugccuuccccaccagcugccuu

SEQ ID NO: 17282 - RNA, 22 nt, Homo sapiens
cagcugguggggaggguguccu

SEQ ID NO: 17283 - RNA, 22 nt, Homo sapiens
uuuuggggaaguuugggaucug

SEQ ID NO: 17284 - RNA, 22 nt, Homo sapiens
uaauccauagaaaucccugaga

SEQ ID NO: 17285 - RNA, 22 nt, Homo sapiens
uguucauagaaguuacagugug

SEQ ID NO: 17286 - RNA, 22 nt, Homo sapiens
uucuguagaauguucugugaac

SEQ ID NO: 17287 - RNA, 22 nt, Homo sapiens
ugggggguggcagcagguggag

SEQ ID NO: 17288 - RNA, 22 nt, Homo sapiens
gccucagcugccacaccuccac

SEQ ID NO: 17289 - RNA, 22 nt, Homo sapiens
caccuccuucagguucuucccu

SEQ ID NO: 17290 - RNA, 22 nt, Homo sapiens
ggaagaaccagagggagguaau

SEQ ID NO: 17291 - RNA, 22 nt, Homo sapiens
ugaagagaggggccuuugugau

SEQ ID NO: 17292 - RNA, 22 nt, Homo sapiens
uuguaaucaccccuuuuuuuau

SEQ ID NO: 17293 - RNA, 22 nt, Homo sapiens
ggguggagggguguggggcugu

SEQ ID NO: 17294 - RNA, 22 nt, Homo sapiens
auccucccaccccugugcccug

SEQ ID NO: 17295 - RNA, 22 nt, Homo sapiens
uuuaauguuuuuaugcaguuua

SEQ ID NO: 17296 - RNA, 22 nt, Homo sapiens
agugcaagaaaacauugaaccu

SEQ ID NO: 17297 - RNA, 22 nt, Homo sapiens
uuuaauguuuuuaugcaguuua

SEQ ID NO: 17298 - RNA, 22 nt, Homo sapiens
agugcaagaaaacauugaaccu

SEQ ID NO: 17299 - RNA, 22 nt, Homo sapiens
uauggccugaaguauauguggc

SEQ ID NO: 17300 - RNA, 22 nt, Homo sapiens
accaaauaaaggcuuuugggcc

SEQ ID NO: 17301 - RNA, 22 nt, Homo sapiens
uggagcagggcaaggaggguug

SEQ ID NO: 17302 - RNA, 22 nt, Homo sapiens
cugcuccuggcccauguuuuag

SEQ ID NO: 17303 - RNA, 22 nt, Homo sapiens
uggcaugugagugaggagguua

SEQ ID NO: 17304 - RNA, 22 nt, Homo sapiens
cucagcuccuccacuuacuagc

SEQ ID NO: 17305 - RNA, 22 nt, Homo sapiens
uguuacuagaauugucuuagau

SEQ ID NO: 17306 - RNA, 22 nt, Homo sapiens
uaggcugguuccuguaacauug

SEQ ID NO: 17307 - RNA, 22 nt, Homo sapiens
ucuagacagggaggagaaguug

SEQ ID NO: 17308 - RNA, 20 nt, Homo sapiens
cuucuccuuccucuuugagu

SEQ ID NO: 17309 - RNA, 22 nt, Homo sapiens
gacucuugcuuuucccugugca

SEQ ID NO: 17310 - RNA, 22 nt, Homo sapiens
uacaggguaggggccaggaauu

SEQ ID NO: 17311 - RNA, 22 nt, Homo sapiens
ucaugcccaucccggccaucua

SEQ ID NO: 17312 - RNA, 22 nt, Homo sapiens
gaugaggccgcugaagggcacc

SEQ ID NO: 17313 - RNA, 22 nt, Homo sapiens
uuugcacuagggucagagccug

SEQ ID NO: 17314 - RNA, 22 nt, Homo sapiens
cuuggacucugacccuugcagu

SEQ ID NO: 17315 - RNA, 22 nt, Homo sapiens
ccuuucaaacuagcagcaccuc

SEQ ID NO: 17316 - RNA, 22 nt, Homo sapiens
gguguugcuaguuugaaaagac

SEQ ID NO: 17317 - RNA, 22 nt, Homo sapiens
cagugacugagcguggggggug

SEQ ID NO: 17318 - RNA, 22 nt, Homo sapiens
acaguccccuuguuaucacucu

SEQ ID NO: 17319 - RNA, 22 nt, Homo sapiens
aguggguuuuauugggaaagga

SEQ ID NO: 17320 - RNA, 22 nt, Homo sapiens
cuauccaaguauaaggccauug

SEQ ID NO: 17321 - RNA, 22 nt, Homo sapiens
ggagacgggagacaggauauuu

SEQ ID NO: 17322 - RNA, 22 nt, Homo sapiens
uggccuguuuuuauucuguuug

SEQ ID NO: 17323 - RNA, 22 nt, Homo sapiens
gggcagagagcaagaaguauca

SEQ ID NO: 17324 - RNA, 22 nt, Homo sapiens
uacuauucuaugcuuuuuggac

SEQ ID NO: 17325 - RNA, 22 nt, Homo sapiens
cccccaccccuuucuccuccaa

SEQ ID NO: 17326 - RNA, 22 nt, Homo sapiens
gcugggugaggaggguggggau

SEQ ID NO: 17327 - RNA, 22 nt, Homo sapiens
gcccuaccuccggcccuugcga

SEQ ID NO: 17328 - RNA, 20 nt, Homo sapiens
cuggggucggagcgucgggc

SEQ ID NO: 17329 - RNA, 22 nt, Homo sapiens
aucgacaacaaaucacagucug

SEQ ID NO: 17330 - RNA, 22 nt, Homo sapiens
uggaagacuagugauuuuguug

SEQ ID NO: 17331 - RNA, 22 nt, Homo sapiens
gcugggcugacgggggagcagc

SEQ ID NO: 17332 - RNA, 22 nt, Homo sapiens
ugcucuccuugccagcaccugc

SEQ ID NO: 17333 - RNA, 22 nt, Homo sapiens
gguggccaggugcauaucuugg

SEQ ID NO: 17334 - RNA, 22 nt, Homo sapiens
ugggaaugccuacuggucaccu

SEQ ID NO: 17335 - RNA, 22 nt, Homo sapiens
aaaaaugcuuugaguaaaugcc

SEQ ID NO: 17336 - RNA, 22 nt, Homo sapiens
cauuuacucagaaaauauuuuu

SEQ ID NO: 17337 - RNA, 22 nt, Homo sapiens
agcacauagguuguuuggcaag

SEQ ID NO: 17338 - RNA, 22 nt, Homo sapiens
ugccauuuagcuuugugugggu

SEQ ID NO: 17339 - RNA, 22 nt, Homo sapiens
cacaucaucagcugugucugca

SEQ ID NO: 17340 - RNA, 22 nt, Homo sapiens
gucaggcacaguugauuaugug

SEQ ID NO: 17341 - RNA, 22 nt, Homo sapiens
cacaucaucagcugugucugca

SEQ ID NO: 17342 - RNA, 22 nt, Homo sapiens
gucaggcacaguugauuaugug

SEQ ID NO: 17343 - RNA, 22 nt, Homo sapiens
uugcucccuccccuuuggguuc

SEQ ID NO: 17344 - RNA, 22 nt, Homo sapiens
gacaacaccaaagggggugggu

SEQ ID NO: 17345 - RNA, 22 nt, Homo sapiens
uccaguugggauucuugguucu

SEQ ID NO: 17346 - RNA, 22 nt, Homo sapiens
aaccaaggaugcccagcuggcc

SEQ ID NO: 17347 - RNA, 22 nt, Homo sapiens
uuuguuauuauuuuucuuuuuu

SEQ ID NO: 17348 - RNA, 22 nt, Homo sapiens
ugagagagggaaaagcagaauu

SEQ ID NO: 17349 - RNA, 22 nt, Homo sapiens
ucagugagucugggggcgugug

SEQ ID NO: 17350 - RNA, 22 nt, Homo sapiens
cauauccccggauuuucuagug

SEQ ID NO: 17351 - RNA, 23 nt, Homo sapiens
ugugcaaaucuaugcaaaacuga

SEQ ID NO: 17352 - RNA, 22 nt, Homo sapiens
uuaguuuugcauaguugcacua

SEQ ID NO: 17353 - RNA, 22 nt, Homo sapiens
uacuguaguaugggcacuucca

SEQ ID NO: 17354 - RNA, 23 nt, Homo sapiens
caaagugcucauagugcagguag

SEQ ID NO: 17355 - RNA, 22 nt, Homo sapiens
ugcuugcauauuuaaggugggg

SEQ ID NO: 17356 - RNA, 22 nt, Homo sapiens
ucccaccuggaagcugugaggc

SEQ ID NO: 17357 - RNA, 22 nt, Homo sapiens
uuacuuaggaugaaggauguuc

SEQ ID NO: 17358 - RNA, 22 nt, Homo sapiens
auagguuuuauccuauguauau

SEQ ID NO: 17359 - RNA, 22 nt, Homo sapiens
uuuggugguugguauucuguua

SEQ ID NO: 17360 - RNA, 22 nt, Homo sapiens
uauaagucaugccagccaccag

SEQ ID NO: 17361 - RNA, 22 nt, Homo sapiens
gcauccugccguggcgcucuca

SEQ ID NO: 17362 - RNA, 22 nt, Homo sapiens
ugagagccuauuguaggcacau

SEQ ID NO: 17363 - RNA, 22 nt, Homo sapiens
uccuccacauggcugaggugug

SEQ ID NO: 17364 - RNA, 22 nt, Homo sapiens
cacccuggccuguggagccagg

SEQ ID NO: 17365 - RNA, 22 nt, Homo sapiens
ugaggauaaauagccgaagcac

SEQ ID NO: 17366 - RNA, 22 nt, Homo sapiens
cuuuuaagcuauuugucuccau

SEQ ID NO: 17367 - RNA, 22 nt, Homo sapiens
gacauagaggguggugaggcuc

SEQ ID NO: 17368 - RNA, 22 nt, Homo sapiens
cuucauuucccucuuggcuucu

SEQ ID NO: 17369 - RNA, 22 nt, Homo sapiens
uggggggcugggagaguaaaag

SEQ ID NO: 17370 - RNA, 22 nt, Homo sapiens
uuuugcugcccaggccucuugg

SEQ ID NO: 17371 - RNA, 22 nt, Homo sapiens
uaugcagaugcugccuuguuga

SEQ ID NO: 17372 - RNA, 22 nt, Homo sapiens
aaguagaagcauuugcauucug

SEQ ID NO: 17373 - RNA, 22 nt, Homo sapiens
caguaggagcagggcugggcag

SEQ ID NO: 17374 - RNA, 22 nt, Homo sapiens
uggcugguuuccuguccccugg

SEQ ID NO: 17375 - RNA, 22 nt, Homo sapiens
ucgucaucuaugauuuccaucu

SEQ ID NO: 17376 - RNA, 22 nt, Homo sapiens
ugggguuuucauagaggaugau

SEQ ID NO: 17377 - RNA, 22 nt, Homo sapiens
ucuuuccacuuggcuucucuug

SEQ ID NO: 17378 - RNA, 22 nt, Homo sapiens
accaucagaggagaaaauaaug

SEQ ID NO: 17379 - RNA, 22 nt, Homo sapiens
ucccagcaggggacguucuuca

SEQ ID NO: 17380 - RNA, 22 nt, Homo sapiens
augaauauuuccugccuuuggg

SEQ ID NO: 17381 - RNA, 22 nt, Homo sapiens
uuuuacccaauaggcuuaaaug

SEQ ID NO: 17382 - RNA, 22 nt, Homo sapiens
uugagccucuuugguagauaau

SEQ ID NO: 17383 - RNA, 22 nt, Homo sapiens
cagggcuguuuuuguuucuccu

SEQ ID NO: 17384 - RNA, 22 nt, Homo sapiens
agagcccuaggcaguguugucc

SEQ ID NO: 17385 - RNA, 22 nt, Homo sapiens
uccaaagagagcaacuggcuua

SEQ ID NO: 17386 - RNA, 22 nt, Homo sapiens
gcugguguagcuccuuuagagu

SEQ ID NO: 17387 - RNA, 22 nt, Homo sapiens
cauucucuuccucacacugcag

SEQ ID NO: 17388 - RNA, 22 nt, Homo sapiens
ucugugugugggagaggguggu

SEQ ID NO: 17389 - RNA, 22 nt, Homo sapiens
ugcgcucgcucgcugccugagc

SEQ ID NO: 17390 - RNA, 22 nt, Homo sapiens
aguaggcggagcagggcggugc

SEQ ID NO: 17391 - RNA, 22 nt, Homo sapiens
uuauugccuggcuuuacagaau

SEQ ID NO: 17392 - RNA, 22 nt, Homo sapiens
uauuaaauccagguaauagagg

SEQ ID NO: 17393 - RNA, 22 nt, Homo sapiens
uuuuacugccuuuguuuuacca

SEQ ID NO: 17394 - RNA, 20 nt, Homo sapiens
uaaggggaagguggggaaag

SEQ ID NO: 17395 - RNA, 22 nt, Homo sapiens
uuagguggguggucucugcagu

SEQ ID NO: 17396 - RNA, 22 nt, Homo sapiens
acuaagaaaccagccacuacca

SEQ ID NO: 17397 - RNA, 22 nt, Homo sapiens
uacuauuuggauguuagccuca

SEQ ID NO: 17398 - RNA, 22 nt, Homo sapiens
gcuacacaucaucaaacagcgg

SEQ ID NO: 17399 - RNA, 22 nt, Homo sapiens
ugcucacuuguccuccuccaug

SEQ ID NO: 17400 - RNA, 22 nt, Homo sapiens
ggaggaggccauaguggcaacu

SEQ ID NO: 17401 - RNA, 22 nt, Homo sapiens
ggucaauagaaucauuguaggu

SEQ ID NO: 17402 - RNA, 22 nt, Homo sapiens
cggauuuaaugagaaauauuga

SEQ ID NO: 17403 - RNA, 22 nt, Homo sapiens
ugauugacuuuagugaugugcc

SEQ ID NO: 17404 - RNA, 22 nt, Homo sapiens
ggugugcacuuauuucagucag

SEQ ID NO: 17405 - RNA, 22 nt, Homo sapiens
gagcuaaacuugaacugaacau

SEQ ID NO: 17406 - RNA, 19 nt, Homo sapiens
aauguucaguuaagugcuu

SEQ ID NO: 17407 - RNA, 22 nt, Homo sapiens
uuugaaauuuaaauguauguuu

SEQ ID NO: 17408 - RNA, 22 nt, Homo sapiens
aacauacacaugaagacaacuu

SEQ ID NO: 17409 - RNA, 22 nt, Homo sapiens
uuuuaauuugggagcaugcuga

SEQ ID NO: 17410 - RNA, 22 nt, Homo sapiens
augcaugcauccacaaguuaaa

SEQ ID NO: 17411 - RNA, 22 nt, Homo sapiens
uaauuucuaccagggccauauu

SEQ ID NO: 17412 - RNA, 22 nt, Homo sapiens
ugguuuugguucagaaacaagu

SEQ ID NO: 17413 - RNA, 22 nt, Homo sapiens
cccagcacaucucuccauuuuu

SEQ ID NO: 17414 - RNA, 22 nt, Homo sapiens
uugaaaugggggugccuggggu

SEQ ID NO: 17415 - RNA, 22 nt, Homo sapiens
caugugcagugagaugggugcc

SEQ ID NO: 17416 - RNA, 22 nt, Homo sapiens
uacccugccucacugcauucuc

SEQ ID NO: 17417 - RNA, 22 nt, Homo sapiens
ggguaggugggauacuauaaca

SEQ ID NO: 17418 - RNA, 22 nt, Homo sapiens
uuauacuauuccacccaccuua

SEQ ID NO: 17419 - RNA, 22 nt, Homo sapiens
aagugauuggaggugggugggg

SEQ ID NO: 17420 - RNA, 22 nt, Homo sapiens
ucucuccuuccuccucaguuuu

SEQ ID NO: 17421 - RNA, 22 nt, Homo sapiens
cugggagaaggcuguuuacucu

SEQ ID NO: 17422 - RNA, 23 nt, Homo sapiens
uguaaacauccuacacucucagc

SEQ ID NO: 17423 - RNA, 22 nt, Homo sapiens
uuuauuuucagcugggaaaucu

SEQ ID NO: 17424 - RNA, 22 nt, Homo sapiens
ugacuuucccagcugaaauaau

SEQ ID NO: 17425 - RNA, 22 nt, Homo sapiens
ggaugaaaagacaauugaaaaa

SEQ ID NO: 17426 - RNA, 22 nt, Homo sapiens
uuccaaaugauuuuucaucccc

SEQ ID NO: 17427 - RNA, 22 nt, Homo sapiens
uuuguucagugacuucuaucuu

SEQ ID NO: 17428 - RNA, 22 nt, Homo sapiens
aaagcauaaguggaugaacaaa

SEQ ID NO: 17429 - RNA, 22 nt, Homo sapiens
uuuuccucuccacuuccuguuc

SEQ ID NO: 17430 - RNA, 20 nt, Homo sapiens
cgggaaguggagggaggaag

SEQ ID NO: 17431 - RNA, 22 nt, Homo sapiens
uuaaugaacucuucuagggcac

SEQ ID NO: 17432 - RNA, 22 nt, Homo sapiens
ugccuuuaaaggacucauugac

SEQ ID NO: 17433 - RNA, 22 nt, Homo sapiens
ucucucaggcuuggaggggcca

SEQ ID NO: 17434 - RNA, 20 nt, Homo sapiens
caccugccaggccucuggga

SEQ ID NO: 17435 - RNA, 22 nt, Homo sapiens
uuugugccauuuaucccucuag

SEQ ID NO: 17436 - RNA, 22 nt, Homo sapiens
gauggaugcaucacacaaaaca

SEQ ID NO: 17437 - RNA, 22 nt, Homo sapiens
ugguucuugugaaacuggaagu

SEQ ID NO: 17438 - RNA, 20 nt, Homo sapiens
ucccagguucauagcugcua

SEQ ID NO: 17439 - RNA, 22 nt, Homo sapiens
uuuggcuggcccuagcaugugu

SEQ ID NO: 17440 - RNA, 22 nt, Homo sapiens
uauguuggagugaguuggagcc

SEQ ID NO: 17441 - RNA, 22 nt, Homo sapiens
uccaagugugguguuuggcaca

SEQ ID NO: 17442 - RNA, 22 nt, Homo sapiens
ccauccaucaguauuugugguu

SEQ ID NO: 17443 - RNA, 22 nt, Homo sapiens
ucucaucuaagugcuggcauau

SEQ ID NO: 17444 - RNA, 22 nt, Homo sapiens
uagcuggccaccagaugaagug

SEQ ID NO: 17445 - RNA, 22 nt, Homo sapiens
ucucuuaggacuguucaagggc

SEQ ID NO: 17446 - RNA, 22 nt, Homo sapiens
cuuugaacagucaguccuaaga

SEQ ID NO: 17447 - RNA, 22 nt, Homo sapiens
ugaggccauuugaagugugaga

SEQ ID NO: 17448 - RNA, 22 nt, Homo sapiens
ucaacacuuuaaaaaucuuucu

SEQ ID NO: 17449 - RNA, 22 nt, Homo sapiens
uccugagcuaauuaagggucac

SEQ ID NO: 17450 - RNA, 22 nt, Homo sapiens
uuuucuuugguggcuucagagg

SEQ ID NO: 17451 - RNA, 22 nt, Homo sapiens
uauuaauauaugccucgagugg

SEQ ID NO: 17452 - RNA, 22 nt, Homo sapiens
acuugaggcaaauaguaauggc

SEQ ID NO: 17453 - RNA, 22 nt, Homo sapiens
ucgagucuucucagagguugga

SEQ ID NO: 17454 - RNA, 22 nt, Homo sapiens
caaccucugccaagucuucaga

SEQ ID NO: 17455 - RNA, 22 nt, Homo sapiens
ugaaugcuggggcaauaggaug

SEQ ID NO: 17456 - RNA, 22 nt, Homo sapiens
uccuguuucucugccauuuaca

SEQ ID NO: 17457 - RNA, 22 nt, Homo sapiens
gggacauggccccauggccaag

SEQ ID NO: 17458 - RNA, 22 nt, Homo sapiens
ccugagcuuggggcuauuucug

SEQ ID NO: 17459 - RNA, 22 nt, Homo sapiens
acaagucaggcucuugggaccu

SEQ ID NO: 17460 - RNA, 22 nt, Homo sapiens
ucccugagacccuaacuuguga

SEQ ID NO: 17461 - RNA, 22 nt, Homo sapiens
ugggagggggcugcgcugcagc

SEQ ID NO: 17462 - RNA, 22 nt, Homo sapiens
cugugcucaggcuccacccacu

SEQ ID NO: 17463 - RNA, 22 nt, Homo sapiens
aaucuauagugcccggaaugug

SEQ ID NO: 17464 - RNA, 22 nt, Homo sapiens
auuguuccaggugcuguggauu

SEQ ID NO: 17465 - RNA, 22 nt, Homo sapiens
ucaauuugucuuucccaaggug

SEQ ID NO: 17466 - RNA, 22 nt, Homo sapiens
uaucuugaaggaggaggaauaa

SEQ ID NO: 17467 - RNA, 22 nt, Homo sapiens
ccucauggagucucaggagaug

SEQ ID NO: 17468 - RNA, 22 nt, Homo sapiens
uuucuccugggguaccgguggg

SEQ ID NO: 17469 - RNA, 22 nt, Homo sapiens
accuucaaauugccaguguuuu

SEQ ID NO: 17470 - RNA, 15 nt, Homo sapiens
cauuggcaauggggu

SEQ ID NO: 17471 - RNA, 22 nt, Homo sapiens
uuuaugagugagaagagaccua

SEQ ID NO: 17472 - RNA, 22 nt, Homo sapiens
aaaucucuucucacaagugaag

SEQ ID NO: 17473 - RNA, 22 nt, Homo sapiens
ucaucucccuucuuggagucuc

SEQ ID NO: 17474 - RNA, 22 nt, Homo sapiens
gagguuccuuaggagggaguuc

SEQ ID NO: 17475 - RNA, 22 nt, Homo sapiens
gcucuccccacguuggcuccca

SEQ ID NO: 17476 - RNA, 22 nt, Homo sapiens
ggagagagagugaggagagcug

SEQ ID NO: 17477 - RNA, 22 nt, Homo sapiens
agccuccucuccugauaaccua

SEQ ID NO: 17478 - RNA, 18 nt, Homo sapiens
gguaucaggagaauggcu

SEQ ID NO: 17479 - RNA, 22 nt, Homo sapiens
cuggcuccacaggccagggugu

SEQ ID NO: 17480 - RNA, 22 nt, Homo sapiens
ccucagccauguggaggcugca

SEQ ID NO: 17481 - RNA, 22 nt, Homo sapiens
uggcuccacaggccagggugug

SEQ ID NO: 17482 - RNA, 22 nt, Homo sapiens
caccucagccauguggaggcgg

SEQ ID NO: 17483 - RNA, 22 nt, Homo sapiens
augagggguagggaaaaggcac

SEQ ID NO: 17484 - RNA, 22 nt, Homo sapiens
ccuuuucccuuucuccucacua

SEQ ID NO: 17485 - RNA, 22 nt, Homo sapiens
cccagggaggcccaggguugga

SEQ ID NO: 17486 - RNA, 22 nt, Homo sapiens
auccucccugggccucucuggc

SEQ ID NO: 17487 - RNA, 23 nt, Homo sapiens
cagugcaauaguauugucaaagc

SEQ ID NO: 17488 - RNA, 22 nt, Homo sapiens
ugcucugacuuuauugcacuac

SEQ ID NO: 17489 - RNA, 22 nt, Homo sapiens
ucuuagcucccccuggcaggac

SEQ ID NO: 17490 - RNA, 22 nt, Homo sapiens
guccugucuggguggggcugcc

SEQ ID NO: 17491 - RNA, 22 nt, Homo sapiens
uggggaagucugagcggcaguu

SEQ ID NO: 17492 - RNA, 22 nt, Homo sapiens
ucugccagccauucucccugcc

SEQ ID NO: 17493 - RNA, 22 nt, Homo sapiens
caauuuagugugugugauauuu

SEQ ID NO: 17494 - RNA, 22 nt, Homo sapiens
uauugcacauuacuaaguugca

SEQ ID NO: 17495 - RNA, 22 nt, Homo sapiens
aaaugaauguuuuagaggccag

SEQ ID NO: 17496 - RNA, 22 nt, Homo sapiens
uggcucugggaccuucaguucu

SEQ ID NO: 17497 - RNA, 22 nt, Homo sapiens
uuccaauauuucucacauaugg

SEQ ID NO: 17498 - RNA, 22 nt, Homo sapiens
ucccugggaauuaauauuugga

SEQ ID NO: 17499 - RNA, 22 nt, Homo sapiens
uccaccgggcugaccggccugg

SEQ ID NO: 17500 - RNA, 22 nt, Homo sapiens
uaggccuaggcccggugagaga

SEQ ID NO: 17501 - RNA, 22 nt, Homo sapiens
uccaccgggcugaccggccugg

SEQ ID NO: 17502 - RNA, 22 nt, Homo sapiens
uaggccuaggcccggugagaga

SEQ ID NO: 17503 - RNA, 22 nt, Homo sapiens
ugggugagcagcugcagcugag

SEQ ID NO: 17504 - RNA, 21 nt, Homo sapiens
uuggcucaggcuguuuccuca

SEQ ID NO: 17505 - RNA, 22 nt, Homo sapiens
ugccucuguggucacagcuuca

SEQ ID NO: 17506 - RNA, 22 nt, Homo sapiens
ggugggugugcagccagaggca

SEQ ID NO: 17507 - RNA, 22 nt, Homo sapiens
caguuggaugguuccugcccuc

SEQ ID NO: 17508 - RNA, 17 nt, Homo sapiens
ggcagucacugucacug

SEQ ID NO: 17509 - RNA, 22 nt, Homo sapiens
cagauggaggagcauccagguu

SEQ ID NO: 17510 - RNA, 22 nt, Homo sapiens
ccucugaagcucuuccauuuug

SEQ ID NO: 17511 - RNA, 22 nt, Homo sapiens
uguccgauacaggcaguggucu

SEQ ID NO: 17512 - RNA, 22 nt, Homo sapiens
accacuggcuuaugggacauuc

SEQ ID NO: 17513 - RNA, 22 nt, Homo sapiens
ugauugguuggauuucccagug

SEQ ID NO: 17514 - RNA, 22 nt, Homo sapiens
ucaggaagucuuaacaauuggc

SEQ ID NO: 17515 - RNA, 22 nt, Homo sapiens
ugcaugugugccauggaagcac

SEQ ID NO: 17516 - RNA, 22 nt, Homo sapiens
uguguucguggccauguguuua

SEQ ID NO: 17517 - RNA, 22 nt, Homo sapiens
ucauugauaauguuguggggau

SEQ ID NO: 17518 - RNA, 22 nt, Homo sapiens
uccgucccuggcauuacaauuu

SEQ ID NO: 17519 - RNA, 22 nt, Homo sapiens
ugggaacugaugcuccccagca

SEQ ID NO: 17520 - RNA, 22 nt, Homo sapiens
gcccuagcugcuggugggcaca

SEQ ID NO: 17521 - RNA, 22 nt, Homo sapiens
ucucccuucuuccaagagucug

SEQ ID NO: 17522 - RNA, 22 nt, Homo sapiens
cagaucuggaagcugggagguu

SEQ ID NO: 17523 - RNA, 22 nt, Homo sapiens
cagcugggaaggcugggucagg

SEQ ID NO: 17524 - RNA, 16 nt, Homo sapiens
cccagcagccuggcug

SEQ ID NO: 17525 - RNA, 22 nt, Homo sapiens
ugcacuggauugucaguauuua

SEQ ID NO: 17526 - RNA, 22 nt, Homo sapiens
guauuugauaguccugccugug

SEQ ID NO: 17527 - RNA, 22 nt, Homo sapiens
ugagaagauuuuaaucugaggu

SEQ ID NO: 17528 - RNA, 22 nt, Homo sapiens
gacaauuugggguaaauuuuca

SEQ ID NO: 17529 - RNA, 22 nt, Homo sapiens
ugggucugugcucuuggccugc

SEQ ID NO: 17530 - RNA, 22 nt, Homo sapiens
auuuggcuggagccuuagccug

SEQ ID NO: 17531 - RNA, 22 nt, Homo sapiens
uggagggggaggggaaagauga

SEQ ID NO: 17532 - RNA, 22 nt, Homo sapiens
ucuuuccccuccuccauuuccu

SEQ ID NO: 17533 - RNA, 22 nt, Homo sapiens
cugauccaagcacagagucuac

SEQ ID NO: 17534 - RNA, 22 nt, Homo sapiens
gccucugcacuuggaucuucuc

SEQ ID NO: 17535 - RNA, 22 nt, Homo sapiens
gguuuggggagcacucauagaa

SEQ ID NO: 17536 - RNA, 19 nt, Homo sapiens
ugaagugcuuccgacagcc

SEQ ID NO: 17537 - RNA, 22 nt, Homo sapiens
uguugagcgagaaucuugccug

SEQ ID NO: 17538 - RNA, 22 nt, Homo sapiens
uuugaauucuuguucugcaucc

SEQ ID NO: 17539 - RNA, 22 nt, Homo sapiens
agcauccucaggagccagugcc

SEQ ID NO: 17540 - RNA, 22 nt, Homo sapiens
cagcagugcucuagagcgugcc

SEQ ID NO: 17541 - RNA, 22 nt, Homo sapiens
uucccugucaguuuccccucug

SEQ ID NO: 17542 - RNA, 22 nt, Homo sapiens
ugagggcugaggccaggggaga

SEQ ID NO: 17543 - RNA, 22 nt, Homo sapiens
ugcugcagcauauuguacuggc

SEQ ID NO: 17544 - RNA, 22 nt, Homo sapiens
gcuuuucaauauguuuggcaug

SEQ ID NO: 17545 - RNA, 22 nt, Homo sapiens
ggagagugggauuagggaacag

SEQ ID NO: 17546 - RNA, 22 nt, Homo sapiens
uguuucaagucccccuuucucc

SEQ ID NO: 17547 - RNA, 22 nt, Homo sapiens
cauaggcuugcucuaacaaugc

SEQ ID NO: 17548 - RNA, 22 nt, Homo sapiens
gucuuugggaugugccuauggu

SEQ ID NO: 17549 - RNA, 22 nt, Homo sapiens
gacauuauuauuuuuccuacuu

SEQ ID NO: 17550 - RNA, 19 nt, Homo sapiens
agaggaagaauaguuuguc

SEQ ID NO: 17551 - RNA, 22 nt, Homo sapiens
gccugggaagaguugaggggag

SEQ ID NO: 17552 - RNA, 22 nt, Homo sapiens
ccuuucuucuucagcccugggg

SEQ ID NO: 17553 - RNA, 22 nt, Homo sapiens
uugaccuuaauaaucugcucca

SEQ ID NO: 17554 - RNA, 22 nt, Homo sapiens
gcagauggacuguugagaguca

SEQ ID NO: 17555 - RNA, 22 nt, Homo sapiens
acuguagaggccuggauugagg

SEQ ID NO: 17556 - RNA, 22 nt, Homo sapiens
ccuggcuaggcuuccacaguug

SEQ ID NO: 17557 - RNA, 22 nt, Homo sapiens
uuuuuugccagguugugcuuuc

SEQ ID NO: 17558 - RNA, 22 nt, Homo sapiens
uggagcacaccaguaaaauuga

SEQ ID NO: 17559 - RNA, 22 nt, Homo sapiens
ugucgguguggcuuuuuauuug

SEQ ID NO: 17560 - RNA, 22 nt, Homo sapiens
acaaauuagagccuaucuuauc

SEQ ID NO: 17561 - RNA, 22 nt, Homo sapiens
ccagcugguggaggcucagcca

SEQ ID NO: 17562 - RNA, 22 nt, Homo sapiens
ucugggcccccagccaccuggg

SEQ ID NO: 17563 - RNA, 24 nt, Homo sapiens
uacugcaucaggaacugauuggau

SEQ ID NO: 17564 - RNA, 22 nt, Homo sapiens
ucaguuccuaaugcauugccuu

SEQ ID NO: 17565 - RNA, 22 nt, Homo sapiens
uccuguguuuaccaucuucugc

SEQ ID NO: 17566 - RNA, 22 nt, Homo sapiens
agaaguaggugagcucgggccu

SEQ ID NO: 17567 - RNA, 22 nt, Homo sapiens
ugguuuuccuuucugacccuuc

SEQ ID NO: 17568 - RNA, 22 nt, Homo sapiens
agaaaaggggaagaaagccagg

SEQ ID NO: 17569 - RNA, 22 nt, Homo sapiens
uuguugaucagacagcacuucu

SEQ ID NO: 17570 - RNA, 22 nt, Homo sapiens
gugcuguuucugaugaaugcca

SEQ ID NO: 17571 - RNA, 22 nt, Homo sapiens
uuaacgcucaaggaugccucug

SEQ ID NO: 17572 - RNA, 22 nt, Homo sapiens
ccugaagcauccuagguuuugg

SEQ ID NO: 17573 - RNA, 22 nt, Homo sapiens
uuagaagaagcaaguuuccuuu

SEQ ID NO: 17574 - RNA, 22 nt, Homo sapiens
aggaaauuuaccucuucuaaac

SEQ ID NO: 17575 - RNA, 22 nt, Homo sapiens
ucuuucccaacuuacuuuacuc

SEQ ID NO: 17576 - RNA, 22 nt, Homo sapiens
aggagggaaguuggguagggug

SEQ ID NO: 17577 - RNA, 22 nt, Homo sapiens
uuaguggucauuguuaagguca

SEQ ID NO: 17578 - RNA, 22 nt, Homo sapiens
ugaccugacaguggccucuggu

SEQ ID NO: 17579 - RNA, 22 nt, Homo sapiens
uuggugaugguguuguauaggg

SEQ ID NO: 17580 - RNA, 22 nt, Homo sapiens
ucuaugccaacuauuguccccu

SEQ ID NO: 17581 - RNA, 22 nt, Homo sapiens
uauuaaugcagggaucauggua

SEQ ID NO: 17582 - RNA, 22 nt, Homo sapiens
uacauguuccuugcuauuauuc

SEQ ID NO: 17583 - RNA, 22 nt, Homo sapiens
uggccaagggucaggccccuag

SEQ ID NO: 17584 - RNA, 22 nt, Homo sapiens
guggccaauugacuuguggcca

SEQ ID NO: 17585 - RNA, 22 nt, Homo sapiens
gguuuucccugagggaagguag

SEQ ID NO: 17586 - RNA, 22 nt, Homo sapiens
uuugccuucccagggauccacc

SEQ ID NO: 17587 - RNA, 22 nt, Homo sapiens
gguuuucccugagggaagguag

SEQ ID NO: 17588 - RNA, 22 nt, Homo sapiens
uuugccuucccagggauccacc

SEQ ID NO: 17589 - RNA, 22 nt, Homo sapiens
uucugcccccuccccaccucag

SEQ ID NO: 17590 - RNA, 22 nt, Homo sapiens
guggugggagagcggugggggu

SEQ ID NO: 17591 - RNA, 22 nt, Homo sapiens
cauuuuuccugucuugcugacu

SEQ ID NO: 17592 - RNA, 22 nt, Homo sapiens
uacagcauuugcaggaauugua

SEQ ID NO: 17593 - RNA, 22 nt, Homo sapiens
ccuuacuguggucccacguccc

SEQ ID NO: 17594 - RNA, 21 nt, Homo sapiens
ggaugggggcuauagaugggg

SEQ ID NO: 17595 - RNA, 22 nt, Homo sapiens
uuaauauguauugaguacuuua

SEQ ID NO: 17596 - RNA, 22 nt, Homo sapiens
cuaaaguacuuuacauauauua

SEQ ID NO: 17597 - RNA, 22 nt, Homo sapiens
uguucuccuuguuuuuccauuc

SEQ ID NO: 17598 - RNA, 22 nt, Homo sapiens
aaggaaaacauggggaacagag

SEQ ID NO: 17599 - RNA, 22 nt, Homo sapiens
uaugaugucauuuaucucagaa

SEQ ID NO: 17600 - RNA, 22 nt, Homo sapiens
ucugagauggaugacauguauc

SEQ ID NO: 17601 - RNA, 22 nt, Homo sapiens
ccaacugcugucacugcaugcu

SEQ ID NO: 17602 - RNA, 22 nt, Homo sapiens
gaacugcagugacagcaggagu

SEQ ID NO: 17603 - RNA, 22 nt, Homo sapiens
aaaauccacaaugucuuugagc

SEQ ID NO: 17604 - RNA, 22 nt, Homo sapiens
uuaaagucaccauuuguggguu

SEQ ID NO: 17605 - RNA, 22 nt, Homo sapiens
ucuacuccacauccucccuaaa

SEQ ID NO: 17606 - RNA, 22 nt, Homo sapiens
uggggcaggauggugagaggag

SEQ ID NO: 17607 - RNA, 22 nt, Homo sapiens
ucccucucuccacugaacacuc

SEQ ID NO: 17608 - RNA, 22 nt, Homo sapiens
gcuuuuuguggcaggaaggucu

SEQ ID NO: 17609 - RNA, 22 nt, Homo sapiens
ugaggucuuccgauuugcagcu

SEQ ID NO: 17610 - RNA, 22 nt, Homo sapiens
ugagaucugggcugccuucccc

SEQ ID NO: 17611 - RNA, 22 nt, Homo sapiens
uuaggaggugaaggucaguguu

SEQ ID NO: 17612 - RNA, 22 nt, Homo sapiens
cuggcuuugcagcuugucuagu

SEQ ID NO: 17613 - RNA, 22 nt, Homo sapiens
accauuuuagaccucucuugac

SEQ ID NO: 17614 - RNA, 22 nt, Homo sapiens
uuagaugagucuagaauggaug

SEQ ID NO: 17615 - RNA, 22 nt, Homo sapiens
ucagcugcaaauaacacuaccu

SEQ ID NO: 17616 - RNA, 22 nt, Homo sapiens
gcaguguuauuuguagcccaaa

SEQ ID NO: 17617 - RNA, 22 nt, Homo sapiens
aggcaugaagacuuuuggugac

SEQ ID NO: 17618 - RNA, 22 nt, Homo sapiens
ucaccaagggcuuugagugccu

SEQ ID NO: 17619 - RNA, 22 nt, Homo sapiens
ucacaaccuugcuguuccuguc

SEQ ID NO: 17620 - RNA, 22 nt, Homo sapiens
caggaacagcaggguugugagg

SEQ ID NO: 17621 - RNA, 22 nt, Homo sapiens
uggcucugugaguugaugacau

SEQ ID NO: 17622 - RNA, 22 nt, Homo sapiens
ugucaacagcucacagaccaau

SEQ ID NO: 17623 - RNA, 22 nt, Homo sapiens
uguacugcagggagagcaaagg

SEQ ID NO: 17624 - RNA, 22 nt, Homo sapiens
uuuauugcucuuauauugcauc

SEQ ID NO: 17625 - RNA, 22 nt, Homo sapiens
uacaggugacgcagguauccag

SEQ ID NO: 17626 - RNA, 22 nt, Homo sapiens
uggaugccugugacaucugagu

SEQ ID NO: 17627 - RNA, 22 nt, Homo sapiens
ucccccaggugugauucugauu

SEQ ID NO: 17628 - RNA, 22 nt, Homo sapiens
uuaucagaaucuccagggguac

SEQ ID NO: 17629 - RNA, 23 nt, Homo sapiens
ucccccaggugugauucugauuu

SEQ ID NO: 17630 - RNA, 22 nt, Homo sapiens
cacuggaccaagagucagaaga

SEQ ID NO: 17631 - RNA, 22 nt, Homo sapiens
ucuucugugaccuugggccagu

SEQ ID NO: 17632 - RNA, 22 nt, Homo sapiens
cugggccacuagcuuuaaacuu

SEQ ID NO: 17633 - RNA, 22 nt, Homo sapiens
uuuugaguuacuguguccaacc

SEQ ID NO: 17634 - RNA, 22 nt, Homo sapiens
uuauguguggcauauuagguug

SEQ ID NO: 17635 - RNA, 22 nt, Homo sapiens
accuaggguaccaaaguagugu

SEQ ID NO: 17636 - RNA, 22 nt, Homo sapiens
cccccagaacagcuuuaagaca

SEQ ID NO: 17637 - RNA, 22 nt, Homo sapiens
uccagaacuguucugggggugg

SEQ ID NO: 17638 - RNA, 22 nt, Homo sapiens
ugagcgaagcccaggcauucag

SEQ ID NO: 17639 - RNA, 22 nt, Homo sapiens
ccgagccugggcugucucagac

SEQ ID NO: 17640 - RNA, 22 nt, Homo sapiens
ugggaggcagauuguugaguca

SEQ ID NO: 17641 - RNA, 22 nt, Homo sapiens
ugaaauucacgcugucuucccc

SEQ ID NO: 17642 - RNA, 22 nt, Homo sapiens
aggcggcagcagcaguggggac

SEQ ID NO: 17643 - RNA, 22 nt, Homo sapiens
ccugcagcugcugccgccuccu

SEQ ID NO: 17644 - RNA, 22 nt, Homo sapiens
gacgugcgcggacgcgggcaag

SEQ ID NO: 17645 - RNA, 22 nt, Homo sapiens
uucguccgugugaguguguccg

SEQ ID NO: 17646 - RNA, 22 nt, Homo sapiens
ugcagagaguaguaagugaaag

SEQ ID NO: 17647 - RNA, 22 nt, Homo sapiens
uuuuaccuacuagucucuugua

SEQ ID NO: 17648 - RNA, 22 nt, Homo sapiens
uagucuaacaccauaaccucag

SEQ ID NO: 17649 - RNA, 22 nt, Homo sapiens
ugagguuaugauguuggacuag

SEQ ID NO: 17650 - RNA, 22 nt, Homo sapiens
ucugugauaccaucaauaccaa

SEQ ID NO: 17651 - RNA, 22 nt, Homo sapiens
gauugaugcuuucacagaucca

SEQ ID NO: 17652 - RNA, 22 nt, Homo sapiens
uuuguccaucagaauguggggg

SEQ ID NO: 17653 - RNA, 22 nt, Homo sapiens
ccaaacuauggauggacgaaga

SEQ ID NO: 17654 - RNA, 22 nt, Homo sapiens
uugcauggcguccggagcuguc

SEQ ID NO: 17655 - RNA, 22 nt, Homo sapiens
gcuccagagaugcugugcagag

SEQ ID NO: 17656 - RNA, 22 nt, Homo sapiens
uggucagggccccugaguucca

SEQ ID NO: 17657 - RNA, 22 nt, Homo sapiens
gggaaguaguccuugaccaggc

SEQ ID NO: 17658 - RNA, 22 nt, Homo sapiens
ucccccucccccaggugccacu

SEQ ID NO: 17659 - RNA, 21 nt, Homo sapiens
caggagugggggaggggagag

SEQ ID NO: 17660 - RNA, 22 nt, Homo sapiens
uuugugguccuaucuucuagcc

SEQ ID NO: 17661 - RNA, 22 nt, Homo sapiens
uggacaggcagauuaggauuag

SEQ ID NO: 17662 - RNA, 22 nt, Homo sapiens
ugaggcuuucagccaaguagua

SEQ ID NO: 17663 - RNA, 22 nt, Homo sapiens
caaacauuugguuuugaguuca

SEQ ID NO: 17664 - RNA, 23 nt, Homo sapiens
uagcaccauuugaaaucaguguu

SEQ ID NO: 17665 - RNA, 22 nt, Homo sapiens
ugguuucacaugguggcuuaga

SEQ ID NO: 17666 - RNA, 22 nt, Homo sapiens
ccggagcagggaacgcggccag

SEQ ID NO: 17667 - RNA, 22 nt, Homo sapiens
ugcgcccgcuccugugcuccgg

SEQ ID NO: 17668 - RNA, 22 nt, Homo sapiens
ggcgucgcuuggcuccucacuc

SEQ ID NO: 17669 - RNA, 22 nt, Homo sapiens
gcuccgagacugagcggcggcu

SEQ ID NO: 17670 - RNA, 22 nt, Homo sapiens
agacguggauuguuuccuuuag

SEQ ID NO: 17671 - RNA, 22 nt, Homo sapiens
aggagacaauccacgucccuaa

SEQ ID NO: 17672 - RNA, 22 nt, Homo sapiens
ggcugguuagauuuguggucuu

SEQ ID NO: 17673 - RNA, 22 nt, Homo sapiens
gacccuagagagagccagccug

SEQ ID NO: 17674 - RNA, 22 nt, Homo sapiens
ugcauacagugggucuuugugu

SEQ ID NO: 17675 - RNA, 22 nt, Homo sapiens
auaagggcaaacucgauaugca

SEQ ID NO: 17676 - RNA, 22 nt, Homo sapiens
ugugguuuggaguuugaagaca

SEQ ID NO: 17677 - RNA, 22 nt, Homo sapiens
ucuguaagcacucaaaaccaca

SEQ ID NO: 17678 - RNA, 22 nt, Homo sapiens
ucauguguucuacaaaccugua

SEQ ID NO: 17679 - RNA, 22 nt, Homo sapiens
cagguuuuauugaacacaugua

SEQ ID NO: 17680 - RNA, 22 nt, Homo sapiens
gcugcaacuagagcuuaaacuu

SEQ ID NO: 17681 - RNA, 22 nt, Homo sapiens
guuucagucccuuaguuugcag

SEQ ID NO: 17682 - RNA, 22 nt, Homo sapiens
agagcuaccuucacacagggcc

SEQ ID NO: 17683 - RNA, 22 nt, Homo sapiens
ggucuagugugagcguagucua

SEQ ID NO: 17684 - RNA, 23 nt, Homo sapiens
aaagugcugcgacauuugagcgu

SEQ ID NO: 17685 - RNA, 22 nt, Homo sapiens
ccucaaauguggagcacuauuc

SEQ ID NO: 17686 - RNA, 22 nt, Homo sapiens
aguccccagaaaugaaaauggg

SEQ ID NO: 17687 - RNA, 22 nt, Homo sapiens
ucccagucuuccuggggauguu

SEQ ID NO: 17688 - RNA, 22 nt, Homo sapiens
ggaggggcagccucagggaucu

SEQ ID NO: 17689 - RNA, 22 nt, Homo sapiens
ggaugccugggucuccucccuc

SEQ ID NO: 17690 - RNA, 22 nt, Homo sapiens
uacauaaaggaggcucuuugcc

SEQ ID NO: 17691 - RNA, 22 nt, Homo sapiens
aaagagaauccuguguguccug

SEQ ID NO: 17692 - RNA, 22 nt, Homo sapiens
aggguauagaauuaacuugcac

SEQ ID NO: 17693 - RNA, 22 nt, Homo sapiens
cgaguuuuauuuuuauacaccu

SEQ ID NO: 17694 - RNA, 22 nt, Homo sapiens
ugaguguccucgcccuuccuuu

SEQ ID NO: 17695 - RNA, 22 nt, Homo sapiens
gacagggcuggcgacaauucau

SEQ ID NO: 17696 - RNA, 22 nt, Homo sapiens
uucuuuaaugucuacaucagca

SEQ ID NO: 17697 - RNA, 22 nt, Homo sapiens
cuguguggaugugaagaaucug

SEQ ID NO: 17698 - RNA, 22 nt, Homo sapiens
uuguuugccucaacuucuuuug

SEQ ID NO: 17699 - RNA, 22 nt, Homo sapiens
acagaaguuguggcaaacuucu

SEQ ID NO: 17700 - RNA, 22 nt, Homo sapiens
aaucagccuccuguaccacucc

SEQ ID NO: 17701 - RNA, 22 nt, Homo sapiens
agcagugcagugagcugauuca

SEQ ID NO: 17702 - RNA, 22 nt, Homo sapiens
caugauccagugggcucuccug

SEQ ID NO: 17703 - RNA, 22 nt, Homo sapiens
gaggggccacuggaugguguua

SEQ ID NO: 17704 - RNA, 22 nt, Homo sapiens
aaaguuggugaaugcaccugcu

SEQ ID NO: 17705 - RNA, 21 nt, Homo sapiens
acggugugcaaucagcuguug

SEQ ID NO: 17706 - RNA, 22 nt, Homo sapiens
gggguuaugggacaaggagagc

SEQ ID NO: 17707 - RNA, 22 nt, Homo sapiens
uuaguuuuuuuccauaccccug

SEQ ID NO: 17708 - RNA, 22 nt, Homo sapiens
cagguguugggaagugccagga

SEQ ID NO: 17709 - RNA, 22 nt, Homo sapiens
uggccauuuccugauaccugug

SEQ ID NO: 17710 - RNA, 22 nt, Homo sapiens
uuccagggaacuccuggagagu

SEQ ID NO: 17711 - RNA, 22 nt, Homo sapiens
uuuccagagucaucugugaggg

SEQ ID NO: 17712 - RNA, 22 nt, Homo sapiens
ugcuggacgcggacgcucgcca

SEQ ID NO: 17713 - RNA, 22 nt, Homo sapiens
uggccgcucugccuccacaucc

SEQ ID NO: 17714 - RNA, 22 nt, Homo sapiens
ucaguguuuuuuauucuuaugu

SEQ ID NO: 17715 - RNA, 22 nt, Homo sapiens
agugaauugggagccaggcuga

SEQ ID NO: 17716 - RNA, 22 nt, Homo sapiens
ucaguguuuuuuauucuuaugu

SEQ ID NO: 17717 - RNA, 22 nt, Homo sapiens
agugaauugggagccaggcuga

SEQ ID NO: 17718 - RNA, 22 nt, Homo sapiens
uccuggugggaaauuaucuccu

SEQ ID NO: 17719 - RNA, 22 nt, Homo sapiens
guggugguguccugucagaaug

SEQ ID NO: 17720 - RNA, 22 nt, Homo sapiens
agcuguaaacggcuucuuccuc

SEQ ID NO: 17721 - RNA, 22 nt, Homo sapiens
ggaugggaacugccuuuuacau

SEQ ID NO: 17722 - RNA, 22 nt, Homo sapiens
ggcucacagcagugcccaaccu

SEQ ID NO: 17723 - RNA, 21 nt, Homo sapiens
guguuggcauccugugaugcc

SEQ ID NO: 17724 - RNA, 22 nt, Homo sapiens
ugacagggcaggccugugcuug

SEQ ID NO: 17725 - RNA, 22 nt, Homo sapiens
agcacagcugagguucugggac

SEQ ID NO: 17726 - RNA, 22 nt, Homo sapiens
uccccuccccugcccgugagcu

SEQ ID NO: 17727 - RNA, 22 nt, Homo sapiens
uuaaugauggcucgggaggagg

SEQ ID NO: 17728 - RNA, 22 nt, Homo sapiens
ugcccugccgugcucacgcugc

SEQ ID NO: 17729 - RNA, 22 nt, Homo sapiens
agcgggaguguguguuuguccu

SEQ ID NO: 17730 - RNA, 22 nt, Homo sapiens
caacauugccuaucuguuggaa

SEQ ID NO: 17731 - RNA, 22 nt, Homo sapiens
cacacagauagaugauguuagc

SEQ ID NO: 17732 - RNA, 22 nt, Homo sapiens
agccaggcugggguggcacagu

SEQ ID NO: 17733 - RNA, 20 nt, Homo sapiens
uguccaccaaagccugugcu

SEQ ID NO: 17734 - RNA, 22 nt, Homo sapiens
uggggauuugucuaccucuuug

SEQ ID NO: 17735 - RNA, 22 nt, Homo sapiens
agggagggagagaaagacugca

SEQ ID NO: 17736 - RNA, 22 nt, Homo sapiens
aggaucucguuucaaaaggguu

SEQ ID NO: 17737 - RNA, 22 nt, Homo sapiens
agccugggggagcggauccugc

SEQ ID NO: 17738 - RNA, 22 nt, Homo sapiens
uuugugccaggauuuaauaaga

SEQ ID NO: 17739 - RNA, 22 nt, Homo sapiens
cuuguucagaucuuacacacug

SEQ ID NO: 17740 - RNA, 22 nt, Homo sapiens
ucgggugcgggacagagguugg

SEQ ID NO: 17741 - RNA, 22 nt, Homo sapiens
uugacuuugagugugugugccu

SEQ ID NO: 17742 - RNA, 22 nt, Homo sapiens
agcaaagcagagccaaggcuuc

SEQ ID NO: 17743 - RNA, 22 nt, Homo sapiens
augcccugguucugccuuuugu

SEQ ID NO: 17744 - RNA, 22 nt, Homo sapiens
gcacccucauuucucuauggag

SEQ ID NO: 17745 - RNA, 19 nt, Homo sapiens
ccuagagucugggggcugc

SEQ ID NO: 17746 - RNA, 22 nt, Homo sapiens
uuuaauucuacaagcauuuauu

SEQ ID NO: 17747 - RNA, 22 nt, Homo sapiens
agguacagugcuuagauuuugg

SEQ ID NO: 17748 - RNA, 22 nt, Homo sapiens
gcccggggccaucucggggguu

SEQ ID NO: 17749 - RNA, 22 nt, Homo sapiens
cuccgagcguggcccugggcug

SEQ ID NO: 17750 - RNA, 22 nt, Homo sapiens
ugaauuugauagucuuggcugu

SEQ ID NO: 17751 - RNA, 22 nt, Homo sapiens
ggagccagacuguuuagguuca

SEQ ID NO: 17752 - RNA, 22 nt, Homo sapiens
aaccugagacccuggcagggug

SEQ ID NO: 17753 - RNA, 19 nt, Homo sapiens
gugcuugccauucagaguu

SEQ ID NO: 17754 - RNA, 22 nt, Homo sapiens
uuauuaaacagguucagaaaca

SEQ ID NO: 17755 - RNA, 22 nt, Homo sapiens
gcauuugaaauuguuuaacaau

SEQ ID NO: 17756 - RNA, 22 nt, Homo sapiens
uggcuugcuugcauguaaccua

SEQ ID NO: 17757 - RNA, 22 nt, Homo sapiens
uauuacauacauucaagcucau

SEQ ID NO: 17758 - RNA, 22 nt, Homo sapiens
aacauucauugcugucgguggg

SEQ ID NO: 17759 - RNA, 22 nt, Homo sapiens
ucacugaucaaugaaugcaaac

SEQ ID NO: 17760 - RNA, 23 nt, Homo sapiens
aacauucauugcugucggugggu

SEQ ID NO: 17761 - RNA, 22 nt, Homo sapiens
uugugagaggggagacuuggca

SEQ ID NO: 17762 - RNA, 22 nt, Homo sapiens
aagucuucacuaaaaucacaua

SEQ ID NO: 17763 - RNA, 22 nt, Homo sapiens
uccauuucccugccuccugcac

SEQ ID NO: 17764 - RNA, 22 nt, Homo sapiens
ccuagggggccgggcagaagag

SEQ ID NO: 17765 - RNA, 22 nt, Homo sapiens
cccagauccaucuggaagccag

SEQ ID NO: 17766 - RNA, 22 nt, Homo sapiens
uguuccaggugcugucucuggu

SEQ ID NO: 17767 - RNA, 22 nt, Homo sapiens
ucacuucaagaagugccaugca

SEQ ID NO: 17768 - RNA, 21 nt, Homo sapiens
uuuugcaccuuuuggagugaa

SEQ ID NO: 17769 - RNA, 22 nt, Homo sapiens
agaggccucccucccagcuggu

SEQ ID NO: 17770 - RNA, 20 nt, Homo sapiens
guuggcugggauggccgucu

SEQ ID NO: 17771 - RNA, 22 nt, Homo sapiens
gaggagagagagcgaggcuuug

SEQ ID NO: 17772 - RNA, 22 nt, Homo sapiens
uuggagucugauuucuccucug

SEQ ID NO: 17773 - RNA, 22 nt, Homo sapiens
ggugagguggcaacauggucau

SEQ ID NO: 17774 - RNA, 22 nt, Homo sapiens
acagccguguuccacugccuug

SEQ ID NO: 17775 - RNA, 22 nt, Homo sapiens
aagaaggagcggcccuugugac

SEQ ID NO: 17776 - RNA, 22 nt, Homo sapiens
ucacaaggaacuucuccucuug

SEQ ID NO: 17777 - RNA, 22 nt, Homo sapiens
aagaaggagcggcccuugugac

SEQ ID NO: 17778 - RNA, 22 nt, Homo sapiens
ucacaaggaacuucuccucuug

SEQ ID NO: 17779 - RNA, 22 nt, Homo sapiens
aagaaggagcggcccuugugac

SEQ ID NO: 17780 - RNA, 22 nt, Homo sapiens
ucacaaggaacuucuccucuug

SEQ ID NO: 17781 - RNA, 22 nt, Homo sapiens
aagaaggagcggcccuugugac

SEQ ID NO: 17782 - RNA, 22 nt, Homo sapiens
ucacaaggaacuucuccucuug

SEQ ID NO: 17783 - RNA, 22 nt, Homo sapiens
aagaaggagcggcccuugugac

SEQ ID NO: 17784 - RNA, 22 nt, Homo sapiens
ucacaaggaacuucuccucuug

SEQ ID NO: 17785 - RNA, 22 nt, Homo sapiens
gcauucccggcccccuggcgac

SEQ ID NO: 17786 - RNA, 22 nt, Homo sapiens
ucuccggggaggcaggaaugug

SEQ ID NO: 17787 - RNA, 22 nt, Homo sapiens
uggugagcagggaacgucaguu

SEQ ID NO: 17788 - RNA, 22 nt, Homo sapiens
gaugauuccuuuguucauugug

SEQ ID NO: 17789 - RNA, 22 nt, Homo sapiens
uggaaaagcauuaagaucauuu

SEQ ID NO: 17790 - RNA, 22 nt, Homo sapiens
aggugacuugaugacuaccacu

SEQ ID NO: 17791 - RNA, 22 nt, Homo sapiens
ugggcuacagcugcuugugggu

SEQ ID NO: 17792 - RNA, 22 nt, Homo sapiens
uagaaguaguucugagccacac

SEQ ID NO: 17793 - RNA, 22 nt, Homo sapiens
gaaaucguacugucauuuguuu

SEQ ID NO: 17794 - RNA, 22 nt, Homo sapiens
aacaaauggcacuauaauuccu

SEQ ID NO: 17795 - RNA, 22 nt, Homo sapiens
uagguggaagggaauuuugaga

SEQ ID NO: 17796 - RNA, 22 nt, Homo sapiens
ucuccauuuccucccacccucc

SEQ ID NO: 17797 - RNA, 22 nt, Homo sapiens
uguccauaauagcauagaguga

SEQ ID NO: 17798 - RNA, 22 nt, Homo sapiens
cuaauugugcuguucuggguca

SEQ ID NO: 17799 - RNA, 22 nt, Homo sapiens
uagggccugcuggugcuuccau

SEQ ID NO: 17800 - RNA, 19 nt, Homo sapiens
aaggaccagcuggccucug

SEQ ID NO: 17801 - RNA, 22 nt, Homo sapiens
gcugagagggcccugagaguug

SEQ ID NO: 17802 - RNA, 22 nt, Homo sapiens
auuuccagagggucccucugcu

SEQ ID NO: 17803 - RNA, 22 nt, Homo sapiens
acagggcaaggggcccagcagg

SEQ ID NO: 17804 - RNA, 22 nt, Homo sapiens
cuguucagccucuuuccuugcc

SEQ ID NO: 17805 - RNA, 22 nt, Homo sapiens
gggccuccuggugcuuccguug

SEQ ID NO: 17806 - RNA, 22 nt, Homo sapiens
acaacaggaaggaccagcuggc

SEQ ID NO: 17807 - RNA, 22 nt, Homo sapiens
uguguaaagcuuuucuuuguuc

SEQ ID NO: 17808 - RNA, 22 nt, Homo sapiens
uagagagcagcuuugcgguuuu

SEQ ID NO: 17809 - RNA, 22 nt, Homo sapiens
uuuugccucuagguguauugca

SEQ ID NO: 17810 - RNA, 22 nt, Homo sapiens
uaauaccuguaggugaaagaug

SEQ ID NO: 17811 - RNA, 22 nt, Homo sapiens
uuuuucaguuccaucucugcuc

SEQ ID NO: 17812 - RNA, 22 nt, Homo sapiens
gaguguguggggcugaggucag

SEQ ID NO: 17813 - RNA, 22 nt, Homo sapiens
uuuaccaggauugccaccugcc

SEQ ID NO: 17814 - RNA, 22 nt, Homo sapiens
gguggccaaaucuggauaauac

SEQ ID NO: 17815 - RNA, 22 nt, Homo sapiens
gaggagaaguccugcuuacuuc

SEQ ID NO: 17816 - RNA, 21 nt, Homo sapiens
gguaacaggguuuucucucuc

SEQ ID NO: 17817 - RNA, 22 nt, Homo sapiens
aagguuuucaugucucucuucu

SEQ ID NO: 17818 - RNA, 22 nt, Homo sapiens
aagagacaaacaugaaaaccuc

SEQ ID NO: 17819 - RNA, 22 nt, Homo sapiens
ugcgugccccggccacccccgg

SEQ ID NO: 17820 - RNA, 22 nt, Homo sapiens
cgcgggguggcuggggcuacgu

SEQ ID NO: 17821 - RNA, 22 nt, Homo sapiens
aaaagaagcacggcuccgggga

SEQ ID NO: 17822 - RNA, 21 nt, Homo sapiens
cccgaagccgugcgcuucuuc

SEQ ID NO: 17823 - RNA, 22 nt, Homo sapiens
ucugugaaagggagugugauac

SEQ ID NO: 17824 - RNA, 22 nt, Homo sapiens
ucuucuccuuuucucuugaguu

SEQ ID NO: 17825 - RNA, 22 nt, Homo sapiens
uccaauaggugguucuaggcuu

SEQ ID NO: 17826 - RNA, 22 nt, Homo sapiens
agccuaaaacuuccuugguaga

SEQ ID NO: 17827 - RNA, 22 nt, Homo sapiens
ccucagaggaugccccaagacc

SEQ ID NO: 17828 - RNA, 22 nt, Homo sapiens
ucuuggugccuucucucuuagg

SEQ ID NO: 17829 - RNA, 22 nt, Homo sapiens
cgccccugcuggcucaguccuc

SEQ ID NO: 17830 - RNA, 22 nt, Homo sapiens
agggugggcuggcauggggcau

SEQ ID NO: 17831 - RNA, 22 nt, Homo sapiens
gacugcagccaguuuaaauaug

SEQ ID NO: 17832 - RNA, 22 nt, Homo sapiens
uuuuaaacuggcauugcaguga

SEQ ID NO: 17833 - RNA, 22 nt, Homo sapiens
ugaggccuccagagaccagugg

SEQ ID NO: 17834 - RNA, 22 nt, Homo sapiens
uaugguucucucgguaggccag

SEQ ID NO: 17835 - RNA, 22 nt, Homo sapiens
ucuggucccuguuugguucaac

SEQ ID NO: 17836 - RNA, 22 nt, Homo sapiens
uggacuagacaacuuaucagaa

SEQ ID NO: 17837 - RNA, 22 nt, Homo sapiens
ucugcuccaggacaggggcccc

SEQ ID NO: 17838 - RNA, 22 nt, Homo sapiens
gccccagccccuggggacagac

SEQ ID NO: 17839 - RNA, 22 nt, Homo sapiens
gaagcuacugccagcagccugc

SEQ ID NO: 17840 - RNA, 22 nt, Homo sapiens
aggucugcugcagagcauggcu

SEQ ID NO: 17841 - RNA, 22 nt, Homo sapiens
cuauacaaucuacugucuuucc

SEQ ID NO: 17842 - RNA, 22 nt, Homo sapiens
ugagguaguagguuguauaguu

SEQ ID NO: 17843 - RNA, 22 nt, Homo sapiens
aaacaaauuucaagcugugaca

SEQ ID NO: 17844 - RNA, 22 nt, Homo sapiens
uaguagguugggguuugugcug

SEQ ID NO: 17845 - RNA, 22 nt, Homo sapiens
ucaaggaacuccagacuguugg

SEQ ID NO: 17846 - RNA, 22 nt, Homo sapiens
caacaguuaggaguucccugag

SEQ ID NO: 17847 - RNA, 22 nt, Homo sapiens
aggucauuaccugcggccgcgg

SEQ ID NO: 17848 - RNA, 22 nt, Homo sapiens
cauggccugaugagugaucugg

SEQ ID NO: 17849 - RNA, 22 nt, Homo sapiens
ccacaauacagugggaggcaca

SEQ ID NO: 17850 - RNA, 22 nt, Homo sapiens
gcgccucccaucugaggugcgg

SEQ ID NO: 17851 - RNA, 22 nt, Homo sapiens
ccacgauacagugggaggcaca

SEQ ID NO: 17852 - RNA, 22 nt, Homo sapiens
ugcuuccccucugaggugcgga

SEQ ID NO: 17853 - RNA, 22 nt, Homo sapiens
ugagccccugccuaccucauca

SEQ ID NO: 17854 - RNA, 22 nt, Homo sapiens
uguggggagcagggguucugaa

SEQ ID NO: 17855 - RNA, 22 nt, Homo sapiens
ugggagcugggaccucacccau

SEQ ID NO: 17856 - RNA, 22 nt, Homo sapiens
ggugggaguccguagucaacca

SEQ ID NO: 17857 - RNA, 22 nt, Homo sapiens
gaaauguggugguuggggggua

SEQ ID NO: 17858 - RNA, 22 nt, Homo sapiens
uccccccaucuuucccauuuac

SEQ ID NO: 17859 - RNA, 22 nt, Homo sapiens
aggcuucaggcucccugaggaa

SEQ ID NO: 17860 - RNA, 22 nt, Homo sapiens
uauccacaggggucugugcucu

SEQ ID NO: 17861 - RNA, 20 nt, Homo sapiens
cuggauggcuccuccauguc

SEQ ID NO: 17862 - RNA, 21 nt, Homo sapiens
cuggauggcuccuccaugucu

SEQ ID NO: 17863 - RNA, 22 nt, Homo sapiens
ucuuggaguaggucauugggug

SEQ ID NO: 17864 - RNA, 23 nt, Homo sapiens
ucuuggaguaggucauugggugg

SEQ ID NO: 17865 - RNA, 22 nt, Homo sapiens
uugugggucuagugcauuuugu

SEQ ID NO: 17866 - RNA, 22 nt, Homo sapiens
caaagugccgacccacugagaa

SEQ ID NO: 17867 - RNA, 22 nt, Homo sapiens
cugcacuggcuaaaggcugggu

SEQ ID NO: 17868 - RNA, 22 nt, Homo sapiens
aaauagccuugguuugugcacc

SEQ ID NO: 17869 - RNA, 22 nt, Homo sapiens
accuccugcuccccgacagccu

SEQ ID NO: 17870 - RNA, 22 nt, Homo sapiens
gaguuuggccggcagaggaagu

SEQ ID NO: 17871 - RNA, 22 nt, Homo sapiens
gccaucugggcguauaagugca

SEQ ID NO: 17872 - RNA, 22 nt, Homo sapiens
cuuggcuugggcucagaggccu

SEQ ID NO: 17873 - RNA, 22 nt, Homo sapiens
gggagggauagacaugauuugg

SEQ ID NO: 17874 - RNA, 22 nt, Homo sapiens
uauuuuuugucuguaaauccuu

SEQ ID NO: 17875 - RNA, 22 nt, Homo sapiens
caaucagcaaguauacugcccu

SEQ ID NO: 17876 - RNA, 23 nt, Homo sapiens
uggcagugucuuagcugguuguu

SEQ ID NO: 17877 - RNA, 22 nt, Homo sapiens
uauguaagaaaauagucaacca

SEQ ID NO: 17878 - RNA, 22 nt, Homo sapiens
uugacuguuuucuuacauagua

SEQ ID NO: 17879 - RNA, 22 nt, Homo sapiens
ccacagagagagaaguaaguga

SEQ ID NO: 17880 - RNA, 21 nt, Homo sapiens
acuugcuugcuuucugcuugg

SEQ ID NO: 17881 - RNA, 22 nt, Homo sapiens
ccagggagucaugaguuggcaa

SEQ ID NO: 17882 - RNA, 22 nt, Homo sapiens
gcuggcaugaagcuccugugug

SEQ ID NO: 17883 - RNA, 22 nt, Homo sapiens
agggucuugcucuggguuuuaa

SEQ ID NO: 17884 - RNA, 22 nt, Homo sapiens
uaaaacccagauuugcccugcu

SEQ ID NO: 17885 - RNA, 22 nt, Homo sapiens
aaaguacauacuguuauauucc

SEQ ID NO: 17886 - RNA, 22 nt, Homo sapiens
aguaaagccaaugugauuuucu

SEQ ID NO: 17887 - RNA, 22 nt, Homo sapiens
gguucaguaaggggauguuguc

SEQ ID NO: 17888 - RNA, 22 nt, Homo sapiens
uuugcucuccuuccucugccca

SEQ ID NO: 17889 - RNA, 22 nt, Homo sapiens
cgccucccuacuggccuuugca

SEQ ID NO: 17890 - RNA, 22 nt, Homo sapiens
augcccaggaggagggaggagc

SEQ ID NO: 17891 - RNA, 22 nt, Homo sapiens
accuccaucucccucccucugc

SEQ ID NO: 17892 - RNA, 22 nt, Homo sapiens
cggugggaguaaggggagugug

SEQ ID NO: 17893 - RNA, 22 nt, Homo sapiens
uaugcacaugaauuuuguucau

SEQ ID NO: 17894 - RNA, 22 nt, Homo sapiens
aaucuaguucauguguauauaa

SEQ ID NO: 17895 - RNA, 22 nt, Homo sapiens
acacuucuggaaguagcagcuu

SEQ ID NO: 17896 - RNA, 22 nt, Homo sapiens
gccauugcuugcccaaguguca

SEQ ID NO: 17897 - RNA, 22 nt, Homo sapiens
aggagaacaaggccauggucug

SEQ ID NO: 17898 - RNA, 22 nt, Homo sapiens
acccgugcgcuuugcuuuccuu

SEQ ID NO: 17899 - RNA, 22 nt, Homo sapiens
gguagaagaaauuagcauaaau

SEQ ID NO: 17900 - RNA, 22 nt, Homo sapiens
auuuugcugaucucuuugccuc

SEQ ID NO: 17901 - RNA, 20 nt, Homo sapiens
guguguggaaaugcuucugc

SEQ ID NO: 17902 - RNA, 22 nt, Homo sapiens
uaaagacaacauuucugcacac

SEQ ID NO: 17903 - RNA, 22 nt, Homo sapiens
gccacuguggagcugagggguu

SEQ ID NO: 17904 - RNA, 22 nt, Homo sapiens
uagauccccaggacacagggca

SEQ ID NO: 17905 - RNA, 22 nt, Homo sapiens
uccaacaucauaaccucagcuc

SEQ ID NO: 17906 - RNA, 22 nt, Homo sapiens
cugagguuaugguguuagacua

SEQ ID NO: 17907 - RNA, 22 nt, Homo sapiens
cgccgcccagcgcccccaccug

SEQ ID NO: 17908 - RNA, 22 nt, Homo sapiens
gcugagggggccugggggcacg

SEQ ID NO: 17909 - RNA, 22 nt, Homo sapiens
aguccagcugcucacaguccac

SEQ ID NO: 17910 - RNA, 22 nt, Homo sapiens
ugguggccgugaaggcuggcuc

SEQ ID NO: 17911 - RNA, 22 nt, Homo sapiens
ggggccaaguuucuuggaugag

SEQ ID NO: 17912 - RNA, 22 nt, Homo sapiens
uuccaaggauaugguugauccc

SEQ ID NO: 17913 - RNA, 22 nt, Homo sapiens
aggaugcaucagacugucagca

SEQ ID NO: 17914 - RNA, 22 nt, Homo sapiens
cugaagguucaugaugugaucc

SEQ ID NO: 17915 - RNA, 22 nt, Homo sapiens
ugucugucugccugucugucuu

SEQ ID NO: 17916 - RNA, 22 nt, Homo sapiens
guggagcaggcagguagaggcu

SEQ ID NO: 17917 - RNA, 22 nt, Homo sapiens
acguccaggaagcggucaguau

SEQ ID NO: 17918 - RNA, 22 nt, Homo sapiens
gaaggugaagagcuuccugcgg

SEQ ID NO: 17919 - RNA, 22 nt, Homo sapiens
uggcucugacgccaguguccua

SEQ ID NO: 17920 - RNA, 22 nt, Homo sapiens
gucacuggggucagagccagcu

SEQ ID NO: 17921 - RNA, 22 nt, Homo sapiens
gggguguccuggcccagccugg

SEQ ID NO: 17922 - RNA, 22 nt, Homo sapiens
gcggcucuccaggacaccccgc

SEQ ID NO: 17923 - RNA, 21 nt, Homo sapiens
aacuggccuacaaagucccag

SEQ ID NO: 17924 - RNA, 22 nt, Homo sapiens
gcugggucuuugcgggcgagau

SEQ ID NO: 17925 - RNA, 22 nt, Homo sapiens
gaaaaguuauugucagcaugug

SEQ ID NO: 17926 - RNA, 22 nt, Homo sapiens
uacacuguaguaugauuuuucc

SEQ ID NO: 17927 - RNA, 22 nt, Homo sapiens
uaacccaucacagacacugggu

SEQ ID NO: 17928 - RNA, 22 nt, Homo sapiens
uccaguaucugugauggguuaa

SEQ ID NO: 17929 - RNA, 22 nt, Homo sapiens
ugaggcaggaggauggaggaga

SEQ ID NO: 17930 - RNA, 22 nt, Homo sapiens
uccugcggccccugccuugccg

SEQ ID NO: 17931 - RNA, 22 nt, Homo sapiens
ugugugcuaacucagucuuuac

SEQ ID NO: 17932 - RNA, 22 nt, Homo sapiens
ugaagaaggaauuggggcacag

SEQ ID NO: 17933 - RNA, 22 nt, Homo sapiens
uuucuccacucgcuuccucucu

SEQ ID NO: 17934 - RNA, 22 nt, Homo sapiens
aguggaggugggagggaacaag

SEQ ID NO: 17935 - RNA, 22 nt, Homo sapiens
gggggcgggugcuugcugcaug

SEQ ID NO: 17936 - RNA, 22 nt, Homo sapiens
uggagcuagucccugcccccua

SEQ ID NO: 17937 - RNA, 22 nt, Homo sapiens
gcuggcauucuuuugaauaagc

SEQ ID NO: 17938 - RNA, 22 nt, Homo sapiens
cauucaaagcaaugccaggcuu

SEQ ID NO: 17939 - RNA, 22 nt, Homo sapiens
ugggaagagagugggagagaaa

SEQ ID NO: 17940 - RNA, 22 nt, Homo sapiens
uuuucuuucaguucuuuccaaa

SEQ ID NO: 17941 - RNA, 22 nt, Homo sapiens
uugaauuuucagaagauguggc

SEQ ID NO: 17942 - RNA, 22 nt, Homo sapiens
acaucuccugaaaacgcagaug

SEQ ID NO: 17943 - RNA, 22 nt, Homo sapiens
uagauagcuagagccagauuuc

SEQ ID NO: 17944 - RNA, 20 nt, Homo sapiens
cagaagaucuuuagcuacug

SEQ ID NO: 17945 - RNA, 22 nt, Homo sapiens
caaagucuuuccuuuaguuucu

SEQ ID NO: 17946 - RNA, 22 nt, Homo sapiens
ugcuaaauggaggagaguuugu

SEQ ID NO: 17947 - RNA, 22 nt, Homo sapiens
aaugaugaagcagaaaccuuga

SEQ ID NO: 17948 - RNA, 22 nt, Homo sapiens
agauuucuacuuaaauauuguu

SEQ ID NO: 17949 - RNA, 22 nt, Homo sapiens
uaccccuccccucgcgcgcucg

SEQ ID NO: 17950 - RNA, 20 nt, Homo sapiens
gaagcgcggggaggggcagg

SEQ ID NO: 17951 - RNA, 22 nt, Homo sapiens
ucauucacuuuguccccaccca

SEQ ID NO: 17952 - RNA, 19 nt, Homo sapiens
ggacugggaagugagggac

SEQ ID NO: 17953 - RNA, 22 nt, Homo sapiens
agggaggagguuggggugaagg

SEQ ID NO: 17954 - RNA, 22 nt, Homo sapiens
uccauccccaacccugccuucc

SEQ ID NO: 17955 - RNA, 22 nt, Homo sapiens
uucucugccaaguggucugaga

SEQ ID NO: 17956 - RNA, 22 nt, Homo sapiens
uagcccacuugggagaggagag

SEQ ID NO: 17957 - RNA, 22 nt, Homo sapiens
caaaaauagcaccauuugccuc

SEQ ID NO: 17958 - RNA, 20 nt, Homo sapiens
agguuguuguguuguuguug

SEQ ID NO: 17959 - RNA, 22 nt, Homo sapiens
ugcuggcuuguucacaggggag

SEQ ID NO: 17960 - RNA, 22 nt, Homo sapiens
ucccuucuggaaaacucagcaa

SEQ ID NO: 17961 - RNA, 22 nt, Homo sapiens
uuugucucuccauuaugauucc

SEQ ID NO: 17962 - RNA, 22 nt, Homo sapiens
ggaaauaauggagggcagggag

SEQ ID NO: 17963 - RNA, 22 nt, Homo sapiens
gggggagcuaaugggcauugcu

SEQ ID NO: 17964 - RNA, 22 nt, Homo sapiens
ugguggugccaggcuucugauu

SEQ ID NO: 17965 - RNA, 22 nt, Homo sapiens
ucauccucuuucuaggucggaa

SEQ ID NO: 17966 - RNA, 22 nt, Homo sapiens
cgggccuggaauaagaggaaga

SEQ ID NO: 17967 - RNA, 22 nt, Homo sapiens
uugaauuagauguuguaguccu

SEQ ID NO: 17968 - RNA, 22 nt, Homo sapiens
gacuacaauauguaaucuaaua

SEQ ID NO: 17969 - RNA, 22 nt, Homo sapiens
caaccguguucgggaacacuug

SEQ ID NO: 17970 - RNA, 21 nt, Homo sapiens
aaguguuuccaauauggcugg

SEQ ID NO: 17971 - RNA, 22 nt, Homo sapiens
gguugggcguggccgcaggggc

SEQ ID NO: 17972 - RNA, 22 nt, Homo sapiens
ccugcaaccccuuccugacccc

SEQ ID NO: 17973 - RNA, 22 nt, Homo sapiens
ccaggcugaggugaaggugugc

SEQ ID NO: 17974 - RNA, 22 nt, Homo sapiens
caccugcacuccagccagggug

SEQ ID NO: 17975 - RNA, 22 nt, Homo sapiens
aaaggcagaaccagggcaucuu

SEQ ID NO: 17976 - RNA, 22 nt, Homo sapiens
aagccuuggcucugcuuugcug

SEQ ID NO: 17977 - RNA, 22 nt, Homo sapiens
cugggacaggaaggauggagac

SEQ ID NO: 17978 - RNA, 22 nt, Homo sapiens
uccaccagccuguuccauuuuc

SEQ ID NO: 17979 - RNA, 22 nt, Homo sapiens
ucgaagccuaucucuauuaauu

SEQ ID NO: 17980 - RNA, 22 nt, Homo sapiens
auuaaaaagagauaggcuucaa

SEQ ID NO: 17981 - RNA, 22 nt, Homo sapiens
ucgaagccuaucucuauuaauu

SEQ ID NO: 17982 - RNA, 22 nt, Homo sapiens
auuaaaaagagauaggcuucaa

SEQ ID NO: 17983 - RNA, 22 nt, Homo sapiens
ucccucuccugcuucaucccca

SEQ ID NO: 17984 - RNA, 22 nt, Homo sapiens
acagggucagcaggggagggug

SEQ ID NO: 17985 - RNA, 22 nt, Homo sapiens
cuggagcuucagaggcugcuug

SEQ ID NO: 17986 - RNA, 22 nt, Homo sapiens
gcggcacucugaaagcugccac

SEQ ID NO: 17987 - RNA, 22 nt, Homo sapiens
gaaaucaccaaacuagaaaaua

SEQ ID NO: 17988 - RNA, 22 nt, Homo sapiens
uuucuaguucaguggugcuaga

SEQ ID NO: 17989 - RNA, 22 nt, Homo sapiens
auggcaggccuaacugagguug

SEQ ID NO: 17990 - RNA, 22 nt, Homo sapiens
guccccagugucacugcuaccu

SEQ ID NO: 17991 - RNA, 22 nt, Homo sapiens
gagggaagccuaggauuuuugu

SEQ ID NO: 17992 - RNA, 22 nt, Homo sapiens
cagaaguucuuuuuuuucucug

SEQ ID NO: 17993 - RNA, 22 nt, Homo sapiens
uauguaauaugguccacaucuu

SEQ ID NO: 17994 - RNA, 22 nt, Homo sapiens
ugguugaccauagaacaugcgc

SEQ ID NO: 17995 - RNA, 21 nt, Homo sapiens
uauguaauaugguccacaucu

SEQ ID NO: 17996 - RNA, 22 nt, Homo sapiens
uaauuccuuuucuuucuuccug

SEQ ID NO: 17997 - RNA, 22 nt, Homo sapiens
gaagcugggagaagggauugga

SEQ ID NO: 17998 - RNA, 22 nt, Homo sapiens
uguaucugugugcacuuuggug

SEQ ID NO: 17999 - RNA, 20 nt, Homo sapiens
auuugugugugcacggggca

SEQ ID NO: 18000 - RNA, 22 nt, Homo sapiens
ugguucugugguuguugucugu

SEQ ID NO: 18001 - RNA, 22 nt, Homo sapiens
guaguaaccacaguaaucacac

SEQ ID NO: 18002 - RNA, 22 nt, Homo sapiens
ugaguucccggaucuguuccau

SEQ ID NO: 18003 - RNA, 17 nt, Homo sapiens
cggauccgcgggaccgc

SEQ ID NO: 18004 - RNA, 22 nt, Homo sapiens
agcagggcaggcugggacccca

SEQ ID NO: 18005 - RNA, 22 nt, Homo sapiens
gggucccaccugcuccuguagg

SEQ ID NO: 18006 - RNA, 22 nt, Homo sapiens
ggaauaggagggaggagaugga

SEQ ID NO: 18007 - RNA, 22 nt, Homo sapiens
cauugguucucuuccuuguauu

SEQ ID NO: 18008 - RNA, 22 nt, Homo sapiens
ucauccccacugauucaaucuc

SEQ ID NO: 18009 - RNA, 18 nt, Homo sapiens
uugaaucuaggggaagau

SEQ ID NO: 18010 - RNA, 22 nt, Homo sapiens
aggagcaggcugugugggccuc

SEQ ID NO: 18011 - RNA, 22 nt, Homo sapiens
agaccagcaaggccuggccuca

SEQ ID NO: 18012 - RNA, 22 nt, Homo sapiens
uggagugagaagaccuggguuc

SEQ ID NO: 18013 - RNA, 22 nt, Homo sapiens
guuaucucagucaucucggcca

SEQ ID NO: 18014 - RNA, 22 nt, Homo sapiens
aggagcagggcugcaggaggag

SEQ ID NO: 18015 - RNA, 22 nt, Homo sapiens
ugccuccuccugcaggcuccag

SEQ ID NO: 18016 - RNA, 22 nt, Homo sapiens
acagccauguuuuagagaauuu

SEQ ID NO: 18017 - RNA, 22 nt, Homo sapiens
acucuuuagaaagaggcugcca

SEQ ID NO: 18018 - RNA, 22 nt, Homo sapiens
gcuccugcugucauaaacacuu

SEQ ID NO: 18019 - RNA, 22 nt, Homo sapiens
uguuuauggaacaggaggaguu

SEQ ID NO: 18020 - RNA, 22 nt, Homo sapiens
ccucuugccacccucuacucuc

SEQ ID NO: 18021 - RNA, 22 nt, Homo sapiens
caaagaguugagggggcggggu

SEQ ID NO: 18022 - RNA, 22 nt, Homo sapiens
acuucuucuucccugucucuuc

SEQ ID NO: 18023 - RNA, 22 nt, Homo sapiens
ggagacggacagcggagaagug

SEQ ID NO: 18024 - RNA, 22 nt, Homo sapiens
ugagcccccgcgcccgggcagc

SEQ ID NO: 18025 - RNA, 22 nt, Homo sapiens
cgaggccggcgugggggugggg

SEQ ID NO: 18026 - RNA, 22 nt, Homo sapiens
ucagggggauauaggagagaac

SEQ ID NO: 18027 - RNA, 22 nt, Homo sapiens
ugacuucuacuauuuuccuggg

SEQ ID NO: 18028 - RNA, 22 nt, Homo sapiens
gggaauaggagagagaagaugg

SEQ ID NO: 18029 - RNA, 22 nt, Homo sapiens
ucgguucucuucccaguauucc

SEQ ID NO: 18030 - RNA, 22 nt, Homo sapiens
aggaugguccagggaauccuau

SEQ ID NO: 18031 - RNA, 22 nt, Homo sapiens
ggauccucugagaacccuccuu

SEQ ID NO: 18032 - RNA, 22 nt, Homo sapiens
cuagguauggucccagggaucc

SEQ ID NO: 18033 - RNA, 22 nt, Homo sapiens
uuaaauuacuagguaccuagug

SEQ ID NO: 18034 - RNA, 20 nt, Homo sapiens
uuagguacccuguaaucuaa

SEQ ID NO: 18035 - RNA, 22 nt, Homo sapiens
agacauccugcugcuguugcuc

SEQ ID NO: 18036 - RNA, 22 nt, Homo sapiens
uugcuaggggugggcuugucug

SEQ ID NO: 18037 - RNA, 22 nt, Homo sapiens
gcagaauguuaauaagcugugu

SEQ ID NO: 18038 - RNA, 22 nt, Homo sapiens
aucaguuuauuaacgcuauguu

SEQ ID NO: 18039 - RNA, 22 nt, Homo sapiens
agagguugcuccgugcggugcu

SEQ ID NO: 18040 - RNA, 22 nt, Homo sapiens
agcgcccuggaguaagcucucc

SEQ ID NO: 18041 - RNA, 22 nt, Homo sapiens
ugcaccuccagcggcuggugag

SEQ ID NO: 18042 - RNA, 22 nt, Homo sapiens
ccagcugguggggaagcugcag

SEQ ID NO: 18043 - RNA, 22 nt, Homo sapiens
ccacauucugcgguggagagag

SEQ ID NO: 18044 - RNA, 22 nt, Homo sapiens
ucugcaccuguaggaugaaguc

SEQ ID NO: 18045 - RNA, 22 nt, Homo sapiens
gaagacugauaacauauaugga

SEQ ID NO: 18046 - RNA, 22 nt, Homo sapiens
uguauaugcagugagucuuucu

SEQ ID NO: 18047 - RNA, 22 nt, Homo sapiens
uccccuuuacccauggagcuca

SEQ ID NO: 18048 - RNA, 22 nt, Homo sapiens
auggcccaaggguggagaggaa

SEQ ID NO: 18049 - RNA, 22 nt, Homo sapiens
agcgggaauggaaggcagggau

SEQ ID NO: 18050 - RNA, 22 nt, Homo sapiens
ucugccuccuuccuuccucuuc

SEQ ID NO: 18051 - RNA, 22 nt, Homo sapiens
cgugaagucucaugccccugaa

SEQ ID NO: 18052 - RNA, 22 nt, Homo sapiens
uggccaggcucaugaggccaca

SEQ ID NO: 18053 - RNA, 22 nt, Homo sapiens
cgugaagucucaugccccugaa

SEQ ID NO: 18054 - RNA, 22 nt, Homo sapiens
uggccaggcucaugaggccaca

SEQ ID NO: 18055 - RNA, 22 nt, Homo sapiens
acucuuucccuguugcacuacu

SEQ ID NO: 18056 - RNA, 22 nt, Homo sapiens
gcagugcaaugaugaaagggca

SEQ ID NO: 18057 - RNA, 22 nt, Homo sapiens
aaaugggaacaccaccaccugg

SEQ ID NO: 18058 - RNA, 22 nt, Homo sapiens
caagcggugcuguucucauugu

SEQ ID NO: 18059 - RNA, 22 nt, Homo sapiens
ggccccuccgagccuccgcggg

SEQ ID NO: 18060 - RNA, 22 nt, Homo sapiens
gccgggacggagagggcgaggc

SEQ ID NO: 18061 - RNA, 22 nt, Homo sapiens
ugccauuagcccaguccaggcc

SEQ ID NO: 18062 - RNA, 22 nt, Homo sapiens
uggacuaggccaguggcaaaca

SEQ ID NO: 18063 - RNA, 22 nt, Homo sapiens
uccuauuucugucuuggccagg

SEQ ID NO: 18064 - RNA, 22 nt, Homo sapiens
ugaguaagacaggaauagagga

SEQ ID NO: 18065 - RNA, 22 nt, Homo sapiens
uagcucaauggguuauuuucag

SEQ ID NO: 18066 - RNA, 22 nt, Homo sapiens
ugugcauuuuccauuugagucc

SEQ ID NO: 18067 - RNA, 22 nt, Homo sapiens
ggugugcguguuccccuggauc

SEQ ID NO: 18068 - RNA, 22 nt, Homo sapiens
ucacagggguugcggacacuuu

SEQ ID NO: 18069 - RNA, 22 nt, Homo sapiens
uaugggggaugucaggcaggcc

SEQ ID NO: 18070 - RNA, 22 nt, Homo sapiens
cauccugacucauguccccugc

SEQ ID NO: 18071 - RNA, 22 nt, Homo sapiens
uagugccgguguugucugggaa

SEQ ID NO: 18072 - RNA, 22 nt, Homo sapiens
ucagacaacauugggacauacg

SEQ ID NO: 18073 - RNA, 22 nt, Homo sapiens
aaagugcugucauagcugaggu

SEQ ID NO: 18074 - RNA, 22 nt, Homo sapiens
aagugcugucauagcugagguc

SEQ ID NO: 18075 - RNA, 22 nt, Homo sapiens
acucagccuugagggcacuuuc

SEQ ID NO: 18076 - RNA, 23 nt, Homo sapiens
cacucagccuugagggcacuuuc

SEQ ID NO: 18077 - RNA, 22 nt, Homo sapiens
uagcuacguuuuuuccucagca

SEQ ID NO: 18078 - RNA, 22 nt, Homo sapiens
uaacugaggcccagagaagcga

SEQ ID NO: 18079 - RNA, 22 nt, Homo sapiens
ucccuagcucccaugucuccca

SEQ ID NO: 18080 - RNA, 22 nt, Homo sapiens
gaggaggcaaggaagagaggga

SEQ ID NO: 18081 - RNA, 22 nt, Homo sapiens
gcuugaggcaguacuggcauuc

SEQ ID NO: 18082 - RNA, 22 nt, Homo sapiens
ugucagugcuguucuucagcug

SEQ ID NO: 18083 - RNA, 22 nt, Homo sapiens
uagagaauggaaagaggcaggg

SEQ ID NO: 18084 - RNA, 22 nt, Homo sapiens
uugcuucuuucuugucuuggau

SEQ ID NO: 18085 - RNA, 22 nt, Homo sapiens
aacauaguggacacaucccugc

SEQ ID NO: 18086 - RNA, 22 nt, Homo sapiens
uaggaagaugguuugcuggcca

SEQ ID NO: 18087 - RNA, 22 nt, Homo sapiens
ugaccagcugggggaguugaua

SEQ ID NO: 18088 - RNA, 22 nt, Homo sapiens
ccauuaaccccagcuggucauc

SEQ ID NO: 18089 - RNA, 22 nt, Homo sapiens
aacucuguagugcuaucagggg

SEQ ID NO: 18090 - RNA, 22 nt, Homo sapiens
cuggaacuagcacuaccagagu

SEQ ID NO: 18091 - RNA, 22 nt, Homo sapiens
uuuauccccggcacccgggcug

SEQ ID NO: 18092 - RNA, 22 nt, Homo sapiens
agcucuggggccgggaugagag

SEQ ID NO: 18093 - RNA, 22 nt, Homo sapiens
ugauguguuggugagacaaacu

SEQ ID NO: 18094 - RNA, 18 nt, Homo sapiens
uuugucuccaggacacac

SEQ ID NO: 18095 - RNA, 22 nt, Homo sapiens
aaacaugguuccgucaagcacc

SEQ ID NO: 18096 - RNA, 21 nt, Homo sapiens
uugugcuugaucuaaccaugu

SEQ ID NO: 18097 - RNA, 22 nt, Homo sapiens
ucuucuccccucccucccagau

SEQ ID NO: 18098 - RNA, 22 nt, Homo sapiens
uggcgaagggaaaggagggagu

SEQ ID NO: 18099 - RNA, 22 nt, Homo sapiens
acacaugggaauggggccgggg

SEQ ID NO: 18100 - RNA, 22 nt, Homo sapiens
ucgggccuucgucaccuguguc

SEQ ID NO: 18101 - RNA, 22 nt, Homo sapiens
ugcuaucaagaaaucuaaugag

SEQ ID NO: 18102 - RNA, 22 nt, Homo sapiens
ucauuagcauucuugaacgugc

SEQ ID NO: 18103 - RNA, 22 nt, Homo sapiens
ugagauugaacaucagcaggcg

SEQ ID NO: 18104 - RNA, 22 nt, Homo sapiens
cugcucuguucuggucucagag

SEQ ID NO: 18105 - RNA, 22 nt, Homo sapiens
agaugagagaauuggccuuaga

SEQ ID NO: 18106 - RNA, 22 nt, Homo sapiens
ucuaaggccccucucuuaguca

SEQ ID NO: 18107 - RNA, 22 nt, Homo sapiens
ugccggucugcagaguccugga

SEQ ID NO: 18108 - RNA, 22 nt, Homo sapiens
aggguaugcggauauggauaac

SEQ ID NO: 18109 - RNA, 22 nt, Homo sapiens
agccagaggcaaagcagccgca

SEQ ID NO: 18110 - RNA, 22 nt, Homo sapiens
cguuugcuuugcuccugagcag

SEQ ID NO: 18111 - RNA, 22 nt, Homo sapiens
gcuagccugucugcuguguuuu

SEQ ID NO: 18112 - RNA, 20 nt, Homo sapiens
gugcacaguggaagagcagc

SEQ ID NO: 18113 - RNA, 22 nt, Homo sapiens
ggugugaucugauuugaagggu

SEQ ID NO: 18114 - RNA, 22 nt, Homo sapiens
ucagcauucugucagguuaacu

SEQ ID NO: 18115 - RNA, 22 nt, Homo sapiens
aggaauuaauggcccgcugagg

SEQ ID NO: 18116 - RNA, 22 nt, Homo sapiens
cagcuggccauuaauccccuag

SEQ ID NO: 18117 - RNA, 22 nt, Homo sapiens
acaggaaggacccaggccccag

SEQ ID NO: 18118 - RNA, 22 nt, Homo sapiens
ugggcccugggccacuccuggc

SEQ ID NO: 18119 - RNA, 22 nt, Homo sapiens
gguggugcguggagaacugaca

SEQ ID NO: 18120 - RNA, 22 nt, Homo sapiens
ucgucggcuccguccaucuccc

SEQ ID NO: 18121 - RNA, 22 nt, Homo sapiens
ugcagcugcucuuccucuauug

SEQ ID NO: 18122 - RNA, 22 nt, Homo sapiens
ggaagagaggagcaguugcuac

SEQ ID NO: 18123 - RNA, 22 nt, Homo sapiens
uggccugguggugauucuccag

SEQ ID NO: 18124 - RNA, 22 nt, Homo sapiens
gcugugaccaccaagccaggug

SEQ ID NO: 18125 - RNA, 22 nt, Homo sapiens
uggccugguggugauucuccag

SEQ ID NO: 18126 - RNA, 22 nt, Homo sapiens
gcugugaccaccaagccaggug

SEQ ID NO: 18127 - RNA, 22 nt, Homo sapiens
cacugguggaauuuuuuccaua

SEQ ID NO: 18128 - RNA, 22 nt, Homo sapiens
uguagaauugauuucccagucu

SEQ ID NO: 18129 - RNA, 22 nt, Homo sapiens
cagaagaugggguagagucagg

SEQ ID NO: 18130 - RNA, 22 nt, Homo sapiens
ugccucugccucacuuugcaga

SEQ ID NO: 18131 - RNA, 22 nt, Homo sapiens
ugguguggauggggguuggggu

SEQ ID NO: 18132 - RNA, 22 nt, Homo sapiens
ccuuccuccacccacaacuagu

SEQ ID NO: 18133 - RNA, 22 nt, Homo sapiens
uggcuccacaggccagggugug

SEQ ID NO: 18134 - RNA, 22 nt, Homo sapiens
caccucagccauguggaggcag

SEQ ID NO: 18135 - RNA, 22 nt, Homo sapiens
uggcuccacaggccagggugug

SEQ ID NO: 18136 - RNA, 22 nt, Homo sapiens
caccucagccauguggaggcag

SEQ ID NO: 18137 - RNA, 22 nt, Homo sapiens
uggcuccacaggccagggugug

SEQ ID NO: 18138 - RNA, 22 nt, Homo sapiens
caccucagccauguggaggcag

SEQ ID NO: 18139 - RNA, 22 nt, Homo sapiens
uaauuuuagaucuggucugcuu

SEQ ID NO: 18140 - RNA, 22 nt, Homo sapiens
cagacuugaccuacaauuagcc

SEQ ID NO: 18141 - RNA, 22 nt, Homo sapiens
uuugauaagcugacaugggaca

SEQ ID NO: 18142 - RNA, 22 nt, Homo sapiens
uguugugucaguuuaucaaacc

SEQ ID NO: 18143 - RNA, 22 nt, Homo sapiens
ugucuuuggcauggucugagcu

SEQ ID NO: 18144 - RNA, 22 nt, Homo sapiens
cggugauuagaucauguuaugg

SEQ ID NO: 18145 - RNA, 22 nt, Homo sapiens
aaaggugcucagccucuagccc

SEQ ID NO: 18146 - RNA, 22 nt, Homo sapiens
gaagaggcagagacaguuuggg

SEQ ID NO: 18147 - RNA, 22 nt, Homo sapiens
accaucgaccguugaguggacc

SEQ ID NO: 18148 - RNA, 22 nt, Homo sapiens
gaacauucaaccugucggugag

SEQ ID NO: 18149 - RNA, 22 nt, Homo sapiens
cauugcacuugucucggucuga

SEQ ID NO: 18150 - RNA, 22 nt, Homo sapiens
gaggcggagacuugggcaauug

SEQ ID NO: 18151 - RNA, 22 nt, Homo sapiens
ccucagagcuuggguuuucuua

SEQ ID NO: 18152 - RNA, 22 nt, Homo sapiens
gagaaaacuggagccugggguu

SEQ ID NO: 18153 - RNA, 22 nt, Homo sapiens
uggagauggguuucacacuccu

SEQ ID NO: 18154 - RNA, 22 nt, Homo sapiens
gcuaagcuuugagacccgcuuc

SEQ ID NO: 18155 - RNA, 22 nt, Homo sapiens
gaggaggggaaaugaaaggaua

SEQ ID NO: 18156 - RNA, 22 nt, Homo sapiens
ucugucauuucccugcuaucuc

SEQ ID NO: 18157 - RNA, 22 nt, Homo sapiens
ugaaacuuggcuuuuagcugca

SEQ ID NO: 18158 - RNA, 21 nt, Homo sapiens
uguggcuggaagcuuguauua

SEQ ID NO: 18159 - RNA, 22 nt, Homo sapiens
gcuuuuacagaugauuaaaugc

SEQ ID NO: 18160 - RNA, 22 nt, Homo sapiens
cuuuugauaacugcuagagcca

SEQ ID NO: 18161 - RNA, 22 nt, Homo sapiens
ucccuuucacuuaacuagccca

SEQ ID NO: 18162 - RNA, 22 nt, Homo sapiens
gaaggacaggcaggugaggggc

SEQ ID NO: 18163 - RNA, 22 nt, Homo sapiens
ugggaagggagagcccuuggcu

SEQ ID NO: 18164 - RNA, 22 nt, Homo sapiens
gggauccaguguccuuccuuuc

SEQ ID NO: 18165 - RNA, 22 nt, Homo sapiens
aauuucaaugcuuccucuuaug

SEQ ID NO: 18166 - RNA, 22 nt, Homo sapiens
acaagaggaagaacugaaauuc

SEQ ID NO: 18167 - RNA, 22 nt, Homo sapiens
uccugaaucaucccuucugucu

SEQ ID NO: 18168 - RNA, 22 nt, Homo sapiens
ggacagugagggaggaaggggg

SEQ ID NO: 18169 - RNA, 22 nt, Homo sapiens
uguuagacuugcguggaucaug

SEQ ID NO: 18170 - RNA, 22 nt, Homo sapiens
guauucagugcaagucaacguc

SEQ ID NO: 18171 - RNA, 22 nt, Homo sapiens
cagcccugugagguguuucugu

SEQ ID NO: 18172 - RNA, 22 nt, Homo sapiens
ggaauaucucauagggcuguug

SEQ ID NO: 18173 - RNA, 22 nt, Homo sapiens
uggccacauucugggucuaagg

SEQ ID NO: 18174 - RNA, 22 nt, Homo sapiens
ucugagauccagaggauggcua

SEQ ID NO: 18175 - RNA, 22 nt, Homo sapiens
uucucuugccagcuucugccac

SEQ ID NO: 18176 - RNA, 22 nt, Homo sapiens
ggauaagguaggaguugggggu

SEQ ID NO: 18177 - RNA, 22 nt, Homo sapiens
ugagaguacuagggguuucccu

SEQ ID NO: 18178 - RNA, 22 nt, Homo sapiens
ggaggccccaaagaguucuauu

SEQ ID NO: 18179 - RNA, 22 nt, Homo sapiens
uuuugggcuaagugcugauagu

SEQ ID NO: 18180 - RNA, 22 nt, Homo sapiens
cuucagcacuuuccagaaggug

SEQ ID NO: 18181 - RNA, 22 nt, Homo sapiens
aggaagcaaaguauuugggggg

SEQ ID NO: 18182 - RNA, 22 nt, Homo sapiens
ccuauggucuuuuguuuucugg

SEQ ID NO: 18183 - RNA, 22 nt, Homo sapiens
agucaggaauugauuuuggaua

SEQ ID NO: 18184 - RNA, 22 nt, Homo sapiens
cagaaaucagauucuuggccag

SEQ ID NO: 18185 - RNA, 22 nt, Homo sapiens
gaugcgcucucgagcuaugugu

SEQ ID NO: 18186 - RNA, 22 nt, Homo sapiens
accauuguucaaaagaucgcgu

SEQ ID NO: 18187 - RNA, 22 nt, Homo sapiens
gaugcgcucucgagcuaugugu

SEQ ID NO: 18188 - RNA, 22 nt, Homo sapiens
accauuguucaaaagaucgcgu

SEQ ID NO: 18189 - RNA, 22 nt, Homo sapiens
gaugcgcucucgagcuaugugu

SEQ ID NO: 18190 - RNA, 22 nt, Homo sapiens
accauuguucaaaagaucgcgu

SEQ ID NO: 18191 - RNA, 22 nt, Homo sapiens
gaugcgcucucgagcuaugugu

SEQ ID NO: 18192 - RNA, 22 nt, Homo sapiens
accauuguucaaaagaucgcgu

SEQ ID NO: 18193 - RNA, 22 nt, Homo sapiens
ucacacuggguuugagggucac

SEQ ID NO: 18194 - RNA, 22 nt, Homo sapiens
uggcuccaccaaacucagggug

SEQ ID NO: 18195 - RNA, 22 nt, Homo sapiens
ugguggcugaggcagggggaug

SEQ ID NO: 18196 - RNA, 22 nt, Homo sapiens
ugaucuccuggcugcaggcuac

SEQ ID NO: 18197 - RNA, 22 nt, Homo sapiens
gcccugugaagaguuggguucg

SEQ ID NO: 18198 - RNA, 22 nt, Homo sapiens
ugcccacaucccaucacagggc

SEQ ID NO: 18199 - RNA, 22 nt, Homo sapiens
uuuggggguuuguggauauguu

SEQ ID NO: 18200 - RNA, 22 nt, Homo sapiens
uaguguccauaaucucuagaga

SEQ ID NO: 18201 - RNA, 22 nt, Homo sapiens
accccaaaugcccuuggggcag

SEQ ID NO: 18202 - RNA, 22 nt, Homo sapiens
ccccaggggguuuugggggcug

SEQ ID NO: 18203 - RNA, 22 nt, Homo sapiens
accccaaaugcccuuggggcag

SEQ ID NO: 18204 - RNA, 22 nt, Homo sapiens
ccccaggggguuuugggggcug

SEQ ID NO: 18205 - RNA, 22 nt, Homo sapiens
auguggugggggagagguguca

SEQ ID NO: 18206 - RNA, 22 nt, Homo sapiens
cccucuucccugcagccacggc

SEQ ID NO: 18207 - RNA, 22 nt, Homo sapiens
ucagccugcaauuagugaaaug

SEQ ID NO: 18208 - RNA, 22 nt, Homo sapiens
ugcagauugugggugggaggac

SEQ ID NO: 18209 - RNA, 22 nt, Homo sapiens
agccugguaauuuucagucaag

SEQ ID NO: 18210 - RNA, 22 nt, Homo sapiens
uuuaucgaaaauuacuaggccu

SEQ ID NO: 18211 - RNA, 22 nt, Homo sapiens
ucugggucccaggccugauggu

SEQ ID NO: 18212 - RNA, 22 nt, Homo sapiens
ccuuuugccugggucuagagau

SEQ ID NO: 18213 - RNA, 22 nt, Homo sapiens
gggaaaagagagaauuuauagc

SEQ ID NO: 18214 - RNA, 20 nt, Homo sapiens
ggcagauucuuucuuggcuc

SEQ ID NO: 18215 - RNA, 22 nt, Homo sapiens
aaauagguacuauucccauuuu

SEQ ID NO: 18216 - RNA, 22 nt, Homo sapiens
agaggugaaagugcuuaugcag

SEQ ID NO: 18217 - RNA, 22 nt, Homo sapiens
aauuuguuuauucuugggagua

SEQ ID NO: 18218 - RNA, 22 nt, Homo sapiens
uauuccaggaguccaggguuuc

SEQ ID NO: 18219 - RNA, 21 nt, Homo sapiens
aaggagcuuacaaucuagcug

SEQ ID NO: 18220 - RNA, 23 nt, Homo sapiens
aaggagcuuacaaucuagcuggg

SEQ ID NO: 18221 - RNA, 22 nt, Homo sapiens
uaacuaaaggccaaaguuuuca

SEQ ID NO: 18222 - RNA, 22 nt, Homo sapiens
agaacuuuggcuuuauuuacuu

SEQ ID NO: 18223 - RNA, 22 nt, Homo sapiens
aucggucucuucugcacuuuuc

SEQ ID NO: 18224 - RNA, 22 nt, Homo sapiens
gagauguugaaggacuggagcu

SEQ ID NO: 18225 - RNA, 22 nt, Homo sapiens
cagcggcauuugguuugguggu

SEQ ID NO: 18226 - RNA, 22 nt, Homo sapiens
cgacugcuaaaugccugccuuu

SEQ ID NO: 18227 - RNA, 22 nt, Homo sapiens
agucucuccccuucccuuuuua

SEQ ID NO: 18228 - RNA, 22 nt, Homo sapiens
aggauggggaggaggaguguuu

SEQ ID NO: 18229 - RNA, 22 nt, Homo sapiens
aaggucaaccaguccucauggu

SEQ ID NO: 18230 - RNA, 21 nt, Homo sapiens
augagugcuggugaccaccag

SEQ ID NO: 18231 - RNA, 22 nt, Homo sapiens
aagcacagcuggacagguuguu

SEQ ID NO: 18232 - RNA, 22 nt, Homo sapiens
uaaucuguuucccagcugagac

SEQ ID NO: 18233 - RNA, 22 nt, Homo sapiens
uagaaacaggcaggacugggag

SEQ ID NO: 18234 - RNA, 22 nt, Homo sapiens
uuucuguucuguucaucuguuc

SEQ ID NO: 18235 - RNA, 22 nt, Homo sapiens
aggacauaagcugggggcagag

SEQ ID NO: 18236 - RNA, 22 nt, Homo sapiens
ucugcuuccgcuccccccucca

SEQ ID NO: 18237 - RNA, 22 nt, Homo sapiens
ucaaugucuccaagagcguuga

SEQ ID NO: 18238 - RNA, 22 nt, Homo sapiens
uagugcuuuuggacagacauug

SEQ ID NO: 18239 - RNA, 22 nt, Homo sapiens
aggaaaggcaagaguggagucu

SEQ ID NO: 18240 - RNA, 22 nt, Homo sapiens
acuuugccuugcuuuuccuggu

SEQ ID NO: 18241 - RNA, 22 nt, Homo sapiens
aaggaagggucuuaggggaucc

SEQ ID NO: 18242 - RNA, 22 nt, Homo sapiens
gauccccuagaccaucccccac

SEQ ID NO: 18243 - RNA, 22 nt, Homo sapiens
gcacccgcauguccugguccuu

SEQ ID NO: 18244 - RNA, 22 nt, Homo sapiens
gcggccaggacagagguggagg

SEQ ID NO: 18245 - RNA, 22 nt, Homo sapiens
gcacccgcauguccugguccuu

SEQ ID NO: 18246 - RNA, 22 nt, Homo sapiens
gcggccaggacagagguggagg

SEQ ID NO: 18247 - RNA, 22 nt, Homo sapiens
aggauuugugggcgcaauucau

SEQ ID NO: 18248 - RNA, 22 nt, Homo sapiens
uggaaauugugccuccagauac

SEQ ID NO: 18249 - RNA, 22 nt, Homo sapiens
uucauuacugcuguuugccacu

SEQ ID NO: 18250 - RNA, 22 nt, Homo sapiens
ugcagggagcaauugugaacau

SEQ ID NO: 18251 - RNA, 22 nt, Homo sapiens
uuauuagaugcuuaccugcgcc

SEQ ID NO: 18252 - RNA, 22 nt, Homo sapiens
cccaaguaagcauccaauaaau

SEQ ID NO: 18253 - RNA, 22 nt, Homo sapiens
ugcaauuguugcuuuuaguugc

SEQ ID NO: 18254 - RNA, 22 nt, Homo sapiens
aacagaaaaguggcauauugca

SEQ ID NO: 18255 - RNA, 22 nt, Homo sapiens
uuaaugccuguuauuuuggaag

SEQ ID NO: 18256 - RNA, 22 nt, Homo sapiens
uccauuguaaauagcauuaaag

SEQ ID NO: 18257 - RNA, 22 nt, Homo sapiens
ucugacaagcaugcuaugugcu

SEQ ID NO: 18258 - RNA, 22 nt, Homo sapiens
acagacuuggcaugcuugcuca

SEQ ID NO: 18259 - RNA, 22 nt, Homo sapiens
uucaaaugggaucuucagcuuu

SEQ ID NO: 18260 - RNA, 18 nt, Homo sapiens
uugaaggucgugacagaa

SEQ ID NO: 18261 - RNA, 22 nt, Homo sapiens
uggcuuuucccauugaaggaaa

SEQ ID NO: 18262 - RNA, 22 nt, Homo sapiens
cuuucaauggaauagccaugga

SEQ ID NO: 18263 - RNA, 22 nt, Homo sapiens
uagaggacauacaaaugaggga

SEQ ID NO: 18264 - RNA, 22 nt, Homo sapiens
uuuauuauuaauguuuuguggc

SEQ ID NO: 18265 - RNA, 22 nt, Homo sapiens
uuuucugcugucuuggagaucu

SEQ ID NO: 18266 - RNA, 22 nt, Homo sapiens
acuucaggauaaacaggaaagg

SEQ ID NO: 18267 - RNA, 22 nt, Homo sapiens
cuaaggaggacagaggggagga

SEQ ID NO: 18268 - RNA, 22 nt, Homo sapiens
ucuucucuuccuccucauacca

SEQ ID NO: 18269 - RNA, 22 nt, Homo sapiens
cgguguccuggauugggguggg

SEQ ID NO: 18270 - RNA, 22 nt, Homo sapiens
guccaggcuccgggaugucgug

SEQ ID NO: 18271 - RNA, 22 nt, Homo sapiens
gagcuggcugguuggggagaag

SEQ ID NO: 18272 - RNA, 22 nt, Homo sapiens
ugaccucagccagcuaaccugc

SEQ ID NO: 18273 - RNA, 22 nt, Homo sapiens
acaggcgugggaaaggcccccg

SEQ ID NO: 18274 - RNA, 22 nt, Homo sapiens
cagggccguccugagccuguga

SEQ ID NO: 18275 - RNA, 22 nt, Homo sapiens
ucuggguuucaugggcacuggc

SEQ ID NO: 18276 - RNA, 22 nt, Homo sapiens
cggucccaucuuaauccaagca

SEQ ID NO: 18277 - RNA, 22 nt, Homo sapiens
auucuugucuccaugcucuagg

SEQ ID NO: 18278 - RNA, 22 nt, Homo sapiens
uaguacuguuggcauggaggug

SEQ ID NO: 18279 - RNA, 22 nt, Homo sapiens
uugcugcuugcucuaaauccau

SEQ ID NO: 18280 - RNA, 22 nt, Homo sapiens
uguggauuagacuggcagcaaa

SEQ ID NO: 18281 - RNA, 20 nt, Homo sapiens
uuuugcgauguguuccuaau

SEQ ID NO: 18282 - RNA, 22 nt, Homo sapiens
uuuugcgauguguuccuaauau

SEQ ID NO: 18283 - RNA, 22 nt, Homo sapiens
ucuguuccauaggaaaggcacu

SEQ ID NO: 18284 - RNA, 22 nt, Homo sapiens
ugugcuuugcuguggggcagug

SEQ ID NO: 18285 - RNA, 22 nt, Homo sapiens
uuugcagaaugcuuuuguucag

SEQ ID NO: 18286 - RNA, 22 nt, Homo sapiens
agauugaagcauugcaacucca

SEQ ID NO: 18287 - RNA, 22 nt, Homo sapiens
gcccugugaagaguuggguucg

SEQ ID NO: 18288 - RNA, 22 nt, Homo sapiens
ugcccacaucccaucacagggc

SEQ ID NO: 18289 - RNA, 22 nt, Homo sapiens
gcccugugaagaguuggguucg

SEQ ID NO: 18290 - RNA, 22 nt, Homo sapiens
ugcccacaucccaucacagggc

SEQ ID NO: 18291 - RNA, 22 nt, Homo sapiens
cugcagaccccaaucuucuugg

SEQ ID NO: 18292 - RNA, 22 nt, Homo sapiens
agaaggucaggggucugcaacc

SEQ ID NO: 18293 - RNA, 22 nt, Homo sapiens
uauggagguucuagaccauguu

SEQ ID NO: 18294 - RNA, 22 nt, Homo sapiens
auggauggaaaccuucaagcag

SEQ ID NO: 18295 - RNA, 22 nt, Homo sapiens
aagacuagcugggcacccgggc

SEQ ID NO: 18296 - RNA, 19 nt, Homo sapiens
ucuggucccagcugcccuu

SEQ ID NO: 18297 - RNA, 22 nt, Homo sapiens
ugacccacaucgccugccugac

SEQ ID NO: 18298 - RNA, 21 nt, Homo sapiens
gugcaggcugggauguggcac

SEQ ID NO: 18299 - RNA, 22 nt, Homo sapiens
guuccaaagacagaaagcuugu

SEQ ID NO: 18300 - RNA, 22 nt, Homo sapiens
cagcuuucacgauuuggaacag

SEQ ID NO: 18301 - RNA, 22 nt, Homo sapiens
agaccagcagugaaggagacau

SEQ ID NO: 18302 - RNA, 22 nt, Homo sapiens
ugucuucucuccugcugcccug

SEQ ID NO: 18303 - RNA, 22 nt, Homo sapiens
ccucccgagccccaauucccuu

SEQ ID NO: 18304 - RNA, 22 nt, Homo sapiens
gcuggagaugagggcugcgcag

SEQ ID NO: 18305 - RNA, 22 nt, Homo sapiens
ugggagugauguuacagcacua

SEQ ID NO: 18306 - RNA, 22 nt, Homo sapiens
ggcuguaaugcgaucccagaau

SEQ ID NO: 18307 - RNA, 22 nt, Homo sapiens
uuccucuuccaccuccuccagc

SEQ ID NO: 18308 - RNA, 22 nt, Homo sapiens
gguguggggaggggagggauag

SEQ ID NO: 18309 - RNA, 22 nt, Homo sapiens
gggcuacaacacaggacccggg

SEQ ID NO: 18310 - RNA, 21 nt, Homo sapiens
ucgugucuuguguugcagccg

SEQ ID NO: 18311 - RNA, 22 nt, Homo sapiens
uguuaucauuaggcucaacaug

SEQ ID NO: 18312 - RNA, 22 nt, Homo sapiens
ugucaugcuuuugauggcauua

SEQ ID NO: 18313 - RNA, 22 nt, Homo sapiens
ucccccucagugcuucaguaac

SEQ ID NO: 18314 - RNA, 22 nt, Homo sapiens
cugacucacuucagaggggggc

SEQ ID NO: 18315 - RNA, 22 nt, Homo sapiens
aacugagccggccuugugucug

SEQ ID NO: 18316 - RNA, 22 nt, Homo sapiens
cggacgcagggccccgauucca

SEQ ID NO: 18317 - RNA, 22 nt, Homo sapiens
aggcuuugcagcugcucuuaga

SEQ ID NO: 18318 - RNA, 22 nt, Homo sapiens
ucuuugaagcacugugagcucc

SEQ ID NO: 18319 - RNA, 22 nt, Homo sapiens
ugggggguggggagaaugggca

SEQ ID NO: 18320 - RNA, 22 nt, Homo sapiens
uccuuuuucuuucccuccuccc

SEQ ID NO: 18321 - RNA, 22 nt, Homo sapiens
gggauuccgagguguuuccauu

SEQ ID NO: 18322 - RNA, 22 nt, Homo sapiens
acacagaggacucgccauggag

SEQ ID NO: 18323 - RNA, 22 nt, Homo sapiens
agagccauauccuugaggcugc

SEQ ID NO: 18324 - RNA, 22 nt, Homo sapiens
cagcugcggaugggcaucaggc

SEQ ID NO: 18325 - RNA, 22 nt, Homo sapiens
uuguguccuuccagggaaguca

SEQ ID NO: 18326 - RNA, 22 nt, Homo sapiens
cuucuccaggaggauuuacaaa

SEQ ID NO: 18327 - RNA, 22 nt, Homo sapiens
uucaggaagauuuggaaaagaa

SEQ ID NO: 18328 - RNA, 22 nt, Homo sapiens
uucucccaaacucuuccugcuu

SEQ ID NO: 18329 - RNA, 22 nt, Homo sapiens
caaacaugaccuggcaguguag

SEQ ID NO: 18330 - RNA, 22 nt, Homo sapiens
uacacugucuaggucugcuuug

SEQ ID NO: 18331 - RNA, 22 nt, Homo sapiens
cacauuguuuggccucucuggc

SEQ ID NO: 18332 - RNA, 22 nt, Homo sapiens
uaaaaaggcuaaauaauguuac

SEQ ID NO: 18333 - RNA, 22 nt, Homo sapiens
uugacagaaccaaaaagggccu

SEQ ID NO: 18334 - RNA, 22 nt, Homo sapiens
gaucuuuuugguuuugucacag

SEQ ID NO: 18335 - RNA, 22 nt, Homo sapiens
agggacaggaggagcgccaggc

SEQ ID NO: 18336 - RNA, 22 nt, Homo sapiens
ccuggugccuucugguucgcug

SEQ ID NO: 18337 - RNA, 22 nt, Homo sapiens
uucacagaauuggagcaucuua

SEQ ID NO: 18338 - RNA, 22 nt, Homo sapiens
agaugcucagggcugugacauu

SEQ ID NO: 18339 - RNA, 22 nt, Homo sapiens
cacaucaucaacugugccugca

SEQ ID NO: 18340 - RNA, 22 nt, Homo sapiens
gucacacacaguugaugagugu

SEQ ID NO: 18341 - RNA, 22 nt, Homo sapiens
uuucuguggccagucacuggag

SEQ ID NO: 18342 - RNA, 22 nt, Homo sapiens
uaguugacuggccaugguaagc

SEQ ID NO: 18343 - RNA, 22 nt, Homo sapiens
gacuacaacucccagugugcac

SEQ ID NO: 18344 - RNA, 22 nt, Homo sapiens
uguaccuugggaguuguagucc

SEQ ID NO: 18345 - RNA, 22 nt, Homo sapiens
uggaagagacugugguucccca

SEQ ID NO: 18346 - RNA, 22 nt, Homo sapiens
ugaggguucacacucucccacc

SEQ ID NO: 18347 - RNA, 22 nt, Homo sapiens
ucauggaugauuagaugugggg

SEQ ID NO: 18348 - RNA, 22 nt, Homo sapiens
cucccagaucuucagcaugaac

SEQ ID NO: 18349 - RNA, 22 nt, Homo sapiens
uuguuccauccagggcaguugg

SEQ ID NO: 18350 - RNA, 22 nt, Homo sapiens
ucucuguaucugggugcugcaa

SEQ ID NO: 18351 - RNA, 22 nt, Homo sapiens
uagagagacugaguacuuuucc

SEQ ID NO: 18352 - RNA, 20 nt, Homo sapiens
aaaaguacuggguuuccaga

SEQ ID NO: 18353 - RNA, 22 nt, Homo sapiens
ucuuagcauuucugguacugua

SEQ ID NO: 18354 - RNA, 22 nt, Homo sapiens
aguuccagaaauguuaauauca

SEQ ID NO: 18355 - RNA, 22 nt, Homo sapiens
gaggguguggagguucagggca

SEQ ID NO: 18356 - RNA, 22 nt, Homo sapiens
cuagagccacccacaccugcac

SEQ ID NO: 18357 - RNA, 22 nt, Homo sapiens
ugagcugugauugcaugcaggu

SEQ ID NO: 18358 - RNA, 22 nt, Homo sapiens
uaccuuugugccacacagcucg

SEQ ID NO: 18359 - RNA, 22 nt, Homo sapiens
gcagggggcggaggccgcugug

SEQ ID NO: 18360 - RNA, 22 nt, Homo sapiens
ugggcggccccugccugcuccg

SEQ ID NO: 18361 - RNA, 22 nt, Homo sapiens
uccuccccgcccccucugccgg

SEQ ID NO: 18362 - RNA, 22 nt, Homo sapiens
gcggagcgggucggggagggaa

SEQ ID NO: 18363 - RNA, 22 nt, Homo sapiens
uggcagcaggagaaggugcccu

SEQ ID NO: 18364 - RNA, 22 nt, Homo sapiens
gcagcuccuccugucaucuguc

SEQ ID NO: 18365 - RNA, 22 nt, Homo sapiens
ccuuuuucggaauccggcagcu

SEQ ID NO: 18366 - RNA, 22 nt, Homo sapiens
ugcuagauucagcaggaagggg

SEQ ID NO: 18367 - RNA, 22 nt, Homo sapiens
uaaggcagugguccuccaaugc

SEQ ID NO: 18368 - RNA, 22 nt, Homo sapiens
ugguggggucacgguccuucag

SEQ ID NO: 18369 - RNA, 22 nt, Homo sapiens
uaaggcaaugguccuccaaugc

SEQ ID NO: 18370 - RNA, 22 nt, Homo sapiens
uuguggggucgggguccuuugg

SEQ ID NO: 18371 - RNA, 22 nt, Homo sapiens
uaaggcaaugguccuccaaugc

SEQ ID NO: 18372 - RNA, 22 nt, Homo sapiens
uuguggggucgggguccuucgg

SEQ ID NO: 18373 - RNA, 22 nt, Homo sapiens
uugaaauaagaggauugcuaau

SEQ ID NO: 18374 - RNA, 22 nt, Homo sapiens
uuagcaguaucaaaucugauuu

SEQ ID NO: 18375 - RNA, 22 nt, Homo sapiens
ucgggggacacuggggcaagag

SEQ ID NO: 18376 - RNA, 22 nt, Homo sapiens
ugcuccagugucuugcuacgga

SEQ ID NO: 18377 - RNA, 22 nt, Homo sapiens
ucgaucaagaagccggaugugg

SEQ ID NO: 18378 - RNA, 18 nt, Homo sapiens
aucugguugcuuggcuga

SEQ ID NO: 18379 - RNA, 22 nt, Homo sapiens
acacagaggaacacugacuugc

SEQ ID NO: 18380 - RNA, 22 nt, Homo sapiens
caagucacuguucuucaaugac

SEQ ID NO: 18381 - RNA, 22 nt, Homo sapiens
ucuacccacaguuugugaggag

SEQ ID NO: 18382 - RNA, 22 nt, Homo sapiens
ucuucauuggcuguggcuggag

SEQ ID NO: 18383 - RNA, 22 nt, Homo sapiens
gccuuucuuugugaagacggaa

SEQ ID NO: 18384 - RNA, 22 nt, Homo sapiens
ucugucuaaaccuacaagagga

SEQ ID NO: 18385 - RNA, 22 nt, Homo sapiens
ugcuuucuggagucugauaaga

SEQ ID NO: 18386 - RNA, 22 nt, Homo sapiens
ugacgugugggacccaggcauu

SEQ ID NO: 18387 - RNA, 22 nt, Homo sapiens
ugcaaagaagaagggaaaggag

SEQ ID NO: 18388 - RNA, 22 nt, Homo sapiens
ugccuuuccuuucuuguugcca

SEQ ID NO: 18389 - RNA, 22 nt, Homo sapiens
uucugacacucucaggaugugg

SEQ ID NO: 18390 - RNA, 22 nt, Homo sapiens
auguccucagaucucaggcugc

SEQ ID NO: 18391 - RNA, 22 nt, Homo sapiens
cugcauuaugagcacuuaaagu

SEQ ID NO: 18392 - RNA, 23 nt, Homo sapiens
uaaagugcuuauagugcagguag

SEQ ID NO: 18393 - RNA, 18 nt, Homo sapiens
acacucaaacugcugaca

SEQ ID NO: 18394 - RNA, 22 nt, Homo sapiens
ucagcagcuccucguaugugua

SEQ ID NO: 18395 - RNA, 22 nt, Homo sapiens
ugcccaagcagggccugucuga

SEQ ID NO: 18396 - RNA, 22 nt, Homo sapiens
uuuuucauuuacaaauauggug

SEQ ID NO: 18397 - RNA, 22 nt, Homo sapiens
caauauuccuaaaugaguaaca

SEQ ID NO: 18398 - RNA, 22 nt, Homo sapiens
uuccuuuuuuggagucuccaug

SEQ ID NO: 18399 - RNA, 22 nt, Homo sapiens
uggagguuccuuaggagggagu

SEQ ID NO: 18400 - RNA, 22 nt, Homo sapiens
ugacauucaucuucaugaguga

SEQ ID NO: 18401 - RNA, 22 nt, Homo sapiens
ucacgagcggagauaaauguca

SEQ ID NO: 18402 - RNA, 22 nt, Homo sapiens
uccauuaucugcuccuaauauu

SEQ ID NO: 18403 - RNA, 22 nt, Homo sapiens
auugugaacagauaaggaaccc

SEQ ID NO: 18404 - RNA, 22 nt, Homo sapiens
ugcugccuucagucucuucaag

SEQ ID NO: 18405 - RNA, 22 nt, Homo sapiens
ccuguagagauugagggcaagu

SEQ ID NO: 18406 - RNA, 22 nt, Homo sapiens
uggaugucacacccaugaugcu

SEQ ID NO: 18407 - RNA, 22 nt, Homo sapiens
gcauagugagguggacagcuag

SEQ ID NO: 18408 - RNA, 22 nt, Homo sapiens
uuuguugcuuuggaugaagaua

SEQ ID NO: 18409 - RNA, 22 nt, Homo sapiens
ucagucucaccaguaacagccu

SEQ ID NO: 18410 - RNA, 22 nt, Homo sapiens
uggggggcggggaggugacggg

SEQ ID NO: 18411 - RNA, 22 nt, Homo sapiens
ucauuccugccccgccucucac

SEQ ID NO: 18412 - RNA, 22 nt, Homo sapiens
uaaauggguguguuugaugaau

SEQ ID NO: 18413 - RNA, 22 nt, Homo sapiens
gauuuccaugcaucaccucauu

SEQ ID NO: 18414 - RNA, 22 nt, Homo sapiens
gcaauuccuuuuuugaagcugg

SEQ ID NO: 18415 - RNA, 20 nt, Homo sapiens
ucccaguuccaagaaagugc

SEQ ID NO: 18416 - RNA, 22 nt, Homo sapiens
caauuuagugugugugauauuu

SEQ ID NO: 18417 - RNA, 21 nt, Homo sapiens
uauugcacauuacuaaguugc

SEQ ID NO: 18418 - RNA, 19 nt, Homo sapiens
auugcacauuacuaaguug

SEQ ID NO: 18419 - RNA, 17 nt, Homo sapiens
cacauuacuaaguugca

SEQ ID NO: 18420 - RNA, 22 nt, Homo sapiens
uugccuagguaccggcagaccc

SEQ ID NO: 18421 - RNA, 22 nt, Homo sapiens
ucugacuggugcuuacuucagu

SEQ ID NO: 18422 - RNA, 22 nt, Homo sapiens
caucuuccugugaagcagugga

SEQ ID NO: 18423 - RNA, 22 nt, Homo sapiens
uccauuuuacagaugaagaaag

SEQ ID NO: 18424 - RNA, 22 nt, Homo sapiens
ucugagugguuaagugagcaua

SEQ ID NO: 18425 - RNA, 22 nt, Homo sapiens
ugcucauuuaaccauuuagaua

SEQ ID NO: 18426 - RNA, 22 nt, Homo sapiens
uccuuuguuugugacuaugaaa

SEQ ID NO: 18427 - RNA, 22 nt, Homo sapiens
ugauuaugauguacauucagag

SEQ ID NO: 18428 - RNA, 22 nt, Homo sapiens
uuaaacagccagugcaaacauu

SEQ ID NO: 18429 - RNA, 22 nt, Homo sapiens
auuguuugcacucugccaguuu

SEQ ID NO: 18430 - RNA, 22 nt, Homo sapiens
accucccucagguucuucccug

SEQ ID NO: 18431 - RNA, 22 nt, Homo sapiens
gggaagaaccuaaaggagguga

SEQ ID NO: 18432 - RNA, 22 nt, Homo sapiens
cagagaaagagagagaguauac

SEQ ID NO: 18433 - RNA, 22 nt, Homo sapiens
uguguuuuucuuuuucucuuug

SEQ ID NO: 18434 - RNA, 22 nt, Homo sapiens
uccaguaccacgugucagggcc

SEQ ID NO: 18435 - RNA, 22 nt, Homo sapiens
ggccugauguggugcuggggcc

SEQ ID NO: 18436 - RNA, 22 nt, Homo sapiens
gcuccaguaacccuuugguguc

SEQ ID NO: 18437 - RNA, 15 nt, Homo sapiens
gaggguuauugaagu

SEQ ID NO: 18438 - RNA, 22 nt, Homo sapiens
ggggaaggggcacggagcggaa

SEQ ID NO: 18439 - RNA, 22 nt, Homo sapiens
cucuuucuggucucuucccucc

SEQ ID NO: 18440 - RNA, 22 nt, Homo sapiens
cacucaauaaauagucauuggu

SEQ ID NO: 18441 - RNA, 22 nt, Homo sapiens
ccagugaauauuuauugaguuc

SEQ ID NO: 18442 - RNA, 22 nt, Homo sapiens
aauuuagugccucugcgucucu

SEQ ID NO: 18443 - RNA, 22 nt, Homo sapiens
agacagcagugguguuuuaaau

SEQ ID NO: 18444 - RNA, 22 nt, Homo sapiens
ugugcacugugacuggcagggg

SEQ ID NO: 18445 - RNA, 22 nt, Homo sapiens
uuuucugccccacauggugcgc

SEQ ID NO: 18446 - RNA, 22 nt, Homo sapiens
ugcagcaggugcucacuaaaca

SEQ ID NO: 18447 - RNA, 22 nt, Homo sapiens
uuuaguaggcaccuacugugug

SEQ ID NO: 18448 - RNA, 22 nt, Homo sapiens
gcucgcgcccggagcccugccc

SEQ ID NO: 18449 - RNA, 17 nt, Homo sapiens
gagcuccgggcgccggc

SEQ ID NO: 18450 - RNA, 22 nt, Homo sapiens
uugauccaagugcggaacuccc

SEQ ID NO: 18451 - RNA, 22 nt, Homo sapiens
aguguuguauagaaaucaauga

SEQ ID NO: 18452 - RNA, 22 nt, Homo sapiens
ccucccucagguucuucccuga

SEQ ID NO: 18453 - RNA, 22 nt, Homo sapiens
gggaagaaccuaaaggagauga

SEQ ID NO: 18454 - RNA, 22 nt, Homo sapiens
cgggcucugggcuccccagccc

SEQ ID NO: 18455 - RNA, 21 nt, Homo sapiens
ugggggacucagagccuccgc

SEQ ID NO: 18456 - RNA, 22 nt, Homo sapiens
agucagagacagaccuagggga

SEQ ID NO: 18457 - RNA, 18 nt, Homo sapiens
ugggcucugucucuaacu

SEQ ID NO: 18458 - RNA, 22 nt, Homo sapiens
uuuuaugccugugacagcuuca

SEQ ID NO: 18459 - RNA, 22 nt, Homo sapiens
gagcaauacauggcaugaaauu

SEQ ID NO: 18460 - RNA, 22 nt, Homo sapiens
ucagagucccucaguggagcgu

SEQ ID NO: 18461 - RNA, 22 nt, Homo sapiens
ugguccaguggggaucucugau

SEQ ID NO: 18462 - RNA, 22 nt, Homo sapiens
acgcagggcgggaggcgaugga

SEQ ID NO: 18463 - RNA, 22 nt, Homo sapiens
ugcgccuccugcucguggugug

SEQ ID NO: 18464 - RNA, 22 nt, Homo sapiens
ugaggagaacagauucuguuuu

SEQ ID NO: 18465 - RNA, 22 nt, Homo sapiens
aaacagaauuggucucuuuaau

SEQ ID NO: 18466 - RNA, 22 nt, Homo sapiens
caccauuagagcagaauggaga

SEQ ID NO: 18467 - RNA, 20 nt, Homo sapiens
ggcuccauguucuaguugug

SEQ ID NO: 18468 - RNA, 22 nt, Homo sapiens
uguaccuuaugugaucaugggu

SEQ ID NO: 18469 - RNA, 22 nt, Homo sapiens
ugguggcucauauguagucuag

SEQ ID NO: 18470 - RNA, 22 nt, Homo sapiens
uauuuccagucuccauucuuuu

SEQ ID NO: 18471 - RNA, 22 nt, Homo sapiens
agaacugagacugggagguauu

SEQ ID NO: 18472 - RNA, 22 nt, Homo sapiens
caagaagucuccugcagucucu

SEQ ID NO: 18473 - RNA, 22 nt, Homo sapiens
gauguggggacugacuucuuug

SEQ ID NO: 18474 - RNA, 22 nt, Homo sapiens
ccugugagucacugaguuuugg

SEQ ID NO: 18475 - RNA, 22 nt, Homo sapiens
aacucaguuguacauucacaga

SEQ ID NO: 18476 - RNA, 22 nt, Homo sapiens
ccauaaugagcuuagguuuuua

SEQ ID NO: 18477 - RNA, 22 nt, Homo sapiens
aagaucuguaauucagcauggc

SEQ ID NO: 18478 - RNA, 22 nt, Homo sapiens
cagcugugaugcuguaggagac

SEQ ID NO: 18479 - RNA, 22 nt, Homo sapiens
uucuacucauuuuacagcuuga

SEQ ID NO: 18480 - RNA, 22 nt, Homo sapiens
aagguccuggagugggccauag

SEQ ID NO: 18481 - RNA, 22 nt, Homo sapiens
uaggcucaacuucagaaucugu

SEQ ID NO: 18482 - RNA, 22 nt, Homo sapiens
uaccccauugugacggagcacu

SEQ ID NO: 18483 - RNA, 22 nt, Homo sapiens
uucuuucacagauggggagaaa

SEQ ID NO: 18484 - RNA, 22 nt, Homo sapiens
agggccuguuuucccgguggcu

SEQ ID NO: 18485 - RNA, 22 nt, Homo sapiens
ucccccggguaaagcagcccau

SEQ ID NO: 18486 - RNA, 22 nt, Homo sapiens
agggccuguuuucccgguggcu

SEQ ID NO: 18487 - RNA, 22 nt, Homo sapiens
ucccccggguaaagcagcccau

SEQ ID NO: 18488 - RNA, 22 nt, Homo sapiens
uacauucaauggaaaccagaug

SEQ ID NO: 18489 - RNA, 22 nt, Homo sapiens
cucucuugguuucuuggugaag

SEQ ID NO: 18490 - RNA, 22 nt, Homo sapiens
caugcugacuaccaccagacgc

SEQ ID NO: 18491 - RNA, 22 nt, Homo sapiens
ugcuggaaugugacguuggcau

SEQ ID NO: 18492 - RNA, 22 nt, Homo sapiens
agggugcacaaaguuuagccac

SEQ ID NO: 18493 - RNA, 22 nt, Homo sapiens
ugccaaguauuguguccugcuc

SEQ ID NO: 18494 - RNA, 22 nt, Homo sapiens
ugguuagggggcgggaagggcg

SEQ ID NO: 18495 - RNA, 22 nt, Homo sapiens
cccgucgcccccgcagucacgc

SEQ ID NO: 18496 - RNA, 22 nt, Homo sapiens
aauugcacuuuagcaaugguga

SEQ ID NO: 18497 - RNA, 22 nt, Homo sapiens
uacuguugcuaauaugcaacuc

SEQ ID NO: 18498 - RNA, 22 nt, Homo sapiens
ggacgacgucacgggggccucu

SEQ ID NO: 18499 - RNA, 22 nt, Homo sapiens
auuucaguccccgggugucucc

SEQ ID NO: 18500 - RNA, 22 nt, Homo sapiens
aggguaaguuggagagggaggg

SEQ ID NO: 18501 - RNA, 22 nt, Homo sapiens
ucuuucuccaugccaagcccuu

SEQ ID NO: 18502 - RNA, 22 nt, Homo sapiens
uggaguucagauccugugccua

SEQ ID NO: 18503 - RNA, 22 nt, Homo sapiens
gccacagauuugaccacuccag

SEQ ID NO: 18504 - RNA, 22 nt, Homo sapiens
caugguuuuaaggucacugccg

SEQ ID NO: 18505 - RNA, 22 nt, Homo sapiens
guaaugaccacaaaacuauaca

SEQ ID NO: 18506 - RNA, 22 nt, Homo sapiens
uuccacccaaucucauugccuu

SEQ ID NO: 18507 - RNA, 22 nt, Homo sapiens
ggccugggacaggguggaacac

SEQ ID NO: 18508 - RNA, 22 nt, Homo sapiens
agaaggaaaauaagcuuuucaa

SEQ ID NO: 18509 - RNA, 22 nt, Homo sapiens
acaaaacuuguuuuccuuucuu

SEQ ID NO: 18510 - RNA, 22 nt, Homo sapiens
uuccucuccugcucucagucca

SEQ ID NO: 18511 - RNA, 21 nt, Homo sapiens
acugagggaaugggggaugag

SEQ ID NO: 18512 - RNA, 22 nt, Homo sapiens
uccucucuugcucucaguccau

SEQ ID NO: 18513 - RNA, 21 nt, Homo sapiens
acugagggaaugggggaugag

SEQ ID NO: 18514 - RNA, 22 nt, Homo sapiens
ugcagggguccuccccacgcug

SEQ ID NO: 18515 - RNA, 22 nt, Homo sapiens
gcugggguggacuccugccuac

SEQ ID NO: 18516 - RNA, 22 nt, Homo sapiens
cggaggugaagagaaggcgccu

SEQ ID NO: 18517 - RNA, 22 nt, Homo sapiens
gcuggggcccuugcugccuccc

SEQ ID NO: 18518 - RNA, 22 nt, Homo sapiens
ugcagcgagccuugcucuauca

SEQ ID NO: 18519 - RNA, 22 nt, Homo sapiens
aaagagcaguggcuccaugcac

SEQ ID NO: 18520 - RNA, 22 nt, Homo sapiens
ccucucaccucccuuagucccu

SEQ ID NO: 18521 - RNA, 22 nt, Homo sapiens
ugggagugagggaggaaagggg

SEQ ID NO: 18522 - RNA, 22 nt, Homo sapiens
acaccgcaaauaucuucugauc

SEQ ID NO: 18523 - RNA, 21 nt, Homo sapiens
ugugaucagauuuuguguugu

SEQ ID NO: 18524 - RNA, 21 nt, Homo sapiens
aucacauugccagggauuucc

SEQ ID NO: 18525 - RNA, 22 nt, Homo sapiens
ugggguuccuggggaugggauu

SEQ ID NO: 18526 - RNA, 21 nt, Homo sapiens
aaucacauugccagggauuuc

SEQ ID NO: 18527 - RNA, 20 nt, Homo sapiens
aucacauugccagggauuuc

SEQ ID NO: 18528 - RNA, 22 nt, Homo sapiens
ucuugaaugacugugauuuucu

SEQ ID NO: 18529 - RNA, 22 nt, Homo sapiens
gcuauuauagucucucaagaau

SEQ ID NO: 18530 - RNA, 22 nt, Homo sapiens
acauuccugccuccccggagau

SEQ ID NO: 18531 - RNA, 22 nt, Homo sapiens
ucgccagggggccgggaaugca

SEQ ID NO: 18532 - RNA, 22 nt, Homo sapiens
uuacaugauaauuauacuuaag

SEQ ID NO: 18533 - RNA, 22 nt, Homo sapiens
ucaggaauaauuaucauaugau

SEQ ID NO: 18534 - RNA, 22 nt, Homo sapiens
ggccgguucaagggcagucaga

SEQ ID NO: 18535 - RNA, 17 nt, Homo sapiens
cugucuacgaaccaguc

SEQ ID NO: 18536 - RNA, 22 nt, Homo sapiens
ugguaacucuaauuuggguaag

SEQ ID NO: 18537 - RNA, 22 nt, Homo sapiens
ugccaaauuugaaauaccaucu

SEQ ID NO: 18538 - RNA, 22 nt, Homo sapiens
ucccacuguccucgcaggggau

SEQ ID NO: 18539 - RNA, 22 nt, Homo sapiens
cccauggaguacaguugggcaa

SEQ ID NO: 18540 - RNA, 22 nt, Homo sapiens
uaaaaugcucuucugucauugu

SEQ ID NO: 18541 - RNA, 22 nt, Homo sapiens
acugacaggagagcauuuugac

SEQ ID NO: 18542 - RNA, 22 nt, Homo sapiens
agaucagaaggugauuguggcu

SEQ ID NO: 18543 - RNA, 22 nt, Homo sapiens
ccacagcacugccuggucagaa

SEQ ID NO: 18544 - RNA, 21 nt, Homo sapiens
agaucagaaggugauuguggc

SEQ ID NO: 18545 - RNA, 19 nt, Homo sapiens
aucagaaggugauuguggc

SEQ ID NO: 18546 - RNA, 20 nt, Homo sapiens
aucagaaggugauuguggcu

SEQ ID NO: 18547 - RNA, 21 nt, Homo sapiens
ccacagcacugccuggucaga

SEQ ID NO: 18548 - RNA, 22 nt, Homo sapiens
gaggcugcucuauucauguagg

SEQ ID NO: 18549 - RNA, 22 nt, Homo sapiens
caugaauggaguggccuggugc

SEQ ID NO: 18550 - RNA, 22 nt, Homo sapiens
ucgaugggaaaugaugugugau

SEQ ID NO: 18551 - RNA, 22 nt, Homo sapiens
uauacaucauuucccaucaauc

SEQ ID NO: 18552 - RNA, 22 nt, Homo sapiens
agaaauuauccuugguguguuc

SEQ ID NO: 18553 - RNA, 22 nt, Homo sapiens
aucauacaaggacaauuucuuu

SEQ ID NO: 18554 - RNA, 22 nt, Homo sapiens
gggucgccuugucucuuuaccc

SEQ ID NO: 18555 - RNA, 22 nt, Homo sapiens
uccgcagggauaggggaugccc

SEQ ID NO: 18556 - RNA, 22 nt, Homo sapiens
ggcaggggcugggccugcagcu

SEQ ID NO: 18557 - RNA, 23 nt, Homo sapiens
ugucugcccgcaugccugccucu

SEQ ID NO: 18558 - RNA, 22 nt, Homo sapiens
caggcaggggauggggaggaga

SEQ ID NO: 18559 - RNA, 22 nt, Homo sapiens
uccucucuucccccagccuauc

SEQ ID NO: 18560 - RNA, 22 nt, Homo sapiens
ggaugauaggauagggaaggga

SEQ ID NO: 18561 - RNA, 22 nt, Homo sapiens
uuacuuuucauuuauuacuuuu

SEQ ID NO: 18562 - RNA, 22 nt, Homo sapiens
gagguaugggugagagagaggc

SEQ ID NO: 18563 - RNA, 22 nt, Homo sapiens
ugucuuuucacuggugccuucu

SEQ ID NO: 18564 - RNA, 22 nt, Homo sapiens
ugcugcccuguuuggacagccc

SEQ ID NO: 18565 - RNA, 22 nt, Homo sapiens
gcacguuguccagcugggcauc

SEQ ID NO: 18566 - RNA, 22 nt, Homo sapiens
gacaacuguccauguccauugg

SEQ ID NO: 18567 - RNA, 22 nt, Homo sapiens
aauagacauggacaauugucca

SEQ ID NO: 18568 - RNA, 22 nt, Homo sapiens
uucuucuugaguaacaucagau

SEQ ID NO: 18569 - RNA, 22 nt, Homo sapiens
ugauucaacuuggcaggagacu

SEQ ID NO: 18570 - RNA, 22 nt, Homo sapiens
uucuucuugaguaacaucagau

SEQ ID NO: 18571 - RNA, 22 nt, Homo sapiens
ugauucaacuuggcaggagacu

SEQ ID NO: 18572 - RNA, 22 nt, Homo sapiens
ggcccaccuuccccgguguaca

SEQ ID NO: 18573 - RNA, 22 nt, Homo sapiens
uauauuccagaggguagggcug

SEQ ID NO: 18574 - RNA, 22 nt, Homo sapiens
caugcugccaccugugguaguc

SEQ ID NO: 18575 - RNA, 22 nt, Homo sapiens
ucaccaccagguggcaguauug

SEQ ID NO: 18576 - RNA, 22 nt, Homo sapiens
uaaacguggauguacuugcuuu

SEQ ID NO: 18577 - RNA, 23 nt, Homo sapiens
uaagugcuuccauguuuugguga

SEQ ID NO: 18578 - RNA, 22 nt, Homo sapiens
caagguggguuuugcauugucc

SEQ ID NO: 18579 - RNA, 22 nt, Homo sapiens
ugggauggcaaagucaucuuca

SEQ ID NO: 18580 - RNA, 22 nt, Homo sapiens
uuauccagccuucaaguucagu

SEQ ID NO: 18581 - RNA, 22 nt, Homo sapiens
aaaugaacuaaagcugauuuag

SEQ ID NO: 18582 - RNA, 22 nt, Homo sapiens
uguucuugcacugccugccaag

SEQ ID NO: 18583 - RNA, 22 nt, Homo sapiens
ugguaggaaagugugggaggaa

SEQ ID NO: 18584 - RNA, 22 nt, Homo sapiens
accuuggcucuagacugcuuac

SEQ ID NO: 18585 - RNA, 21 nt, Homo sapiens
uaacagucuccagucacggcc

SEQ ID NO: 18586 - RNA, 22 nt, Homo sapiens
ugcauugcuguugcauugcacg

SEQ ID NO: 18587 - RNA, 22 nt, Homo sapiens
ugcagugccucggcagugcagc

SEQ ID NO: 18588 - RNA, 22 nt, Homo sapiens
cagcccagcccgcugggaggug

SEQ ID NO: 18589 - RNA, 22 nt, Homo sapiens
uucccacgggucaggggcugag

SEQ ID NO: 18590 - RNA, 22 nt, Homo sapiens
gauuccugcagaaucacgcagc

SEQ ID NO: 18591 - RNA, 22 nt, Homo sapiens
uguguguuucugugggaguguu

SEQ ID NO: 18592 - RNA, 22 nt, Homo sapiens
ccagcugggggcuggccuuggc

SEQ ID NO: 18593 - RNA, 22 nt, Homo sapiens
cugcugggcugguccuucugag

SEQ ID NO: 18594 - RNA, 22 nt, Homo sapiens
ugucuaugagagugggcuuugc

SEQ ID NO: 18595 - RNA, 22 nt, Homo sapiens
ccugaagcccauucugaggcuc

SEQ ID NO: 18596 - RNA, 22 nt, Homo sapiens
uauggugggagaggaagauuuc

SEQ ID NO: 18597 - RNA, 22 nt, Homo sapiens
aguuuucugaguccuauaguau

SEQ ID NO: 18598 - RNA, 22 nt, Homo sapiens
uccccuagauacgaauuuguga

SEQ ID NO: 18599 - RNA, 22 nt, Homo sapiens
caaauucggaucuacaggguau

SEQ ID NO: 18600 - RNA, 22 nt, Homo sapiens
agcuucccgggcagcugggcag

SEQ ID NO: 18601 - RNA, 22 nt, Homo sapiens
cccagcugucugugaacgcugg

SEQ ID NO: 18602 - RNA, 22 nt, Homo sapiens
cagguggaagaagggccgaguc

SEQ ID NO: 18603 - RNA, 22 nt, Homo sapiens
uggcugauccucuucauuucuc

SEQ ID NO: 18604 - RNA, 22 nt, Homo sapiens
ugagcauccggagaggugauuc

SEQ ID NO: 18605 - RNA, 22 nt, Homo sapiens
auccgacuccccugugcucagu

SEQ ID NO: 18606 - RNA, 22 nt, Homo sapiens
ugcagggaagggcaugcuauug

SEQ ID NO: 18607 - RNA, 22 nt, Homo sapiens
uggugaugcuuuucugauuugu

SEQ ID NO: 18608 - RNA, 22 nt, Homo sapiens
uaccugcaguggcagcuucauu

SEQ ID NO: 18609 - RNA, 22 nt, Homo sapiens
ugaagcaguagcuccaggagug

SEQ ID NO: 18610 - RNA, 22 nt, Homo sapiens
caugaaaucaagcgugggugag

SEQ ID NO: 18611 - RNA, 22 nt, Homo sapiens
gacccauacuugguuucagagg

SEQ ID NO: 18612 - RNA, 22 nt, Homo sapiens
acccuccccucaccccaauucc

SEQ ID NO: 18613 - RNA, 22 nt, Homo sapiens
agaugaggugagguggggaggg

SEQ ID NO: 18614 - RNA, 22 nt, Homo sapiens
gcacucagcccuggcuguuggc

SEQ ID NO: 18615 - RNA, 22 nt, Homo sapiens
gacagccacaggcugagggaua

SEQ ID NO: 18616 - RNA, 22 nt, Homo sapiens
uugacuuacuguuugcuggcug

SEQ ID NO: 18617 - RNA, 22 nt, Homo sapiens
gcuuguaugauagagucagccu

SEQ ID NO: 18618 - RNA, 22 nt, Homo sapiens
ugaagaagggggggaagggcgu

SEQ ID NO: 18619 - RNA, 22 nt, Homo sapiens
cuuggcccaucuccucccuccu

SEQ ID NO: 18620 - RNA, 22 nt, Homo sapiens
uuucccaaauguaaauuccauc

SEQ ID NO: 18621 - RNA, 22 nt, Homo sapiens
ugggguucacuccugggaaagg

SEQ ID NO: 18622 - RNA, 22 nt, Homo sapiens
uucugagauccugcacaugugg

SEQ ID NO: 18623 - RNA, 22 nt, Homo sapiens
aauaagcguguggggugucaug

SEQ ID NO: 18624 - RNA, 22 nt, Homo sapiens
uacucauauugauugcauuuau

SEQ ID NO: 18625 - RNA, 22 nt, Homo sapiens
gauaauucuucaaugugggaca

SEQ ID NO: 18626 - RNA, 22 nt, Homo sapiens
ccucccucccgcccuccuuuug

SEQ ID NO: 18627 - RNA, 22 nt, Homo sapiens
gacagggggugggagggggcau

SEQ ID NO: 18628 - RNA, 22 nt, Homo sapiens
gggcauugggugauugggccug

SEQ ID NO: 18629 - RNA, 17 nt, Homo sapiens
cccucacucaauuuucc

SEQ ID NO: 18630 - RNA, 22 nt, Homo sapiens
aggggccgucccuguccccgcu

SEQ ID NO: 18631 - RNA, 22 nt, Homo sapiens
uggggaaggcaggcccccgcca

SEQ ID NO: 18632 - RNA, 22 nt, Homo sapiens
caguggccucaggcccucugcc

SEQ ID NO: 18633 - RNA, 22 nt, Homo sapiens
ugagggugccugggccaucucu

SEQ ID NO: 18634 - RNA, 22 nt, Homo sapiens
ggugcucaaauaagacuuguug

SEQ ID NO: 18635 - RNA, 22 nt, Homo sapiens
acaaauacuuauugaggaccug

SEQ ID NO: 18636 - RNA, 22 nt, Homo sapiens
gcaagcccuugccuaccacacu

SEQ ID NO: 18637 - RNA, 22 nt, Homo sapiens
gucugguagccaaaugcuguca

SEQ ID NO: 18638 - RNA, 22 nt, Homo sapiens
cgagguugcccuuuguauauuc

SEQ ID NO: 18639 - RNA, 22 nt, Homo sapiens
uauacaagggcaagcucucugu

SEQ ID NO: 18640 - RNA, 22 nt, Homo sapiens
ugaaaacauuggcuucuaaaag

SEQ ID NO: 18641 - RNA, 22 nt, Homo sapiens
gacauuagagcuaaguuuuugg

SEQ ID NO: 18642 - RNA, 22 nt, Homo sapiens
gagcaggaauagaagcucuguu

SEQ ID NO: 18643 - RNA, 20 nt, Homo sapiens
uagaccuucuauuuucucuc

SEQ ID NO: 18644 - RNA, 22 nt, Homo sapiens
gacagcuggccuggcggccucc

SEQ ID NO: 18645 - RNA, 22 nt, Homo sapiens
gucuguuagggcggcugucuug

SEQ ID NO: 18646 - RNA, 22 nt, Homo sapiens
gacagcuggccuggcggccucc

SEQ ID NO: 18647 - RNA, 22 nt, Homo sapiens
gucuguuagggcggcugucuug

SEQ ID NO: 18648 - RNA, 22 nt, Homo sapiens
cauaugcaaaggggaaggcuuu

SEQ ID NO: 18649 - RNA, 21 nt, Homo sapiens
ccuucccuguugcauacagua

SEQ ID NO: 18650 - RNA, 22 nt, Homo sapiens
cauaugcaaaggggaaggcuuu

SEQ ID NO: 18651 - RNA, 21 nt, Homo sapiens
ccuucccuguugcauacagua

SEQ ID NO: 18652 - RNA, 22 nt, Homo sapiens
cgccagugggagucgggcccag

SEQ ID NO: 18653 - RNA, 18 nt, Homo sapiens
ccgacucucccgcccgcg

SEQ ID NO: 18654 - RNA, 22 nt, Homo sapiens
uuuaacagggagaaaaucuaau

SEQ ID NO: 18655 - RNA, 22 nt, Homo sapiens
uacuggcauuuuuccauuaaau

SEQ ID NO: 18656 - RNA, 22 nt, Homo sapiens
cagagccggccugcuguggagg

SEQ ID NO: 18657 - RNA, 22 nt, Homo sapiens
uccccacggcuggcgggcucag

SEQ ID NO: 18658 - RNA, 22 nt, Homo sapiens
ucacaccuaugaauuccuggag

SEQ ID NO: 18659 - RNA, 22 nt, Homo sapiens
uacuccagggucaaugguggaa

SEQ ID NO: 18660 - RNA, 22 nt, Homo sapiens
ugcagaaguccaggacguaaug

SEQ ID NO: 18661 - RNA, 22 nt, Homo sapiens
ccagaguccagggcucugcggg

SEQ ID NO: 18662 - RNA, 22 nt, Homo sapiens
ucccacugcccugagcuuggag

SEQ ID NO: 18663 - RNA, 21 nt, Homo sapiens
uccaagcaggggcagcaagga

SEQ ID NO: 18664 - RNA, 22 nt, Homo sapiens
ugcaaauggcaguuuuguuauu

SEQ ID NO: 18665 - RNA, 19 nt, Homo sapiens
ugacaagcugccauaacac

SEQ ID NO: 18666 - RNA, 22 nt, Homo sapiens
cauuacuauuugccucaaguga

SEQ ID NO: 18667 - RNA, 22 nt, Homo sapiens
acucgaggcauauauuaauagc

SEQ ID NO: 18668 - RNA, 22 nt, Homo sapiens
ccuaagagcaacggggugcauu

SEQ ID NO: 18669 - RNA, 22 nt, Homo sapiens
agcggcacccaguugugccuag

SEQ ID NO: 18670 - RNA, 22 nt, Homo sapiens
uuaugagcccacuggugaaucc

SEQ ID NO: 18671 - RNA, 22 nt, Homo sapiens
ucaccagugggcugauaguccc

SEQ ID NO: 18672 - RNA, 22 nt, Homo sapiens
uuagggucgaagccccacuccc

SEQ ID NO: 18673 - RNA, 22 nt, Homo sapiens
agauggagccagggcccuaacc

SEQ ID NO: 18674 - RNA, 22 nt, Homo sapiens
gccacacgggguaauaauaacu

SEQ ID NO: 18675 - RNA, 21 nt, Homo sapiens
guuauuuuuaugccgcaagcc

SEQ ID NO: 18676 - RNA, 22 nt, Homo sapiens
agggcuggucugaggggauguu

SEQ ID NO: 18677 - RNA, 22 nt, Homo sapiens
auuccugaucgggucaggccug

SEQ ID NO: 18678 - RNA, 22 nt, Homo sapiens
ggcgggagcagggaguggagac

SEQ ID NO: 18679 - RNA, 22 nt, Homo sapiens
agccccuccccuuucuccgccc

SEQ ID NO: 18680 - RNA, 22 nt, Homo sapiens
guuuccccagccuagagguaug

SEQ ID NO: 18681 - RNA, 22 nt, Homo sapiens
acucuguggcacgggggaaguc

SEQ ID NO: 18682 - RNA, 22 nt, Homo sapiens
ugggccuaagcuugugucuaca

SEQ ID NO: 18683 - RNA, 22 nt, Homo sapiens
uggcaacaaauuaguucugggg

SEQ ID NO: 18684 - RNA, 22 nt, Homo sapiens
aagcaccuccagagcuugaagc

SEQ ID NO: 18685 - RNA, 21 nt, Homo sapiens
ucaagccagggggcguuuuuc

SEQ ID NO: 18686 - RNA, 21 nt, Homo sapiens
uuucaagccagggggcguuuu

SEQ ID NO: 18687 - RNA, 22 nt, Homo sapiens
uuucaagccagggggcguuuuu

SEQ ID NO: 18688 - RNA, 23 nt, Homo sapiens
uuucaagccagggggcguuuuuc

SEQ ID NO: 18689 - RNA, 22 nt, Homo sapiens
aagcucacagucuaguuguguu

SEQ ID NO: 18690 - RNA, 22 nt, Homo sapiens
acccccagcuagauuguaagcu

SEQ ID NO: 18691 - RNA, 22 nt, Homo sapiens
gcaccacugcugccccugcccc

SEQ ID NO: 18692 - RNA, 22 nt, Homo sapiens
gcagaggcagugguggggcagc

SEQ ID NO: 18693 - RNA, 22 nt, Homo sapiens
gcaccacugcugccccugcccc

SEQ ID NO: 18694 - RNA, 22 nt, Homo sapiens
gcagaggcagugguggggcagc

SEQ ID NO: 18695 - RNA, 22 nt, Homo sapiens
uuucugcagaacuacagagccu

SEQ ID NO: 18696 - RNA, 22 nt, Homo sapiens
cuguguguuucugucggagugu

SEQ ID NO: 18697 - RNA, 22 nt, Homo sapiens
uggggagaggggaggauugggg

SEQ ID NO: 18698 - RNA, 22 nt, Homo sapiens
uccuccuccccucuuuucccca

SEQ ID NO: 18699 - RNA, 22 nt, Homo sapiens
ucagauggggcacgcagacccu

SEQ ID NO: 18700 - RNA, 22 nt, Homo sapiens
uagggcugcugccucacucacc

SEQ ID NO: 18701 - RNA, 22 nt, Homo sapiens
uagcuguuuaugcacuccugcc

SEQ ID NO: 18702 - RNA, 22 nt, Homo sapiens
ggagaagugcauaagcaacauu

SEQ ID NO: 18703 - RNA, 22 nt, Homo sapiens
ucgcugcuccccaugacaggcu

SEQ ID NO: 18704 - RNA, 22 nt, Homo sapiens
gugugagcauggggagcaguga

SEQ ID NO: 18705 - RNA, 22 nt, Homo sapiens
ucgcugcuccccaugacaggcu

SEQ ID NO: 18706 - RNA, 22 nt, Homo sapiens
gugugagcauggggagcaguga

SEQ ID NO: 18707 - RNA, 22 nt, Homo sapiens
agggcuuagcugcuugugagca

SEQ ID NO: 18708 - RNA, 21 nt, Homo sapiens
uucacaguggcuaaguuccgc

SEQ ID NO: 18709 - RNA, 22 nt, Homo sapiens
agcugaaagggcaaaagacuga

SEQ ID NO: 18710 - RNA, 22 nt, Homo sapiens
gucuuuugcccuuccagcucuu

SEQ ID NO: 18711 - RNA, 22 nt, Homo sapiens
ugagcacugacucugugccagg

SEQ ID NO: 18712 - RNA, 22 nt, Homo sapiens
uggcacagaguaagugcucaau

SEQ ID NO: 18713 - RNA, 22 nt, Homo sapiens
cguaucucccuccccacugcgc

SEQ ID NO: 18714 - RNA, 22 nt, Homo sapiens
guaguugguggggggagguagu

SEQ ID NO: 18715 - RNA, 22 nt, Homo sapiens
gcucgggggaugcagggcccca

SEQ ID NO: 18716 - RNA, 16 nt, Homo sapiens
gcccuucauccccagc

SEQ ID NO: 18717 - RNA, 22 nt, Homo sapiens
uugcaagccuugggugugggag

SEQ ID NO: 18718 - RNA, 22 nt, Homo sapiens
cuacacucaaggcauggaggag

SEQ ID NO: 18719 - RNA, 22 nt, Homo sapiens
ucgucagcuuugugcugcuucu

SEQ ID NO: 18720 - RNA, 22 nt, Homo sapiens
aagagacagcauggagcugaua

SEQ ID NO: 18721 - RNA, 22 nt, Homo sapiens
uaggcgaacacgguggcgagcc

SEQ ID NO: 18722 - RNA, 22 nt, Homo sapiens
ucuuggccgccaucuucgccuu

SEQ ID NO: 18723 - RNA, 22 nt, Homo sapiens
gcucugcagggcuuugguugug

SEQ ID NO: 18724 - RNA, 18 nt, Homo sapiens
gccagagcccugccaagc

SEQ ID NO: 18725 - RNA, 24 nt, Homo sapiens
agcuacaucuggcuacugggucuc

SEQ ID NO: 18726 - RNA, 22 nt, Homo sapiens
uggcucaguagccaguguagau

SEQ ID NO: 18727 - RNA, 22 nt, Homo sapiens
cacggauccuucacccuggcuu

SEQ ID NO: 18728 - RNA, 22 nt, Homo sapiens
aagccaggguggaaugcguggu

SEQ ID NO: 18729 - RNA, 22 nt, Homo sapiens
gggcuucuuugaugaaaggguu

SEQ ID NO: 18730 - RNA, 19 nt, Homo sapiens
ccuccuuucaaagauaccc

SEQ ID NO: 18731 - RNA, 22 nt, Homo sapiens
ugcucucagcaucccccauccc

SEQ ID NO: 18732 - RNA, 21 nt, Homo sapiens
ggagaggaggagcugagucac

SEQ ID NO: 18733 - RNA, 22 nt, Homo sapiens
cugggcuucagagguuguugcu

SEQ ID NO: 18734 - RNA, 22 nt, Homo sapiens
cccuaacuucuaaaaagucugu

SEQ ID NO: 18735 - RNA, 22 nt, Homo sapiens
uuacccccugcugcugacguga

SEQ ID NO: 18736 - RNA, 22 nt, Homo sapiens
guucgguggaagggggaauucc

SEQ ID NO: 18737 - RNA, 22 nt, Homo sapiens
ccacauuuccaaagaugccagu

SEQ ID NO: 18738 - RNA, 22 nt, Homo sapiens
ggagcuggcuuguggaaguugg

SEQ ID NO: 18739 - RNA, 22 nt, Homo sapiens
uauaugcccauggacugcaugg

SEQ ID NO: 18740 - RNA, 22 nt, Homo sapiens
uguaguccaaaggcacauaccc

SEQ ID NO: 18741 - RNA, 22 nt, Homo sapiens
uauauaucaaacauauuccuac

SEQ ID NO: 18742 - RNA, 22 nt, Homo sapiens
ugauauguuugauauauuaggu

SEQ ID NO: 18743 - RNA, 22 nt, Homo sapiens
uaaggugcaucuagugcagaua

SEQ ID NO: 18744 - RNA, 22 nt, Homo sapiens
uacugcccuaagugcuccuucu

SEQ ID NO: 18745 - RNA, 22 nt, Homo sapiens
uucuggagggugggucagugca

SEQ ID NO: 18746 - RNA, 22 nt, Homo sapiens
cuggcccuccuuccagauaccc

SEQ ID NO: 18747 - RNA, 22 nt, Homo sapiens
aguagggugcacccggaauuga

SEQ ID NO: 18748 - RNA, 22 nt, Homo sapiens
uucuucuugugcccugucucau

SEQ ID NO: 18749 - RNA, 22 nt, Homo sapiens
uuauggucaaaaggcauaggug

SEQ ID NO: 18750 - RNA, 22 nt, Homo sapiens
ccugugcuuuuaaauuguaauc

SEQ ID NO: 18751 - RNA, 22 nt, Homo sapiens
aaucaagacucaauaaaaauug

SEQ ID NO: 18752 - RNA, 22 nt, Homo sapiens
auuuuuauugagagccuugaug

SEQ ID NO: 18753 - RNA, 22 nt, Homo sapiens
ucaggacugggucauucuguuc

SEQ ID NO: 18754 - RNA, 22 nt, Homo sapiens
caguggggccuggucccgagcg

SEQ ID NO: 18755 - RNA, 22 nt, Homo sapiens
ucuuuuggggaaauuugggacc

SEQ ID NO: 18756 - RNA, 22 nt, Homo sapiens
cauagaaaucccugagagcccc

SEQ ID NO: 18757 - RNA, 22 nt, Homo sapiens
uucuguucucucguuuuuuucg

SEQ ID NO: 18758 - RNA, 22 nt, Homo sapiens
aggaccgggagggcaggaaugg

SEQ ID NO: 18759 - RNA, 22 nt, Homo sapiens
agagguauagggcaugggaaaa

SEQ ID NO: 18760 - RNA, 20 nt, Homo sapiens
uuccuaugcauauacuucuu

SEQ ID NO: 18761 - RNA, 21 nt, Homo sapiens
uuccuaugcauauacuucuuu

SEQ ID NO: 18762 - RNA, 22 nt, Homo sapiens
uuuccuaugcauauacuucuuu

SEQ ID NO: 18763 - RNA, 22 nt, Homo sapiens
uuucuuuuagcaaagaugagga

SEQ ID NO: 18764 - RNA, 22 nt, Homo sapiens
ucuucuguuuuuguuaggaggg

SEQ ID NO: 18765 - RNA, 19 nt, Homo sapiens
cauagcgagaccccgucug

SEQ ID NO: 18766 - RNA, 22 nt, Homo sapiens
ucugaugacaucucagccuucg

SEQ ID NO: 18767 - RNA, 22 nt, Homo sapiens
cguggcucagagucaucggaca

SEQ ID NO: 18768 - RNA, 22 nt, Homo sapiens
agaaucaaagcuucucccaagc

SEQ ID NO: 18769 - RNA, 22 nt, Homo sapiens
uugggagaagguuucuuucucc

SEQ ID NO: 18770 - RNA, 22 nt, Homo sapiens
uggaguugggggaacauugugu

SEQ ID NO: 18771 - RNA, 22 nt, Homo sapiens
uacaugugccuuaacuucauuu

SEQ ID NO: 18772 - RNA, 22 nt, Homo sapiens
ucagauguguccacagcuaauu

SEQ ID NO: 18773 - RNA, 22 nt, Homo sapiens
auuagugugggaugaucaugac

SEQ ID NO: 18774 - RNA, 22 nt, Homo sapiens
uuuggauugaugacuggcuggg

SEQ ID NO: 18775 - RNA, 22 nt, Homo sapiens
caacuucucauuaauccuucga

SEQ ID NO: 18776 - RNA, 22 nt, Homo sapiens
gaugcguuggggcaggggaggu

SEQ ID NO: 18777 - RNA, 22 nt, Homo sapiens
cgaccccugccccagcgugugu

SEQ ID NO: 18778 - RNA, 22 nt, Homo sapiens
uuuuuuccaauagugaauaugc

SEQ ID NO: 18779 - RNA, 22 nt, Homo sapiens
cauauucaccacuggacaaauc

SEQ ID NO: 18780 - RNA, 22 nt, Homo sapiens
gagcccucuucccuagugaucg

SEQ ID NO: 18781 - RNA, 22 nt, Homo sapiens
ugguucuggggaaggggguugg

SEQ ID NO: 18782 - RNA, 22 nt, Homo sapiens
gcuggugcuuuguggggucucc

SEQ ID NO: 18783 - RNA, 22 nt, Homo sapiens
gacuccagaaacaguaucaguc

SEQ ID NO: 18784 - RNA, 22 nt, Homo sapiens
uggggucaauaucacgauuuau

SEQ ID NO: 18785 - RNA, 22 nt, Homo sapiens
uaaaucuugauauugacuaaaa

SEQ ID NO: 18786 - RNA, 22 nt, Homo sapiens
ccgccugcgccgggcucagucu

SEQ ID NO: 18787 - RNA, 22 nt, Homo sapiens
gcgagcgcaggcgcgggcggcg

SEQ ID NO: 18788 - RNA, 22 nt, Homo sapiens
uuugaggccacuagggaaccag

SEQ ID NO: 18789 - RNA, 19 nt, Homo sapiens
ggacccuaguggccugaga

SEQ ID NO: 18790 - RNA, 22 nt, Homo sapiens
acagggcugagugggaagggcu

SEQ ID NO: 18791 - RNA, 22 nt, Homo sapiens
cuuaucuagcucaauuccugag

SEQ ID NO: 18792 - RNA, 22 nt, Homo sapiens
ucugcucagcuguuuuguuucc

SEQ ID NO: 18793 - RNA, 20 nt, Homo sapiens
gacagaagcagcugggagga

SEQ ID NO: 18794 - RNA, 22 nt, Homo sapiens
gugauuaaaccagauguguuga

SEQ ID NO: 18795 - RNA, 22 nt, Homo sapiens
gccaucguuggguuuaauuacu

SEQ ID NO: 18796 - RNA, 22 nt, Homo sapiens
gccgccuccccaccucacccug

SEQ ID NO: 18797 - RNA, 22 nt, Homo sapiens
ggugggcagaggggaggcgggg

SEQ ID NO: 18798 - RNA, 22 nt, Homo sapiens
uuaaucaccauggauguaugau

SEQ ID NO: 18799 - RNA, 22 nt, Homo sapiens
uacuuuuucaugaugauuaauc

SEQ ID NO: 18800 - RNA, 22 nt, Homo sapiens
uagucauagauacccaagguca

SEQ ID NO: 18801 - RNA, 22 nt, Homo sapiens
ugugaaacuuuggggaucuacg

SEQ ID NO: 18802 - RNA, 22 nt, Homo sapiens
caguuuggaggagaaagugcgg

SEQ ID NO: 18803 - RNA, 22 nt, Homo sapiens
cacgccuucuuucuucaaaugc

SEQ ID NO: 18804 - RNA, 22 nt, Homo sapiens
cgcagcccggacuggccggagg

SEQ ID NO: 18805 - RNA, 22 nt, Homo sapiens
uuggucgguccuuaggcugcgc

SEQ ID NO: 18806 - RNA, 22 nt, Homo sapiens
agaggaaugauaaauggcaagg

SEQ ID NO: 18807 - RNA, 22 nt, Homo sapiens
uaaugcuuuuugucauacucau

SEQ ID NO: 18808 - RNA, 22 nt, Homo sapiens
uuuuuauuuuguuuuacugcuu

SEQ ID NO: 18809 - RNA, 22 nt, Homo sapiens
caggcuaacuggguggaaauga

SEQ ID NO: 18810 - RNA, 22 nt, Homo sapiens
uuuuuauuuuguuuuacugcuu

SEQ ID NO: 18811 - RNA, 22 nt, Homo sapiens
caggcuaacuggguggaaauga

SEQ ID NO: 18812 - RNA, 22 nt, Homo sapiens
uuuucucucuugccuagcuccu

SEQ ID NO: 18813 - RNA, 22 nt, Homo sapiens
agcauagaagagagagggggcc

SEQ ID NO: 18814 - RNA, 22 nt, Homo sapiens
uugcccucccucucagugccug

SEQ ID NO: 18815 - RNA, 22 nt, Homo sapiens
ggcacgcagaggaggaagaggg

SEQ ID NO: 18816 - RNA, 22 nt, Homo sapiens
uaagauaguucuguauauucuu

SEQ ID NO: 18817 - RNA, 22 nt, Homo sapiens
aagcauauagaaagguuuuggg

SEQ ID NO: 18818 - RNA, 22 nt, Homo sapiens
uucgucauccuccugaggccug

SEQ ID NO: 18819 - RNA, 19 nt, Homo sapiens
ccaaacagaggaugaggag

SEQ ID NO: 18820 - RNA, 22 nt, Homo sapiens
ucaggagggaggggaagaggca

SEQ ID NO: 18821 - RNA, 22 nt, Homo sapiens
ucuccuggucccucccuccguc

SEQ ID NO: 18822 - RNA, 22 nt, Homo sapiens
ugaugccccucucaggcccuga

SEQ ID NO: 18823 - RNA, 22 nt, Homo sapiens
gguugcccuggaagggguguga

SEQ ID NO: 18824 - RNA, 22 nt, Homo sapiens
ugccuucucccugaaugcugug

SEQ ID NO: 18825 - RNA, 22 nt, Homo sapiens
ugcguauucaggcaggaagaca

SEQ ID NO: 18826 - RNA, 22 nt, Homo sapiens
ugugucugccugcgguuuccuu

SEQ ID NO: 18827 - RNA, 22 nt, Homo sapiens
gauggaagcccagcugccaccu

SEQ ID NO: 18828 - RNA, 22 nt, Homo sapiens
acagugagaacuuuuccugaaa

SEQ ID NO: 18829 - RNA, 18 nt, Homo sapiens
gggaaauguuuucggugu

SEQ ID NO: 18830 - RNA, 22 nt, Homo sapiens
uaaugacaugcccugguaguuu

SEQ ID NO: 18831 - RNA, 22 nt, Homo sapiens
acugccaaggcacaucauugcu

SEQ ID NO: 18832 - RNA, 22 nt, Homo sapiens
ggugagccauucuauuuagauu

SEQ ID NO: 18833 - RNA, 22 nt, Homo sapiens
ucaugauuggaaaugguuggcc

SEQ ID NO: 18834 - RNA, 22 nt, Homo sapiens
gcagcucccacucacucugggc

SEQ ID NO: 18835 - RNA, 22 nt, Homo sapiens
cagggaguggaaaggagcugaa

SEQ ID NO: 18836 - RNA, 22 nt, Homo sapiens
ugggauggacugaggcugggug

SEQ ID NO: 18837 - RNA, 22 nt, Homo sapiens
caccagccuccucuuuuccuga

SEQ ID NO: 18838 - RNA, 22 nt, Homo sapiens
caucugcccagacacagcccug

SEQ ID NO: 18839 - RNA, 22 nt, Homo sapiens
gggcuguguugacugcagaagg

SEQ ID NO: 18840 - RNA, 22 nt, Homo sapiens
ggcacaaggcgccagcggcgag

SEQ ID NO: 18841 - RNA, 22 nt, Homo sapiens
ucguugccuggcgacuaguccc

SEQ ID NO: 18842 - RNA, 22 nt, Homo sapiens
ugguguggugggggugggcagu

SEQ ID NO: 18843 - RNA, 22 nt, Homo sapiens
uugcuggccccagaaugcugag

SEQ ID NO: 18844 - RNA, 22 nt, Homo sapiens
ugcgcgcaaccucuggggcaac

SEQ ID NO: 18845 - RNA, 22 nt, Homo sapiens
ccccagaggcugggugcagggg

SEQ ID NO: 18846 - RNA, 22 nt, Homo sapiens
ccuauucuugguuacuugcacg

SEQ ID NO: 18847 - RNA, 21 nt, Homo sapiens
uucaaguaauccaggauaggc

SEQ ID NO: 18848 - RNA, 22 nt, Homo sapiens
gagaggcuggccucaggagcua

SEQ ID NO: 18849 - RNA, 22 nt, Homo sapiens
uccagcuccugccugccucugc

SEQ ID NO: 18850 - RNA, 22 nt, Homo sapiens
uuucuggcugcccauauuuuuc

SEQ ID NO: 18851 - RNA, 22 nt, Homo sapiens
aagagucagggagccagaugcu

SEQ ID NO: 18852 - RNA, 22 nt, Homo sapiens
ugugcuagguacacuggucuuu

SEQ ID NO: 18853 - RNA, 22 nt, Homo sapiens
auugugcuggugauaacuauag

SEQ ID NO: 18854 - RNA, 22 nt, Homo sapiens
ucuagcugcagaggacccucag

SEQ ID NO: 18855 - RNA, 22 nt, Homo sapiens
aggagucuucaucagcuagaua

SEQ ID NO: 18856 - RNA, 22 nt, Homo sapiens
ucccugcuccaaggcugcagcu

SEQ ID NO: 18857 - RNA, 22 nt, Homo sapiens
uggagcccaggcagcugggagc

SEQ ID NO: 18858 - RNA, 22 nt, Homo sapiens
uggacuuuggguccuguggccu

SEQ ID NO: 18859 - RNA, 22 nt, Homo sapiens
aggccucaggacagaagccgag

SEQ ID NO: 18860 - RNA, 22 nt, Homo sapiens
uguaaauaauucucagccaauu

SEQ ID NO: 18861 - RNA, 22 nt, Homo sapiens
ugccuaggaauuauuuauaaug

SEQ ID NO: 18862 - RNA, 22 nt, Homo sapiens
uaggccugcugacccagggaga

SEQ ID NO: 18863 - RNA, 22 nt, Homo sapiens
uggccuugggucagagagggcu

SEQ ID NO: 18864 - RNA, 22 nt, Homo sapiens
caaagaggagugggagaagaaa

SEQ ID NO: 18865 - RNA, 22 nt, Homo sapiens
ugcauuccggccuccucuuucu

SEQ ID NO: 18866 - RNA, 22 nt, Homo sapiens
ugaccaauggcaucaaagagcu

SEQ ID NO: 18867 - RNA, 21 nt, Homo sapiens
gucucuaugucaauggugagc

SEQ ID NO: 18868 - RNA, 22 nt, Homo sapiens
ugaccaaugacauugaagagcu

SEQ ID NO: 18869 - RNA, 21 nt, Homo sapiens
gucucuaugucaauggugagu

SEQ ID NO: 18870 - RNA, 22 nt, Homo sapiens
cgaguccugcugacuuccugcc

SEQ ID NO: 18871 - RNA, 15 nt, Homo sapiens
ggagucagaggaucg

SEQ ID NO: 18872 - RNA, 22 nt, Homo sapiens
uacuuucucaugccuggguuuc

SEQ ID NO: 18873 - RNA, 22 nt, Homo sapiens
ucaggaacccaggugagggugg

SEQ ID NO: 18874 - RNA, 22 nt, Homo sapiens
uacuguucucagguuucaugcc

SEQ ID NO: 18875 - RNA, 22 nt, Homo sapiens
uggccaaggcugaggacagcac

SEQ ID NO: 18876 - RNA, 22 nt, Homo sapiens
ucccugucccccguggaggcuc

SEQ ID NO: 18877 - RNA, 22 nt, Homo sapiens
gggcuucucuggugacaggguc

SEQ ID NO: 18878 - RNA, 22 nt, Homo sapiens
ugauguucaaagagaaacaacu

SEQ ID NO: 18879 - RNA, 22 nt, Homo sapiens
gguuguuuuucuugucacaauu

SEQ ID NO: 18880 - RNA, 22 nt, Homo sapiens
uggggaauaguuuuguucuuuu

SEQ ID NO: 18881 - RNA, 22 nt, Homo sapiens
aaagagguggaugguuucccuu

SEQ ID NO: 18882 - RNA, 22 nt, Homo sapiens
uccugagcugagcugcggggaa

SEQ ID NO: 18883 - RNA, 22 nt, Homo sapiens
uccucgaucagcucaugcuaga

SEQ ID NO: 18884 - RNA, 22 nt, Homo sapiens
acccaguccccgggcagcaggc

SEQ ID NO: 18885 - RNA, 22 nt, Homo sapiens
ggcugcugcccggcugggcucg

SEQ ID NO: 18886 - RNA, 22 nt, Homo sapiens
aguuccugccaccuugggggcc

SEQ ID NO: 18887 - RNA, 22 nt, Homo sapiens
ccucccgaguggcacgggcagc

SEQ ID NO: 18888 - RNA, 22 nt, Homo sapiens
cgcucgguccauuucugggcgc

SEQ ID NO: 18889 - RNA, 22 nt, Homo sapiens
gccuggaauaccgagcagcgau

SEQ ID NO: 18890 - RNA, 22 nt, Homo sapiens
uuuaugugugcaaauaggguaa

SEQ ID NO: 18891 - RNA, 22 nt, Homo sapiens
ccagauuugcauuggcaaaugg

SEQ ID NO: 18892 - RNA, 22 nt, Homo sapiens
gagccaagggcccuuauggagg

SEQ ID NO: 18893 - RNA, 22 nt, Homo sapiens
gccuguuaggggcucuagcuuu

SEQ ID NO: 18894 - RNA, 22 nt, Homo sapiens
ggagugguuggguugcauuugg

SEQ ID NO: 18895 - RNA, 21 nt, Homo sapiens
uaagugcagcccacccaaucc

SEQ ID NO: 18896 - RNA, 22 nt, Homo sapiens
ccaccaguguugggcauugggg

SEQ ID NO: 18897 - RNA, 22 nt, Homo sapiens
ucugagcccagagcugguggug

SEQ ID NO: 18898 - RNA, 22 nt, Homo sapiens
ucgucguaguggaggugcagca

SEQ ID NO: 18899 - RNA, 20 nt, Homo sapiens
guggacuccauggugaagag

SEQ ID NO: 18900 - RNA, 22 nt, Homo sapiens
cagccagccagguccugcagga

SEQ ID NO: 18901 - RNA, 22 nt, Homo sapiens
ugugcagcaacucagcuggcuu

SEQ ID NO: 18902 - RNA, 22 nt, Homo sapiens
ccacccccaugccgcgugcucc

SEQ ID NO: 18903 - RNA, 22 nt, Homo sapiens
gucacugcggcugugggugagg

SEQ ID NO: 18904 - RNA, 22 nt, Homo sapiens
gugugcuagggccagaucaucc

SEQ ID NO: 18905 - RNA, 22 nt, Homo sapiens
uaggaggucugaguccaugcag

SEQ ID NO: 18906 - RNA, 22 nt, Homo sapiens
ggaggagcucccggguggcucu

SEQ ID NO: 18907 - RNA, 22 nt, Homo sapiens
gagccccuuggagcaucucacu

SEQ ID NO: 18908 - RNA, 22 nt, Homo sapiens
gggaguuaguuaaugaccaucc

SEQ ID NO: 18909 - RNA, 22 nt, Homo sapiens
ugguuauuauguggcucaauga

SEQ ID NO: 18910 - RNA, 22 nt, Homo sapiens
uggguuuaaggauuccccaaug

SEQ ID NO: 18911 - RNA, 22 nt, Homo sapiens
cuaggaaaucuguagaccacag

SEQ ID NO: 18912 - RNA, 22 nt, Homo sapiens
uggguuuaaggauuccccaaug

SEQ ID NO: 18913 - RNA, 22 nt, Homo sapiens
cuaggaaaucuguagaccacag

SEQ ID NO: 18914 - RNA, 22 nt, Homo sapiens
cagacugggugagaaccgccag

SEQ ID NO: 18915 - RNA, 22 nt, Homo sapiens
cugguucugcacuugguccuga

SEQ ID NO: 18916 - RNA, 22 nt, Homo sapiens
ugagaggaggggaggguccugg

SEQ ID NO: 18917 - RNA, 22 nt, Homo sapiens
gacccugcugaccugcuuaguu

SEQ ID NO: 18918 - RNA, 22 nt, Homo sapiens
ucuguuguguggccucaugugc

SEQ ID NO: 18919 - RNA, 22 nt, Homo sapiens
acagaggcacagaugauaggca

SEQ ID NO: 18920 - RNA, 22 nt, Homo sapiens
aauuccgaauggccccaguccc

SEQ ID NO: 18921 - RNA, 22 nt, Homo sapiens
ugguuguggccacuuggauuuc

SEQ ID NO: 18922 - RNA, 22 nt, Homo sapiens
uggggggcuacugacagaggag

SEQ ID NO: 18923 - RNA, 22 nt, Homo sapiens
ucucugugagaugccuuccuga

SEQ ID NO: 18924 - RNA, 22 nt, Homo sapiens
auugaaaccucuaagaguggag

SEQ ID NO: 18925 - RNA, 22 nt, Homo sapiens
acucaggagaguggcaaucaca

SEQ ID NO: 18926 - RNA, 19 nt, Homo sapiens
uacucaggagaguggcaau

SEQ ID NO: 18927 - RNA, 23 nt, Homo sapiens
uacucaggagaguggcaaucaca

SEQ ID NO: 18928 - RNA, 22 nt, Homo sapiens
ucuggccuucccccugaccugc

SEQ ID NO: 18929 - RNA, 22 nt, Homo sapiens
uaguagucagggagaugccuua

SEQ ID NO: 18930 - RNA, 22 nt, Homo sapiens
caaagggagggauggaggcccu

SEQ ID NO: 18931 - RNA, 22 nt, Homo sapiens
ccuucuucauccuucuugcugg

SEQ ID NO: 18932 - RNA, 22 nt, Homo sapiens
ggagugcagggcaggguuuccc

SEQ ID NO: 18933 - RNA, 21 nt, Homo sapiens
agacccuggucugcacucuau

SEQ ID NO: 18934 - RNA, 20 nt, Homo sapiens
gacccuggucugcacucuau

SEQ ID NO: 18935 - RNA, 21 nt, Homo sapiens
gacccuggucugcacucuauc

SEQ ID NO: 18936 - RNA, 22 nt, Homo sapiens
uaugaagcaaaacuaaucagag

SEQ ID NO: 18937 - RNA, 22 nt, Homo sapiens
uguccugguuuuguuucauaca

SEQ ID NO: 18938 - RNA, 22 nt, Homo sapiens
acauuugccuugccuuuagugc

SEQ ID NO: 18939 - RNA, 22 nt, Homo sapiens
acugggucaggggagggcagaa

SEQ ID NO: 18940 - RNA, 22 nt, Homo sapiens
uggacagagggggaaauccaga

SEQ ID NO: 18941 - RNA, 22 nt, Homo sapiens
ucuggauuuucccuauggcuag

SEQ ID NO: 18942 - RNA, 22 nt, Homo sapiens
uaggcaguguauugcuagcggc

SEQ ID NO: 18943 - RNA, 22 nt, Homo sapiens
guugcuaguugcacuccucucu

SEQ ID NO: 18944 - RNA, 22 nt, Homo sapiens
uuuuagcuguaguuauuauauu

SEQ ID NO: 18945 - RNA, 22 nt, Homo sapiens
guugcagcugcagcuaugaaga

SEQ ID NO: 18946 - RNA, 22 nt, Homo sapiens
uuucauuuugugaaagugaagg

SEQ ID NO: 18947 - RNA, 22 nt, Homo sapiens
ccucacauuuacacaguggcag

SEQ ID NO: 18948 - RNA, 22 nt, Homo sapiens
acucaguuuucgcaggaucccu

SEQ ID NO: 18949 - RNA, 22 nt, Homo sapiens
aggugggguggaggcugaggag

SEQ ID NO: 18950 - RNA, 22 nt, Homo sapiens
agugggagagaaacuuugggcu

SEQ ID NO: 18951 - RNA, 22 nt, Homo sapiens
uccuaguuucagucccagcuuu

SEQ ID NO: 18952 - RNA, 22 nt, Homo sapiens
gauugcucucucguuucuuaau

SEQ ID NO: 18953 - RNA, 22 nt, Homo sapiens
auuaagauccagaagcaagaca

SEQ ID NO: 18954 - RNA, 22 nt, Homo sapiens
ugggagagauggaaagcaagau

SEQ ID NO: 18955 - RNA, 22 nt, Homo sapiens
ucuugcuuccaacucucauuau

SEQ ID NO: 18956 - RNA, 22 nt, Homo sapiens
ugccuaaggcacuggguauaug

SEQ ID NO: 18957 - RNA, 22 nt, Homo sapiens
uaaucccaguccuuagguagug

SEQ ID NO: 18958 - RNA, 22 nt, Homo sapiens
ucaagaugacagcaggacuggc

SEQ ID NO: 18959 - RNA, 22 nt, Homo sapiens
ccagucaugugcuguuauuuuu

SEQ ID NO: 18960 - RNA, 22 nt, Homo sapiens
uauggagaugggaauuagugag

SEQ ID NO: 18961 - RNA, 22 nt, Homo sapiens
uuugauuauucuccauccuaau

SEQ ID NO: 18962 - RNA, 22 nt, Homo sapiens
acagaagccacuuagagcguaa

SEQ ID NO: 18963 - RNA, 17 nt, Homo sapiens
cucuaaguggcgcaugu

SEQ ID NO: 18964 - RNA, 22 nt, Homo sapiens
uaguuuugcagguuugcaucca

SEQ ID NO: 18965 - RNA, 23 nt, Homo sapiens
ugugcaaauccaugcaaaacuga

SEQ ID NO: 18966 - RNA, 22 nt, Homo sapiens
gccauucucuugccugccucuc

SEQ ID NO: 18967 - RNA, 22 nt, Homo sapiens
gggaggcaggaggggaggcuug

SEQ ID NO: 18968 - RNA, 22 nt, Homo sapiens
uuuaguguuccuuuuuccugau

SEQ ID NO: 18969 - RNA, 22 nt, Homo sapiens
uaaugggagaaagggaguacag

SEQ ID NO: 18970 - RNA, 22 nt, Homo sapiens
uauagcaguuuuaggagaucug

SEQ ID NO: 18971 - RNA, 22 nt, Homo sapiens
gagcuccaaacgggcuauaugc

SEQ ID NO: 18972 - RNA, 17 nt, Homo sapiens
gaagacaggugcaauuu

SEQ ID NO: 18973 - RNA, 22 nt, Homo sapiens
uagaucaauuuaucucuugucc

SEQ ID NO: 18974 - RNA, 22 nt, Homo sapiens
caggagauaaauugaucugugc

SEQ ID NO: 18975 - RNA, 22 nt, Homo sapiens
aauggauuuguaggaggaaggg

SEQ ID NO: 18976 - RNA, 22 nt, Homo sapiens
ucccuuuucuacaaauuuuaaa

SEQ ID NO: 18977 - RNA, 22 nt, Homo sapiens
uaaaugccagccugcucauuac

SEQ ID NO: 18978 - RNA, 22 nt, Homo sapiens
ugauuugagcagugcuggcugc

SEQ ID NO: 18979 - RNA, 22 nt, Homo sapiens
ccuguugagcaacuggccaucc

SEQ ID NO: 18980 - RNA, 22 nt, Homo sapiens
gguggugcaguuucaauggggu

SEQ ID NO: 18981 - RNA, 22 nt, Homo sapiens
ccuaagcccuaggcuuccauca

SEQ ID NO: 18982 - RNA, 22 nt, Homo sapiens
agugggggucagaggccugggg

SEQ ID NO: 18983 - RNA, 22 nt, Homo sapiens
ugaaguaguugguuuaggaguu

SEQ ID NO: 18984 - RNA, 22 nt, Homo sapiens
uaaacccuaaggacuacaucag

SEQ ID NO: 18985 - RNA, 22 nt, Homo sapiens
aggccuguguuccuucccauaa

SEQ ID NO: 18986 - RNA, 22 nt, Homo sapiens
uggggcagaacauaggccucca

SEQ ID NO: 18987 - RNA, 22 nt, Homo sapiens
agagcuccugccugagcuggac

SEQ ID NO: 18988 - RNA, 22 nt, Homo sapiens
ugccugcuggguaggggcacgu

SEQ ID NO: 18989 - RNA, 22 nt, Homo sapiens
ugcuguccucuuugcuuggucu

SEQ ID NO: 18990 - RNA, 22 nt, Homo sapiens
gggcagggaggaaggcccugug

SEQ ID NO: 18991 - RNA, 22 nt, Homo sapiens
ugugaguggacugcacuauggu

SEQ ID NO: 18992 - RNA, 22 nt, Homo sapiens
uuuugucaguucggcucaagga

SEQ ID NO: 18993 - RNA, 22 nt, Homo sapiens
ugcccucucugggccuugauuc

SEQ ID NO: 18994 - RNA, 22 nt, Homo sapiens
gaagccaggguggaaggggucu

SEQ ID NO: 18995 - RNA, 22 nt, Homo sapiens
acugguagcuuuuuauugacug

SEQ ID NO: 18996 - RNA, 22 nt, Homo sapiens
guaugcaauaaaaaacuuccag

SEQ ID NO: 18997 - RNA, 22 nt, Homo sapiens
ccagguucucagucagcugggg

SEQ ID NO: 18998 - RNA, 22 nt, Homo sapiens
ccaggugacccugaaccugcug

SEQ ID NO: 18999 - RNA, 22 nt, Homo sapiens
agguggcugcacacugggccga

SEQ ID NO: 19000 - RNA, 22 nt, Homo sapiens
ggcccaccucuguguggucacc

SEQ ID NO: 19001 - RNA, 22 nt, Homo sapiens
auggauuugcucugugaccuug

SEQ ID NO: 19002 - RNA, 22 nt, Homo sapiens
cuuuggcacugagcagcaucug

SEQ ID NO: 19003 - RNA, 22 nt, Homo sapiens
ugguugcuuccagugccuguuu

SEQ ID NO: 19004 - RNA, 22 nt, Homo sapiens
caggcauggaagcaauaaaaaa

SEQ ID NO: 19005 - RNA, 22 nt, Homo sapiens
uuggggaucaugguuauauucc

SEQ ID NO: 19006 - RNA, 22 nt, Homo sapiens
aaaaaugacccugagcccuuuu

SEQ ID NO: 19007 - RNA, 22 nt, Homo sapiens
gcagcuaaagagacaaucugau

SEQ ID NO: 19008 - RNA, 22 nt, Homo sapiens
caucuauugcucuuuggugaug

SEQ ID NO: 19009 - RNA, 22 nt, Homo sapiens
gggccagggacgucaccaacuu

SEQ ID NO: 19010 - RNA, 22 nt, Homo sapiens
uuggcuucgucuuugaucccau

SEQ ID NO: 19011 - RNA, 22 nt, Homo sapiens
ggccuggggcuggaggaguucc

SEQ ID NO: 19012 - RNA, 22 nt, Homo sapiens
gaaaugccucuggccugguaaa

SEQ ID NO: 19013 - RNA, 22 nt, Homo sapiens
ucagagcguccucuuccacccc

SEQ ID NO: 19014 - RNA, 22 nt, Homo sapiens
auggguagaggccuccugaguu

SEQ ID NO: 19015 - RNA, 22 nt, Homo sapiens
uugcuucuaagcuuacuugaaa

SEQ ID NO: 19016 - RNA, 22 nt, Homo sapiens
uuaaaugagauuagaaguccug

SEQ ID NO: 19017 - RNA, 22 nt, Homo sapiens
ggcuccuuaaacuaauauuugc

SEQ ID NO: 19018 - RNA, 22 nt, Homo sapiens
gguaaauauugguuuagccugg

SEQ ID NO: 19019 - RNA, 22 nt, Homo sapiens
gggaccgagagggccucggcug

SEQ ID NO: 19020 - RNA, 22 nt, Homo sapiens
gccgaggcccgggccgguuccc

SEQ ID NO: 19021 - RNA, 22 nt, Homo sapiens
uggaagggcuggccaggaggga

SEQ ID NO: 19022 - RNA, 22 nt, Homo sapiens
uccuuucuaguuaccauuuugc

SEQ ID NO: 19023 - RNA, 22 nt, Homo sapiens
ggagaaagguaucaucugcugu

SEQ ID NO: 19024 - RNA, 22 nt, Homo sapiens
cugcagcgaugcuguuucuuuc

SEQ ID NO: 19025 - RNA, 22 nt, Homo sapiens
caguccagaggagcugagagua

SEQ ID NO: 19026 - RNA, 22 nt, Homo sapiens
ugagucuuggcuucuuggcugu

SEQ ID NO: 19027 - RNA, 22 nt, Homo sapiens
cagcacagaccucaggcugugu

SEQ ID NO: 19028 - RNA, 22 nt, Homo sapiens
acaugcaggagccugugcuggg

SEQ ID NO: 19029 - RNA, 22 nt, Homo sapiens
ugcgggcuuuugguucacuguc

SEQ ID NO: 19030 - RNA, 22 nt, Homo sapiens
guugucaguguccggacccuca

SEQ ID NO: 19031 - RNA, 22 nt, Homo sapiens
gcuggagaggaaagcaugguuc

SEQ ID NO: 19032 - RNA, 15 nt, Homo sapiens
auguuuucucuaagu

SEQ ID NO: 19033 - RNA, 22 nt, Homo sapiens
ugggagcuuuugcuuucuacuu

SEQ ID NO: 19034 - RNA, 20 nt, Homo sapiens
augggagcaguggcuuucag

SEQ ID NO: 19035 - RNA, 22 nt, Homo sapiens
agaugagaccuacuaauaugcu

SEQ ID NO: 19036 - RNA, 22 nt, Homo sapiens
cauaauacaggguuuauuuuuu

SEQ ID NO: 19037 - RNA, 22 nt, Homo sapiens
uggucccugugggucaggucug

SEQ ID NO: 19038 - RNA, 22 nt, Homo sapiens
cacugccucccacaggggcuug

SEQ ID NO: 19039 - RNA, 22 nt, Homo sapiens
ucuggccacugccugacccuca

SEQ ID NO: 19040 - RNA, 22 nt, Homo sapiens
gagucaggcaggagggccaggu

SEQ ID NO: 19041 - RNA, 22 nt, Homo sapiens
aagaagagauggugguugugca

SEQ ID NO: 19042 - RNA, 22 nt, Homo sapiens
ugcauaacaccaacauuuuucc

SEQ ID NO: 19043 - RNA, 22 nt, Homo sapiens
gcaccugccucugcucuccccu

SEQ ID NO: 19044 - RNA, 22 nt, Homo sapiens
gcaggaugcggaauggcaggug

SEQ ID NO: 19045 - RNA, 22 nt, Homo sapiens
cguguucacagcggaccuugau

SEQ ID NO: 19046 - RNA, 22 nt, Homo sapiens
uuaaggcacgcggugaaugcca

SEQ ID NO: 19047 - RNA, 20 nt, Homo sapiens
uaaggcacgcggugaaugcc

SEQ ID NO: 19048 - RNA, 22 nt, Homo sapiens
ugauuugcugggguugcugggu

SEQ ID NO: 19049 - RNA, 22 nt, Homo sapiens
ugcaggcugauugcagcagauu

SEQ ID NO: 19050 - RNA, 22 nt, Homo sapiens
gaaacagcucagucacagggug

SEQ ID NO: 19051 - RNA, 22 nt, Homo sapiens
cuuugugacugggcuugagaac

SEQ ID NO: 19052 - RNA, 22 nt, Homo sapiens
ugagugccgggcguggagagcu

SEQ ID NO: 19053 - RNA, 22 nt, Homo sapiens
uagcuccacaugcccuggccug

SEQ ID NO: 19054 - RNA, 22 nt, Homo sapiens
cccgguuuucccagcaccuccu

SEQ ID NO: 19055 - RNA, 18 nt, Homo sapiens
ggugugcugggagaaggg

SEQ ID NO: 19056 - RNA, 22 nt, Homo sapiens
cgcagaggggcuugaggcccug

SEQ ID NO: 19057 - RNA, 22 nt, Homo sapiens
gggccaugggccucguguggcc

SEQ ID NO: 19058 - RNA, 22 nt, Homo sapiens
gggguggggaaggaggucacag

SEQ ID NO: 19059 - RNA, 18 nt, Homo sapiens
ugugacgacuucccuccu

SEQ ID NO: 19060 - RNA, 22 nt, Homo sapiens
ucgggguuuugagggcgagaug

SEQ ID NO: 19061 - RNA, 21 nt, Homo sapiens
aacuggcccucaaagucccgc

SEQ ID NO: 19062 - RNA, 22 nt, Homo sapiens
aacuggcccucaaagucccgcu

SEQ ID NO: 19063 - RNA, 24 nt, Homo sapiens
aacuggcccucaaagucccgcuuu

SEQ ID NO: 19064 - RNA, 23 nt, Homo sapiens
acuggcccucaaagucccgcuuu

SEQ ID NO: 19065 - RNA, 25 nt, Homo sapiens
ccaacuggcccucaaagucccgcuu

SEQ ID NO: 19066 - RNA, 22 nt, Homo sapiens
uuuaacucuucuuguuuucacu

SEQ ID NO: 19067 - RNA, 22 nt, Homo sapiens
ugaauuugaacagaguugaaua

SEQ ID NO: 19068 - RNA, 22 nt, Homo sapiens
uuuaacucuucuuguuuucacu

SEQ ID NO: 19069 - RNA, 22 nt, Homo sapiens
ugaauuugaacagaguugaaua

SEQ ID NO: 19070 - RNA, 22 nt, Homo sapiens
ucagguaaaugccaaucaggag

SEQ ID NO: 19071 - RNA, 22 nt, Homo sapiens
uccugauugguauugaucugaa

SEQ ID NO: 19072 - RNA, 22 nt, Homo sapiens
ggggucacagacuccugguagc

SEQ ID NO: 19073 - RNA, 22 nt, Homo sapiens
uguuuuuggggguggguggccc

SEQ ID NO: 19074 - RNA, 22 nt, Homo sapiens
cagacuccaguuugagccuuua

SEQ ID NO: 19075 - RNA, 22 nt, Homo sapiens
augguucaugcagaggucuggg

SEQ ID NO: 19076 - RNA, 22 nt, Homo sapiens
uggcaagcacuguagggaugca

SEQ ID NO: 19077 - RNA, 22 nt, Homo sapiens
agcaugcuggaggcuugcuagu

SEQ ID NO: 19078 - RNA, 22 nt, Homo sapiens
uaaucaugagcugguaggucau

SEQ ID NO: 19079 - RNA, 22 nt, Homo sapiens
ugacacuuccggcaugauggau

SEQ ID NO: 19080 - RNA, 22 nt, Homo sapiens
uuaguuaaguuuggaugcaugg

SEQ ID NO: 19081 - RNA, 22 nt, Homo sapiens
uguauccaagcuuaacuaacug

SEQ ID NO: 19082 - RNA, 22 nt, Homo sapiens
gagguuuucauguuugucucuu

SEQ ID NO: 19083 - RNA, 22 nt, Homo sapiens
gagaagagagacaugaaaaccu

SEQ ID NO: 19084 - RNA, 22 nt, Homo sapiens
uuuuauuuaccugagagaacca

SEQ ID NO: 19085 - RNA, 20 nt, Homo sapiens
gucucucagguaaauaugaa

SEQ ID NO: 19086 - RNA, 22 nt, Homo sapiens
ccaucuucuaggcagagggaca

SEQ ID NO: 19087 - RNA, 17 nt, Homo sapiens
ucucugccuagaagugg

SEQ ID NO: 19088 - RNA, 22 nt, Homo sapiens
ccuggccaggccccuugcaggg

SEQ ID NO: 19089 - RNA, 22 nt, Homo sapiens
cucucagggucuggccgggucc

SEQ ID NO: 19090 - RNA, 22 nt, Homo sapiens
ugaccuuugaacagcccaggga

SEQ ID NO: 19091 - RNA, 22 nt, Homo sapiens
ucuugaugcuuguuuaaagguu

SEQ ID NO: 19092 - RNA, 22 nt, Homo sapiens
gaggaaaguaguaugggaugau

SEQ ID NO: 19093 - RNA, 22 nt, Homo sapiens
gucagaccacagcuuuccuuuu

SEQ ID NO: 19094 - RNA, 22 nt, Homo sapiens
ugaauuccugcaguuucagcug

SEQ ID NO: 19095 - RNA, 22 nt, Homo sapiens
cagaaaugccaggaauuuaugu

SEQ ID NO: 19096 - RNA, 22 nt, Homo sapiens
uaccugacucugaccaaccucu

SEQ ID NO: 19097 - RNA, 22 nt, Homo sapiens
gaugguuggcguuugggacuug

SEQ ID NO: 19098 - RNA, 22 nt, Homo sapiens
uaggaaagaaugagggagagga

SEQ ID NO: 19099 - RNA, 22 nt, Homo sapiens
ucuuuuccuccucuuucuuagc

SEQ ID NO: 19100 - RNA, 22 nt, Homo sapiens
acuucugauguuauccucgcuc

SEQ ID NO: 19101 - RNA, 22 nt, Homo sapiens
agugggaugaguuagagguguc

SEQ ID NO: 19102 - RNA, 22 nt, Homo sapiens
uuuuuguuuaguguuuuggggc

SEQ ID NO: 19103 - RNA, 22 nt, Homo sapiens
uaaccaauaaauuaagcaaaac

SEQ ID NO: 19104 - RNA, 22 nt, Homo sapiens
uuuuuguuuaguguuuuggggc

SEQ ID NO: 19105 - RNA, 22 nt, Homo sapiens
uaaccaauaaauuaagcaaaac

SEQ ID NO: 19106 - RNA, 22 nt, Homo sapiens
uaaacaacugacacagccaugg

SEQ ID NO: 19107 - RNA, 22 nt, Homo sapiens
uccaucugucagucuguuuaua

SEQ ID NO: 19108 - RNA, 22 nt, Homo sapiens
uuguucuguuccugaugauucu

SEQ ID NO: 19109 - RNA, 22 nt, Homo sapiens
ucaucacgaacacaacagcguu

SEQ ID NO: 19110 - RNA, 22 nt, Homo sapiens
ugucugcagcacauagauuaga

SEQ ID NO: 19111 - RNA, 22 nt, Homo sapiens
uguuugugaauguugcggauug

SEQ ID NO: 19112 - RNA, 22 nt, Homo sapiens
uacagguaguagguugcguagu

SEQ ID NO: 19113 - RNA, 22 nt, Homo sapiens
uuauaugaccugcugcuaccuu

SEQ ID NO: 19114 - RNA, 22 nt, Homo sapiens
acugcuaagcaguugccuugau

SEQ ID NO: 19115 - RNA, 22 nt, Homo sapiens
ucaggaguaccugcuuauugca

SEQ ID NO: 19116 - RNA, 22 nt, Homo sapiens
ucaaguggggauuggguugcag

SEQ ID NO: 19117 - RNA, 22 nt, Homo sapiens
cacagcccgcccucuuugaggu

SEQ ID NO: 19118 - RNA, 22 nt, Homo sapiens
uggugacagggaugugguggug

SEQ ID NO: 19119 - RNA, 17 nt, Homo sapiens
cucccauucuuguccca

SEQ ID NO: 19120 - RNA, 22 nt, Homo sapiens
ucaagcccgguguucagacuuc

SEQ ID NO: 19121 - RNA, 22 nt, Homo sapiens
gucugaugauaucuugcuugau

SEQ ID NO: 19122 - RNA, 22 nt, Homo sapiens
ucauaaagauggcgauuguaua

SEQ ID NO: 19123 - RNA, 22 nt, Homo sapiens
uugcuugccuuccuuuaugauu

SEQ ID NO: 19124 - RNA, 22 nt, Homo sapiens
uuucucaugacacauccacagu

SEQ ID NO: 19125 - RNA, 22 nt, Homo sapiens
gcuggaaucaucaugggaauag

SEQ ID NO: 19126 - RNA, 22 nt, Homo sapiens
uggggcccugaggccuuccccc

SEQ ID NO: 19127 - RNA, 22 nt, Homo sapiens
gauggagggccuggccccagcg

SEQ ID NO: 19128 - RNA, 22 nt, Homo sapiens
accaguuucuaccuggcagcac

SEQ ID NO: 19129 - RNA, 22 nt, Homo sapiens
uaucugucagguacugucugag

SEQ ID NO: 19130 - RNA, 22 nt, Homo sapiens
uaccacaggguagaaccacgga

SEQ ID NO: 19131 - RNA, 22 nt, Homo sapiens
ccagugguuuuacccuauggua

SEQ ID NO: 19132 - RNA, 23 nt, Homo sapiens
uaccacaggguagaaccacggac

SEQ ID NO: 19133 - RNA, 22 nt, Homo sapiens
uuucaccuucugacuguucugu

SEQ ID NO: 19134 - RNA, 19 nt, Homo sapiens
caguccaggaagguguaag

SEQ ID NO: 19135 - RNA, 22 nt, Homo sapiens
uggugagccuggaggaagacuu

SEQ ID NO: 19136 - RNA, 22 nt, Homo sapiens
gugucugucagccagguuccca

SEQ ID NO: 19137 - RNA, 22 nt, Homo sapiens
auaggaucagggguuuggggug

SEQ ID NO: 19138 - RNA, 22 nt, Homo sapiens
ccccggacuccuggcccuccuu

SEQ ID NO: 19139 - RNA, 22 nt, Homo sapiens
agcuggcagcucucagggguac

SEQ ID NO: 19140 - RNA, 22 nt, Homo sapiens
ucucauccuuggggcugcugcu

SEQ ID NO: 19141 - RNA, 22 nt, Homo sapiens
agggguggcagagugguaagag

SEQ ID NO: 19142 - RNA, 22 nt, Homo sapiens
ucccuaccucuucuccucccuc

SEQ ID NO: 19143 - RNA, 22 nt, Homo sapiens
uguggggugggaggugagggga

SEQ ID NO: 19144 - RNA, 22 nt, Homo sapiens
ucuuucuccuuccuuuuccuau

SEQ ID NO: 19145 - RNA, 22 nt, Homo sapiens
ugaggaagaggggugcuggacu

SEQ ID NO: 19146 - RNA, 22 nt, Homo sapiens
cucagcaucaaccucuccuucc

SEQ ID NO: 19147 - RNA, 22 nt, Homo sapiens
cgugacucacuggcaaagaucu

SEQ ID NO: 19148 - RNA, 22 nt, Homo sapiens
uguuuuuuucagggggguugga

SEQ ID NO: 19149 - RNA, 22 nt, Homo sapiens
aaguggcuuuuaagcaauuaga

SEQ ID NO: 19150 - RNA, 20 nt, Homo sapiens
uaauuguuucaaaagcccuu

SEQ ID NO: 19151 - RNA, 22 nt, Homo sapiens
acucaguuuuuggccucugcug

SEQ ID NO: 19152 - RNA, 22 nt, Homo sapiens
uguggcagggggaauugagagg

SEQ ID NO: 19153 - RNA, 22 nt, Homo sapiens
auagaaaagggucauaugacuc

SEQ ID NO: 19154 - RNA, 22 nt, Homo sapiens
ucauaauggcucauuucugccc

SEQ ID NO: 19155 - RNA, 22 nt, Homo sapiens
uauuucaagacaccaauaagca

SEQ ID NO: 19156 - RNA, 22 nt, Homo sapiens
uuuauuggcaucuuaaaauagg

SEQ ID NO: 19157 - RNA, 22 nt, Homo sapiens
gguggagaggagauggggugca

SEQ ID NO: 19158 - RNA, 22 nt, Homo sapiens
ucacccucauggccucccacuu

SEQ ID NO: 19159 - RNA, 22 nt, Homo sapiens
ggcugacaauggcuccuugugu

SEQ ID NO: 19160 - RNA, 20 nt, Homo sapiens
gaggggagguauuguuugcc

SEQ ID NO: 19161 - RNA, 22 nt, Homo sapiens
uuugggcccugaaagcacgcau

SEQ ID NO: 19162 - RNA, 22 nt, Homo sapiens
uguccuuucagggccuaacauc

SEQ ID NO: 19163 - RNA, 22 nt, Homo sapiens
cacagggcacacaggugcaccc

SEQ ID NO: 19164 - RNA, 22 nt, Homo sapiens
ugcaccugugugcuaaggucag

SEQ ID NO: 19165 - RNA, 22 nt, Homo sapiens
uuucucuuccuauagauguugg

SEQ ID NO: 19166 - RNA, 22 nt, Homo sapiens
acacaucuaucuugggagaaaa

SEQ ID NO: 19167 - RNA, 22 nt, Homo sapiens
gguuggcuuucccugugcacua

SEQ ID NO: 19168 - RNA, 20 nt, Homo sapiens
ucaguggacaugaagcuacc

SEQ ID NO: 19169 - RNA, 22 nt, Homo sapiens
ugucugaaugcuguugcuugcc

SEQ ID NO: 19170 - RNA, 22 nt, Homo sapiens
aaguauagcauucuaacagcau

SEQ ID NO: 19171 - RNA, 22 nt, Homo sapiens
caaagcgcuccccuuuagaggu

SEQ ID NO: 19172 - RNA, 22 nt, Homo sapiens
aggcaaugucaggaaagaggaa

SEQ ID NO: 19173 - RNA, 22 nt, Homo sapiens
cucuuuccucaaguugguguug

SEQ ID NO: 19174 - RNA, 22 nt, Homo sapiens
uggguacuauaauuugcauugc

SEQ ID NO: 19175 - RNA, 22 nt, Homo sapiens
cuugcaaauuaugggaccaggg

SEQ ID NO: 19176 - RNA, 22 nt, Homo sapiens
agaucagggacucugucuuuau

SEQ ID NO: 19177 - RNA, 22 nt, Homo sapiens
ugaaauagagcccuuguucuug

SEQ ID NO: 19178 - RNA, 22 nt, Homo sapiens
ggaguuggggcauggggcauuu

SEQ ID NO: 19179 - RNA, 22 nt, Homo sapiens
uguugccuuccccccaucuuuu

SEQ ID NO: 19180 - RNA, 22 nt, Homo sapiens
uuuuugcccaccugggagucaa

SEQ ID NO: 19181 - RNA, 22 nt, Homo sapiens
ugauuuucaugggaagcaagac

SEQ ID NO: 19182 - RNA, 22 nt, Homo sapiens
aauauugcuucuauuuguuuua

SEQ ID NO: 19183 - RNA, 22 nt, Homo sapiens
uaggggagagaagugauauucu

SEQ ID NO: 19184 - RNA, 22 nt, Homo sapiens
gcauuucucauuagcaacagac

SEQ ID NO: 19185 - RNA, 22 nt, Homo sapiens
uuguaguuaaugagucugugcu

SEQ ID NO: 19186 - RNA, 22 nt, Homo sapiens
agggcggggaucccuggcuuug

SEQ ID NO: 19187 - RNA, 22 nt, Homo sapiens
gacagggcuccccgcaccgcag

SEQ ID NO: 19188 - RNA, 22 nt, Homo sapiens
gggaugccccgagggcuccugc

SEQ ID NO: 19189 - RNA, 22 nt, Homo sapiens
accugcccuugggagccgucag

SEQ ID NO: 19190 - RNA, 22 nt, Homo sapiens
uccuguggcuguauuuggccag

SEQ ID NO: 19191 - RNA, 22 nt, Homo sapiens
gugaaaugccagccaaagcagg

SEQ ID NO: 19192 - RNA, 22 nt, Homo sapiens
auaguaagugcauaauaaaugu

SEQ ID NO: 19193 - RNA, 22 nt, Homo sapiens
uuuauuaaauacuuacugagag

SEQ ID NO: 19194 - RNA, 22 nt, Homo sapiens
uggagaagggaccgggaaggaa

SEQ ID NO: 19195 - RNA, 22 nt, Homo sapiens
uccucccagguucuaucuccuc

SEQ ID NO: 19196 - RNA, 22 nt, Homo sapiens
ucauaaagguggcgaugguaug

SEQ ID NO: 19197 - RNA, 22 nt, Homo sapiens
acugcuugccuuccuucaugau

SEQ ID NO: 19198 - RNA, 22 nt, Homo sapiens
ccugacagaugagggaguauuc

SEQ ID NO: 19199 - RNA, 22 nt, Homo sapiens
aucacuguuuccaucuaggcag

SEQ ID NO: 19200 - RNA, 22 nt, Homo sapiens
ccauccugccagcccugggcca

SEQ ID NO: 19201 - RNA, 22 nt, Homo sapiens
uuuggguuaguaggaugauccu

SEQ ID NO: 19202 - RNA, 22 nt, Homo sapiens
ucauggagucuccuaauaugag

SEQ ID NO: 19203 - RNA, 19 nt, Homo sapiens
ucauuuaggcagcuucuga

SEQ ID NO: 19204 - RNA, 22 nt, Homo sapiens
uucucccacuacccagcauggu

SEQ ID NO: 19205 - RNA, 22 nt, Homo sapiens
cugcuaccggggugggggagag

SEQ ID NO: 19206 - RNA, 22 nt, Homo sapiens
cagacaggcagcaggagggagu

SEQ ID NO: 19207 - RNA, 22 nt, Homo sapiens
ucguuuccucgcucgccuuucc

SEQ ID NO: 19208 - RNA, 22 nt, Homo sapiens
ccugcaggguuugcaucaauua

SEQ ID NO: 19209 - RNA, 20 nt, Homo sapiens
auugaugagcugccugcggc

SEQ ID NO: 19210 - RNA, 22 nt, Homo sapiens
uguagggguaggggaauggagc

SEQ ID NO: 19211 - RNA, 19 nt, Homo sapiens
ccuuucccuuccuuuccac

SEQ ID NO: 19212 - RNA, 22 nt, Homo sapiens
aggcuugggcccugcguguuuc

SEQ ID NO: 19213 - RNA, 22 nt, Homo sapiens
gaagcagguggggcuguuggga

SEQ ID NO: 19214 - RNA, 22 nt, Homo sapiens
uggugguuuccuuuugucuccu

SEQ ID NO: 19215 - RNA, 22 nt, Homo sapiens
ggugacaguaggaucuacccga

SEQ ID NO: 19216 - RNA, 22 nt, Homo sapiens
uggugguuuccuuuugucuccu

SEQ ID NO: 19217 - RNA, 22 nt, Homo sapiens
ggugacaguaggaucuacccga

SEQ ID NO: 19218 - RNA, 22 nt, Homo sapiens
uggugguuuccuuuugucuccu

SEQ ID NO: 19219 - RNA, 22 nt, Homo sapiens
ggugacaguaggaucuacccga

SEQ ID NO: 19220 - RNA, 22 nt, Homo sapiens
uggugguuuccuuuugucuccu

SEQ ID NO: 19221 - RNA, 22 nt, Homo sapiens
ggugacaguaggaucuacccga

SEQ ID NO: 19222 - RNA, 22 nt, Homo sapiens
uggugguuuccuuuugucuccu

SEQ ID NO: 19223 - RNA, 22 nt, Homo sapiens
gguggcaguaggaucuacccga

SEQ ID NO: 19224 - RNA, 22 nt, Homo sapiens
agaagaggcacaaaugcuacac

SEQ ID NO: 19225 - RNA, 22 nt, Homo sapiens
gucugcaauugugcuccuuucu

SEQ ID NO: 19226 - RNA, 22 nt, Homo sapiens
ucugugaucaaguucucugccu

SEQ ID NO: 19227 - RNA, 22 nt, Homo sapiens
gucagaggaccuugauacagac

SEQ ID NO: 19228 - RNA, 22 nt, Homo sapiens
ggugggagaugagaagggccaa

SEQ ID NO: 19229 - RNA, 22 nt, Homo sapiens
gugccucuugucauccuuccuu

SEQ ID NO: 19230 - RNA, 22 nt, Homo sapiens
uauuuugccuaagaaucucucu

SEQ ID NO: 19231 - RNA, 21 nt, Homo sapiens
gagauucauagcagcaaugua

SEQ ID NO: 19232 - RNA, 22 nt, Homo sapiens
uaaagcuuucagugcaaugccu

SEQ ID NO: 19233 - RNA, 22 nt, Homo sapiens
cauuguaaaugggaguauuauc

SEQ ID NO: 19234 - RNA, 22 nt, Homo sapiens
agcaggcuccgggggacaggga

SEQ ID NO: 19235 - RNA, 22 nt, Homo sapiens
uguccucuagggccugcagucu

SEQ ID NO: 19236 - RNA, 22 nt, Homo sapiens
uuaccuccuccucaaugaggcu

SEQ ID NO: 19237 - RNA, 22 nt, Homo sapiens
agucuguuccggagggguacca

SEQ ID NO: 19238 - RNA, 22 nt, Homo sapiens
uccagcucgagacugacucuga

SEQ ID NO: 19239 - RNA, 22 nt, Homo sapiens
gcgcaggggagucucagguggg

SEQ ID NO: 19240 - RNA, 22 nt, Homo sapiens
ggauggaguccuucaguccaga

SEQ ID NO: 19241 - RNA, 22 nt, Homo sapiens
ugggcugugggaauccuucuuu

SEQ ID NO: 19242 - RNA, 22 nt, Homo sapiens
uggagaguguagagagagaggu

SEQ ID NO: 19243 - RNA, 22 nt, Homo sapiens
ucuuucuaacacuuuucugaua

SEQ ID NO: 19244 - RNA, 22 nt, Homo sapiens
ccucuaagaguucuuuucuccu

SEQ ID NO: 19245 - RNA, 22 nt, Homo sapiens
ggaggaggacacuugagccucc

SEQ ID NO: 19246 - RNA, 22 nt, Homo sapiens
uuuccaucuccucauuguuucu

SEQ ID NO: 19247 - RNA, 22 nt, Homo sapiens
gagagaugagggcagaggagga

SEQ ID NO: 19248 - RNA, 22 nt, Homo sapiens
cggggggcugcggccgcccggc

SEQ ID NO: 19249 - RNA, 22 nt, Homo sapiens
ccgggaccgcagcgcucacggc

SEQ ID NO: 19250 - RNA, 22 nt, Homo sapiens
uccugauuagguuuccauagcu

SEQ ID NO: 19251 - RNA, 22 nt, Homo sapiens
uuacacaugggaaccugaucag

SEQ ID NO: 19252 - RNA, 22 nt, Homo sapiens
aggugauggacaguguagccau

SEQ ID NO: 19253 - RNA, 22 nt, Homo sapiens
ugugcucauucccgucucccgu

SEQ ID NO: 19254 - RNA, 22 nt, Homo sapiens
uaccagggaaggcccugggaga

SEQ ID NO: 19255 - RNA, 22 nt, Homo sapiens
ucuuccuggggccucagaggug

SEQ ID NO: 19256 - RNA, 22 nt, Homo sapiens
caacggaaucccaaaagcagcu

SEQ ID NO: 19257 - RNA, 22 nt, Homo sapiens
gcugcgcuuggauuucgucccc

SEQ ID NO: 19258 - RNA, 22 nt, Homo sapiens
aggacacagaaccgugggggca

SEQ ID NO: 19259 - RNA, 22 nt, Homo sapiens
cugccccuguuccuguguccca

SEQ ID NO: 19260 - RNA, 24 nt, Homo sapiens
aaaagugcuuacagugcagguagc

SEQ ID NO: 19261 - RNA, 22 nt, Homo sapiens
cugcaauguaagcacuucuuac

SEQ ID NO: 19262 - RNA, 22 nt, Homo sapiens
uucugacaugguagacuuuugg

SEQ ID NO: 19263 - RNA, 22 nt, Homo sapiens
caaaagacugcucaugggaaga

SEQ ID NO: 19264 - RNA, 22 nt, Homo sapiens
ugccuccacauggcugaggugu

SEQ ID NO: 19265 - RNA, 22 nt, Homo sapiens
cacccuggccuguggagccagg

SEQ ID NO: 19266 - RNA, 22 nt, Homo sapiens
ugccuccacauggcugaggugu

SEQ ID NO: 19267 - RNA, 22 nt, Homo sapiens
cacccuggccuguggagccagg

SEQ ID NO: 19268 - RNA, 22 nt, Homo sapiens
gccuccacauggcugaggugug

SEQ ID NO: 19269 - RNA, 22 nt, Homo sapiens
acccuggccuguggagccaggc

SEQ ID NO: 19270 - RNA, 22 nt, Homo sapiens
ugaagaugacagccgaugagcu

SEQ ID NO: 19271 - RNA, 22 nt, Homo sapiens
ucaccuggcugucaacuucuug

SEQ ID NO: 19272 - RNA, 22 nt, Homo sapiens
cagauuuucugaggccauuagg

SEQ ID NO: 19273 - RNA, 22 nt, Homo sapiens
ugauggacuugggaacuuuugu

SEQ ID NO: 19274 - RNA, 22 nt, Homo sapiens
uaguuuuucaaguauuuggggc

SEQ ID NO: 19275 - RNA, 22 nt, Homo sapiens
ccucagauauuuggauaauugc

SEQ ID NO: 19276 - RNA, 22 nt, Homo sapiens
ugggggaaagggacuugccugu

SEQ ID NO: 19277 - RNA, 22 nt, Homo sapiens
caggacaagcuuuugccauugc

SEQ ID NO: 19278 - RNA, 22 nt, Homo sapiens
gguccugagugaggaagagagu

SEQ ID NO: 19279 - RNA, 22 nt, Homo sapiens
ugagcucuuucucaucaggcuc

SEQ ID NO: 19280 - RNA, 22 nt, Homo sapiens
gguucagugguuagggccaacc

SEQ ID NO: 19281 - RNA, 16 nt, Homo sapiens
gcccagaucucugacc

SEQ ID NO: 19282 - RNA, 22 nt, Homo sapiens
uaguuaauaagauuggaagaaa

SEQ ID NO: 19283 - RNA, 21 nt, Homo sapiens
uuccagucuuaucuacuuauc

SEQ ID NO: 19284 - RNA, 22 nt, Homo sapiens
ccagaguagcaggaucuggcag

SEQ ID NO: 19285 - RNA, 22 nt, Homo sapiens
uaacccucaaacaauucacaua

SEQ ID NO: 19286 - RNA, 22 nt, Homo sapiens
ugagggucugggcacuccuggg

SEQ ID NO: 19287 - RNA, 22 nt, Homo sapiens
uccccagggggcagguccaucu

SEQ ID NO: 19288 - RNA, 22 nt, Homo sapiens
ugagggucugggcacuccuggg

SEQ ID NO: 19289 - RNA, 22 nt, Homo sapiens
uccccagggggcagguccaucu

SEQ ID NO: 19290 - RNA, 22 nt, Homo sapiens
ugagggucugggcacuccuggg

SEQ ID NO: 19291 - RNA, 22 nt, Homo sapiens
uccccagggggcagguccaucu

SEQ ID NO: 19292 - RNA, 22 nt, Homo sapiens
ugagggucugggcacuccuggg

SEQ ID NO: 19293 - RNA, 22 nt, Homo sapiens
uccccagggugcagguccaucu

SEQ ID NO: 19294 - RNA, 21 nt, Homo sapiens
cugaccuaugaauugacagcc

SEQ ID NO: 19295 - RNA, 22 nt, Homo sapiens
uggcugccaauuccauagguca

SEQ ID NO: 19296 - RNA, 22 nt, Homo sapiens
aaauguuaauuccauuguugga

SEQ ID NO: 19297 - RNA, 22 nt, Homo sapiens
uuacucaugggaucaacauucu

SEQ ID NO: 19298 - RNA, 22 nt, Homo sapiens
gaaaaccaaggccugagcuggg

SEQ ID NO: 19299 - RNA, 22 nt, Homo sapiens
ucagucuugggucggguuuucu

SEQ ID NO: 19300 - RNA, 22 nt, Homo sapiens
uuucucuaucuuugaggcugca

SEQ ID NO: 19301 - RNA, 22 nt, Homo sapiens
uuuugcagccuggugaggaaau

SEQ ID NO: 19302 - RNA, 22 nt, Homo sapiens
ucuccucugucuaccacgaggg

SEQ ID NO: 19303 - RNA, 22 nt, Homo sapiens
uuuuguggugauggagaggcac

SEQ ID NO: 19304 - RNA, 22 nt, Homo sapiens
cggggccuggugaauuaggacg

SEQ ID NO: 19305 - RNA, 22 nt, Homo sapiens
uccagauugauccagcccuugg

SEQ ID NO: 19306 - RNA, 22 nt, Homo sapiens
uuugcauaaucauuuaucugaa

SEQ ID NO: 19307 - RNA, 22 nt, Homo sapiens
auuucagagugugaugcaaaag

SEQ ID NO: 19308 - RNA, 22 nt, Homo sapiens
cccccaggccucacuggcucag

SEQ ID NO: 19309 - RNA, 22 nt, Homo sapiens
guagcucugaggccugggucug

SEQ ID NO: 19310 - RNA, 22 nt, Homo sapiens
ugacugaugucuggggcagagu

SEQ ID NO: 19311 - RNA, 22 nt, Homo sapiens
acucuuccuccgacauccucuc

SEQ ID NO: 19312 - RNA, 22 nt, Homo sapiens
ucaugaaggcgcauugagggga

SEQ ID NO: 19313 - RNA, 22 nt, Homo sapiens
cccuugcugugccuuuucacau

SEQ ID NO: 19314 - RNA, 22 nt, Homo sapiens
uguacuggaacucgagugaaca

SEQ ID NO: 19315 - RNA, 22 nt, Homo sapiens
uucucuagaauccagcccaauu

SEQ ID NO: 19316 - RNA, 22 nt, Homo sapiens
gagagcgggguugggggcggac

SEQ ID NO: 19317 - RNA, 22 nt, Homo sapiens
ucccccccauccccuuucuacc

SEQ ID NO: 19318 - RNA, 22 nt, Homo sapiens
uacuuuguggaggggagguuuu

SEQ ID NO: 19319 - RNA, 22 nt, Homo sapiens
agcccagcuccuccacagaaua

SEQ ID NO: 19320 - RNA, 22 nt, Homo sapiens
ugcaccaugguugucugagcau

SEQ ID NO: 19321 - RNA, 22 nt, Homo sapiens
ugcucauaccccaugguuucug

SEQ ID NO: 19322 - RNA, 22 nt, Homo sapiens
agagguggcauggagccuggcu

SEQ ID NO: 19323 - RNA, 22 nt, Homo sapiens
agccagucuauacgccaucucu

SEQ ID NO: 19324 - RNA, 22 nt, Homo sapiens
gauuccuggaaauacuguucuu

SEQ ID NO: 19325 - RNA, 24 nt, Homo sapiens
guccaguuuucccaggaaucccuu

SEQ ID NO: 19326 - RNA, 22 nt, Homo sapiens
uucuaggauuucucagguguag

SEQ ID NO: 19327 - RNA, 22 nt, Homo sapiens
cauuugagaaauccgcaggaua

SEQ ID NO: 19328 - RNA, 22 nt, Homo sapiens
uuucguaacuccugacccaagc

SEQ ID NO: 19329 - RNA, 22 nt, Homo sapiens
gcuagggaggagcauggaccuu

SEQ ID NO: 19330 - RNA, 22 nt, Homo sapiens
uuguuuuguucauucaugcauc

SEQ ID NO: 19331 - RNA, 20 nt, Homo sapiens
cuaaaugagugaaugaacaa

SEQ ID NO: 19332 - RNA, 22 nt, Homo sapiens
ucuugaagguucuaccauacau

SEQ ID NO: 19333 - RNA, 22 nt, Homo sapiens
uaugguagggguuuugagcugu

SEQ ID NO: 19334 - RNA, 22 nt, Homo sapiens
uuuuguggaguuuguaaauuug

SEQ ID NO: 19335 - RNA, 22 nt, Homo sapiens
gauuuuauaggcuucauaaacu

SEQ ID NO: 19336 - RNA, 22 nt, Homo sapiens
uugagcagcucggagccauaag

SEQ ID NO: 19337 - RNA, 22 nt, Homo sapiens
ugugguaaagcugcuuauuguu

SEQ ID NO: 19338 - RNA, 22 nt, Homo sapiens
uggugauugaauaaaaguguca

SEQ ID NO: 19339 - RNA, 22 nt, Homo sapiens
auggccuuuuguucucccucau

SEQ ID NO: 19340 - RNA, 22 nt, Homo sapiens
ucugcagaggcccuacugugca

SEQ ID NO: 19341 - RNA, 21 nt, Homo sapiens
auagucagggcccuguuugau

SEQ ID NO: 19342 - RNA, 22 nt, Homo sapiens
uaaaauugaucccaagguccuu

SEQ ID NO: 19343 - RNA, 22 nt, Homo sapiens
uaagacuuagggaucggacuua

SEQ ID NO: 19344 - RNA, 22 nt, Homo sapiens
gcacaguguggccaccuucagu

SEQ ID NO: 19345 - RNA, 22 nt, Homo sapiens
uggcaguggguggcacuguguc

SEQ ID NO: 19346 - RNA, 22 nt, Homo sapiens
ucgugucucuccagggcugcac

SEQ ID NO: 19347 - RNA, 22 nt, Homo sapiens
ugucuaccuggacggccacagg

SEQ ID NO: 19348 - RNA, 22 nt, Homo sapiens
ugugguacaugcuggaaguugc

SEQ ID NO: 19349 - RNA, 22 nt, Homo sapiens
gcagcucaguauaguaccucug

SEQ ID NO: 19350 - RNA, 22 nt, Homo sapiens
uccuccuccccgcugggacagc

SEQ ID NO: 19351 - RNA, 22 nt, Homo sapiens
ugccaguggggguaggagaggg

SEQ ID NO: 19352 - RNA, 22 nt, Homo sapiens
uugugcaaucuguuuggcugcu

SEQ ID NO: 19353 - RNA, 22 nt, Homo sapiens
agccccacagagugguagaauu

SEQ ID NO: 19354 - RNA, 22 nt, Homo sapiens
aggcaagcauggcguuuggagc

SEQ ID NO: 19355 - RNA, 22 nt, Homo sapiens
ucaaaucccagcucugccacuu

SEQ ID NO: 19356 - RNA, 22 nt, Homo sapiens
ccuauuaagagaagccccauuu

SEQ ID NO: 19357 - RNA, 22 nt, Homo sapiens
augaaguuuucuugaauaggcu

SEQ ID NO: 19358 - RNA, 22 nt, Homo sapiens
cacggguuaggcucuugggagc

SEQ ID NO: 19359 - RNA, 22 nt, Homo sapiens
ucccugagacccuaacuuguga

SEQ ID NO: 19360 - RNA, 22 nt, Homo sapiens
uuuuaugagguaauaauccagu

SEQ ID NO: 19361 - RNA, 22 nt, Homo sapiens
gagaaaaccaaguuauugccuc

SEQ ID NO: 19362 - RNA, 22 nt, Homo sapiens
aaaacaucccuugagagaggau

SEQ ID NO: 19363 - RNA, 22 nt, Homo sapiens
cagcucuccuucagggguguuu

SEQ ID NO: 19364 - RNA, 22 nt, Homo sapiens
agaaaggcauggaggcaaacuu

SEQ ID NO: 19365 - RNA, 22 nt, Homo sapiens
auuuugcuucaugucuuuugcu

SEQ ID NO: 19366 - RNA, 22 nt, Homo sapiens
acuauaaaauguagagagcgau

SEQ ID NO: 19367 - RNA, 22 nt, Homo sapiens
ugcuuuacauauuuuaacucuu

SEQ ID NO: 19368 - RNA, 22 nt, Homo sapiens
uaguccccagaaugcaaaugcu

SEQ ID NO: 19369 - RNA, 22 nt, Homo sapiens
caucugcauauugggagaccug

SEQ ID NO: 19370 - RNA, 22 nt, Homo sapiens
caggagguccucuggaguucug

SEQ ID NO: 19371 - RNA, 22 nt, Homo sapiens
aacuucagaggaacuccuggga

SEQ ID NO: 19372 - RNA, 22 nt, Homo sapiens
uagccugaaaauagagaugguc

SEQ ID NO: 19373 - RNA, 22 nt, Homo sapiens
ccaauucuguuuucaauggcuu

SEQ ID NO: 19374 - RNA, 22 nt, Homo sapiens
uaggcgggcuggggucggaggu

SEQ ID NO: 19375 - RNA, 22 nt, Homo sapiens
uucccuuggccccagcucgucc

SEQ ID NO: 19376 - RNA, 22 nt, Homo sapiens
ggcuuuuaguuuccauagaaaa

SEQ ID NO: 19377 - RNA, 22 nt, Homo sapiens
uucaaaagaaacugaaagcacc

SEQ ID NO: 19378 - RNA, 22 nt, Homo sapiens
uagaaugaggacauagcuuuuu

SEQ ID NO: 19379 - RNA, 22 nt, Homo sapiens
aaggcuguguccucauuuuaua

SEQ ID NO: 19380 - RNA, 22 nt, Homo sapiens
ugcucugacgagguugcacuac

SEQ ID NO: 19381 - RNA, 22 nt, Homo sapiens
ugcaaugauauugucaaagcau

SEQ ID NO: 19382 - RNA, 22 nt, Homo sapiens
cgcuuccccgccuccccucugc

SEQ ID NO: 19383 - RNA, 22 nt, Homo sapiens
agggugagguggggaggcggcg

SEQ ID NO: 19384 - RNA, 22 nt, Homo sapiens
acuuuuuugguagugccuucug

SEQ ID NO: 19385 - RNA, 22 nt, Homo sapiens
aaggucaaggccaaaagagugg

SEQ ID NO: 19386 - RNA, 22 nt, Homo sapiens
gggucugugucacugugggagu

SEQ ID NO: 19387 - RNA, 19 nt, Homo sapiens
cucacagugacacgagccc

SEQ ID NO: 19388 - RNA, 22 nt, Homo sapiens
acauggauuuuccucuaugauu

SEQ ID NO: 19389 - RNA, 22 nt, Homo sapiens
aacauagaaggaauauccacgu

SEQ ID NO: 19390 - RNA, 22 nt, Homo sapiens
ucuggaggcaauugggacuaua

SEQ ID NO: 19391 - RNA, 22 nt, Homo sapiens
auuuugccaguuguucagagaa

SEQ ID NO: 19392 - RNA, 22 nt, Homo sapiens
ugccuugagaaauggaaagguc

SEQ ID NO: 19393 - RNA, 22 nt, Homo sapiens
cuuuuccauuucuacacccuag

SEQ ID NO: 19394 - RNA, 22 nt, Homo sapiens
ucagcugcggugcagcgugggu

SEQ ID NO: 19395 - RNA, 22 nt, Homo sapiens
cccacacuguauucgucagcuc

SEQ ID NO: 19396 - RNA, 22 nt, Homo sapiens
ugggauucucugguggucagaa

SEQ ID NO: 19397 - RNA, 22 nt, Homo sapiens
ucagaccacgggaggaacccag

SEQ ID NO: 19398 - RNA, 22 nt, Homo sapiens
caggcccugggggagauggagg

SEQ ID NO: 19399 - RNA, 22 nt, Homo sapiens
uccauuuuccaccagagcugca

SEQ ID NO: 19400 - RNA, 22 nt, Homo sapiens
caaucugcuucucaagccacca

SEQ ID NO: 19401 - RNA, 19 nt, Homo sapiens
ugguuugcagagcguuuug

SEQ ID NO: 19402 - RNA, 22 nt, Homo sapiens
uucuguggcagauugggaugga

SEQ ID NO: 19403 - RNA, 22 nt, Homo sapiens
auccuguuuugccagugagaag

SEQ ID NO: 19404 - RNA, 22 nt, Homo sapiens
gcuuccuccagggaggggccug

SEQ ID NO: 19405 - RNA, 16 nt, Homo sapiens
cccuccuggcaguggc

SEQ ID NO: 19406 - RNA, 22 nt, Homo sapiens
ccgaguuuucaggacuucaggg

SEQ ID NO: 19407 - RNA, 22 nt, Homo sapiens
uucgaaguuuuaaaauuuggag

SEQ ID NO: 19408 - RNA, 22 nt, Homo sapiens
gccuccgugauggccguggugu

SEQ ID NO: 19409 - RNA, 20 nt, Homo sapiens
accgcccgcugcacuuuggc

SEQ ID NO: 19410 - RNA, 22 nt, Homo sapiens
gaagacccuaggacucccuccu

SEQ ID NO: 19411 - RNA, 22 nt, Homo sapiens
acucgagccccagggucugaug

SEQ ID NO: 19412 - RNA, 22 nt, Homo sapiens
agcagugggauaugguguaugg

SEQ ID NO: 19413 - RNA, 22 nt, Homo sapiens
uacagccuguguccugcucugu

SEQ ID NO: 19414 - RNA, 22 nt, Homo sapiens
uacagccacaguggaaaauggg

SEQ ID NO: 19415 - RNA, 22 nt, Homo sapiens
uuuucuauugcaaaugggugua

SEQ ID NO: 19416 - RNA, 22 nt, Homo sapiens
ucgugguccuggcuuccucauc

SEQ ID NO: 19417 - RNA, 22 nt, Homo sapiens
gauggggcuccaggccuuugca

SEQ ID NO: 19418 - RNA, 22 nt, Homo sapiens
agccugcugaagcucagagggc

SEQ ID NO: 19419 - RNA, 22 nt, Homo sapiens
ucggauccgucugagcuuggcu

SEQ ID NO: 19420 - RNA, 22 nt, Homo sapiens
ugagguguuuugugaggcgagc

SEQ ID NO: 19421 - RNA, 22 nt, Homo sapiens
guuccucugccgacuauuucag

SEQ ID NO: 19422 - RNA, 22 nt, Homo sapiens
ugcucauucaagugaagaguca

SEQ ID NO: 19423 - RNA, 22 nt, Homo sapiens
uagcuucuugcuuggcugagca

SEQ ID NO: 19424 - RNA, 22 nt, Homo sapiens
cagugucugcuuggcuccaggg

SEQ ID NO: 19425 - RNA, 22 nt, Homo sapiens
uugggacuaacagaaaauuggc

SEQ ID NO: 19426 - RNA, 22 nt, Homo sapiens
ugcuuuggauuuuguaccuggg

SEQ ID NO: 19427 - RNA, 22 nt, Homo sapiens
agguauagaauugaaagcacuc

SEQ ID NO: 19428 - RNA, 22 nt, Homo sapiens
uuucagaagucaacuagguaaa

SEQ ID NO: 19429 - RNA, 22 nt, Homo sapiens
uccugggaugacuuuugaaaug

SEQ ID NO: 19430 - RNA, 22 nt, Homo sapiens
ugcaagguuucucucugccuaa

SEQ ID NO: 19431 - RNA, 22 nt, Homo sapiens
gaguaggagaggccuugugggg

SEQ ID NO: 19432 - RNA, 22 nt, Homo sapiens
uggggucaggugugugcacagg

SEQ ID NO: 19433 - RNA, 22 nt, Homo sapiens
cugcagccauugccuggcccug

SEQ ID NO: 19434 - RNA, 22 nt, Homo sapiens
uggacguuguuggggugcucuc

SEQ ID NO: 19435 - RNA, 22 nt, Homo sapiens
ugggggagcauucccugcuccu

SEQ ID NO: 19436 - RNA, 22 nt, Homo sapiens
ugaguugaccuccacagggcca

SEQ ID NO: 19437 - RNA, 22 nt, Homo sapiens
caaguggaaguuacuuuaccuc

SEQ ID NO: 19438 - RNA, 22 nt, Homo sapiens
uggggcacacagauuuauaguu

SEQ ID NO: 19439 - RNA, 22 nt, Homo sapiens
cugaacugacugugcccugccc

SEQ ID NO: 19440 - RNA, 22 nt, Homo sapiens
ugggguugagucaaggcagagc

SEQ ID NO: 19441 - RNA, 22 nt, Homo sapiens
ugugcugcaggucagcccuggg

SEQ ID NO: 19442 - RNA, 22 nt, Homo sapiens
aagucaggugcugagauguucc

SEQ ID NO: 19443 - RNA, 22 nt, Homo sapiens
guuccucuagugccugagggga

SEQ ID NO: 19444 - RNA, 22 nt, Homo sapiens
ugaggcccagcauucagggcag

SEQ ID NO: 19445 - RNA, 22 nt, Homo sapiens
ugucuuugugcugggaucucau

SEQ ID NO: 19446 - RNA, 22 nt, Homo sapiens
ugccacugccucaucucuuucc

SEQ ID NO: 19447 - RNA, 22 nt, Homo sapiens
aaaaugggagggaaugguggug

SEQ ID NO: 19448 - RNA, 22 nt, Homo sapiens
uacagcuaagaauuucaucuuu

SEQ ID NO: 19449 - RNA, 22 nt, Homo sapiens
agauuaaauucauacuguacug

SEQ ID NO: 19450 - RNA, 22 nt, Homo sapiens
uuacuguuggacauguguggcu

SEQ ID NO: 19451 - RNA, 22 nt, Homo sapiens
gguuuaguauguucauauguga

SEQ ID NO: 19452 - RNA, 22 nt, Homo sapiens
uaugcaugaggagaggacugag

SEQ ID NO: 19453 - RNA, 22 nt, Homo sapiens
guuuucaucuucgugccagagc

SEQ ID NO: 19454 - RNA, 22 nt, Homo sapiens
ucaugcucuggggcugaggccg

SEQ ID NO: 19455 - RNA, 22 nt, Homo sapiens
cugcuccagcccugggguuggg

SEQ ID NO: 19456 - RNA, 22 nt, Homo sapiens
ggugcagguauguuacuuuuac

SEQ ID NO: 19457 - RNA, 22 nt, Homo sapiens
uaaguaacauauuuugugcuuu

SEQ ID NO: 19458 - RNA, 22 nt, Homo sapiens
uuuugcuguuugggaguguuuu

SEQ ID NO: 19459 - RNA, 22 nt, Homo sapiens
caaggcuuucucaaauaggaua

SEQ ID NO: 19460 - RNA, 22 nt, Homo sapiens
acauccuacauaugcaaccagc

SEQ ID NO: 19461 - RNA, 22 nt, Homo sapiens
uggcagcacuaugcaggauguu

SEQ ID NO: 19462 - RNA, 22 nt, Homo sapiens
uggggaggugguguggcugucg

SEQ ID NO: 19463 - RNA, 22 nt, Homo sapiens
cucauuuuggccaaauugcuau

SEQ ID NO: 19464 - RNA, 22 nt, Homo sapiens
agucuccugaagaagaggcaga

SEQ ID NO: 19465 - RNA, 22 nt, Homo sapiens
ugucucuauucuaggagcugcu

SEQ ID NO: 19466 - RNA, 22 nt, Homo sapiens
uuguacaggaauaaaaggaaua

SEQ ID NO: 19467 - RNA, 22 nt, Homo sapiens
uacuauuucuuuauuacugacu

SEQ ID NO: 19468 - RNA, 22 nt, Homo sapiens
ucuggggguggaggggaggguc

SEQ ID NO: 19469 - RNA, 22 nt, Homo sapiens
ucuccuccucccacugccagac

SEQ ID NO: 19470 - RNA, 22 nt, Homo sapiens
uguguccuagucaggagaggca

SEQ ID NO: 19471 - RNA, 18 nt, Homo sapiens
ucguccuugaggauccac

SEQ ID NO: 19472 - RNA, 22 nt, Homo sapiens
uggccuaucaucugacauacag

SEQ ID NO: 19473 - RNA, 22 nt, Homo sapiens
gagguguuggauggggcugcuc

SEQ ID NO: 19474 - RNA, 22 nt, Homo sapiens
ccuugcuugcagcauaugcauu

SEQ ID NO: 19475 - RNA, 19 nt, Homo sapiens
uaugugcuuucaagugagg

SEQ ID NO: 19476 - RNA, 22 nt, Homo sapiens
ugaaaggaaaaggguuuugacu

SEQ ID NO: 19477 - RNA, 22 nt, Homo sapiens
aagggaacucuuucacuuuugc

SEQ ID NO: 19478 - RNA, 22 nt, Homo sapiens
ugguguagccgccaagcggagg

SEQ ID NO: 19479 - RNA, 22 nt, Homo sapiens
cucucgcuagcgcucugcgccc

SEQ ID NO: 19480 - RNA, 22 nt, Homo sapiens
uccugggaaugaggcccgcuuc

SEQ ID NO: 19481 - RNA, 20 nt, Homo sapiens
aggggguucuuuuccuggga

SEQ ID NO: 19482 - RNA, 22 nt, Homo sapiens
cacuggacuucccaaucccgag

SEQ ID NO: 19483 - RNA, 20 nt, Homo sapiens
uccuggaugggagucuggug

SEQ ID NO: 19484 - RNA, 22 nt, Homo sapiens
ugacucuucaaccucaggacuu

SEQ ID NO: 19485 - RNA, 22 nt, Homo sapiens
cuguccuaagguuguugaguug

SEQ ID NO: 19486 - RNA, 22 nt, Homo sapiens
uucaaacugagcuucaaguggc

SEQ ID NO: 19487 - RNA, 22 nt, Homo sapiens
cacauaaaagguagcaguuuga

SEQ ID NO: 19488 - RNA, 22 nt, Homo sapiens
ugugaauugccugcugucagcc

SEQ ID NO: 19489 - RNA, 21 nt, Homo sapiens
uggcugcaggcauauuugcau

SEQ ID NO: 19490 - RNA, 22 nt, Homo sapiens
uggccaggaugacguguaggug

SEQ ID NO: 19491 - RNA, 22 nt, Homo sapiens
ccccucauggcuccugguccaa

SEQ ID NO: 19492 - RNA, 22 nt, Homo sapiens
ugccuaguaccuucuuuucuuc

SEQ ID NO: 19493 - RNA, 21 nt, Homo sapiens
ggaugaagaggguggguggga

SEQ ID NO: 19494 - RNA, 22 nt, Homo sapiens
ugcuuucuagcagguagauguu

SEQ ID NO: 19495 - RNA, 22 nt, Homo sapiens
caucuugcuuguuagaggugcu

SEQ ID NO: 19496 - RNA, 22 nt, Homo sapiens
ucagccaccccaguuugccugg

SEQ ID NO: 19497 - RNA, 22 nt, Homo sapiens
ugggcacacugggaugaauugg

SEQ ID NO: 19498 - RNA, 22 nt, Homo sapiens
aggucugcgagcucugcugggu

SEQ ID NO: 19499 - RNA, 22 nt, Homo sapiens
ccuucucagagcuguagccuug

SEQ ID NO: 19500 - RNA, 22 nt, Homo sapiens
gcuuggagcuccugcuaccaug

SEQ ID NO: 19501 - RNA, 22 nt, Homo sapiens
ugguuacgaaaggagucugagc

SEQ ID NO: 19502 - RNA, 22 nt, Homo sapiens
uucuauuuucugcuucuaaacu

SEQ ID NO: 19503 - RNA, 22 nt, Homo sapiens
guuugagcaggaauucgaagcc

SEQ ID NO: 19504 - RNA, 22 nt, Homo sapiens
gggugggugccaggguggggca

SEQ ID NO: 19505 - RNA, 21 nt, Homo sapiens
ugcccuccaccugcccugccu

SEQ ID NO: 19506 - RNA, 23 nt, Homo sapiens
uaagugcuuccauguuucagugg

SEQ ID NO: 19507 - RNA, 22 nt, Homo sapiens
uuuaacauggggguaccugcug

SEQ ID NO: 19508 - RNA, 22 nt, Homo sapiens
ugacccagcucuuuuccuguuc

SEQ ID NO: 19509 - RNA, 22 nt, Homo sapiens
aggaaaggcucuggguaauuga

SEQ ID NO: 19510 - RNA, 22 nt, Homo sapiens
ugaagauagguuauccguguug

SEQ ID NO: 19511 - RNA, 22 nt, Homo sapiens
auacacgguugaccuauuuuuc

SEQ ID NO: 19512 - RNA, 22 nt, Homo sapiens
ucaugaagcuuacaguaugauc

SEQ ID NO: 19513 - RNA, 19 nt, Homo sapiens
uaugcuguaaguuguuuga

SEQ ID NO: 19514 - RNA, 22 nt, Homo sapiens
uugaaagagaggagaggaagcc

SEQ ID NO: 19515 - RNA, 22 nt, Homo sapiens
ucauccucuaguuuuuuucaag

SEQ ID NO: 19516 - RNA, 22 nt, Homo sapiens
gggaggauggugcaucacuuaa

SEQ ID NO: 19517 - RNA, 22 nt, Homo sapiens
agugucauggaccuuccucccu

SEQ ID NO: 19518 - RNA, 22 nt, Homo sapiens
ggcugccaggcauauggccucu

SEQ ID NO: 19519 - RNA, 20 nt, Homo sapiens
auggaggcccugucugugcc

SEQ ID NO: 19520 - RNA, 22 nt, Homo sapiens
uaaugccuggguccuuccucag

SEQ ID NO: 19521 - RNA, 22 nt, Homo sapiens
ucuggaggagagacucaggcau

SEQ ID NO: 19522 - RNA, 22 nt, Homo sapiens
agguguuucuguucuucagaga

SEQ ID NO: 19523 - RNA, 18 nt, Homo sapiens
uucuaagaacaggguccu

SEQ ID NO: 19524 - RNA, 22 nt, Homo sapiens
agaugugggacagagcuccucg

SEQ ID NO: 19525 - RNA, 20 nt, Homo sapiens
aggagaaacuguccuuuucu

SEQ ID NO: 19526 - RNA, 22 nt, Homo sapiens
uuucggguguuuuucuccaguc

SEQ ID NO: 19527 - RNA, 22 nt, Homo sapiens
uguagaaagcacgggccccagg

SEQ ID NO: 19528 - RNA, 22 nt, Homo sapiens
ccagaguagcaggaucuggcag

SEQ ID NO: 19529 - RNA, 22 nt, Homo sapiens
uaacccucaaagaauccacaua

SEQ ID NO: 19530 - RNA, 22 nt, Homo sapiens
caaauucguaucuaggggaaua

SEQ ID NO: 19531 - RNA, 23 nt, Homo sapiens
uacccuguagauccgaauuugug

SEQ ID NO: 19532 - RNA, 22 nt, Homo sapiens
ugguaugccucguuuccaguaa

SEQ ID NO: 19533 - RNA, 22 nt, Homo sapiens
uguugagggcuaggcaaucuac

SEQ ID NO: 19534 - RNA, 22 nt, Homo sapiens
aaagccagcauuauguuuaauu

SEQ ID NO: 19535 - RNA, 22 nt, Homo sapiens
uaaauaugaugcuagcuuuuag

SEQ ID NO: 19536 - RNA, 22 nt, Homo sapiens
uuaauaugcaaauucuaagugg

SEQ ID NO: 19537 - RNA, 22 nt, Homo sapiens
ugugcuaauuugcacauuaaua

SEQ ID NO: 19538 - RNA, 22 nt, Homo sapiens
uccccaagcucuaaggacuucc

SEQ ID NO: 19539 - RNA, 22 nt, Homo sapiens
guguccauagaagcuuuggggc

SEQ ID NO: 19540 - RNA, 22 nt, Homo sapiens
uuaucacagaagcaaaugaaaa

SEQ ID NO: 19541 - RNA, 22 nt, Homo sapiens
ucauuuacuucuaugacaacau

SEQ ID NO: 19542 - RNA, 22 nt, Homo sapiens
ccagguacaucauuagccaacu

SEQ ID NO: 19543 - RNA, 22 nt, Homo sapiens
cuuggaaggugagucccugggu

SEQ ID NO: 19544 - RNA, 22 nt, Homo sapiens
uuguacaaagucacaugaguca

SEQ ID NO: 19545 - RNA, 22 nt, Homo sapiens
auucuugugacuuuuguaacau

SEQ ID NO: 19546 - RNA, 22 nt, Homo sapiens
aacuuuggguuacuauggcaau

SEQ ID NO: 19547 - RNA, 17 nt, Homo sapiens
ugccguagacccauguu

SEQ ID NO: 19548 - RNA, 22 nt, Homo sapiens
gcaucauuguucucucaggcug

SEQ ID NO: 19549 - RNA, 22 nt, Homo sapiens
ggcugggggaacaauauugcug

SEQ ID NO: 19550 - RNA, 22 nt, Homo sapiens
uggagauagccccggguggggg

SEQ ID NO: 19551 - RNA, 22 nt, Homo sapiens
ccggcuuggggacagcuccaga

SEQ ID NO: 19552 - RNA, 22 nt, Homo sapiens
aaaacacccucuaagagaggag

SEQ ID NO: 19553 - RNA, 22 nt, Homo sapiens
uucucuuagaggguguagaguu

SEQ ID NO: 19554 - RNA, 22 nt, Homo sapiens
uuuaucuugacuggauugcuua

SEQ ID NO: 19555 - RNA, 22 nt, Homo sapiens
uuaaauuguccaguugagauaa

SEQ ID NO: 19556 - RNA, 22 nt, Homo sapiens
uaggggaccuccuauagggaua

SEQ ID NO: 19557 - RNA, 22 nt, Homo sapiens
uuccuacaggagguuccccuua

SEQ ID NO: 19558 - RNA, 22 nt, Homo sapiens
gauguccugaggcagaggauau

SEQ ID NO: 19559 - RNA, 22 nt, Homo sapiens
uccucuccccuaggccaucuug

SEQ ID NO: 19560 - RNA, 22 nt, Homo sapiens
uucuggaaacugaaaugggaca

SEQ ID NO: 19561 - RNA, 22 nt, Homo sapiens
ugucucauuucagggcagaggg

SEQ ID NO: 19562 - RNA, 22 nt, Homo sapiens
uggucauaaggucugcuuagau

SEQ ID NO: 19563 - RNA, 22 nt, Homo sapiens
ucuuaggcaguucuuugugcug

SEQ ID NO: 19564 - RNA, 22 nt, Homo sapiens
uggucauaaggucugcuuagau

SEQ ID NO: 19565 - RNA, 22 nt, Homo sapiens
ucuuaggcaguucuuugugcug

SEQ ID NO: 19566 - RNA, 22 nt, Homo sapiens
aggcgaagucagagagcucuuc

SEQ ID NO: 19567 - RNA, 22 nt, Homo sapiens
agagcucucuggcuuugccuua

SEQ ID NO: 19568 - RNA, 22 nt, Homo sapiens
ucuuguaccuugcagcacacuc

SEQ ID NO: 19569 - RNA, 22 nt, Homo sapiens
ugugccuguaagauguauuagc

SEQ ID NO: 19570 - RNA, 22 nt, Homo sapiens
ugacagugucuaucuuauuggu

SEQ ID NO: 19571 - RNA, 22 nt, Homo sapiens
uccuaggauggugccuggcacu

SEQ ID NO: 19572 - RNA, 22 nt, Homo sapiens
ugucuuugaauggggguaauug

SEQ ID NO: 19573 - RNA, 22 nt, Homo sapiens
cagguuguucccuggaagaggg

SEQ ID NO: 19574 - RNA, 22 nt, Homo sapiens
ucuguuugacaguucuggcuua

SEQ ID NO: 19575 - RNA, 22 nt, Homo sapiens
acaaagccaagacuuaaauaga

SEQ ID NO: 19576 - RNA, 22 nt, Homo sapiens
uucuuugucaguuuacgccauu

SEQ ID NO: 19577 - RNA, 22 nt, Homo sapiens
uggugggaaacugacagaauga

SEQ ID NO: 19578 - RNA, 22 nt, Homo sapiens
gcccugugaugggaugugggca

SEQ ID NO: 19579 - RNA, 22 nt, Homo sapiens
aacccaacucuucacagggccg

SEQ ID NO: 19580 - RNA, 22 nt, Homo sapiens
uagguauauaguguaaaaccuu

SEQ ID NO: 19581 - RNA, 22 nt, Homo sapiens
aguuuuugcacuauauaccuau

SEQ ID NO: 19582 - RNA, 22 nt, Homo sapiens
uggcaugccucaaagggacugg

SEQ ID NO: 19583 - RNA, 22 nt, Homo sapiens
cuaggucccucugagggucacu

SEQ ID NO: 19584 - RNA, 22 nt, Homo sapiens
uacaugugcacaacgugcaggu

SEQ ID NO: 19585 - RNA, 22 nt, Homo sapiens
ugugccauguuggugugcugca

SEQ ID NO: 19586 - RNA, 22 nt, Homo sapiens
uggcuggaguguaggugcugga

SEQ ID NO: 19587 - RNA, 22 nt, Homo sapiens
augccccugcccuccagcaugu

SEQ ID NO: 19588 - RNA, 22 nt, Homo sapiens
ugugaggguacagggggaaggu

SEQ ID NO: 19589 - RNA, 22 nt, Homo sapiens
uucccuuugugccuucgauucu

SEQ ID NO: 19590 - RNA, 22 nt, Homo sapiens
uguuguugaccugcugggugug

SEQ ID NO: 19591 - RNA, 22 nt, Homo sapiens
uuuaccaguaggucaauucucu

SEQ ID NO: 19592 - RNA, 22 nt, Homo sapiens
uacuacccuaccuacuaccaaa

SEQ ID NO: 19593 - RNA, 22 nt, Homo sapiens
uuugguaauagguauaguaccu

SEQ ID NO: 19594 - RNA, 22 nt, Homo sapiens
ccuaagugaaaaauaugcuaag

SEQ ID NO: 19595 - RNA, 22 nt, Homo sapiens
uagcguguuuuucacauagggu

SEQ ID NO: 19596 - RNA, 22 nt, Homo sapiens
ugcaggguauaggcgcgcccgc

SEQ ID NO: 19597 - RNA, 22 nt, Homo sapiens
cgggugggccucugcgcugcug

SEQ ID NO: 19598 - RNA, 22 nt, Homo sapiens
ucacccugcuuugcggagaaug

SEQ ID NO: 19599 - RNA, 22 nt, Homo sapiens
ucucagcagagccaggagagag

SEQ ID NO: 19600 - RNA, 22 nt, Homo sapiens
gcauagagcuccaggccuggga

SEQ ID NO: 19601 - RNA, 22 nt, Homo sapiens
cuuuggucuggagacucuugcu

SEQ ID NO: 19602 - RNA, 22 nt, Homo sapiens
ggcuuuuguccuguggggcaau

SEQ ID NO: 19603 - RNA, 19 nt, Homo sapiens
auugcucuuuggauuugcc

SEQ ID NO: 19604 - RNA, 22 nt, Homo sapiens
ugagggaaacucauucauacuc

SEQ ID NO: 19605 - RNA, 22 nt, Homo sapiens
gaugaaugaguuuccuuuccag

SEQ ID NO: 19606 - RNA, 22 nt, Homo sapiens
gagcuaagaaaccucugaaugg

SEQ ID NO: 19607 - RNA, 22 nt, Homo sapiens
uauucagaggcuuucugggcug

SEQ ID NO: 19608 - RNA, 22 nt, Homo sapiens
gagguagggaaaucucuugcuc

SEQ ID NO: 19609 - RNA, 22 nt, Homo sapiens
agcaagauuucucuauuuccug

SEQ ID NO: 19610 - RNA, 22 nt, Homo sapiens
ggcuguuccuggggcaagggag

SEQ ID NO: 19611 - RNA, 18 nt, Homo sapiens
uugccuuaggagcagacc

SEQ ID NO: 19612 - RNA, 22 nt, Homo sapiens
ucaaguguuggauagcgguuga

SEQ ID NO: 19613 - RNA, 22 nt, Homo sapiens
acucagguuuaauacuuggcuu

SEQ ID NO: 19614 - RNA, 22 nt, Homo sapiens
cccugccuucuccauucacaca

SEQ ID NO: 19615 - RNA, 18 nt, Homo sapiens
ugaaggagggggcggugg

SEQ ID NO: 19616 - RNA, 22 nt, Homo sapiens
aacccguagauccgaucuugug

SEQ ID NO: 19617 - RNA, 22 nt, Homo sapiens
aagcucgcuucuaugggucugu

SEQ ID NO: 19618 - RNA, 21 nt, Homo sapiens
caagcucgcuucuaugggucu

SEQ ID NO: 19619 - RNA, 22 nt, Homo sapiens
agguuucuagacuccuaggcua

SEQ ID NO: 19620 - RNA, 22 nt, Homo sapiens
uggugaggguuggggagccugg

SEQ ID NO: 19621 - RNA, 22 nt, Homo sapiens
uaagcuuauaacauguauagac

SEQ ID NO: 19622 - RNA, 22 nt, Homo sapiens
ucuuuauauguguauguuacaa

SEQ ID NO: 19623 - RNA, 22 nt, Homo sapiens
ccuucgaggaaucguuuauuug

SEQ ID NO: 19624 - RNA, 22 nt, Homo sapiens
gacugcgagcuccuugaaggcu

SEQ ID NO: 19625 - RNA, 22 nt, Homo sapiens
uccagagcuuucguacaguuua

SEQ ID NO: 19626 - RNA, 22 nt, Homo sapiens
gcuaaggcaaaagcuuuggcag

SEQ ID NO: 19627 - RNA, 22 nt, Homo sapiens
gcugcccgccagcugugagcgc

SEQ ID NO: 19628 - RNA, 22 nt, Homo sapiens
caaacagcugggucggcagcug

SEQ ID NO: 19629 - RNA, 22 nt, Homo sapiens
uguuugcugggugacaguccuu

SEQ ID NO: 19630 - RNA, 22 nt, Homo sapiens
gggcuaucccuuguggacugau

SEQ ID NO: 19631 - RNA, 22 nt, Homo sapiens
gagggaaagaugggaaggggac

SEQ ID NO: 19632 - RNA, 22 nt, Homo sapiens
cccauccugccccagcuuuccc

SEQ ID NO: 19633 - RNA, 22 nt, Homo sapiens
ggaggagggaggagaugggcca

SEQ ID NO: 19634 - RNA, 22 nt, Homo sapiens
cgcccuucccccccuucuucac

SEQ ID NO: 19635 - RNA, 22 nt, Homo sapiens
ugagacagcccaggcucggcac

SEQ ID NO: 19636 - RNA, 22 nt, Homo sapiens
ugaaugccugggcuucgcucag

SEQ ID NO: 19637 - RNA, 22 nt, Homo sapiens
ggccagaagaggagggugaggg

SEQ ID NO: 19638 - RNA, 22 nt, Homo sapiens
cguacucuuugaggcuucuggc

SEQ ID NO: 19639 - RNA, 22 nt, Homo sapiens
ugucuagcauuuauaaucaacu

SEQ ID NO: 19640 - RNA, 22 nt, Homo sapiens
ucgauuuuaaaugcuagccauu

SEQ ID NO: 19641 - RNA, 22 nt, Homo sapiens
gccuugcugacauugugacucu

SEQ ID NO: 19642 - RNA, 20 nt, Homo sapiens
uugggauguuuagcaagagu

SEQ ID NO: 19643 - RNA, 22 nt, Homo sapiens
ucucugaccagaggaucugucu

SEQ ID NO: 19644 - RNA, 22 nt, Homo sapiens
cggguggcuucuggucacagcc

SEQ ID NO: 19645 - RNA, 22 nt, Homo sapiens
uuucagaguguuuaaacacaau

SEQ ID NO: 19646 - RNA, 22 nt, Homo sapiens
uguugggacacucuaguguugu

SEQ ID NO: 19647 - RNA, 22 nt, Homo sapiens
ugcuuuaaaaggcaugcuuucc

SEQ ID NO: 19648 - RNA, 22 nt, Homo sapiens
gauuauuuuuuuuacagcauag

SEQ ID NO: 19649 - RNA, 22 nt, Homo sapiens
uugauaaugcaagucaggcuga

SEQ ID NO: 19650 - RNA, 22 nt, Homo sapiens
ucagcaggcauguuugucaaau

SEQ ID NO: 19651 - RNA, 22 nt, Homo sapiens
gggcccuggcuccaucuccuuu

SEQ ID NO: 19652 - RNA, 22 nt, Homo sapiens
ggggaguggggcuucgacccua

SEQ ID NO: 19653 - RNA, 22 nt, Homo sapiens
cagucucagugggcuuugacuu

SEQ ID NO: 19654 - RNA, 22 nt, Homo sapiens
guuggggccagugggaggcuga

SEQ ID NO: 19655 - RNA, 22 nt, Homo sapiens
uccugguagccccugcuuccau

SEQ ID NO: 19656 - RNA, 22 nt, Homo sapiens
gugguaggggugaggaaggagg

SEQ ID NO: 19657 - RNA, 22 nt, Homo sapiens
ggaggagccacagccugguaac

SEQ ID NO: 19658 - RNA, 17 nt, Homo sapiens
ggcugugcgcuccugcc

SEQ ID NO: 19659 - RNA, 22 nt, Homo sapiens
aaccuuggucaugugaaagggc

SEQ ID NO: 19660 - RNA, 22 nt, Homo sapiens
ccuucaccuggucaggcguuuu

SEQ ID NO: 19661 - RNA, 22 nt, Homo sapiens
ugucccaggcaggggcugggca

SEQ ID NO: 19662 - RNA, 22 nt, Homo sapiens
cucagccuccugacaggacacu

SEQ ID NO: 19663 - RNA, 22 nt, Homo sapiens
accccagugcccuuuccuuucu

SEQ ID NO: 19664 - RNA, 22 nt, Homo sapiens
gaggggaagggcaggggagaag

SEQ ID NO: 19665 - RNA, 22 nt, Homo sapiens
gggagggagggacuuuugugga

SEQ ID NO: 19666 - RNA, 22 nt, Homo sapiens
cagcaacguccuuccccacccc

SEQ ID NO: 19667 - RNA, 22 nt, Homo sapiens
ucucagcuacuucuuuggaagg

SEQ ID NO: 19668 - RNA, 22 nt, Homo sapiens
aguuccagaagaagcagggggu

SEQ ID NO: 19669 - RNA, 22 nt, Homo sapiens
gaggcucugggguucccucugc

SEQ ID NO: 19670 - RNA, 22 nt, Homo sapiens
uagguaugacacuccagaggcc

SEQ ID NO: 19671 - RNA, 22 nt, Homo sapiens
ggguuagggugaaagguauaaa

SEQ ID NO: 19672 - RNA, 16 nt, Homo sapiens
cuucgccuuugacacc

SEQ ID NO: 19673 - RNA, 22 nt, Homo sapiens
ucugcaaguguucaucaugacg

SEQ ID NO: 19674 - RNA, 18 nt, Homo sapiens
augagcauccugcagcag

SEQ ID NO: 19675 - RNA, 22 nt, Homo sapiens
ucugcacauguucaucaugaca

SEQ ID NO: 19676 - RNA, 22 nt, Homo sapiens
ucaugaugagcauccugcagca

SEQ ID NO: 19677 - RNA, 22 nt, Homo sapiens
gggggaguccagacaacaggcg

SEQ ID NO: 19678 - RNA, 19 nt, Homo sapiens
ccucggucuggcucccacc

SEQ ID NO: 19679 - RNA, 22 nt, Homo sapiens
uaagggcacaggucaccugcga

SEQ ID NO: 19680 - RNA, 17 nt, Homo sapiens
uguccuugcuccuucag

SEQ ID NO: 19681 - RNA, 22 nt, Homo sapiens
uaugaaaaucggagauugggua

SEQ ID NO: 19682 - RNA, 22 nt, Homo sapiens
uucaacucugauuuuacauacg

SEQ ID NO: 19683 - RNA, 22 nt, Homo sapiens
ucccaccuccuggggcuggaug

SEQ ID NO: 19684 - RNA, 21 nt, Homo sapiens
ucugcuucuggggcugggcgc

SEQ ID NO: 19685 - RNA, 22 nt, Homo sapiens
ccccaccuucccuagaaugggc

SEQ ID NO: 19686 - RNA, 21 nt, Homo sapiens
ugcgcaucugggauguggagg

SEQ ID NO: 19687 - RNA, 22 nt, Homo sapiens
gguggauguuccuucuaugcuu

SEQ ID NO: 19688 - RNA, 22 nt, Homo sapiens
aaucauagaggaaaauccgcau

SEQ ID NO: 19689 - RNA, 22 nt, Homo sapiens
cccagauacaauggacaauaug

SEQ ID NO: 19690 - RNA, 22 nt, Homo sapiens
cauuguccuugcuguuuggaga

SEQ ID NO: 19691 - RNA, 22 nt, Homo sapiens
cugggaagguguggcaugucca

SEQ ID NO: 19692 - RNA, 22 nt, Homo sapiens
ggugaacuguuacucccaucag

SEQ ID NO: 19693 - RNA, 22 nt, Homo sapiens
agugcugcuccuuuuccagaug

SEQ ID NO: 19694 - RNA, 22 nt, Homo sapiens
aguuggauugugagagcugcac

SEQ ID NO: 19695 - RNA, 22 nt, Homo sapiens
aggagauaacuguacaggccac

SEQ ID NO: 19696 - RNA, 21 nt, Homo sapiens
ugagguaguaguuuguacagu

SEQ ID NO: 19697 - RNA, 22 nt, Homo sapiens
aaauaggcccuuuucucaauug

SEQ ID NO: 19698 - RNA, 22 nt, Homo sapiens
uugagaaagggggcuauuccuu

SEQ ID NO: 19699 - RNA, 22 nt, Homo sapiens
ggagggguggggaagcaacugc

SEQ ID NO: 19700 - RNA, 22 nt, Homo sapiens
aucugcugucucugcucuucac

SEQ ID NO: 19701 - RNA, 22 nt, Homo sapiens
ucucacauaugaucugcagcca

SEQ ID NO: 19702 - RNA, 22 nt, Homo sapiens
cuccagaucauuugguggggac

SEQ ID NO: 19703 - RNA, 22 nt, Homo sapiens
caggccugcuguugcccagcuu

SEQ ID NO: 19704 - RNA, 22 nt, Homo sapiens
gcuggcaggagcugccucuuca

SEQ ID NO: 19705 - RNA, 22 nt, Homo sapiens
ucuccucacccugccucagcug

SEQ ID NO: 19706 - RNA, 22 nt, Homo sapiens
gcugguuugggguagaggacag

SEQ ID NO: 19707 - RNA, 22 nt, Homo sapiens
ccugggagcucucaacccgaau

SEQ ID NO: 19708 - RNA, 22 nt, Homo sapiens
gcggcggccagagcucccgggg

SEQ ID NO: 19709 - RNA, 22 nt, Homo sapiens
ggggugggggcgcuccaugcag

SEQ ID NO: 19710 - RNA, 18 nt, Homo sapiens
caggagccccugaccacc

SEQ ID NO: 19711 - RNA, 22 nt, Homo sapiens
uggggccugggcccaggcagcu

SEQ ID NO: 19712 - RNA, 22 nt, Homo sapiens
gcugggcuggcucaggcccuua

SEQ ID NO: 19713 - RNA, 22 nt, Homo sapiens
uccugguccagacucuucuccu

SEQ ID NO: 19714 - RNA, 19 nt, Homo sapiens
agagucugcgggucagaga

SEQ ID NO: 19715 - RNA, 22 nt, Homo sapiens
ugugcagugaucccuggagucc

SEQ ID NO: 19716 - RNA, 22 nt, Homo sapiens
uccgggaaacauugcugaagga

SEQ ID NO: 19717 - RNA, 22 nt, Homo sapiens
ucuccugggguuuggggugggu

SEQ ID NO: 19718 - RNA, 22 nt, Homo sapiens
ccaccaacuaaauuaaccagga

SEQ ID NO: 19719 - RNA, 22 nt, Homo sapiens
ccucuuccccagcuccccaccu

SEQ ID NO: 19720 - RNA, 22 nt, Homo sapiens
uggggaaagcuggggcuagaug

SEQ ID NO: 19721 - RNA, 22 nt, Homo sapiens
uaaugcaaaaagaaaacauucu

SEQ ID NO: 19722 - RNA, 22 nt, Homo sapiens
cuugacuguguuccuugcauug

SEQ ID NO: 19723 - RNA, 22 nt, Homo sapiens
aguuaucacagugacugucauu

SEQ ID NO: 19724 - RNA, 22 nt, Homo sapiens
ugcaucauucacugugggugac

SEQ ID NO: 19725 - RNA, 22 nt, Homo sapiens
acccucuauggucucccucaug

SEQ ID NO: 19726 - RNA, 22 nt, Homo sapiens
auaguaagaacccuggagggcc

SEQ ID NO: 19727 - RNA, 22 nt, Homo sapiens
agccugucccuaagucccuccc

SEQ ID NO: 19728 - RNA, 22 nt, Homo sapiens
aaggauuuagggacaggcuuug

SEQ ID NO: 19729 - RNA, 22 nt, Homo sapiens
ugcuuccucucagcuccucucc

SEQ ID NO: 19730 - RNA, 22 nt, Homo sapiens
gagggagguuuagaggaaguua

SEQ ID NO: 19731 - RNA, 22 nt, Homo sapiens
aaugcuggcuggguuaguagcc

SEQ ID NO: 19732 - RNA, 20 nt, Homo sapiens
ggaugcugaucagcucacuu

SEQ ID NO: 19733 - RNA, 22 nt, Homo sapiens
aaguugucaaguuuugcuacca

SEQ ID NO: 19734 - RNA, 22 nt, Homo sapiens
ggcuauagcaaaacuugauuua

SEQ ID NO: 19735 - RNA, 22 nt, Homo sapiens
gcucaaccuuuugccaagaaaa

SEQ ID NO: 19736 - RNA, 22 nt, Homo sapiens
uccuugacaaaagguuggcauu

SEQ ID NO: 19737 - RNA, 22 nt, Homo sapiens
uccccuccuccccugcugccgc

SEQ ID NO: 19738 - RNA, 22 nt, Homo sapiens
ccuggggaggggagagaggagg

SEQ ID NO: 19739 - RNA, 22 nt, Homo sapiens
uucccaaauucaugucacuggg

SEQ ID NO: 19740 - RNA, 22 nt, Homo sapiens
ucuaagugagaugagagggacu

SEQ ID NO: 19741 - RNA, 22 nt, Homo sapiens
agggggagagggagcaaguugg

SEQ ID NO: 19742 - RNA, 21 nt, Homo sapiens
cucugacccuucucucugauu

SEQ ID NO: 19743 - RNA, 22 nt, Homo sapiens
caguuugcugcacagauauuug

SEQ ID NO: 19744 - RNA, 22 nt, Homo sapiens
auuugcuguggggcagacugug

SEQ ID NO: 19745 - RNA, 22 nt, Homo sapiens
ggcaggugggaggaggggcauc

SEQ ID NO: 19746 - RNA, 22 nt, Homo sapiens
ggugcucuccgcucccugcuuc

SEQ ID NO: 19747 - RNA, 22 nt, Homo sapiens
caugccaggcacuguucuaaag

SEQ ID NO: 19748 - RNA, 22 nt, Homo sapiens
uuagagcaugccuggcacacgg

SEQ ID NO: 19749 - RNA, 22 nt, Homo sapiens
uggcagcaacugugaacuccuc

SEQ ID NO: 19750 - RNA, 22 nt, Homo sapiens
aguuuacagucgugggugccau

SEQ ID NO: 19751 - RNA, 22 nt, Homo sapiens
caguucugucuaggcaguggcu

SEQ ID NO: 19752 - RNA, 22 nt, Homo sapiens
caacaacuuagacacgugacug

SEQ ID NO: 19753 - RNA, 22 nt, Homo sapiens
caugcuuggcucaguccugucc

SEQ ID NO: 19754 - RNA, 22 nt, Homo sapiens
gcauggcugagcuaagcauguc

SEQ ID NO: 19755 - RNA, 22 nt, Homo sapiens
gggaggaggguccgggccaggu

SEQ ID NO: 19756 - RNA, 22 nt, Homo sapiens
gaggccugaggcagcuucccuc

SEQ ID NO: 19757 - RNA, 22 nt, Homo sapiens
ugucccccuuuaccaccucgua

SEQ ID NO: 19758 - RNA, 22 nt, Homo sapiens
ugggguggggagguauggugag

SEQ ID NO: 19759 - RNA, 22 nt, Homo sapiens
uuuuggaguuggaacguccagg

SEQ ID NO: 19760 - RNA, 22 nt, Homo sapiens
uggaauuuucaguccaagaggu

SEQ ID NO: 19761 - RNA, 22 nt, Homo sapiens
uccccgaagcagaugugugcag

SEQ ID NO: 19762 - RNA, 22 nt, Homo sapiens
ugugcaacuugccuuuggggga

SEQ ID NO: 19763 - RNA, 22 nt, Homo sapiens
agcagcaggcgcacggccgucu

SEQ ID NO: 19764 - RNA, 21 nt, Homo sapiens
ugguggagcgcuuguuguagu

SEQ ID NO: 19765 - RNA, 22 nt, Homo sapiens
agcagcaggcgcacggccgucu

SEQ ID NO: 19766 - RNA, 21 nt, Homo sapiens
ugguggagcgcuuguuguagu

SEQ ID NO: 19767 - RNA, 22 nt, Homo sapiens
gcauguggugaccccacucaug

SEQ ID NO: 19768 - RNA, 22 nt, Homo sapiens
ggugguucaggucaccauaggu

SEQ ID NO: 19769 - RNA, 22 nt, Homo sapiens
gcagagccaaaaccguaacagc

SEQ ID NO: 19770 - RNA, 22 nt, Homo sapiens
gccugggguucuggcucugucc

SEQ ID NO: 19771 - RNA, 22 nt, Homo sapiens
ucugauggcuuagguaaacacu

SEQ ID NO: 19772 - RNA, 22 nt, Homo sapiens
uuacugaggucguguacagacc

SEQ ID NO: 19773 - RNA, 22 nt, Homo sapiens
uccacucugcuccuuccgccca

SEQ ID NO: 19774 - RNA, 22 nt, Homo sapiens
gguggggugcagagaugggggu

SEQ ID NO: 19775 - RNA, 22 nt, Homo sapiens
ugcugcuuuauaaugauuauaa

SEQ ID NO: 19776 - RNA, 22 nt, Homo sapiens
uauggucuuuggguagcagcag

SEQ ID NO: 19777 - RNA, 22 nt, Homo sapiens
uauuugcuaauaugcaaauuuu

SEQ ID NO: 19778 - RNA, 22 nt, Homo sapiens
aguuugcuguugcuggguauga

SEQ ID NO: 19779 - RNA, 22 nt, Homo sapiens
ucugugagcugcuggacccccu

SEQ ID NO: 19780 - RNA, 22 nt, Homo sapiens
gggcacagcagugagcagaaaa

SEQ ID NO: 19781 - RNA, 22 nt, Homo sapiens
caggaaugguugcacacuguca

SEQ ID NO: 19782 - RNA, 22 nt, Homo sapiens
cagugcugccaccucguuccca

SEQ ID NO: 19783 - RNA, 22 nt, Homo sapiens
ugucuguccucucauaggauca

SEQ ID NO: 19784 - RNA, 22 nt, Homo sapiens
ucccacagagaagacaggcaag

SEQ ID NO: 19785 - RNA, 22 nt, Homo sapiens
agccugggccaccacaggggaa

SEQ ID NO: 19786 - RNA, 22 nt, Homo sapiens
cacagaccugggugcccgggcc

SEQ ID NO: 19787 - RNA, 22 nt, Homo sapiens
accgauucugaaguguccccuc

SEQ ID NO: 19788 - RNA, 21 nt, Homo sapiens
ugggggguaugagaguuggcu

SEQ ID NO: 19789 - RNA, 22 nt, Homo sapiens
acccuuuccccgcagaccucuc

SEQ ID NO: 19790 - RNA, 22 nt, Homo sapiens
agcucgggugccucgggugaga

SEQ ID NO: 19791 - RNA, 22 nt, Homo sapiens
agguuuggagcgggggaggcca

SEQ ID NO: 19792 - RNA, 22 nt, Homo sapiens
gcucaucccacucccaaaccca

SEQ ID NO: 19793 - RNA, 22 nt, Homo sapiens
acaggggagcugauggccagcc

SEQ ID NO: 19794 - RNA, 22 nt, Homo sapiens
aggagcuggccagccuccuggg

SEQ ID NO: 19795 - RNA, 22 nt, Homo sapiens
cgcuuccggggcauggccagga

SEQ ID NO: 19796 - RNA, 22 nt, Homo sapiens
agcuucuuggccugcucagcag

SEQ ID NO: 19797 - RNA, 22 nt, Homo sapiens
aucuccagcacuccaaccacag

SEQ ID NO: 19798 - RNA, 21 nt, Homo sapiens
gcuggcuuggauuuggagggg

SEQ ID NO: 19799 - RNA, 22 nt, Homo sapiens
ugcaggaugagugaaaaggcau

SEQ ID NO: 19800 - RNA, 22 nt, Homo sapiens
ugcuaguucaugucuuucugca

SEQ ID NO: 19801 - RNA, 22 nt, Homo sapiens
gagacuagcuuauacauaaaau

SEQ ID NO: 19802 - RNA, 22 nt, Homo sapiens
uuaugaauaagcucauuucuga

SEQ ID NO: 19803 - RNA, 22 nt, Homo sapiens
uguguaucucuccagagaugcu

SEQ ID NO: 19804 - RNA, 22 nt, Homo sapiens
caacuuggggugguacaaggag

SEQ ID NO: 19805 - RNA, 22 nt, Homo sapiens
gcgaugcuucccuggguccuau

SEQ ID NO: 19806 - RNA, 22 nt, Homo sapiens
ugauagggccugagguaagcug

SEQ ID NO: 19807 - RNA, 22 nt, Homo sapiens
uccucaugcccucucccugcuc

SEQ ID NO: 19808 - RNA, 22 nt, Homo sapiens
gcagauggaggaagugaggagc

SEQ ID NO: 19809 - RNA, 22 nt, Homo sapiens
agcgcuuuguucuucgcuggcu

SEQ ID NO: 19810 - RNA, 22 nt, Homo sapiens
cggcaggcgggaaaagcgcgca

SEQ ID NO: 19811 - RNA, 22 nt, Homo sapiens
aggguucauccacaugcucucu

SEQ ID NO: 19812 - RNA, 22 nt, Homo sapiens
agacauaaggaauggcuuuuac

SEQ ID NO: 19813 - RNA, 22 nt, Homo sapiens
agagucccugggucuguuccau

SEQ ID NO: 19814 - RNA, 16 nt, Homo sapiens
cagaucugagggaccu

SEQ ID NO: 19815 - RNA, 22 nt, Homo sapiens
ucuuuggcuuuggaguaguuua

SEQ ID NO: 19816 - RNA, 22 nt, Homo sapiens
ggcucucuucagaguuggaaac

SEQ ID NO: 19817 - RNA, 22 nt, Homo sapiens
acauuuaaauugcaggcagccc

SEQ ID NO: 19818 - RNA, 22 nt, Homo sapiens
gagcuggcugugguugagugca

SEQ ID NO: 19819 - RNA, 22 nt, Homo sapiens
uugaugccaccugagggccuga

SEQ ID NO: 19820 - RNA, 22 nt, Homo sapiens
gagcccugguggcagcccaggg

SEQ ID NO: 19821 - RNA, 22 nt, Homo sapiens
caauuguucuuuggucuuucag

SEQ ID NO: 19822 - RNA, 22 nt, Homo sapiens
ugugagaccaaagaacuacuuu

SEQ ID NO: 19823 - RNA, 22 nt, Homo sapiens
ucucccuaucacggaaucauug

SEQ ID NO: 19824 - RNA, 22 nt, Homo sapiens
augguuuccauuuaggagaagc

SEQ ID NO: 19825 - RNA, 22 nt, Homo sapiens
ugagggggugacucagagugug

SEQ ID NO: 19826 - RNA, 20 nt, Homo sapiens
augucugaguaacucccaca

SEQ ID NO: 19827 - RNA, 22 nt, Homo sapiens
uuucccagugagccugggcucg

SEQ ID NO: 19828 - RNA, 22 nt, Homo sapiens
ugggucuagaguuugaagagag

SEQ ID NO: 19829 - RNA, 22 nt, Homo sapiens
agaagguuaaaccugugucagg

SEQ ID NO: 19830 - RNA, 22 nt, Homo sapiens
gcucugagacaggugccuuuag

SEQ ID NO: 19831 - RNA, 22 nt, Homo sapiens
uugagcuaacagggggcucuag

SEQ ID NO: 19832 - RNA, 22 nt, Homo sapiens
uagagcucucugguggccauau

SEQ ID NO: 19833 - RNA, 22 nt, Homo sapiens
ugaaagcagcugcagaacccuu

SEQ ID NO: 19834 - RNA, 18 nt, Homo sapiens
gguucuggcuugcuuaca

SEQ ID NO: 19835 - RNA, 22 nt, Homo sapiens
ugagcuugaauguauguaauag

SEQ ID NO: 19836 - RNA, 22 nt, Homo sapiens
uagguuacaugcaagcaagcca

SEQ ID NO: 19837 - RNA, 22 nt, Homo sapiens
ugagaugagaagucugcagcug

SEQ ID NO: 19838 - RNA, 22 nt, Homo sapiens
ugagccaagggcuucucuucau

SEQ ID NO: 19839 - RNA, 22 nt, Homo sapiens
uggggccgcagacccugggcgc

SEQ ID NO: 19840 - RNA, 22 nt, Homo sapiens
ggcgcggggaucucguggcucc

SEQ ID NO: 19841 - RNA, 22 nt, Homo sapiens
agaagacguuuuggguugugaa

SEQ ID NO: 19842 - RNA, 22 nt, Homo sapiens
ucacauauuccaaaauuucuuc

SEQ ID NO: 19843 - RNA, 22 nt, Homo sapiens
caagggggugaggaggguggug

SEQ ID NO: 19844 - RNA, 20 nt, Homo sapiens
ccucccuuucuuccucccug

SEQ ID NO: 19845 - RNA, 22 nt, Homo sapiens
aacugaggcacggugagaggca

SEQ ID NO: 19846 - RNA, 22 nt, Homo sapiens
cucuguacucagugccuccguu

SEQ ID NO: 19847 - RNA, 22 nt, Homo sapiens
ccaugcuuggcuuagcagaguc

SEQ ID NO: 19848 - RNA, 22 nt, Homo sapiens
ugugcuaugccacuaagcauga

SEQ ID NO: 19849 - RNA, 22 nt, Homo sapiens
ugugaaguagaaauacacuucu

SEQ ID NO: 19850 - RNA, 22 nt, Homo sapiens
aguguguguuuuauuuauuaua

SEQ ID NO: 19851 - RNA, 22 nt, Homo sapiens
ggagagggcacaggcuuggcuc

SEQ ID NO: 19852 - RNA, 17 nt, Homo sapiens
cugccugugcuccuccc

SEQ ID NO: 19853 - RNA, 22 nt, Homo sapiens
gaguaguagaauguaaguucug

SEQ ID NO: 19854 - RNA, 22 nt, Homo sapiens
uaucuuacauacugcugucucc

SEQ ID NO: 19855 - RNA, 22 nt, Homo sapiens
uuaguggaccguguuacauacg

SEQ ID NO: 19856 - RNA, 22 nt, Homo sapiens
uacgcuauacggucuacuaucu

SEQ ID NO: 19857 - RNA, 22 nt, Homo sapiens
acuugacugucccggggauuaa

SEQ ID NO: 19858 - RNA, 22 nt, Homo sapiens
aucacccaggugacagcgagca

SEQ ID NO: 19859 - RNA, 22 nt, Homo sapiens
gggaugguagaccggugacgug

SEQ ID NO: 19860 - RNA, 22 nt, Homo sapiens
uaggucacccguuugacuaucc

SEQ ID NO: 19861 - RNA, 22 nt, Homo sapiens
uagacaauuccauccuacgugg

SEQ ID NO: 19862 - RNA, 22 nt, Homo sapiens
uccacagugguggaauuguuca

SEQ ID NO: 19863 - RNA, 22 nt, Homo sapiens
uuaggcuuuguagagcucuaag

SEQ ID NO: 19864 - RNA, 22 nt, Homo sapiens
uugggucuacagagccuaaagu

SEQ ID NO: 19865 - RNA, 22 nt, Homo sapiens
auuucgagucagugggcuguga

SEQ ID NO: 19866 - RNA, 22 nt, Homo sapiens
uaguuuauugacccugaaugug

SEQ ID NO: 19867 - RNA, 22 nt, Homo sapiens
caccaccguguagcgcuucuug

SEQ ID NO: 19868 - RNA, 22 nt, Homo sapiens
aggugcguuucuuggugguggc

SEQ ID NO: 19869 - RNA, 22 nt, Homo sapiens
accgguccccgagccaaguaau

SEQ ID NO: 19870 - RNA, 21 nt, Homo sapiens
uacuugaacugggucccgggc

SEQ ID NO: 19871 - RNA, 22 nt, Homo sapiens
uuauggcagccaggauauuguc

SEQ ID NO: 19872 - RNA, 22 nt, Homo sapiens
agugcucguagguguuaugaug

SEQ ID NO: 19873 - RNA, 22 nt, Homo sapiens
ugugaagcuggccauggcucag

SEQ ID NO: 19874 - RNA, 22 nt, Homo sapiens
agccauggcugagaguuuacag

SEQ ID NO: 19875 - RNA, 22 nt, Homo sapiens
ugucaggggcggccuugccgcc

SEQ ID NO: 19876 - RNA, 22 nt, Homo sapiens
cgcuaggcugcgucugaaagcg

SEQ ID NO: 19877 - RNA, 22 nt, Homo sapiens
cagcagccccagcuccagcccc

SEQ ID NO: 19878 - RNA, 22 nt, Homo sapiens
gcaggagacuaaggggguguug

SEQ ID NO: 19879 - RNA, 22 nt, Homo sapiens
ggaagcggagcuggggagacug

SEQ ID NO: 19880 - RNA, 22 nt, Homo sapiens
uccuuucccagugcuccuuccu

SEQ ID NO: 19881 - RNA, 22 nt, Homo sapiens
ugggacugggggguugggggac

SEQ ID NO: 19882 - RNA, 22 nt, Homo sapiens
ucucccccgcccucagucccug

SEQ ID NO: 19883 - RNA, 22 nt, Homo sapiens
gguggggauuuguugcauuacu

SEQ ID NO: 19884 - RNA, 21 nt, Homo sapiens
uauugcacuugucccggccug

SEQ ID NO: 19885 - RNA, 22 nt, Homo sapiens
gaacagcauaggcuggcuccuu

SEQ ID NO: 19886 - RNA, 22 nt, Homo sapiens
ggaaggcguucuaucuguucug

SEQ ID NO: 19887 - RNA, 22 nt, Homo sapiens
gcaauauuucugaaagcugaga

SEQ ID NO: 19888 - RNA, 22 nt, Homo sapiens
uaaagucagcuugcaguuauau

SEQ ID NO: 19889 - RNA, 22 nt, Homo sapiens
gcugggcuccaggaguggccug

SEQ ID NO: 19890 - RNA, 22 nt, Homo sapiens
caguucacuccuggccgaguug

SEQ ID NO: 19891 - RNA, 22 nt, Homo sapiens
aggacaccaaacuaauugggau

SEQ ID NO: 19892 - RNA, 22 nt, Homo sapiens
ugucacuuaaggguggugucuc

SEQ ID NO: 19893 - RNA, 22 nt, Homo sapiens
ucuccagauuaccacagaagac

SEQ ID NO: 19894 - RNA, 22 nt, Homo sapiens
gauuuaaugugguauuggggaa

SEQ ID NO: 19895 - RNA, 22 nt, Homo sapiens
gcagugaauaucaaugagagga

SEQ ID NO: 19896 - RNA, 22 nt, Homo sapiens
ugcuucauugauuuuugcuggu

SEQ ID NO: 19897 - RNA, 22 nt, Homo sapiens
ugccuuccugccuuccauucua

SEQ ID NO: 19898 - RNA, 22 nt, Homo sapiens
aagaagagagguaggaagcaag

SEQ ID NO: 19899 - RNA, 22 nt, Homo sapiens
ucccagaacccagcucaccuac

SEQ ID NO: 19900 - RNA, 22 nt, Homo sapiens
gaaggugggcaguucuggaaug

SEQ ID NO: 19901 - RNA, 22 nt, Homo sapiens
uccccuguguagccggcagcag

SEQ ID NO: 19902 - RNA, 22 nt, Homo sapiens
uggugcuggacccacaggggcu

SEQ ID NO: 19903 - RNA, 22 nt, Homo sapiens
ccucaucuggggcuuuaaugga

SEQ ID NO: 19904 - RNA, 22 nt, Homo sapiens
auucaagcuuuggaugagcagu

SEQ ID NO: 19905 - RNA, 22 nt, Homo sapiens
uccucuuuugcccucccccauc

SEQ ID NO: 19906 - RNA, 22 nt, Homo sapiens
ugggaagggugggagugguggg

SEQ ID NO: 19907 - RNA, 22 nt, Homo sapiens
agagugcaaggccggaagcccc

SEQ ID NO: 19908 - RNA, 21 nt, Homo sapiens
gcucacggcuugccccucccu

SEQ ID NO: 19909 - RNA, 22 nt, Homo sapiens
uaaccucuuugaucaauagaaa

SEQ ID NO: 19910 - RNA, 20 nt, Homo sapiens
guuuucuauugauuggugac

SEQ ID NO: 19911 - RNA, 22 nt, Homo sapiens
uguuauguucacuucaggguug

SEQ ID NO: 19912 - RNA, 22 nt, Homo sapiens
gcccugaccacagacaaagcag

SEQ ID NO: 19913 - RNA, 22 nt, Homo sapiens
gcguguggucagcggcgggcgu

SEQ ID NO: 19914 - RNA, 22 nt, Homo sapiens
ccccugcccgcgcuggccgccu

SEQ ID NO: 19915 - RNA, 22 nt, Homo sapiens
ugugccuacauuucaauuucca

SEQ ID NO: 19916 - RNA, 22 nt, Homo sapiens
aaacugaaauucagguauaauc

SEQ ID NO: 19917 - RNA, 22 nt, Homo sapiens
caggauuguccugcagaucaac

SEQ ID NO: 19918 - RNA, 18 nt, Homo sapiens
aggaccugcgggacaaga

SEQ ID NO: 19919 - RNA, 23 nt, Homo sapiens
aggaccugcgggacaagauucuu

SEQ ID NO: 19920 - RNA, 22 nt, Homo sapiens
accugauuuccacccaccugua

SEQ ID NO: 19921 - RNA, 22 nt, Homo sapiens
ugcagggauggaaauaagcggg

SEQ ID NO: 19922 - RNA, 22 nt, Homo sapiens
aagggggauggugguggugagg

SEQ ID NO: 19923 - RNA, 22 nt, Homo sapiens
uggccauucaccagcuccucag

SEQ ID NO: 19924 - RNA, 22 nt, Homo sapiens
uuaguggucauuguuaagguca

SEQ ID NO: 19925 - RNA, 22 nt, Homo sapiens
ugaccugacaguggcuucuggu

SEQ ID NO: 19926 - RNA, 22 nt, Homo sapiens
ggagggcagggcccuaagauac

SEQ ID NO: 19927 - RNA, 19 nt, Homo sapiens
ugucuugggcccugguccc

SEQ ID NO: 19928 - RNA, 22 nt, Homo sapiens
uugguaugcagaacacacaguc

SEQ ID NO: 19929 - RNA, 22 nt, Homo sapiens
cugugcugugcauguacuuaag

SEQ ID NO: 19930 - RNA, 22 nt, Homo sapiens
ucagcaaucaguccucccccag

SEQ ID NO: 19931 - RNA, 22 nt, Homo sapiens
ugggagggggcaacugcugagu

SEQ ID NO: 19932 - RNA, 22 nt, Homo sapiens
uaauggccagcugggagaguug

SEQ ID NO: 19933 - RNA, 22 nt, Homo sapiens
uuaaccucagcgggccauuaau

SEQ ID NO: 19934 - RNA, 22 nt, Homo sapiens
uggcuuuuuguuucaacuuuca

SEQ ID NO: 19935 - RNA, 22 nt, Homo sapiens
aaagacaauagcagaaagccag

SEQ ID NO: 19936 - RNA, 22 nt, Homo sapiens
agcaaguaaaucuggacagguu

SEQ ID NO: 19937 - RNA, 22 nt, Homo sapiens
ccugagacuagguuuauuugcc

SEQ ID NO: 19938 - RNA, 22 nt, Homo sapiens
uggaggagccagcggcuggcua

SEQ ID NO: 19939 - RNA, 22 nt, Homo sapiens
cuagcacuugcugaguuucuuc

SEQ ID NO: 19940 - RNA, 22 nt, Homo sapiens
ucagaugaugucaggcccaguu

SEQ ID NO: 19941 - RNA, 22 nt, Homo sapiens
gaacagggcucaucuucugaga

SEQ ID NO: 19942 - RNA, 22 nt, Homo sapiens
uguuucuagucugguuuuguga

SEQ ID NO: 19943 - RNA, 22 nt, Homo sapiens
uuaugccagaucugaagcaacu

SEQ ID NO: 19944 - RNA, 22 nt, Homo sapiens
uuaggcugucagcggcugccga

SEQ ID NO: 19945 - RNA, 22 nt, Homo sapiens
gcuggucguuuggcagcauagg

SEQ ID NO: 19946 - RNA, 22 nt, Homo sapiens
agacuuggugagcugguaggaa

SEQ ID NO: 19947 - RNA, 20 nt, Homo sapiens
ugcuggcuugccaagcuccu

SEQ ID NO: 19948 - RNA, 22 nt, Homo sapiens
accagggggaggaggguguugg

SEQ ID NO: 19949 - RNA, 22 nt, Homo sapiens
ucuugacucuccuucccauggc

SEQ ID NO: 19950 - RNA, 18 nt, Homo sapiens
acacucaaacugcugaca

SEQ ID NO: 19951 - RNA, 19 nt, Homo sapiens
gacacucaaacugcugaca

SEQ ID NO: 19952 - RNA, 22 nt, Homo sapiens
gcugacacucaaacugcugaca

SEQ ID NO: 19953 - RNA, 22 nt, Homo sapiens
uggucaaaaacucucaguggac

SEQ ID NO: 19954 - RNA, 22 nt, Homo sapiens
ucugcugagaguuucugacuga

SEQ ID NO: 19955 - RNA, 22 nt, Homo sapiens
uuguuaaagaggaaaaguggua

SEQ ID NO: 19956 - RNA, 22 nt, Homo sapiens
ucacauuuuccuauagucagcu

SEQ ID NO: 19957 - RNA, 22 nt, Homo sapiens
cgagaaaagggaaggcucccag

SEQ ID NO: 19958 - RNA, 22 nt, Homo sapiens
uggcaguggucccacuucuuga

SEQ ID NO: 19959 - RNA, 22 nt, Homo sapiens
gcacauuuauuacauacggggc

SEQ ID NO: 19960 - RNA, 22 nt, Homo sapiens
cucuguugugauaaauuggcug

SEQ ID NO: 19961 - RNA, 22 nt, Homo sapiens
aggcagguagcugggcuccagg

SEQ ID NO: 19962 - RNA, 22 nt, Homo sapiens
uaaagcuccaguuaaauagcuu

SEQ ID NO: 19963 - RNA, 22 nt, Homo sapiens
gagcucugauuguugaggaggg

SEQ ID NO: 19964 - RNA, 22 nt, Homo sapiens
uguccccuuccaaucauagcuc

SEQ ID NO: 19965 - RNA, 22 nt, Homo sapiens
uacaauguugggaagggucaaa

SEQ ID NO: 19966 - RNA, 22 nt, Homo sapiens
ugacccuucucaacauuauauc

SEQ ID NO: 19967 - RNA, 22 nt, Homo sapiens
uccauagaccucuauuuucucu

SEQ ID NO: 19968 - RNA, 22 nt, Homo sapiens
gagagauaagggucauguguca

SEQ ID NO: 19969 - RNA, 22 nt, Homo sapiens
uguggaagacagcugaguggau

SEQ ID NO: 19970 - RNA, 22 nt, Homo sapiens
ggccauuggguuucuccacagg

SEQ ID NO: 19971 - RNA, 22 nt, Homo sapiens
aauuggugucccauuuguuggg

SEQ ID NO: 19972 - RNA, 22 nt, Homo sapiens
cagcuuauugggacacugauca

SEQ ID NO: 19973 - RNA, 22 nt, Homo sapiens
ucagggauaaaaauacccaggu

SEQ ID NO: 19974 - RNA, 22 nt, Homo sapiens
uggaaccgguauuaucccuggg

SEQ ID NO: 19975 - RNA, 22 nt, Homo sapiens
aaaugucugcauggcugucugc

SEQ ID NO: 19976 - RNA, 22 nt, Homo sapiens
agauaaucuaugcagcauuuuu

SEQ ID NO: 19977 - RNA, 22 nt, Homo sapiens
uuuucucugaccuccuucccag

SEQ ID NO: 19978 - RNA, 22 nt, Homo sapiens
gaaggagggaggggaggggaga

SEQ ID NO: 19979 - RNA, 22 nt, Homo sapiens
ucccuguggaggaccccuuacc

SEQ ID NO: 19980 - RNA, 22 nt, Homo sapiens
ucagggaccccucugaguggag

SEQ ID NO: 19981 - RNA, 22 nt, Homo sapiens
ucagcaggaaagcaugcaaguc

SEQ ID NO: 19982 - RNA, 22 nt, Homo sapiens
uuuguguuucccugcagaggga

SEQ ID NO: 19983 - RNA, 22 nt, Homo sapiens
uccacuucccugcuguucuuuc

SEQ ID NO: 19984 - RNA, 22 nt, Homo sapiens
aaugagcagugggugggugagg

SEQ ID NO: 19985 - RNA, 22 nt, Homo sapiens
aaauuuuuagggccauugagca

SEQ ID NO: 19986 - RNA, 22 nt, Homo sapiens
uucaguagcccugaaaauuucu

SEQ ID NO: 19987 - RNA, 22 nt, Homo sapiens
gguuuaggugaauuuugcugca

SEQ ID NO: 19988 - RNA, 22 nt, Homo sapiens
ugcugagauucaccugaaugug

SEQ ID NO: 19989 - RNA, 22 nt, Homo sapiens
cagcagggauuuucuagucucc

SEQ ID NO: 19990 - RNA, 22 nt, Homo sapiens
agacugaagauggcucuauugg

SEQ ID NO: 19991 - RNA, 22 nt, Homo sapiens
uaccauuugauuuaauuuuuaa

SEQ ID NO: 19992 - RNA, 22 nt, Homo sapiens
aaaaauagaucaaaugguggug

SEQ ID NO: 19993 - RNA, 22 nt, Homo sapiens
ucacuccucuuccuuuuaauug

SEQ ID NO: 19994 - RNA, 19 nt, Homo sapiens
uuaagggggaggggaaaga

SEQ ID NO: 19995 - RNA, 22 nt, Homo sapiens
aggguacuggaagagugugccc

SEQ ID NO: 19996 - RNA, 22 nt, Homo sapiens
uacaugccuuccaguaccauuu

SEQ ID NO: 19997 - RNA, 22 nt, Homo sapiens
ucuucaccugcucuacccacuu

SEQ ID NO: 19998 - RNA, 22 nt, Homo sapiens
gaaguguagacaaggugggagu

SEQ ID NO: 19999 - RNA, 22 nt, Homo sapiens
cccucucacucugucccucagu

SEQ ID NO: 20000 - RNA, 22 nt, Homo sapiens
ucagagaggcagggcauggggg

SEQ ID NO: 20001 - RNA, 22 nt, Homo sapiens
ucaggugcaguaauugccacag

SEQ ID NO: 20002 - RNA, 22 nt, Homo sapiens
uuuggggaauucugcaguugaa

SEQ ID NO: 20003 - RNA, 22 nt, Homo sapiens
aggugggagguggggugggggg

SEQ ID NO: 20004 - RNA, 22 nt, Homo sapiens
gccccgcccccgcccccacugc

SEQ ID NO: 20005 - RNA, 22 nt, Homo sapiens
ugcauacagugggucuuugugu

SEQ ID NO: 20006 - RNA, 22 nt, Homo sapiens
auaagggcaaacucgauaugca

SEQ ID NO: 20007 - RNA, 22 nt, Homo sapiens
ugcauacagugggucuuugugu

SEQ ID NO: 20008 - RNA, 22 nt, Homo sapiens
auaagggcaaacucgauaugca

SEQ ID NO: 20009 - RNA, 22 nt, Homo sapiens
ugcauacagugggucuuugugu

SEQ ID NO: 20010 - RNA, 22 nt, Homo sapiens
auaagggcaaacucgauaugca

SEQ ID NO: 20011 - RNA, 22 nt, Homo sapiens
ugcauacagugggucuuugugu

SEQ ID NO: 20012 - RNA, 22 nt, Homo sapiens
auaagggcaaacucgauaugca

SEQ ID NO: 20013 - RNA, 22 nt, Homo sapiens
ugcauacagugggucuuugugu

SEQ ID NO: 20014 - RNA, 22 nt, Homo sapiens
auaagggcaaacucgauaugca

SEQ ID NO: 20015 - RNA, 22 nt, Homo sapiens
uacuuguaacuauaaaagaugu

SEQ ID NO: 20016 - RNA, 22 nt, Homo sapiens
caucauuuguaguuacagguag

SEQ ID NO: 20017 - RNA, 21 nt, Homo sapiens
cagcagcacacugugguuugu

SEQ ID NO: 20018 - RNA, 22 nt, Homo sapiens
ggacaggcccagggcggggcca

SEQ ID NO: 20019 - RNA, 22 nt, Homo sapiens
ccccccgccccggugcauucug

SEQ ID NO: 20020 - RNA, 22 nt, Homo sapiens
uauacugucauggugacucuga

SEQ ID NO: 20021 - RNA, 22 nt, Homo sapiens
gagucaccauggcaguauagca

SEQ ID NO: 20022 - RNA, 22 nt, Homo sapiens
ccaggggcuccagcuaccccau

SEQ ID NO: 20023 - RNA, 22 nt, Homo sapiens
gggucaggcuuggggcccaggg

SEQ ID NO: 20024 - RNA, 22 nt, Homo sapiens
ccaaggccuacccuggggagac

SEQ ID NO: 20025 - RNA, 22 nt, Homo sapiens
ucuccuucaggagugggcuuug

SEQ ID NO: 20026 - RNA, 22 nt, Homo sapiens
gaggagcugccuggcagagggg

SEQ ID NO: 20027 - RNA, 22 nt, Homo sapiens
ggcuggcugcgggcagcccucc

SEQ ID NO: 20028 - RNA, 22 nt, Homo sapiens
ggauccgaggcucccagacccg

SEQ ID NO: 20029 - RNA, 22 nt, Homo sapiens
gggcugagaugcccuggaucag

SEQ ID NO: 20030 - RNA, 22 nt, Homo sapiens
gcacaugaaggcgcccacacau

SEQ ID NO: 20031 - RNA, 22 nt, Homo sapiens
gugugaggugcaugcaugugag

SEQ ID NO: 20032 - RNA, 22 nt, Homo sapiens
aggaggccugggaugagcagga

SEQ ID NO: 20033 - RNA, 22 nt, Homo sapiens
ugcuccauuuccaagccucucc

SEQ ID NO: 20034 - RNA, 22 nt, Homo sapiens
cguguucacagcggaccuugau

SEQ ID NO: 20035 - RNA, 22 nt, Homo sapiens
uaaggcacgcggugaaugccaa

SEQ ID NO: 20036 - RNA, 21 nt, Homo sapiens
cguguucacagcggaccuuga

SEQ ID NO: 20037 - RNA, 22 nt, Homo sapiens
gccgggaguugagaugugagca

SEQ ID NO: 20038 - RNA, 22 nt, Homo sapiens
uuaucucagauuacucuuggcu

SEQ ID NO: 20039 - RNA, 22 nt, Homo sapiens
uacacagggccggaucuugcca

SEQ ID NO: 20040 - RNA, 22 nt, Homo sapiens
gggagaaaugagccuuggugga

SEQ ID NO: 20041 - RNA, 22 nt, Homo sapiens
ggaaacagaagggaugcgccaa

SEQ ID NO: 20042 - RNA, 22 nt, Homo sapiens
gcaggcaucccuuuuaguucau

SEQ ID NO: 20043 - RNA, 22 nt, Homo sapiens
ggaaacagaagggaugcgccaa

SEQ ID NO: 20044 - RNA, 22 nt, Homo sapiens
gcaggcaucccuuuuaguucau

SEQ ID NO: 20045 - RNA, 21 nt, Homo sapiens
aucgugcauccuuuuagagug

SEQ ID NO: 20046 - RNA, 22 nt, Homo sapiens
aucgugcauccuuuuagagugu

SEQ ID NO: 20047 - RNA, 22 nt, Homo sapiens
ccucuagauggaagcacugucu

SEQ ID NO: 20048 - RNA, 19 nt, Homo sapiens
gugcauccuuuuagagugu

SEQ ID NO: 20049 - RNA, 22 nt, Homo sapiens
gugcauccuuuuagaguguuac

SEQ ID NO: 20050 - RNA, 22 nt, Homo sapiens
acaagucaggcucuugggaccu

SEQ ID NO: 20051 - RNA, 22 nt, Homo sapiens
ucccugagacccuaacuuguga

SEQ ID NO: 20052 - RNA, 21 nt, Homo sapiens
acaagucaggcucuugggacc

SEQ ID NO: 20053 - RNA, 22 nt, Homo sapiens
ucacaagucaggcucuugggac

SEQ ID NO: 20054 - RNA, 17 nt, Homo sapiens
ucaggcucuugggaccu

SEQ ID NO: 20055 - RNA, 22 nt, Homo sapiens
ucaccugucuuuuuugugggau

SEQ ID NO: 20056 - RNA, 22 nt, Homo sapiens
uccuagaagaaggcagacauga

SEQ ID NO: 20057 - RNA, 22 nt, Homo sapiens
cgcggaaggaggcggggcgggg

SEQ ID NO: 20058 - RNA, 22 nt, Homo sapiens
uugucaccagcccccuccgugu

SEQ ID NO: 20059 - RNA, 22 nt, Homo sapiens
aacugugaggaccagggguagc

SEQ ID NO: 20060 - RNA, 22 nt, Homo sapiens
cacuccugaguccuggcccucc

SEQ ID NO: 20061 - RNA, 22 nt, Homo sapiens
ggcugagacagagggcguuggc

SEQ ID NO: 20062 - RNA, 22 nt, Homo sapiens
cugugaccccucugucuuugca

SEQ ID NO: 20063 - RNA, 22 nt, Homo sapiens
uccucucccuugucuccuacau

SEQ ID NO: 20064 - RNA, 22 nt, Homo sapiens
aaaggggaaaaggcgagaagag

SEQ ID NO: 20065 - RNA, 22 nt, Homo sapiens
ugguuguccauucuauuucagu

SEQ ID NO: 20066 - RNA, 22 nt, Homo sapiens
aauggaggagggauggauuguu

SEQ ID NO: 20067 - RNA, 22 nt, Homo sapiens
uuugcauguugggcucauccuc

SEQ ID NO: 20068 - RNA, 22 nt, Homo sapiens
ggaagauggcccacauguaguu

SEQ ID NO: 20069 - RNA, 22 nt, Homo sapiens
agaucuggugagccgguugcug

SEQ ID NO: 20070 - RNA, 22 nt, Homo sapiens
cgcuacacagcucaucagguuc

SEQ ID NO: 20071 - RNA, 22 nt, Homo sapiens
uaguugaaauguaaucucuuaa

SEQ ID NO: 20072 - RNA, 22 nt, Homo sapiens
gggagauaauuacacuuucacu

SEQ ID NO: 20073 - RNA, 22 nt, Homo sapiens
ccaucccugagccccuuucuaa

SEQ ID NO: 20074 - RNA, 20 nt, Homo sapiens
uggaauggggcuggggucgg

SEQ ID NO: 20075 - RNA, 22 nt, Homo sapiens
ucagaagucgaaggagggccau

SEQ ID NO: 20076 - RNA, 22 nt, Homo sapiens
gaacugcuuggacuuuugagcu

SEQ ID NO: 20077 - RNA, 22 nt, Homo sapiens
aggggugggggaccccaggaga

SEQ ID NO: 20078 - RNA, 22 nt, Homo sapiens
uccuguccugucccccugccca

SEQ ID NO: 20079 - RNA, 22 nt, Homo sapiens
agaaucauauuucucucugugc

SEQ ID NO: 20080 - RNA, 22 nt, Homo sapiens
uguuaacaggagagaaugauac

SEQ ID NO: 20081 - RNA, 22 nt, Homo sapiens
uuccauuaucuuccucugcccu

SEQ ID NO: 20082 - RNA, 22 nt, Homo sapiens
gggauggggaagagaggaagag

SEQ ID NO: 20083 - RNA, 22 nt, Homo sapiens
uaucccugcccuccagaagcuc

SEQ ID NO: 20084 - RNA, 22 nt, Homo sapiens
cugauggauggacagggguagu

SEQ ID NO: 20085 - RNA, 22 nt, Homo sapiens
ugauguccugggggguugggac

SEQ ID NO: 20086 - RNA, 22 nt, Homo sapiens
caccagccccccaggaaacucc

SEQ ID NO: 20087 - RNA, 22 nt, Homo sapiens
ucaucaagcaaagguuaagggc

SEQ ID NO: 20088 - RNA, 22 nt, Homo sapiens
gccuagaacuuggcuuguuuug

SEQ ID NO: 20089 - RNA, 22 nt, Homo sapiens
uguaugccaacgcuuagaguaa

SEQ ID NO: 20090 - RNA, 22 nt, Homo sapiens
uucuaagcauugguauacauua

SEQ ID NO: 20091 - RNA, 22 nt, Homo sapiens
uuccaagagcuuauuucugaau

SEQ ID NO: 20092 - RNA, 22 nt, Homo sapiens
uacaugaaauaggauucuggag

SEQ ID NO: 20093 - RNA, 22 nt, Homo sapiens
aaagaaacacuuugauuugaaa

SEQ ID NO: 20094 - RNA, 22 nt, Homo sapiens
uggggccagagugcuccuuugg

SEQ ID NO: 20095 - RNA, 22 nt, Homo sapiens
ucuuucccagggagcuucugag

SEQ ID NO: 20096 - RNA, 19 nt, Homo sapiens
ugaagcuccuugggaaaag

SEQ ID NO: 20097 - RNA, 22 nt, Homo sapiens
accugcuagauccuuuuuaggc

SEQ ID NO: 20098 - RNA, 22 nt, Homo sapiens
ucuuccugccaugaaaagaggg

SEQ ID NO: 20099 - RNA, 22 nt, Homo sapiens
cacaaaucccagaagucaccgc

SEQ ID NO: 20100 - RNA, 22 nt, Homo sapiens
caugaccuucugggauuuguag

SEQ ID NO: 20101 - RNA, 22 nt, Homo sapiens
agguucuucuucuguaaaauga

SEQ ID NO: 20102 - RNA, 22 nt, Homo sapiens
uuuugcagcucuggaaucugag

SEQ ID NO: 20103 - RNA, 22 nt, Homo sapiens
uaugcuauaaagacuaauaauu

SEQ ID NO: 20104 - RNA, 22 nt, Homo sapiens
uuguuauccauuauagcaaaac

SEQ ID NO: 20105 - RNA, 22 nt, Homo sapiens
ugcagagggagagagcguuacc

SEQ ID NO: 20106 - RNA, 17 nt, Homo sapiens
guucucucuccuucuca

SEQ ID NO: 20107 - RNA, 22 nt, Homo sapiens
uucccacacuugaagcccucug

SEQ ID NO: 20108 - RNA, 22 nt, Homo sapiens
agauggccuuaggugggaauug

SEQ ID NO: 20109 - RNA, 22 nt, Homo sapiens
ugcaucugcuguugcuugacca

SEQ ID NO: 20110 - RNA, 22 nt, Homo sapiens
uggcaagcacagaaauguacau

SEQ ID NO: 20111 - RNA, 22 nt, Homo sapiens
gguggccaggugcauaucuugg

SEQ ID NO: 20112 - RNA, 22 nt, Homo sapiens
ugggaaugccuacuggucaccu

SEQ ID NO: 20113 - RNA, 22 nt, Homo sapiens
cagguggaagcauggacuuugc

SEQ ID NO: 20114 - RNA, 22 nt, Homo sapiens
gugaagaucaacuuccgcuuca

SEQ ID NO: 20115 - RNA, 22 nt, Homo sapiens
agagcauacuuuugcacuuuca

SEQ ID NO: 20116 - RNA, 22 nt, Homo sapiens
uuuuaaagaaaaguauguuuug

SEQ ID NO: 20117 - RNA, 22 nt, Homo sapiens
gcccuuccucaaggcugacugg

SEQ ID NO: 20118 - RNA, 20 nt, Homo sapiens
uacagccuguggggaagugu

SEQ ID NO: 20119 - RNA, 22 nt, Homo sapiens
caaggccagagggcauucaagu

SEQ ID NO: 20120 - RNA, 22 nt, Homo sapiens
ugggagcugccaccuggccuuc

SEQ ID NO: 20121 - RNA, 22 nt, Homo sapiens
uaacaaauuuaaaaaaaacuaa

SEQ ID NO: 20122 - RNA, 22 nt, Homo sapiens
guuuuuuuucaacuuguuacag

SEQ ID NO: 20123 - RNA, 22 nt, Homo sapiens
ugguggacagaggagaggggaa

SEQ ID NO: 20124 - RNA, 22 nt, Homo sapiens
ucccuucuaaguguuaccauca

SEQ ID NO: 20125 - RNA, 22 nt, Homo sapiens
uaaaaguacagaccuuucuuga

SEQ ID NO: 20126 - RNA, 22 nt, Homo sapiens
ucuuggagaagggauugugcuc

SEQ ID NO: 20127 - RNA, 22 nt, Homo sapiens
ugcugucuuuaaucugccugug

SEQ ID NO: 20128 - RNA, 22 nt, Homo sapiens
cgggcgggugggugguucaaau

SEQ ID NO: 20129 - RNA, 22 nt, Homo sapiens
uguguuuuuaacucuaggaguc

SEQ ID NO: 20130 - RNA, 22 nt, Homo sapiens
aaauuccaagggcuacaaacac

SEQ ID NO: 20131 - RNA, 22 nt, Homo sapiens
ucuccccuuuucucaagcccag

SEQ ID NO: 20132 - RNA, 20 nt, Homo sapiens
uggguuuguagaggggaagg

SEQ ID NO: 20133 - RNA, 22 nt, Homo sapiens
ucuccugucaccuugcucuccu

SEQ ID NO: 20134 - RNA, 21 nt, Homo sapiens
gggcagcaggagauaggaagg

SEQ ID NO: 20135 - RNA, 22 nt, Homo sapiens
ucauagguuucaaagcucuggg

SEQ ID NO: 20136 - RNA, 22 nt, Homo sapiens
uuggggcuuuaacguguaagcu

SEQ ID NO: 20137 - RNA, 22 nt, Homo sapiens
ucauucucauuccaagacguuu

SEQ ID NO: 20138 - RNA, 22 nt, Homo sapiens
augugugggggaagggaagucu

SEQ ID NO: 20139 - RNA, 22 nt, Homo sapiens
uucuaacauucugugauucuug

SEQ ID NO: 20140 - RNA, 22 nt, Homo sapiens
agaaucauaaaauuuagaguug

SEQ ID NO: 20141 - RNA, 22 nt, Homo sapiens
ucugggcguaguagugacgaau

SEQ ID NO: 20142 - RNA, 22 nt, Homo sapiens
ucuccacuacugcggccacaca

SEQ ID NO: 20143 - RNA, 22 nt, Homo sapiens
uucucccaucuuuauucgcuag

SEQ ID NO: 20144 - RNA, 22 nt, Homo sapiens
uagugggcaagaggaagagaag

SEQ ID NO: 20145 - RNA, 22 nt, Homo sapiens
uaucuaaagcaggcucuauuua

SEQ ID NO: 20146 - RNA, 22 nt, Homo sapiens
auuggagucuguuuuagaugag

SEQ ID NO: 20147 - RNA, 22 nt, Homo sapiens
gccccuuccaguccuucucgga

SEQ ID NO: 20148 - RNA, 19 nt, Homo sapiens
cgaggaggacggaaggugc

SEQ ID NO: 20149 - RNA, 22 nt, Homo sapiens
uuuuagucaauaucaagauuua

SEQ ID NO: 20150 - RNA, 22 nt, Homo sapiens
uaaaucgugauauugaccccau

SEQ ID NO: 20151 - RNA, 22 nt, Homo sapiens
ucccccuuuuacugccuuuuuc

SEQ ID NO: 20152 - RNA, 22 nt, Homo sapiens
gaggcaguggaagggaaaguau

SEQ ID NO: 20153 - RNA, 22 nt, Homo sapiens
uccugacccagucuuggccgua

SEQ ID NO: 20154 - RNA, 22 nt, Homo sapiens
uggacaggacuggggccaggac

SEQ ID NO: 20155 - RNA, 22 nt, Homo sapiens
ucccuuccaaacggugcucccu

SEQ ID NO: 20156 - RNA, 17 nt, Homo sapiens
gcuacugugggaggaag

SEQ ID NO: 20157 - RNA, 22 nt, Homo sapiens
cacugaaaucuugacuguacac

SEQ ID NO: 20158 - RNA, 22 nt, Homo sapiens
ggugcagggaggaucagcugca

SEQ ID NO: 20159 - RNA, 22 nt, Homo sapiens
auguccucaucugcccaguggg

SEQ ID NO: 20160 - RNA, 22 nt, Homo sapiens
agggaugugggaggaugaagug

SEQ ID NO: 20161 - RNA, 22 nt, Homo sapiens
agauacaagaggccugacgugu

SEQ ID NO: 20162 - RNA, 22 nt, Homo sapiens
auggcaggaaucauguguuuug

SEQ ID NO: 20163 - RNA, 22 nt, Homo sapiens
ugugucugugugcguaucugug

SEQ ID NO: 20164 - RNA, 22 nt, Homo sapiens
uaaaauauauacacacauauac

SEQ ID NO: 20165 - RNA, 22 nt, Homo sapiens
cgagggugcagggcugggguac

SEQ ID NO: 20166 - RNA, 21 nt, Homo sapiens
uaccccugccucagccuuccu

SEQ ID NO: 20167 - RNA, 22 nt, Homo sapiens
ugcucccaggaugcaaugcgcc

SEQ ID NO: 20168 - RNA, 22 nt, Homo sapiens
cguugcaaacugggaguuggag

SEQ ID NO: 20169 - RNA, 22 nt, Homo sapiens
aggucagaggaggcuggggcac

SEQ ID NO: 20170 - RNA, 22 nt, Homo sapiens
ccccaccucccacucacugugg

SEQ ID NO: 20171 - RNA, 22 nt, Homo sapiens
uccuuacugaggucccaaacug

SEQ ID NO: 20172 - RNA, 22 nt, Homo sapiens
cuagauggggcuucagggggca

SEQ ID NO: 20173 - RNA, 22 nt, Homo sapiens
ugguuuaccgucccacauacau

SEQ ID NO: 20174 - RNA, 22 nt, Homo sapiens
ugugggaugguaaaccgcuucu

SEQ ID NO: 20175 - RNA, 22 nt, Homo sapiens
ggcaccagaagugcugacgagg

SEQ ID NO: 20176 - RNA, 22 nt, Homo sapiens
ucacgaugacucagcacuuccu

SEQ ID NO: 20177 - RNA, 22 nt, Homo sapiens
gcucuaggcuucaggggucugu

SEQ ID NO: 20178 - RNA, 22 nt, Homo sapiens
gaccucugugaagccaguacgg

SEQ ID NO: 20179 - RNA, 22 nt, Homo sapiens
caucaaggcucucaauaaaaau

SEQ ID NO: 20180 - RNA, 22 nt, Homo sapiens
auuuuuauugagucuugauuga

SEQ ID NO: 20181 - RNA, 22 nt, Homo sapiens
aggaagcagagcaaaguccugg

SEQ ID NO: 20182 - RNA, 22 nt, Homo sapiens
ccugggauuucugcuaccugau

SEQ ID NO: 20183 - RNA, 22 nt, Homo sapiens
uuaaugaacucuucuagggcac

SEQ ID NO: 20184 - RNA, 22 nt, Homo sapiens
ugccuuuaaaggacucauugac

SEQ ID NO: 20185 - RNA, 22 nt, Homo sapiens
aacgucuuugcagccaguaaag

SEQ ID NO: 20186 - RNA, 22 nt, Homo sapiens
uugcucuagcugcaaaucguuu

SEQ ID NO: 20187 - RNA, 22 nt, Homo sapiens
ccugccuggcccugugcaggug

SEQ ID NO: 20188 - RNA, 22 nt, Homo sapiens
aucugcaugguugggcuuucug

SEQ ID NO: 20189 - RNA, 22 nt, Homo sapiens
ggggagggggcaggcaaaggcc

SEQ ID NO: 20190 - RNA, 22 nt, Homo sapiens
agguucccuguccccuuucucu

SEQ ID NO: 20191 - RNA, 22 nt, Homo sapiens
cauuuauggggcuuggauuggg

SEQ ID NO: 20192 - RNA, 22 nt, Homo sapiens
uagaaaauccaggucuuggaau

SEQ ID NO: 20193 - RNA, 22 nt, Homo sapiens
uagcauugggagaugaauuaac

SEQ ID NO: 20194 - RNA, 22 nt, Homo sapiens
gauucgucuuucaauuuuauaa

SEQ ID NO: 20195 - RNA, 22 nt, Homo sapiens
uggagguucucacaucuccacc

SEQ ID NO: 20196 - RNA, 22 nt, Homo sapiens
uggagaaguaugagccuucaca

SEQ ID NO: 20197 - RNA, 22 nt, Homo sapiens
ggacacaggcgguggucugggc

SEQ ID NO: 20198 - RNA, 22 nt, Homo sapiens
cagagcagugggguguguuggg

SEQ ID NO: 20199 - RNA, 22 nt, Homo sapiens
aaagacagggguggagacaggg

SEQ ID NO: 20200 - RNA, 22 nt, Homo sapiens
uugucuuucccccuguuuucuu

SEQ ID NO: 20201 - RNA, 22 nt, Homo sapiens
ugguggcuuucuagggucacuu

SEQ ID NO: 20202 - RNA, 22 nt, Homo sapiens
ugaccgcugggaaugcagccaa

SEQ ID NO: 20203 - RNA, 22 nt, Homo sapiens
gcgucuuggcuccgucugaaua

SEQ ID NO: 20204 - RNA, 22 nt, Homo sapiens
uuuggcuccagcucugggcgcg

SEQ ID NO: 20205 - RNA, 22 nt, Homo sapiens
ucgucauccugaaauuucccau

SEQ ID NO: 20206 - RNA, 22 nt, Homo sapiens
uuaugggagacgggaugaugag

SEQ ID NO: 20207 - RNA, 22 nt, Homo sapiens
uaacaggguggaaacuugauaa

SEQ ID NO: 20208 - RNA, 22 nt, Homo sapiens
uuuuguuauuuccuaccugaca

SEQ ID NO: 20209 - RNA, 22 nt, Homo sapiens
ucuggcugggagacaggcgccg

SEQ ID NO: 20210 - RNA, 22 nt, Homo sapiens
gccaagucucccuggucagaau

SEQ ID NO: 20211 - RNA, 22 nt, Homo sapiens
caguaguuaucacagugucugu

SEQ ID NO: 20212 - RNA, 21 nt, Homo sapiens
aggcacuguuguaaucacuuc

SEQ ID NO: 20213 - RNA, 22 nt, Homo sapiens
ggauaaauagagcccucacauc

SEQ ID NO: 20214 - RNA, 22 nt, Homo sapiens
gacaugagggcucuauuuucag

SEQ ID NO: 20215 - RNA, 22 nt, Homo sapiens
uaaagguguuggaacaaucgug

SEQ ID NO: 20216 - RNA, 22 nt, Homo sapiens
acgauuguucucuccuugcgca

SEQ ID NO: 20217 - RNA, 22 nt, Homo sapiens
ggagcaggagaccagggaggag

SEQ ID NO: 20218 - RNA, 22 nt, Homo sapiens
ucuucccgaggucccagcugac

SEQ ID NO: 20219 - RNA, 22 nt, Homo sapiens
ugcccacccaugccacagggcu

SEQ ID NO: 20220 - RNA, 22 nt, Homo sapiens
ccacuggguguuuggugggcac

SEQ ID NO: 20221 - RNA, 22 nt, Homo sapiens
ccuggccaggccccuugcaggg

SEQ ID NO: 20222 - RNA, 22 nt, Homo sapiens
cucucagggucuggccgggucc

SEQ ID NO: 20223 - RNA, 21 nt, Homo sapiens
caaagcgcuucccuuuggagc

SEQ ID NO: 20224 - RNA, 21 nt, Homo sapiens
cucuagagggaagcacuuucu

SEQ ID NO: 20225 - RNA, 20 nt, Homo sapiens
ucuagagggaagcacuuucu

SEQ ID NO: 20226 - RNA, 21 nt, Homo sapiens
ucuagagggaagcacuuucug

SEQ ID NO: 20227 - RNA, 22 nt, Homo sapiens
ggcaggggcaggaccuucagag

SEQ ID NO: 20228 - RNA, 22 nt, Homo sapiens
ugaguccaguccuggccucugc

SEQ ID NO: 20229 - RNA, 22 nt, Homo sapiens
ggcaggggcaggaccuucagag

SEQ ID NO: 20230 - RNA, 22 nt, Homo sapiens
ugaguccaguccuggccucugc

SEQ ID NO: 20231 - RNA, 22 nt, Homo sapiens
ggcaggggcaggaccuucagag

SEQ ID NO: 20232 - RNA, 22 nt, Homo sapiens
ugaguccaguccuggccucugc

SEQ ID NO: 20233 - RNA, 22 nt, Homo sapiens
uccauuggggcauuauuuugca

SEQ ID NO: 20234 - RNA, 22 nt, Homo sapiens
aaauaguaccccuguggucuga

SEQ ID NO: 20235 - RNA, 22 nt, Homo sapiens
cgcacacugcucccaggacagc

SEQ ID NO: 20236 - RNA, 22 nt, Homo sapiens
uggcaccgggagcagguguggg

SEQ ID NO: 20237 - RNA, 22 nt, Homo sapiens
uggauuaacugguuccauuguc

SEQ ID NO: 20238 - RNA, 22 nt, Homo sapiens
cuauggcacucuuaauccguac

SEQ ID NO: 20239 - RNA, 22 nt, Homo sapiens
uuagaagagguaaauuuccuuu

SEQ ID NO: 20240 - RNA, 22 nt, Homo sapiens
aggaaacuugcuucuucuaaac

SEQ ID NO: 20241 - RNA, 22 nt, Homo sapiens
ucauggucccagcagccaggcc

SEQ ID NO: 20242 - RNA, 22 nt, Homo sapiens
gcacugcugggauugugucuuu

SEQ ID NO: 20243 - RNA, 22 nt, Homo sapiens
cagagaaggaagcagccagaga

SEQ ID NO: 20244 - RNA, 22 nt, Homo sapiens
ugcuggcagcuuccuccuucuc

SEQ ID NO: 20245 - RNA, 22 nt, Homo sapiens
gggggaguugggaguggagggu

SEQ ID NO: 20246 - RNA, 22 nt, Homo sapiens
ucucccacgugccaccuccccu

SEQ ID NO: 20247 - RNA, 22 nt, Homo sapiens
aacaggccagcaagucuuggag

SEQ ID NO: 20248 - RNA, 20 nt, Homo sapiens
uugagacaugcugucccuuu

SEQ ID NO: 20249 - RNA, 22 nt, Homo sapiens
uccccaccuugggucuuggguu

SEQ ID NO: 20250 - RNA, 22 nt, Homo sapiens
ugaggguccagggagguggcag

SEQ ID NO: 20251 - RNA, 22 nt, Homo sapiens
uuaauggcuggcugggaggcag

SEQ ID NO: 20252 - RNA, 22 nt, Homo sapiens
gguuccucccagcuggucauua

SEQ ID NO: 20253 - RNA, 22 nt, Homo sapiens
caaauguagcuggcacuacgau

SEQ ID NO: 20254 - RNA, 22 nt, Homo sapiens
ugaagugcuggcuguuuugcug

SEQ ID NO: 20255 - RNA, 22 nt, Homo sapiens
ugaauggcaggaggguugcgca

SEQ ID NO: 20256 - RNA, 22 nt, Homo sapiens
ggguuucuccuucucauuugcc

SEQ ID NO: 20257 - RNA, 22 nt, Homo sapiens
ucaucaucucugguacugcuuu

SEQ ID NO: 20258 - RNA, 22 nt, Homo sapiens
gguagucacuggggauguaagc

SEQ ID NO: 20259 - RNA, 22 nt, Homo sapiens
cugugggccaccuagucaccaa

SEQ ID NO: 20260 - RNA, 21 nt, Homo sapiens
ugugacugguugaccagaggg

SEQ ID NO: 20261 - RNA, 22 nt, Homo sapiens
uuugcauggacaggcacagagg

SEQ ID NO: 20262 - RNA, 22 nt, Homo sapiens
ucccugugucuucugugcaagg

SEQ ID NO: 20263 - RNA, 22 nt, Homo sapiens
ugaagauacagauuuuuaacaa

SEQ ID NO: 20264 - RNA, 22 nt, Homo sapiens
uguuaaaaaacuguaucuucag

SEQ ID NO: 20265 - RNA, 22 nt, Homo sapiens
gggugggugguccgcagacaua

SEQ ID NO: 20266 - RNA, 22 nt, Homo sapiens
uguucugagguccaccgacuuu

SEQ ID NO: 20267 - RNA, 22 nt, Homo sapiens
ugaagguugcggcagcuucggg

SEQ ID NO: 20268 - RNA, 22 nt, Homo sapiens
uccgggcugccuuugccuuuaa

SEQ ID NO: 20269 - RNA, 22 nt, Homo sapiens
uccucucaaggaggcugcuauc

SEQ ID NO: 20270 - RNA, 20 nt, Homo sapiens
uguagccucucuugaguaga

SEQ ID NO: 20271 - RNA, 22 nt, Homo sapiens
uccauacuucaccccccucagu

SEQ ID NO: 20272 - RNA, 22 nt, Homo sapiens
ugagacuggggcgugaggcugu

SEQ ID NO: 20273 - RNA, 22 nt, Homo sapiens
uuuccuuagccugcucuucccu

SEQ ID NO: 20274 - RNA, 22 nt, Homo sapiens
uggggaagagcagauuaagcag

SEQ ID NO: 20275 - RNA, 22 nt, Homo sapiens
ccuguuggggcagugcagggcc

SEQ ID NO: 20276 - RNA, 22 nt, Homo sapiens
cuccugugauugccucgcccag

SEQ ID NO: 20277 - RNA, 22 nt, Homo sapiens
uggagcagugagucuuuuacac

SEQ ID NO: 20278 - RNA, 22 nt, Homo sapiens
ugagagagcuugaugccuccuu

SEQ ID NO: 20279 - RNA, 22 nt, Homo sapiens
uaaagcuuucagugcaaugccu

SEQ ID NO: 20280 - RNA, 22 nt, Homo sapiens
cauuguaaaugggaguauuauc

SEQ ID NO: 20281 - RNA, 22 nt, Homo sapiens
uggcuguuguggugugcaaaac

SEQ ID NO: 20282 - RNA, 22 nt, Homo sapiens
uugccacacugcaacaccuuac

SEQ ID NO: 20283 - RNA, 22 nt, Homo sapiens
uccuaaugauuuucuaugucug

SEQ ID NO: 20284 - RNA, 22 nt, Homo sapiens
uagauguauaaauauuaaaaag

SEQ ID NO: 20285 - RNA, 22 nt, Homo sapiens
ccuugccuggguucaaauccug

SEQ ID NO: 20286 - RNA, 22 nt, Homo sapiens
cugggugaccucagguaagucc

SEQ ID NO: 20287 - RNA, 22 nt, Homo sapiens
gggcugugagcugcugugggca

SEQ ID NO: 20288 - RNA, 22 nt, Homo sapiens
cccaguguggcccaagcuccug

SEQ ID NO: 20289 - RNA, 22 nt, Homo sapiens
agggagcagcauccuucacuug

SEQ ID NO: 20290 - RNA, 22 nt, Homo sapiens
uccagggaggacgcugccccag

SEQ ID NO: 20291 - RNA, 22 nt, Homo sapiens
caaaaugugccaggaugucuug

SEQ ID NO: 20292 - RNA, 22 nt, Homo sapiens
gaccuuccauggcgucuuuugu

SEQ ID NO: 20293 - RNA, 22 nt, Homo sapiens
ugaccccaaaugcccuugggac

SEQ ID NO: 20294 - RNA, 22 nt, Homo sapiens
gccccaggggguuuugggggcu

SEQ ID NO: 20295 - RNA, 22 nt, Homo sapiens
cauauaguaggugcucuguguu

SEQ ID NO: 20296 - RNA, 22 nt, Homo sapiens
cauuuauugagcaccuacugga

SEQ ID NO: 20297 - RNA, 22 nt, Homo sapiens
gcucaagugguagcugucucau

SEQ ID NO: 20298 - RNA, 22 nt, Homo sapiens
aggccggcuaccacuuggggcu

SEQ ID NO: 20299 - RNA, 22 nt, Homo sapiens
gcucaagugguagcugucucau

SEQ ID NO: 20300 - RNA, 22 nt, Homo sapiens
aggccggcuaccacuuggggcu

SEQ ID NO: 20301 - RNA, 22 nt, Homo sapiens
gcucaagugguagcugucucau

SEQ ID NO: 20302 - RNA, 22 nt, Homo sapiens
aggccggcuaccacuuggggcu

SEQ ID NO: 20303 - RNA, 22 nt, Homo sapiens
uaaauagagguuuaauuaacac

SEQ ID NO: 20304 - RNA, 22 nt, Homo sapiens
uuaauuaaaucuguauuuacau

SEQ ID NO: 20305 - RNA, 21 nt, Homo sapiens
aaagugcacccaguuuugggg

SEQ ID NO: 20306 - RNA, 21 nt, Homo sapiens
ucaaaacugaggggcauuuuc

SEQ ID NO: 20307 - RNA, 22 nt, Homo sapiens
ucaaaacugaggggcauuuucu

SEQ ID NO: 20308 - RNA, 22 nt, Homo sapiens
gcgcggcgccggccagcccgcc

SEQ ID NO: 20309 - RNA, 22 nt, Homo sapiens
caggcaucaggccggcgccgcg

SEQ ID NO: 20310 - RNA, 22 nt, Homo sapiens
uggucggcuguucccucuccca

SEQ ID NO: 20311 - RNA, 22 nt, Homo sapiens
ggaaaggaauuucugaccauga

SEQ ID NO: 20312 - RNA, 22 nt, Homo sapiens
gguuugccuaggugggucauuc

SEQ ID NO: 20313 - RNA, 21 nt, Homo sapiens
ugauuugccuaggcaaaugca

SEQ ID NO: 20314 - RNA, 22 nt, Homo sapiens
gauuaucaggccucuuucuacc

SEQ ID NO: 20315 - RNA, 22 nt, Homo sapiens
guagaaugaggccugacauauc

SEQ ID NO: 20316 - RNA, 22 nt, Homo sapiens
gauuaucaggccucuuucuacc

SEQ ID NO: 20317 - RNA, 22 nt, Homo sapiens
guagaaugaggccugacauauc

SEQ ID NO: 20318 - RNA, 22 nt, Homo sapiens
uggugaugggguuugguguccc

SEQ ID NO: 20319 - RNA, 22 nt, Homo sapiens
gggccuucugaccugguugcca

SEQ ID NO: 20320 - RNA, 22 nt, Homo sapiens
caggagcugcuaagugcuccuc

SEQ ID NO: 20321 - RNA, 22 nt, Homo sapiens
gguagcauggagagcuccuggc

SEQ ID NO: 20322 - RNA, 22 nt, Homo sapiens
ugcagguuguccucaguuucag

SEQ ID NO: 20323 - RNA, 22 nt, Homo sapiens
ucaggcugaaggcccuugcagg

SEQ ID NO: 20324 - RNA, 22 nt, Homo sapiens
ugggguucugcccggcagggcu

SEQ ID NO: 20325 - RNA, 22 nt, Homo sapiens
cagcccugggggaggccucggc

SEQ ID NO: 20326 - RNA, 22 nt, Homo sapiens
uguuagucauggauguugccac

SEQ ID NO: 20327 - RNA, 22 nt, Homo sapiens
caucaaguaugacuagugggac

SEQ ID NO: 20328 - RNA, 22 nt, Homo sapiens
cacuucaggacugugggaaagu

SEQ ID NO: 20329 - RNA, 22 nt, Homo sapiens
aguuuccccauuugaacagugu

SEQ ID NO: 20330 - RNA, 22 nt, Homo sapiens
uccuuggccuggcggucuccac

SEQ ID NO: 20331 - RNA, 22 nt, Homo sapiens
gagggucugcugcugggcugag

SEQ ID NO: 20332 - RNA, 22 nt, Homo sapiens
uaaguaguaagccagguuaggc

SEQ ID NO: 20333 - RNA, 22 nt, Homo sapiens
cacagagccuggcacauuauuu

SEQ ID NO: 20334 - RNA, 22 nt, Homo sapiens
uaccacuguucaauagguggaa

SEQ ID NO: 20335 - RNA, 22 nt, Homo sapiens
ucugccucuuggguagugguag

SEQ ID NO: 20336 - RNA, 22 nt, Homo sapiens
ucagucucuggaccaugucuac

SEQ ID NO: 20337 - RNA, 22 nt, Homo sapiens
uggacauuaucuggggcuggau

SEQ ID NO: 20338 - RNA, 22 nt, Homo sapiens
uuuaaagaggaaacagaccaaa

SEQ ID NO: 20339 - RNA, 22 nt, Homo sapiens
uuuucuguuuuucuuuuaaaau

SEQ ID NO: 20340 - RNA, 22 nt, Homo sapiens
caggacccuccaggggggucuc

SEQ ID NO: 20341 - RNA, 19 nt, Homo sapiens
ccucccugaggggguuaug

SEQ ID NO: 20342 - RNA, 22 nt, Homo sapiens
uccagcaggaggagaugcuaaa

SEQ ID NO: 20343 - RNA, 22 nt, Homo sapiens
uuagcauuuuuuaccuuguugg

SEQ ID NO: 20344 - RNA, 22 nt, Homo sapiens
ggauuggccccagcgccaggug

SEQ ID NO: 20345 - RNA, 22 nt, Homo sapiens
ccucugcgugugaaggugccag

SEQ ID NO: 20346 - RNA, 22 nt, Homo sapiens
uaagaggaaauaucacuuagua

SEQ ID NO: 20347 - RNA, 22 nt, Homo sapiens
uaaguaguguuuccuacuaauu

SEQ ID NO: 20348 - RNA, 22 nt, Homo sapiens
uuggcaguccagggucaaacag

SEQ ID NO: 20349 - RNA, 22 nt, Homo sapiens
ucuguguccugggcucugagcg

SEQ ID NO: 20350 - RNA, 22 nt, Homo sapiens
uccacugccugccuccgcugga

SEQ ID NO: 20351 - RNA, 22 nt, Homo sapiens
ggcuagggugcagguggggagu

SEQ ID NO: 20352 - RNA, 22 nt, Homo sapiens
agggcaaacucuacuaagaccu

SEQ ID NO: 20353 - RNA, 22 nt, Homo sapiens
guuuggguggagaguguccugg

SEQ ID NO: 20354 - RNA, 22 nt, Homo sapiens
ggaugagaauggggcaguaagg

SEQ ID NO: 20355 - RNA, 22 nt, Homo sapiens
ugcuucgugcccucccacucug

SEQ ID NO: 20356 - RNA, 22 nt, Homo sapiens
ccugggugguggggcugggguu

SEQ ID NO: 20357 - RNA, 22 nt, Homo sapiens
uuccugcuccacugccggggcu

SEQ ID NO: 20358 - RNA, 23 nt, Homo sapiens
agcagcauuguacagggcuauga

SEQ ID NO: 20359 - RNA, 22 nt, Homo sapiens
uucagcuucuuuacagugcugc

SEQ ID NO: 20360 - RNA, 22 nt, Homo sapiens
ugcugggaaggugggauggaaa

SEQ ID NO: 20361 - RNA, 22 nt, Homo sapiens
uccuugguugugccucccagga

SEQ ID NO: 20362 - RNA, 22 nt, Homo sapiens
uuucuagggcacagacagugca

SEQ ID NO: 20363 - RNA, 22 nt, Homo sapiens
uguaguuuagguuucagaaggg

SEQ ID NO: 20364 - RNA, 22 nt, Homo sapiens
caaucacagcuuaaucuaauua

SEQ ID NO: 20365 - RNA, 22 nt, Homo sapiens
auuagauuaaguagugauuuau

SEQ ID NO: 20366 - RNA, 22 nt, Homo sapiens
ugcccuuggagaucauaccagc

SEQ ID NO: 20367 - RNA, 17 nt, Homo sapiens
guaauccucaaggggag

SEQ ID NO: 20368 - RNA, 22 nt, Homo sapiens
gccaggccuggggauccagggc

SEQ ID NO: 20369 - RNA, 22 nt, Homo sapiens
gcccuggagcugggaguggccu

SEQ ID NO: 20370 - RNA, 22 nt, Homo sapiens
ggcaguguaguguaagggcaug

SEQ ID NO: 20371 - RNA, 22 nt, Homo sapiens
guggcucuuucauuuacugugu

SEQ ID NO: 20372 - RNA, 22 nt, Homo sapiens
gucaggaugcccaggcccugcc

SEQ ID NO: 20373 - RNA, 20 nt, Homo sapiens
gcagggcccagcuccugggc

SEQ ID NO: 20374 - RNA, 22 nt, Homo sapiens
uaagaggaaauaucacuuagua

SEQ ID NO: 20375 - RNA, 22 nt, Homo sapiens
uaaguaguguuuccuacuaauu

SEQ ID NO: 20376 - RNA, 22 nt, Homo sapiens
ugaaaggguuucauuuauggcc

SEQ ID NO: 20377 - RNA, 22 nt, Homo sapiens
cuguaaaauagacccaggaggu

SEQ ID NO: 20378 - RNA, 22 nt, Homo sapiens
aaugcggccuccgccccgcgcg

SEQ ID NO: 20379 - RNA, 22 nt, Homo sapiens
gucgcgggggauggaggcggcg

SEQ ID NO: 20380 - RNA, 22 nt, Homo sapiens
uaccugaguguagauauugacc

SEQ ID NO: 20381 - RNA, 22 nt, Homo sapiens
ucaauguuuacauugaaggaca

SEQ ID NO: 20382 - RNA, 22 nt, Homo sapiens
ugcggguggggaggcaggggcg

SEQ ID NO: 20383 - RNA, 20 nt, Homo sapiens
uccccucccccagcccgggc

SEQ ID NO: 20384 - RNA, 22 nt, Homo sapiens
acgguuuuaccagacaguauua

SEQ ID NO: 20385 - RNA, 22 nt, Homo sapiens
uaaccaugucugguaagacgcc

SEQ ID NO: 20386 - RNA, 22 nt, Homo sapiens
gguccugggguaagagaggauc

SEQ ID NO: 20387 - RNA, 22 nt, Homo sapiens
uuucucccuucccaagaccuga

SEQ ID NO: 20388 - RNA, 22 nt, Homo sapiens
gcccgcccccugcgccuccccg

SEQ ID NO: 20389 - RNA, 22 nt, Homo sapiens
gagggggaagguaggggcggcg

SEQ ID NO: 20390 - RNA, 22 nt, Homo sapiens
uuuccugucuuuagcuguaggg

SEQ ID NO: 20391 - RNA, 22 nt, Homo sapiens
uacaguaaaagacaggguugga

SEQ ID NO: 20392 - RNA, 22 nt, Homo sapiens
ggacucuagacccaggaaggcc

SEQ ID NO: 20393 - RNA, 22 nt, Homo sapiens
uuggccuucuggucugaguugc

SEQ ID NO: 20394 - RNA, 22 nt, Homo sapiens
aggcccuucagcccuuggaagg

SEQ ID NO: 20395 - RNA, 22 nt, Homo sapiens
cagugaggggcugguggggauu

SEQ ID NO: 20396 - RNA, 22 nt, Homo sapiens
ucaccaagcucucuucccggcu

SEQ ID NO: 20397 - RNA, 22 nt, Homo sapiens
cagugggaggagggcugggguc

SEQ ID NO: 20398 - RNA, 22 nt, Homo sapiens
uugaagguucuaccacaccagu

SEQ ID NO: 20399 - RNA, 22 nt, Homo sapiens
uguguggugggggcuuugagcu

SEQ ID NO: 20400 - RNA, 22 nt, Homo sapiens
acccggggguggagaguggagg

SEQ ID NO: 20401 - RNA, 22 nt, Homo sapiens
cucugaguccaccugaugggcc

SEQ ID NO: 20402 - RNA, 22 nt, Homo sapiens
uggcacaguagacagugagcca

SEQ ID NO: 20403 - RNA, 22 nt, Homo sapiens
ugggcuucacuaacugugcugc

SEQ ID NO: 20404 - RNA, 22 nt, Homo sapiens
aacccuucaccgaguguggugg

SEQ ID NO: 20405 - RNA, 22 nt, Homo sapiens
accucacucggcuaaggauuuu

SEQ ID NO: 20406 - RNA, 22 nt, Homo sapiens
agaagacauuucagaauuucuu

SEQ ID NO: 20407 - RNA, 22 nt, Homo sapiens
gagauucugaagaacuucauca

SEQ ID NO: 20408 - RNA, 22 nt, Homo sapiens
uacccccaaaccuucagcugcu

SEQ ID NO: 20409 - RNA, 22 nt, Homo sapiens
ggggcuugugaggguuuggagu

SEQ ID NO: 20410 - RNA, 22 nt, Homo sapiens
uggcacauaauaaaugcuaugu

SEQ ID NO: 20411 - RNA, 22 nt, Homo sapiens
ucucaauuuuuauaugugacag

SEQ ID NO: 20412 - RNA, 22 nt, Homo sapiens
ucguggcuggacaaaugaguug

SEQ ID NO: 20413 - RNA, 22 nt, Homo sapiens
caacucaugugcagcucauggc

SEQ ID NO: 20414 - RNA, 22 nt, Homo sapiens
uuugguccuuccauugguccua

SEQ ID NO: 20415 - RNA, 22 nt, Homo sapiens
agggcaugggaaggacccaagg

SEQ ID NO: 20416 - RNA, 22 nt, Homo sapiens
gcuuucuuuuguuucucuuccc

SEQ ID NO: 20417 - RNA, 22 nt, Homo sapiens
caagaaggacacaaggauggcu

SEQ ID NO: 20418 - RNA, 22 nt, Homo sapiens
ugcucagaaaggucagcaugag

SEQ ID NO: 20419 - RNA, 22 nt, Homo sapiens
uuucaagcuggccucuggcagg

SEQ ID NO: 20420 - RNA, 22 nt, Homo sapiens
gguguggagugugacuguguug

SEQ ID NO: 20421 - RNA, 22 nt, Homo sapiens
ugugguauauacgcacacacgc

SEQ ID NO: 20422 - RNA, 22 nt, Homo sapiens
aaacuguccuuccuagaggugu

SEQ ID NO: 20423 - RNA, 22 nt, Homo sapiens
ugccucuugggaggagaggccu

SEQ ID NO: 20424 - RNA, 22 nt, Homo sapiens
ugcagagcccugaagccgacgg

SEQ ID NO: 20425 - RNA, 22 nt, Homo sapiens
ccuggcucggggacuccugccc

SEQ ID NO: 20426 - RNA, 22 nt, Homo sapiens
ucgcacaauccgauuccuuggg

SEQ ID NO: 20427 - RNA, 22 nt, Homo sapiens
ucagggaguuuggcacguggga

SEQ ID NO: 20428 - RNA, 22 nt, Homo sapiens
uggaugggugaggggggaguug

SEQ ID NO: 20429 - RNA, 22 nt, Homo sapiens
acccucuccccugccccccaga

SEQ ID NO: 20430 - RNA, 22 nt, Homo sapiens
aggaagugacuguaucuacaag

SEQ ID NO: 20431 - RNA, 22 nt, Homo sapiens
uguagauagcccaugaacuucc

SEQ ID NO: 20432 - RNA, 22 nt, Homo sapiens
gaggucagaggaggccaaggcc

SEQ ID NO: 20433 - RNA, 22 nt, Homo sapiens
aaggccuaggcucugcccuccc

SEQ ID NO: 20434 - RNA, 22 nt, Homo sapiens
ucugcccccagugucccugcuu

SEQ ID NO: 20435 - RNA, 22 nt, Homo sapiens
cagggaguugggagguggcaag

SEQ ID NO: 20436 - RNA, 22 nt, Homo sapiens
ucccccauccucgaccaucuuu

SEQ ID NO: 20437 - RNA, 22 nt, Homo sapiens
gcaauggcgagggaggggagag

SEQ ID NO: 20438 - RNA, 22 nt, Homo sapiens
uucuccugcucuauuuauucag

SEQ ID NO: 20439 - RNA, 22 nt, Homo sapiens
ugggagaugagggugggaggaa

SEQ ID NO: 20440 - RNA, 22 nt, Homo sapiens
uugggggcugugaccagccaca

SEQ ID NO: 20441 - RNA, 22 nt, Homo sapiens
cggugcugggcacccccagggu

SEQ ID NO: 20442 - RNA, 22 nt, Homo sapiens
uggugugggcaaggaaaagaaa

SEQ ID NO: 20443 - RNA, 20 nt, Homo sapiens
ucuuuuccuguccaggcaau

SEQ ID NO: 20444 - RNA, 22 nt, Homo sapiens
gcagccucuugggaggggaggu

SEQ ID NO: 20445 - RNA, 22 nt, Homo sapiens
cuuccagccugggggcugguga

SEQ ID NO: 20446 - RNA, 22 nt, Homo sapiens
gcagccucuugggaggggaggu

SEQ ID NO: 20447 - RNA, 22 nt, Homo sapiens
cuuccagccugggggcugguga

SEQ ID NO: 20448 - RNA, 22 nt, Homo sapiens
ccuggaacagggagcgucaguu

SEQ ID NO: 20449 - RNA, 22 nt, Homo sapiens
accaaccugccuguuuuagggg

SEQ ID NO: 20450 - RNA, 22 nt, Homo sapiens
uuugcuugacuacaucagugag

SEQ ID NO: 20451 - RNA, 22 nt, Homo sapiens
gcaagauagaguggagugaaau

SEQ ID NO: 20452 - RNA, 22 nt, Homo sapiens
gggucaccacacuuugcuaacu

SEQ ID NO: 20453 - RNA, 22 nt, Homo sapiens
aguagcgagggaauggugccgc

SEQ ID NO: 20454 - RNA, 22 nt, Homo sapiens
uaggagacugguagacucuaac

SEQ ID NO: 20455 - RNA, 22 nt, Homo sapiens
gcuguucaccagucaucugcua

SEQ ID NO: 20456 - RNA, 22 nt, Homo sapiens
guuuucuacuuuccuacauugc

SEQ ID NO: 20457 - RNA, 22 nt, Homo sapiens
uguaauggaaaguggggagggg

SEQ ID NO: 20458 - RNA, 22 nt, Homo sapiens
agugagaugccucacucgcucu

SEQ ID NO: 20459 - RNA, 22 nt, Homo sapiens
aggcguccugaggcauccacaa

SEQ ID NO: 20460 - RNA, 22 nt, Homo sapiens
ucgggggucacagugggucggg

SEQ ID NO: 20461 - RNA, 22 nt, Homo sapiens
caggcucagugugacuccucca

SEQ ID NO: 20462 - RNA, 22 nt, Homo sapiens
cccccucaguccaccagagccc

SEQ ID NO: 20463 - RNA, 22 nt, Homo sapiens
ggcucugggucuguggggagcg

SEQ ID NO: 20464 - RNA, 22 nt, Homo sapiens
agccagcuccccuggcaggcua

SEQ ID NO: 20465 - RNA, 22 nt, Homo sapiens
cugagcuggggagagagggagc

SEQ ID NO: 20466 - RNA, 22 nt, Homo sapiens
aaaggguaggccagggaggaag

SEQ ID NO: 20467 - RNA, 22 nt, Homo sapiens
uccuccccucuguagcccuuuc

SEQ ID NO: 20468 - RNA, 21 nt, Homo sapiens
agggcccccccucaauccugu

SEQ ID NO: 20469 - RNA, 22 nt, Homo sapiens
ggguuggguggaggcucuccug

SEQ ID NO: 20470 - RNA, 22 nt, Homo sapiens
ccaccugucuucucuaugguau

SEQ ID NO: 20471 - RNA, 22 nt, Homo sapiens
acccuaagagagggcagaugug

SEQ ID NO: 20472 - RNA, 22 nt, Homo sapiens
aguuuuccauuuuguuucacau

SEQ ID NO: 20473 - RNA, 22 nt, Homo sapiens
aggcaaaggacuggaaaacacu

SEQ ID NO: 20474 - RNA, 22 nt, Homo sapiens
ugacccauuuuaagcaguuccc

SEQ ID NO: 20475 - RNA, 22 nt, Homo sapiens
agcuguucaaaugagucacucu

SEQ ID NO: 20476 - RNA, 22 nt, Homo sapiens
gagagcacgcugagcaggcccg

SEQ ID NO: 20477 - RNA, 22 nt, Homo sapiens
aucugcauuaguauuuuccucc

SEQ ID NO: 20478 - RNA, 22 nt, Homo sapiens
aaccaagugaguaaaugucaag

SEQ ID NO: 20479 - RNA, 22 nt, Homo sapiens
uuugauauuuccucacuuguga

SEQ ID NO: 20480 - RNA, 22 nt, Homo sapiens
gaagaaggagcggcccuuguga

SEQ ID NO: 20481 - RNA, 22 nt, Homo sapiens
ucacaaggaacgucuccucuug

SEQ ID NO: 20482 - RNA, 22 nt, Homo sapiens
gacaaccaaacaggauauuuca

SEQ ID NO: 20483 - RNA, 22 nt, Homo sapiens
uauuaucccguuugguaaucug

SEQ ID NO: 20484 - RNA, 22 nt, Homo sapiens
cccacaggcacgacugguuugg

SEQ ID NO: 20485 - RNA, 22 nt, Homo sapiens
cucaaaccggcugugccugugg

SEQ ID NO: 20486 - RNA, 22 nt, Homo sapiens
cagucgcauggcagccagcugg

SEQ ID NO: 20487 - RNA, 22 nt, Homo sapiens
ggugguaaccuugugaucccca

SEQ ID NO: 20488 - RNA, 22 nt, Homo sapiens
ucugcccccgccuccugccagg

SEQ ID NO: 20489 - RNA, 22 nt, Homo sapiens
uggaugggguggaggaugcaga

SEQ ID NO: 20490 - RNA, 22 nt, Homo sapiens
uguuugacucgguaguuuuauu

SEQ ID NO: 20491 - RNA, 22 nt, Homo sapiens
uauaaacuaucuuguuacacgg

SEQ ID NO: 20492 - RNA, 22 nt, Homo sapiens
auggugcccuagugacuacaaa

SEQ ID NO: 20493 - RNA, 22 nt, Homo sapiens
ucaagucacuagugguuccguu

SEQ ID NO: 20494 - RNA, 19 nt, Homo sapiens
aaaauggugcccuagugac

SEQ ID NO: 20495 - RNA, 23 nt, Homo sapiens
aaaauggugcccuagugacuaca

SEQ ID NO: 20496 - RNA, 21 nt, Homo sapiens
aaauggugcccuagugacuac

SEQ ID NO: 20497 - RNA, 22 nt, Homo sapiens
aggagggcagggcggugggaag

SEQ ID NO: 20498 - RNA, 21 nt, Homo sapiens
ucacuuccugacccuguugcu

SEQ ID NO: 20499 - RNA, 22 nt, Homo sapiens
aggagggcagggcggugggaag

SEQ ID NO: 20500 - RNA, 21 nt, Homo sapiens
ucacuuccugacccuguugcu

SEQ ID NO: 20501 - RNA, 19 nt, Homo sapiens
caaagcgcuucucuuuaga

SEQ ID NO: 20502 - RNA, 20 nt, Homo sapiens
caaagcgcuucucuuuagag

SEQ ID NO: 20503 - RNA, 21 nt, Homo sapiens
caaagcgcuucucuuuagagu

SEQ ID NO: 20504 - RNA, 22 nt, Homo sapiens
caaagcgcuucucuuuagagug

SEQ ID NO: 20505 - RNA, 21 nt, Homo sapiens
cucuggagggaagcacuuucu

SEQ ID NO: 20506 - RNA, 23 nt, Homo sapiens
ucucuggagggaagcacuuucug

SEQ ID NO: 20507 - RNA, 22 nt, Homo sapiens
acaguccuguggagugggcaug

SEQ ID NO: 20508 - RNA, 22 nt, Homo sapiens
agguuuauuucauuggauuguu

SEQ ID NO: 20509 - RNA, 22 nt, Homo sapiens
cacuccuggggauuauaggagc

SEQ ID NO: 20510 - RNA, 22 nt, Homo sapiens
uccuuauaaugcccuaaggaug

SEQ ID NO: 20511 - RNA, 22 nt, Homo sapiens
uucagagacugguuaucauuca

SEQ ID NO: 20512 - RNA, 22 nt, Homo sapiens
gguaaugaaccaucucugagcc

SEQ ID NO: 20513 - RNA, 22 nt, Homo sapiens
gaaacacaagagcaaggugcug

SEQ ID NO: 20514 - RNA, 22 nt, Homo sapiens
agguagcuuuuuucuguguguu

SEQ ID NO: 20515 - RNA, 22 nt, Homo sapiens
agggaucuggggcagauggugg

SEQ ID NO: 20516 - RNA, 21 nt, Homo sapiens
ucacuucugccacagaugacu

SEQ ID NO: 20517 - RNA, 22 nt, Homo sapiens
cgagauaagauagugcuguccc

SEQ ID NO: 20518 - RNA, 22 nt, Homo sapiens
ggaugcuuauuuuuaaaucuca

SEQ ID NO: 20519 - RNA, 22 nt, Homo sapiens
ggauggcccauguuucaccagc

SEQ ID NO: 20520 - RNA, 22 nt, Homo sapiens
cucggggcuuaugggcaguuuu

SEQ ID NO: 20521 - RNA, 20 nt, Homo sapiens
uaugucugcugaccaucacc

SEQ ID NO: 20522 - RNA, 23 nt, Homo sapiens
uggugggccgcagaacaugugcu

SEQ ID NO: 20523 - RNA, 22 nt, Homo sapiens
agggaucuggggagggaggagg

SEQ ID NO: 20524 - RNA, 20 nt, Homo sapiens
cucggcucucugcccgggcu

SEQ ID NO: 20525 - RNA, 22 nt, Homo sapiens
uggacaccucaggaugcuuccu

SEQ ID NO: 20526 - RNA, 22 nt, Homo sapiens
ggaaguagccuggaugugcaua

SEQ ID NO: 20527 - RNA, 22 nt, Homo sapiens
ugucacugugugauguucuucu

SEQ ID NO: 20528 - RNA, 22 nt, Homo sapiens
gaggaugugucaccagguggug

SEQ ID NO: 20529 - RNA, 22 nt, Homo sapiens
uagaugucugaccaccuucugg

SEQ ID NO: 20530 - RNA, 22 nt, Homo sapiens
ucuagaacgguuaggcuucugu

SEQ ID NO: 20531 - RNA, 19 nt, Homo sapiens
agaggcuggccgugaugaa

SEQ ID NO: 20532 - RNA, 20 nt, Homo sapiens
agaggcuggccgugaugaau

SEQ ID NO: 20533 - RNA, 22 nt, Homo sapiens
agaggcuggccgugaugaauuc

SEQ ID NO: 20534 - RNA, 21 nt, Homo sapiens
gucauacacggcucuccucuc

SEQ ID NO: 20535 - RNA, 22 nt, Homo sapiens
gucauacacggcucuccucucu

SEQ ID NO: 20536 - RNA, 22 nt, Homo sapiens
uggggcuugaaugggguuccau

SEQ ID NO: 20537 - RNA, 22 nt, Homo sapiens
uggggucuuggagaggcagucc

SEQ ID NO: 20538 - RNA, 22 nt, Homo sapiens
uggggcuugaaugggguuccau

SEQ ID NO: 20539 - RNA, 22 nt, Homo sapiens
uggggucuuggagaggcagucc

SEQ ID NO: 20540 - RNA, 22 nt, Homo sapiens
uguaugugugugggugguagug

SEQ ID NO: 20541 - RNA, 17 nt, Homo sapiens
cagcccucacucacaau

SEQ ID NO: 20542 - RNA, 22 nt, Homo sapiens
uucuuauauuccagaggccacu

SEQ ID NO: 20543 - RNA, 22 nt, Homo sapiens
uagucugcagaauguaagagau

SEQ ID NO: 20544 - RNA, 22 nt, Homo sapiens
ggaaauaaaugcuucugaaguu

SEQ ID NO: 20545 - RNA, 22 nt, Homo sapiens
auuaguagaggcauuuaguucu

SEQ ID NO: 20546 - RNA, 22 nt, Homo sapiens
aguggaaaaauucagucaguug

SEQ ID NO: 20547 - RNA, 18 nt, Homo sapiens
cugacugaguuuuuuucu

SEQ ID NO: 20548 - RNA, 22 nt, Homo sapiens
aacacugagauacacaucucau

SEQ ID NO: 20549 - RNA, 22 nt, Homo sapiens
ugagacguguaucucauuuuuu

SEQ ID NO: 20550 - RNA, 22 nt, Homo sapiens
ucuguucucuccacaugucagc

SEQ ID NO: 20551 - RNA, 22 nt, Homo sapiens
uuggaaauggggagaacagauu

SEQ ID NO: 20552 - RNA, 22 nt, Homo sapiens
uggagggaagagggucucagac

SEQ ID NO: 20553 - RNA, 22 nt, Homo sapiens
ugacauccuuuaagaucuccuu

SEQ ID NO: 20554 - RNA, 22 nt, Homo sapiens
ggugagggggugggaggugugg

SEQ ID NO: 20555 - RNA, 22 nt, Homo sapiens
uacacccaacccgcccccuucc

SEQ ID NO: 20556 - RNA, 22 nt, Homo sapiens
gguggggacgguagugugguug

SEQ ID NO: 20557 - RNA, 21 nt, Homo sapiens
ugggcaccuuauuguuuuccc

SEQ ID NO: 20558 - RNA, 22 nt, Homo sapiens
agagaggaaggaggucuguaag

SEQ ID NO: 20559 - RNA, 22 nt, Homo sapiens
gcaccccucacuuuccuucucc

SEQ ID NO: 20560 - RNA, 22 nt, Homo sapiens
uggagcccaggaagacagagac

SEQ ID NO: 20561 - RNA, 22 nt, Homo sapiens
gcgaggcuguccuugggcuccu

SEQ ID NO: 20562 - RNA, 21 nt, Homo sapiens
ucagucucaucugcaaagaag

SEQ ID NO: 20563 - RNA, 22 nt, Homo sapiens
uguuugcagaggaaacugagac

SEQ ID NO: 20564 - RNA, 22 nt, Homo sapiens
cguguauuugacaagcugaguu

SEQ ID NO: 20565 - RNA, 21 nt, Homo sapiens
ugucaguuugucaaauacccc

SEQ ID NO: 20566 - RNA, 22 nt, Homo sapiens
ggucugguccccuguugcccau

SEQ ID NO: 20567 - RNA, 18 nt, Homo sapiens
acagacuggggaccagcc

SEQ ID NO: 20568 - RNA, 22 nt, Homo sapiens
aggucaggacugugugucuggg

SEQ ID NO: 20569 - RNA, 22 nt, Homo sapiens
cccagcacagugccuggcacac

SEQ ID NO: 20570 - RNA, 22 nt, Homo sapiens
agggggagggugaagagauggg

SEQ ID NO: 20571 - RNA, 22 nt, Homo sapiens
uuuacauuauuuuucaugcuuu

SEQ ID NO: 20572 - RNA, 22 nt, Homo sapiens
acuucagauauuuaauauauua

SEQ ID NO: 20573 - RNA, 22 nt, Homo sapiens
uauaugaaauaucuuaaguuua

SEQ ID NO: 20574 - RNA, 22 nt, Homo sapiens
caggggcaggagaaggcagagg

SEQ ID NO: 20575 - RNA, 22 nt, Homo sapiens
uuuuccaucucuaacuccuaug

SEQ ID NO: 20576 - RNA, 22 nt, Homo sapiens
uacuggaugguggguuuucaga

SEQ ID NO: 20577 - RNA, 22 nt, Homo sapiens
uggcugcccacaucugguagug

SEQ ID NO: 20578 - RNA, 22 nt, Homo sapiens
gcaggggcccugcuuccguuua

SEQ ID NO: 20579 - RNA, 22 nt, Homo sapiens
agggaagcagcagccgccuguc

SEQ ID NO: 20580 - RNA, 22 nt, Homo sapiens
agcuggucucaaauguuccuuc

SEQ ID NO: 20581 - RNA, 22 nt, Homo sapiens
auuagagcagauguaggcacag

SEQ ID NO: 20582 - RNA, 22 nt, Homo sapiens
uuggggcugcguauuuccaugu

SEQ ID NO: 20583 - RNA, 22 nt, Homo sapiens
uaaacaugcagccugccaauuc

SEQ ID NO: 20584 - RNA, 22 nt, Homo sapiens
agacugacugcaguguggucau

SEQ ID NO: 20585 - RNA, 22 nt, Homo sapiens
ugcucacacugcagcagucugc

SEQ ID NO: 20586 - RNA, 22 nt, Homo sapiens
ccugcgggagaggaggcuggcu

SEQ ID NO: 20587 - RNA, 15 nt, Homo sapiens
cuucccuccugccgg

SEQ ID NO: 20588 - RNA, 22 nt, Homo sapiens
ugccucuccucugcccuuccua

SEQ ID NO: 20589 - RNA, 22 nt, Homo sapiens
gaggggugaaccaaggcaggua

SEQ ID NO: 20590 - RNA, 22 nt, Homo sapiens
uguccuuugugcagaacaguaa

SEQ ID NO: 20591 - RNA, 20 nt, Homo sapiens
uuacaucuggacaaaggcca

SEQ ID NO: 20592 - RNA, 22 nt, Homo sapiens
ccauccuccaugcaugggaauc

SEQ ID NO: 20593 - RNA, 22 nt, Homo sapiens
uuuccacaggaugguggguggg

SEQ ID NO: 20594 - RNA, 22 nt, Homo sapiens
uuguguguggguagggggcaac

SEQ ID NO: 20595 - RNA, 22 nt, Homo sapiens
ugcccccuauagauuuuaagac

SEQ ID NO: 20596 - RNA, 22 nt, Homo sapiens
uggaguggucuuucucucaacu

SEQ ID NO: 20597 - RNA, 22 nt, Homo sapiens
gcacagagaagccacuuucaga

SEQ ID NO: 20598 - RNA, 22 nt, Homo sapiens
agcacucuacacagauugucua

SEQ ID NO: 20599 - RNA, 22 nt, Homo sapiens
auuaucuguguagaacacuuaa

SEQ ID NO: 20600 - RNA, 22 nt, Homo sapiens
acuuccggccccgccgcggaag

SEQ ID NO: 20601 - RNA, 19 nt, Homo sapiens
uccgccgcgcgccggaugu

SEQ ID NO: 20602 - RNA, 22 nt, Homo sapiens
aggccaggcccucaggcaaggg

SEQ ID NO: 20603 - RNA, 22 nt, Homo sapiens
caccugcuugccagggccgauc

SEQ ID NO: 20604 - RNA, 22 nt, Homo sapiens
aggccaggcccucaggcaaggg

SEQ ID NO: 20605 - RNA, 22 nt, Homo sapiens
caccugcuugccagggccgauc

SEQ ID NO: 20606 - RNA, 22 nt, Homo sapiens
aggccaggcccucaggcaaggg

SEQ ID NO: 20607 - RNA, 22 nt, Homo sapiens
caccugcuugccagggccgauc

SEQ ID NO: 20608 - RNA, 22 nt, Homo sapiens
uggcuagcauuuaaaaucgacc

SEQ ID NO: 20609 - RNA, 22 nt, Homo sapiens
ugauuauaaaugcuagacacuc

SEQ ID NO: 20610 - RNA, 22 nt, Homo sapiens
uguggacucaguucuggugccc

SEQ ID NO: 20611 - RNA, 17 nt, Homo sapiens
ugaauuccauaggcugu

SEQ ID NO: 20612 - RNA, 21 nt, Homo sapiens
ugagaacugaauuccauaggc

SEQ ID NO: 20613 - RNA, 22 nt, Homo sapiens
ugagaacugaauuccauaggcu

SEQ ID NO: 20614 - RNA, 22 nt, Homo sapiens
acaguucacaaaaccuuggccu

SEQ ID NO: 20615 - RNA, 22 nt, Homo sapiens
ccagaauuuugugaacaguugu

SEQ ID NO: 20616 - RNA, 22 nt, Homo sapiens
uccccaggaauuuccugggcug

SEQ ID NO: 20617 - RNA, 22 nt, Homo sapiens
augccuggggaagacuguuggg

SEQ ID NO: 20618 - RNA, 22 nt, Homo sapiens
acuuaggacagcugguuuacca

SEQ ID NO: 20619 - RNA, 22 nt, Homo sapiens
gugagccagcuuccuugacacu

SEQ ID NO: 20620 - RNA, 22 nt, Homo sapiens
uuucaggggaaagacuggguuu

SEQ ID NO: 20621 - RNA, 22 nt, Homo sapiens
cuuacucauuuucucugggggu

SEQ ID NO: 20622 - RNA, 22 nt, Homo sapiens
gguagggcacgggacuaaggga

SEQ ID NO: 20623 - RNA, 20 nt, Homo sapiens
uccccgguccuggguucucu

SEQ ID NO: 20624 - RNA, 22 nt, Homo sapiens
ugaaaggcaaaggcagccacau

SEQ ID NO: 20625 - RNA, 22 nt, Homo sapiens
uggcuuccuauugccuugagaa

SEQ ID NO: 20626 - RNA, 22 nt, Homo sapiens
ucuuccuucucagggcuuuguu

SEQ ID NO: 20627 - RNA, 22 nt, Homo sapiens
aacagcccugaaaggcuggagu

SEQ ID NO: 20628 - RNA, 22 nt, Homo sapiens
gauggaagaggccauauguggc

SEQ ID NO: 20629 - RNA, 20 nt, Homo sapiens
gcuacaaggcucuuucccuc

SEQ ID NO: 20630 - RNA, 22 nt, Homo sapiens
cuuuauaucauuaacauaaaug

SEQ ID NO: 20631 - RNA, 22 nt, Homo sapiens
uuauguacuuugauagaaagca

SEQ ID NO: 20632 - RNA, 22 nt, Homo sapiens
uggauggagaaaggcugccacu

SEQ ID NO: 20633 - RNA, 22 nt, Homo sapiens
uaaggggccucuuucucauucu

SEQ ID NO: 20634 - RNA, 22 nt, Homo sapiens
uguuuggcauuaggggugggag

SEQ ID NO: 20635 - RNA, 22 nt, Homo sapiens
uucugcuccagaugccaggggu

SEQ ID NO: 20636 - RNA, 22 nt, Homo sapiens
gguggaugugcuggccucuaug

SEQ ID NO: 20637 - RNA, 19 nt, Homo sapiens
uaaagccggcccaucuucc

SEQ ID NO: 20638 - RNA, 22 nt, Homo sapiens
uauauauguguguguguguaua

SEQ ID NO: 20639 - RNA, 22 nt, Homo sapiens
uauagauuuaaauacguaugua

SEQ ID NO: 20640 - RNA, 22 nt, Homo sapiens
ugugccagucuugcuggcagcc

SEQ ID NO: 20641 - RNA, 21 nt, Homo sapiens
gaaacuuggugagucuggcca

SEQ ID NO: 20642 - RNA, 22 nt, Homo sapiens
agaagaagggugaauggcccag

SEQ ID NO: 20643 - RNA, 22 nt, Homo sapiens
cuugggugagucacccuccucu

SEQ ID NO: 20644 - RNA, 22 nt, Homo sapiens
ugaugaauuaacucagcuccaa

SEQ ID NO: 20645 - RNA, 22 nt, Homo sapiens
ugagagcugauuuaacucauuu

SEQ ID NO: 20646 - RNA, 22 nt, Homo sapiens
uuacuucccuccccauaaccca

SEQ ID NO: 20647 - RNA, 22 nt, Homo sapiens
gauauggggagaggagugaaca

SEQ ID NO: 20648 - RNA, 22 nt, Homo sapiens
ucuacuagugguugauggccuc

SEQ ID NO: 20649 - RNA, 22 nt, Homo sapiens
gguucaucaauaacucagagaa

SEQ ID NO: 20650 - RNA, 22 nt, Homo sapiens
uuggccacugggguguugaguu

SEQ ID NO: 20651 - RNA, 20 nt, Homo sapiens
aucucaacccccagccacuc

SEQ ID NO: 20652 - RNA, 22 nt, Homo sapiens
uuggccacugggguguugaguu

SEQ ID NO: 20653 - RNA, 20 nt, Homo sapiens
aucucaacccccagccacuc

SEQ ID NO: 20654 - RNA, 22 nt, Homo sapiens
ugcuggcugagggacacaggcu

SEQ ID NO: 20655 - RNA, 22 nt, Homo sapiens
gccaguggacccuggggcagcc

SEQ ID NO: 20656 - RNA, 22 nt, Homo sapiens
gcucuugauuugagagaagggc

SEQ ID NO: 20657 - RNA, 22 nt, Homo sapiens
ccucucuuuacuuaagggacug

SEQ ID NO: 20658 - RNA, 22 nt, Homo sapiens
acuugcucaaggucucacauag

SEQ ID NO: 20659 - RNA, 22 nt, Homo sapiens
uauuacaugaaaccuugagcaa

SEQ ID NO: 20660 - RNA, 22 nt, Homo sapiens
uuguggcggccucugacaucac

SEQ ID NO: 20661 - RNA, 22 nt, Homo sapiens
augucacagggccccauugugg

SEQ ID NO: 20662 - RNA, 22 nt, Homo sapiens
ucuuuuggggaaguuugggauc

SEQ ID NO: 20663 - RNA, 22 nt, Homo sapiens
uccauagaaaucccugagaguc

SEQ ID NO: 20664 - RNA, 22 nt, Homo sapiens
gacuacugaagaagcaugcugu

SEQ ID NO: 20665 - RNA, 22 nt, Homo sapiens
gcacaugcuucucugguguccc

SEQ ID NO: 20666 - RNA, 22 nt, Homo sapiens
uagagguuucagaaaguuuugc

SEQ ID NO: 20667 - RNA, 22 nt, Homo sapiens
ugaagcccuuccaagaugacuu

SEQ ID NO: 20668 - RNA, 22 nt, Homo sapiens
ucacacaagauaggcuuuuggg

SEQ ID NO: 20669 - RNA, 21 nt, Homo sapiens
cuucuugccugucuuggugcu

SEQ ID NO: 20670 - RNA, 22 nt, Homo sapiens
uuaccccugacucuugcugugc

SEQ ID NO: 20671 - RNA, 22 nt, Homo sapiens
caguaggggccauugguaaagu

SEQ ID NO: 20672 - RNA, 22 nt, Homo sapiens
uggggaaauggguucucuugau

SEQ ID NO: 20673 - RNA, 22 nt, Homo sapiens
cagaagauuuccuuuaacuacc

SEQ ID NO: 20674 - RNA, 22 nt, Homo sapiens
ucagccucugugaauugaagag

SEQ ID NO: 20675 - RNA, 21 nt, Homo sapiens
uuuaugcacagggggagauuc

SEQ ID NO: 20676 - RNA, 22 nt, Homo sapiens
gcuagucagagacagaccuagg

SEQ ID NO: 20677 - RNA, 20 nt, Homo sapiens
ugggcucugucucuaacugc

SEQ ID NO: 20678 - RNA, 22 nt, Homo sapiens
agagcuaguagguaguagaguu

SEQ ID NO: 20679 - RNA, 22 nt, Homo sapiens
gguuuuucugucuaccuguaaa

SEQ ID NO: 20680 - RNA, 22 nt, Homo sapiens
gccacgugcugcgaagugcccu

SEQ ID NO: 20681 - RNA, 22 nt, Homo sapiens
ggauauacuucaugggccugug

SEQ ID NO: 20682 - RNA, 22 nt, Homo sapiens
uauguuuuauuuuuguuuauga

SEQ ID NO: 20683 - RNA, 22 nt, Homo sapiens
uagaggaaaaugaaacuagcau

SEQ ID NO: 20684 - RNA, 22 nt, Homo sapiens
uucacaaaacucauagagugcu

SEQ ID NO: 20685 - RNA, 22 nt, Homo sapiens
cacucugugaguguggugaaua

SEQ ID NO: 20686 - RNA, 22 nt, Homo sapiens
ugugacaguuaaggcaaaugug

SEQ ID NO: 20687 - RNA, 22 nt, Homo sapiens
guuuuugccuuaucagucagag

SEQ ID NO: 20688 - RNA, 22 nt, Homo sapiens
uaaaacacugacaaaucuguua

SEQ ID NO: 20689 - RNA, 22 nt, Homo sapiens
uggauuuagucggcuuuuagug

SEQ ID NO: 20690 - RNA, 22 nt, Homo sapiens
uguuggccaggcucugggggca

SEQ ID NO: 20691 - RNA, 22 nt, Homo sapiens
ccacaguuggccugugcugacc

SEQ ID NO: 20692 - RNA, 22 nt, Homo sapiens
ugaguaccgccaugucuguugg

SEQ ID NO: 20693 - RNA, 21 nt, Homo sapiens
accaggcauuguggucuccgc

SEQ ID NO: 20694 - RNA, 22 nt, Homo sapiens
ggagguggaggggagcaggauu

SEQ ID NO: 20695 - RNA, 22 nt, Homo sapiens
uaagucccugucccugaccuug

SEQ ID NO: 20696 - RNA, 22 nt, Homo sapiens
cugguacuuuugugguaaucuc

SEQ ID NO: 20697 - RNA, 22 nt, Homo sapiens
agguugccauaguuaccaauca

SEQ ID NO: 20698 - RNA, 22 nt, Homo sapiens
uuggaucaggaugaaugguagc

SEQ ID NO: 20699 - RNA, 21 nt, Homo sapiens
ugccauuuuucuuggccccag

SEQ ID NO: 20700 - RNA, 22 nt, Homo sapiens
cacaacagaguuggagagaaag

SEQ ID NO: 20701 - RNA, 22 nt, Homo sapiens
uucucuccaaacucuguuguac

SEQ ID NO: 20702 - RNA, 22 nt, Homo sapiens
uuaagcucuggggaagaagccu

SEQ ID NO: 20703 - RNA, 22 nt, Homo sapiens
gggcuucacucacugcuuaaau

SEQ ID NO: 20704 - RNA, 22 nt, Homo sapiens
ugggggugccuuucagagucac

SEQ ID NO: 20705 - RNA, 22 nt, Homo sapiens
gcucugaaagguuccuccuuag

SEQ ID NO: 20706 - RNA, 22 nt, Homo sapiens
cccuggggccugauuugcagca

SEQ ID NO: 20707 - RNA, 22 nt, Homo sapiens
cugugugucagcccaagggccu

SEQ ID NO: 20708 - RNA, 22 nt, Homo sapiens
ggcucuuuuaguuguccauguc

SEQ ID NO: 20709 - RNA, 22 nt, Homo sapiens
gucagggacuagcuagagacug

SEQ ID NO: 20710 - RNA, 22 nt, Homo sapiens
gauuccuggaaauacuguucuu

SEQ ID NO: 20711 - RNA, 22 nt, Homo sapiens
uccaguuuucccaggaaucccu

SEQ ID NO: 20712 - RNA, 20 nt, Homo sapiens
auuccuggaaauacuguucu

SEQ ID NO: 20713 - RNA, 21 nt, Homo sapiens
auuccuggaaauacuguucuu

SEQ ID NO: 20714 - RNA, 23 nt, Homo sapiens
aaagugcauccuuuuagagguuu

SEQ ID NO: 20715 - RNA, 20 nt, Homo sapiens
cucuagagggaagcgcuuuc

SEQ ID NO: 20716 - RNA, 24 nt, Homo sapiens
cucuagagggaagcgcuuucuguu

SEQ ID NO: 20717 - RNA, 22 nt, Homo sapiens
ucacccuugauaauguucuucu

SEQ ID NO: 20718 - RNA, 22 nt, Homo sapiens
agaagcagcuuucaaggugauu

SEQ ID NO: 20719 - RNA, 22 nt, Homo sapiens
aggcacugugugugcacaaauc

SEQ ID NO: 20720 - RNA, 22 nt, Homo sapiens
gauuuguccacauacccucugc

SEQ ID NO: 20721 - RNA, 22 nt, Homo sapiens
uucccagcacugcuaagcaaag

SEQ ID NO: 20722 - RNA, 22 nt, Homo sapiens
ugcuuagcagugcuaggaagga

SEQ ID NO: 20723 - RNA, 22 nt, Homo sapiens
aaccaagccaagcucagccuua

SEQ ID NO: 20724 - RNA, 22 nt, Homo sapiens
ggguugagcuuauggcugguuc

SEQ ID NO: 20725 - RNA, 22 nt, Homo sapiens
uucugauugacacaggauggac

SEQ ID NO: 20726 - RNA, 22 nt, Homo sapiens
uccaucagugucaggaaggacc

SEQ ID NO: 20727 - RNA, 22 nt, Homo sapiens
uguccuguuguuguucauaaac

SEQ ID NO: 20728 - RNA, 22 nt, Homo sapiens
uuuaugucaucagcagaaaacc

SEQ ID NO: 20729 - RNA, 22 nt, Homo sapiens
uagugcuacagaacauuauucu

SEQ ID NO: 20730 - RNA, 22 nt, Homo sapiens
gauaaauuuuguggcacuuuua

SEQ ID NO: 20731 - RNA, 22 nt, Homo sapiens
uuggaaaggggguuugggacuc

SEQ ID NO: 20732 - RNA, 22 nt, Homo sapiens
ccucaccccagcuuuccaauuu

SEQ ID NO: 20733 - RNA, 22 nt, Homo sapiens
uauguauuuaugcacaucguga

SEQ ID NO: 20734 - RNA, 22 nt, Homo sapiens
aaugugaccaaaauacauacac

SEQ ID NO: 20735 - RNA, 22 nt, Homo sapiens
uaaaagcugagacaaugaaagc

SEQ ID NO: 20736 - RNA, 21 nt, Homo sapiens
cgcuuuuucucagcuuucggc

SEQ ID NO: 20737 - RNA, 22 nt, Homo sapiens
caggcaucccaauuaggauuau

SEQ ID NO: 20738 - RNA, 22 nt, Homo sapiens
auucuaauugggaugccuagcu

SEQ ID NO: 20739 - RNA, 22 nt, Homo sapiens
uuaaugauauacaugcuuaagu

SEQ ID NO: 20740 - RNA, 22 nt, Homo sapiens
ucagcaugcauaucauuaacua

SEQ ID NO: 20741 - RNA, 22 nt, Homo sapiens
uugccacuauggccuccucccu

SEQ ID NO: 20742 - RNA, 22 nt, Homo sapiens
ggaggaggacaagugagcaccu

SEQ ID NO: 20743 - RNA, 22 nt, Homo sapiens
ucacacucccagagcugaggcu

SEQ ID NO: 20744 - RNA, 22 nt, Homo sapiens
ucaguuaugggaguguggcugg

SEQ ID NO: 20745 - RNA, 22 nt, Homo sapiens
cagaaggccuuguaucccgugc

SEQ ID NO: 20746 - RNA, 22 nt, Homo sapiens
aggaaggcgaagggccuucugg

SEQ ID NO: 20747 - RNA, 22 nt, Homo sapiens
uucuggagggagauauaaacuc

SEQ ID NO: 20748 - RNA, 22 nt, Homo sapiens
uuauauuucccuucagaaguug

SEQ ID NO: 20749 - RNA, 22 nt, Homo sapiens
ucuuggccagggcacacuguuu

SEQ ID NO: 20750 - RNA, 21 nt, Homo sapiens
uuuaaugcccuggccagagcc

SEQ ID NO: 20751 - RNA, 22 nt, Homo sapiens
ucagcaggccuuagugauuaua

SEQ ID NO: 20752 - RNA, 22 nt, Homo sapiens
cuguaguuaaaggucuguuagc

SEQ ID NO: 20753 - RNA, 22 nt, Homo sapiens
ugccuccucuccuggucuaagc

SEQ ID NO: 20754 - RNA, 22 nt, Homo sapiens
aucuuggccagcagggggcggu

SEQ ID NO: 20755 - RNA, 22 nt, Homo sapiens
uccucccccaaccuccugccca

SEQ ID NO: 20756 - RNA, 22 nt, Homo sapiens
gcaagagggaugggggagagga

SEQ ID NO: 20757 - RNA, 22 nt, Homo sapiens
cacagccuuaguggaagcccug

SEQ ID NO: 20758 - RNA, 22 nt, Homo sapiens
gguuuccuggaaaguucugugg

SEQ ID NO: 20759 - RNA, 22 nt, Homo sapiens
ugaauguauuuccaagaaagca

SEQ ID NO: 20760 - RNA, 22 nt, Homo sapiens
ugugcuauuucuggaaauguuc

SEQ ID NO: 20761 - RNA, 22 nt, Homo sapiens
caggccccacuuaacuugaaag

SEQ ID NO: 20762 - RNA, 22 nt, Homo sapiens
ucaaguuaaauggggucuuucu

SEQ ID NO: 20763 - RNA, 22 nt, Homo sapiens
uucccuuucugaccccuccucc

SEQ ID NO: 20764 - RNA, 20 nt, Homo sapiens
gagggguggggugaggaugg

SEQ ID NO: 20765 - RNA, 23 nt, Homo sapiens
uaauacugccugguaaugaugac

SEQ ID NO: 20766 - RNA, 22 nt, Homo sapiens
uggccaucuuacugggcagcau

SEQ ID NO: 20767 - RNA, 22 nt, Homo sapiens
uacaggagcaggugggacccca

SEQ ID NO: 20768 - RNA, 22 nt, Homo sapiens
gggucccagccugcccugcugg

SEQ ID NO: 20769 - RNA, 22 nt, Homo sapiens
ucuacagugccuggucaccaac

SEQ ID NO: 20770 - RNA, 22 nt, Homo sapiens
guggugauggggcaucagccgc

SEQ ID NO: 20771 - RNA, 22 nt, Homo sapiens
cagggaaagaccagagacagcc

SEQ ID NO: 20772 - RNA, 22 nt, Homo sapiens
cugcucugguucuuuucugagg

SEQ ID NO: 20773 - RNA, 22 nt, Homo sapiens
ucguaaugaagcggcuucuuaa

SEQ ID NO: 20774 - RNA, 22 nt, Homo sapiens
uguuuagccagcuucauuaaca

SEQ ID NO: 20775 - RNA, 22 nt, Homo sapiens
uagacugggaaugacuugagga

SEQ ID NO: 20776 - RNA, 22 nt, Homo sapiens
ucauaguuauguucccaguacc

SEQ ID NO: 20777 - RNA, 22 nt, Homo sapiens
ugagucucagauguaaaggauu

SEQ ID NO: 20778 - RNA, 22 nt, Homo sapiens
gucgauacaucuugauucagug

SEQ ID NO: 20779 - RNA, 22 nt, Homo sapiens
ugccucuuccuccuguagcacu

SEQ ID NO: 20780 - RNA, 22 nt, Homo sapiens
ucuugcugggacggaggggcag

SEQ ID NO: 20781 - RNA, 22 nt, Homo sapiens
uuagaguucaggagaauaagau

SEQ ID NO: 20782 - RNA, 22 nt, Homo sapiens
ucguauuuuucugucucuuaaa

SEQ ID NO: 20783 - RNA, 22 nt, Homo sapiens
gauucuggggcuaacaggagga

SEQ ID NO: 20784 - RNA, 22 nt, Homo sapiens
ucuuggcagccucaguuucccc

SEQ ID NO: 20785 - RNA, 22 nt, Homo sapiens
uuuguggauacaaauauuuccu

SEQ ID NO: 20786 - RNA, 22 nt, Homo sapiens
ggguuuaauuuguaucccaaug

SEQ ID NO: 20787 - RNA, 22 nt, Homo sapiens
aguuaggcccaagaaccagggu

SEQ ID NO: 20788 - RNA, 22 nt, Homo sapiens
ucagggcuuugggccuggcuuu

SEQ ID NO: 20789 - RNA, 22 nt, Homo sapiens
uugccuguguucucuucucuuu

SEQ ID NO: 20790 - RNA, 22 nt, Homo sapiens
gccaagaagagggaacgcaggg

SEQ ID NO: 20791 - RNA, 22 nt, Homo sapiens
uggggagcuuugcuaguucagc

SEQ ID NO: 20792 - RNA, 22 nt, Homo sapiens
ugcaagcaacagagcuuccugg

SEQ ID NO: 20793 - RNA, 22 nt, Homo sapiens
uccaggacuggugguacccuuc

SEQ ID NO: 20794 - RNA, 22 nt, Homo sapiens
gggagacccaccguccuggacu

SEQ ID NO: 20795 - RNA, 22 nt, Homo sapiens
uggcccaggugcacccagaggc

SEQ ID NO: 20796 - RNA, 22 nt, Homo sapiens
ccuuuggguugugacuuggguu

SEQ ID NO: 20797 - RNA, 22 nt, Homo sapiens
ugcccggaggugagaugaauaa

SEQ ID NO: 20798 - RNA, 22 nt, Homo sapiens
ggcguuucuugucuuugggugg

SEQ ID NO: 20799 - RNA, 22 nt, Homo sapiens
ugguggggaagaagugggggca

SEQ ID NO: 20800 - RNA, 22 nt, Homo sapiens
ugucccuggcuucuccuucucc

SEQ ID NO: 20801 - RNA, 22 nt, Homo sapiens
cgagguuuuccuuuauauucua

SEQ ID NO: 20802 - RNA, 22 nt, Homo sapiens
gaaaguggaacggagcccuguc

SEQ ID NO: 20803 - RNA, 22 nt, Homo sapiens
agcggugggcgcgcaccugccu

SEQ ID NO: 20804 - RNA, 22 nt, Homo sapiens
gggcggggcgcggagcuugacc

SEQ ID NO: 20805 - RNA, 22 nt, Homo sapiens
ggcugaucugcauacauauuuu

SEQ ID NO: 20806 - RNA, 22 nt, Homo sapiens
aaugugaagugugagucagcug

SEQ ID NO: 20807 - RNA, 22 nt, Homo sapiens
ugcaagugagucauuuuacuug

SEQ ID NO: 20808 - RNA, 22 nt, Homo sapiens
auaugcaauuacuugcuugcau

SEQ ID NO: 20809 - RNA, 22 nt, Homo sapiens
uggaagggcuugggguggagca

SEQ ID NO: 20810 - RNA, 22 nt, Homo sapiens
ucugugccccaacaccuucugc

SEQ ID NO: 20811 - RNA, 22 nt, Homo sapiens
acugccugacaauugucacugu

SEQ ID NO: 20812 - RNA, 20 nt, Homo sapiens
cagggacaaugacagguggu

SEQ ID NO: 20813 - RNA, 22 nt, Homo sapiens
uuuggggaaguuugggaucugg

SEQ ID NO: 20814 - RNA, 21 nt, Homo sapiens
uaauccauagaaaucccugag

SEQ ID NO: 20815 - RNA, 22 nt, Homo sapiens
acuguugucuagaccaugccug

SEQ ID NO: 20816 - RNA, 20 nt, Homo sapiens
ggcagcgucuacacagaugu

SEQ ID NO: 20817 - RNA, 22 nt, Homo sapiens
ugaccuggugcucaauaagugc

SEQ ID NO: 20818 - RNA, 22 nt, Homo sapiens
acuuauugagcgccaacucugu

SEQ ID NO: 20819 - RNA, 22 nt, Homo sapiens
aguuuuccuuuauugaguacca

SEQ ID NO: 20820 - RNA, 22 nt, Homo sapiens
gacuuuaauaaaagggaaauga

SEQ ID NO: 20821 - RNA, 22 nt, Homo sapiens
ugacuccuucuccaggagcugu

SEQ ID NO: 20822 - RNA, 22 nt, Homo sapiens
gcucuuggcuuggagcuccugg

SEQ ID NO: 20823 - RNA, 22 nt, Homo sapiens
acucuuucccuguugcacuacu

SEQ ID NO: 20824 - RNA, 22 nt, Homo sapiens
cagugcaaugaugaaagggcau

SEQ ID NO: 20825 - RNA, 22 nt, Homo sapiens
uggugagaggguucuuuccccc

SEQ ID NO: 20826 - RNA, 22 nt, Homo sapiens
gacugauuggagcgcucucgac

SEQ ID NO: 20827 - RNA, 22 nt, Homo sapiens
gaacauaguggacuuuggcaaa

SEQ ID NO: 20828 - RNA, 22 nt, Homo sapiens
uuugggggagaacuauguucau

SEQ ID NO: 20829 - RNA, 22 nt, Homo sapiens
uauaagaagugaagaagaguua

SEQ ID NO: 20830 - RNA, 22 nt, Homo sapiens
cuguuucuuugauuucuuguuu

SEQ ID NO: 20831 - RNA, 22 nt, Homo sapiens
ccugcuuccugucgucccuguc

SEQ ID NO: 20832 - RNA, 20 nt, Homo sapiens
gggagggaccagguaguggg

SEQ ID NO: 20833 - RNA, 22 nt, Homo sapiens
ccauaucauggcacugagggaa

SEQ ID NO: 20834 - RNA, 22 nt, Homo sapiens
uccccagugcugugaguggcau

SEQ ID NO: 20835 - RNA, 22 nt, Homo sapiens
ccugcgcuuccucuugcacuuc

SEQ ID NO: 20836 - RNA, 20 nt, Homo sapiens
gggggcgggaggaagauugg

SEQ ID NO: 20837 - RNA, 22 nt, Homo sapiens
gcuggacuacagcuguguguuu

SEQ ID NO: 20838 - RNA, 18 nt, Homo sapiens
caaauagcuguaguaugc

SEQ ID NO: 20839 - RNA, 22 nt, Homo sapiens
uggucuauuacucacaccuuau

SEQ ID NO: 20840 - RNA, 22 nt, Homo sapiens
ggugcaaggaugaguaggcugu

SEQ ID NO: 20841 - RNA, 22 nt, Homo sapiens
uuccuuguuuauguccuuggcc

SEQ ID NO: 20842 - RNA, 22 nt, Homo sapiens
gcuugggaggugaugaggagaa

SEQ ID NO: 20843 - RNA, 22 nt, Homo sapiens
ucacuuggcucaugucuugaua

SEQ ID NO: 20844 - RNA, 22 nt, Homo sapiens
uggggagggcugagccaaguac

SEQ ID NO: 20845 - RNA, 22 nt, Homo sapiens
caucuugagaugggaacuuauc

SEQ ID NO: 20846 - RNA, 22 nt, Homo sapiens
gcccagugucccaucacagugc

SEQ ID NO: 20847 - RNA, 22 nt, Homo sapiens
ugcuguuucacucacaucuuua

SEQ ID NO: 20848 - RNA, 22 nt, Homo sapiens
ugagggugugcagugugcggug

SEQ ID NO: 20849 - RNA, 22 nt, Homo sapiens
uggacaguauuuaguauucuau

SEQ ID NO: 20850 - RNA, 22 nt, Homo sapiens
uaauuuacugagugcuaccuaa

SEQ ID NO: 20851 - RNA, 22 nt, Homo sapiens
gcaggaagccagagcaggggag

SEQ ID NO: 20852 - RNA, 22 nt, Homo sapiens
uugaccucuuuggcuccuggcu

SEQ ID NO: 20853 - RNA, 22 nt, Homo sapiens
gccggggcuuccagucugcucu

SEQ ID NO: 20854 - RNA, 22 nt, Homo sapiens
ggcuggacuggacagcccaagg

SEQ ID NO: 20855 - RNA, 22 nt, Homo sapiens
uuugucauuuuguuucucggca

SEQ ID NO: 20856 - RNA, 21 nt, Homo sapiens
ugccuggaaaggacguggcgg

SEQ ID NO: 20857 - RNA, 22 nt, Homo sapiens
acaugugcacaacaugcagguu

SEQ ID NO: 20858 - RNA, 22 nt, Homo sapiens
auaugccauguuggugugcugc

SEQ ID NO: 20859 - RNA, 22 nt, Homo sapiens
auucuaucuguuuacucucuau

SEQ ID NO: 20860 - RNA, 22 nt, Homo sapiens
agaguaaauagacagaaggcag

SEQ ID NO: 20861 - RNA, 22 nt, Homo sapiens
uuugagguaagacugccaugug

SEQ ID NO: 20862 - RNA, 20 nt, Homo sapiens
aucugguggcuuccuuuugu

SEQ ID NO: 20863 - RNA, 22 nt, Homo sapiens
uuguaguuaccguguguaugug

SEQ ID NO: 20864 - RNA, 22 nt, Homo sapiens
acauauauaggaacagcacucc

SEQ ID NO: 20865 - RNA, 22 nt, Homo sapiens
gggcauuuguuggaaguagaag

SEQ ID NO: 20866 - RNA, 22 nt, Homo sapiens
ucuccuuggacaggugcccuug

SEQ ID NO: 20867 - RNA, 22 nt, Homo sapiens
uggaauuugggugcagccuccu

SEQ ID NO: 20868 - RNA, 22 nt, Homo sapiens
aggcugugccuacgugccuuuu

SEQ ID NO: 20869 - RNA, 22 nt, Homo sapiens
uugcuucuuaacuuuaucaaac

SEQ ID NO: 20870 - RNA, 22 nt, Homo sapiens
uuuggucaggguuauagcuuag

SEQ ID NO: 20871 - RNA, 23 nt, Homo sapiens
ucaagagcaauaacgaaaaaugu

SEQ ID NO: 20872 - RNA, 22 nt, Homo sapiens
uuuucauuauugcuccugaccu

SEQ ID NO: 20873 - RNA, 22 nt, Homo sapiens
acaaugcuugguaugaauguca

SEQ ID NO: 20874 - RNA, 22 nt, Homo sapiens
ugacacucauaccaggcauuga

SEQ ID NO: 20875 - RNA, 22 nt, Homo sapiens
agaggagcccuuucuucuuugu

SEQ ID NO: 20876 - RNA, 22 nt, Homo sapiens
aagggagaaaggcucucuccug

SEQ ID NO: 20877 - RNA, 22 nt, Homo sapiens
acggauguuugagcaugugcua

SEQ ID NO: 20878 - RNA, 20 nt, Homo sapiens
ucaaaugcucagacuccugu

SEQ ID NO: 20879 - RNA, 22 nt, Homo sapiens
ugaggagccagggaagcaggug

SEQ ID NO: 20880 - RNA, 22 nt, Homo sapiens
gccuccuuccugccgcucuucc

SEQ ID NO: 20881 - RNA, 22 nt, Homo sapiens
ugccugggcugaguccaagagc

SEQ ID NO: 20882 - RNA, 22 nt, Homo sapiens
ccuugaacugcuuggacaugag

SEQ ID NO: 20883 - RNA, 22 nt, Homo sapiens
ucccuuugcuguugaugaugug

SEQ ID NO: 20884 - RNA, 22 nt, Homo sapiens
ggacgucauuaaagcaguggac

SEQ ID NO: 20885 - RNA, 22 nt, Homo sapiens
uggccauuucaguucucuccuu

SEQ ID NO: 20886 - RNA, 22 nt, Homo sapiens
gaaagaggugacaugaacaacc

SEQ ID NO: 20887 - RNA, 22 nt, Homo sapiens
uggcugccuggggagcugucug

SEQ ID NO: 20888 - RNA, 22 nt, Homo sapiens
ggucccuccccugcagcuacug

SEQ ID NO: 20889 - RNA, 22 nt, Homo sapiens
agacuuuccagguccugggcua

SEQ ID NO: 20890 - RNA, 21 nt, Homo sapiens
gcuggaggcuuguaaagucgu

SEQ ID NO: 20891 - RNA, 22 nt, Homo sapiens
ugcacauguguaugcaugcaug

SEQ ID NO: 20892 - RNA, 22 nt, Homo sapiens
cauuuauguguguacauugcau

SEQ ID NO: 20893 - RNA, 22 nt, Homo sapiens
uggggcaagggguuugucugga

SEQ ID NO: 20894 - RNA, 21 nt, Homo sapiens
ugcacagaccccuggcucuga

SEQ ID NO: 20895 - RNA, 22 nt, Homo sapiens
cgucccagcgccgaccggagag

SEQ ID NO: 20896 - RNA, 22 nt, Homo sapiens
ugaguccgucggcgcggggcug

SEQ ID NO: 20897 - RNA, 22 nt, Homo sapiens
cccaccucccacuccaggcauc

SEQ ID NO: 20898 - RNA, 22 nt, Homo sapiens
ccgaguugggguggggguggcg

SEQ ID NO: 20899 - RNA, 22 nt, Homo sapiens
agcagagggggcgggggagugg

SEQ ID NO: 20900 - RNA, 22 nt, Homo sapiens
ugaccccaguuuccucugcccc

SEQ ID NO: 20901 - RNA, 22 nt, Homo sapiens
uuccaucuccguucucuuucua

SEQ ID NO: 20902 - RNA, 22 nt, Homo sapiens
uucucagaguuggagaugaaag

SEQ ID NO: 20903 - RNA, 22 nt, Homo sapiens
uagucagcucauaaauuauaag

SEQ ID NO: 20904 - RNA, 22 nt, Homo sapiens
uaaaauagauuuuaugggcuga

SEQ ID NO: 20905 - RNA, 22 nt, Homo sapiens
ucuuggcuguggggccucagcu

SEQ ID NO: 20906 - RNA, 22 nt, Homo sapiens
cagugcaggccucaggcuaggg

SEQ ID NO: 20907 - RNA, 22 nt, Homo sapiens
ggucaggagagggggcaggcac

SEQ ID NO: 20908 - RNA, 22 nt, Homo sapiens
ugacugcuuucacuccuggcug

SEQ ID NO: 20909 - RNA, 22 nt, Homo sapiens
uccacgcuuagguggagcgagg

SEQ ID NO: 20910 - RNA, 22 nt, Homo sapiens
uggcuuucuaggcuggacuuuc

SEQ ID NO: 20911 - RNA, 22 nt, Homo sapiens
agaugagccacugucauggaga

SEQ ID NO: 20912 - RNA, 22 nt, Homo sapiens
ugcccaugacaguccucauuuu

SEQ ID NO: 20913 - RNA, 22 nt, Homo sapiens
ugguuugcaagcugaaggagaa

SEQ ID NO: 20914 - RNA, 22 nt, Homo sapiens
ucccacagcuguugcagccaac

SEQ ID NO: 20915 - RNA, 22 nt, Homo sapiens
ugaccagcugggguuaauggcc

SEQ ID NO: 20916 - RNA, 22 nt, Homo sapiens
gcuaucaacucccccagcuggu

SEQ ID NO: 20917 - RNA, 22 nt, Homo sapiens
aggcccaggagcagcugaccuc

SEQ ID NO: 20918 - RNA, 20 nt, Homo sapiens
ucaggccugaccugggcugu

SEQ ID NO: 20919 - RNA, 22 nt, Homo sapiens
ucagugcaucacagaacuuugu

SEQ ID NO: 20920 - RNA, 22 nt, Homo sapiens
ugaaguucuguuauacacucag

SEQ ID NO: 20921 - RNA, 22 nt, Homo sapiens
uacauggaccaggcauagugag

SEQ ID NO: 20922 - RNA, 20 nt, Homo sapiens
ucaugcauuugauccaugga

SEQ ID NO: 20923 - RNA, 23 nt, Homo sapiens
aggcaguguaguuagcugauugc

SEQ ID NO: 20924 - RNA, 20 nt, Homo sapiens
aucacuaaccacacggccag

SEQ ID NO: 20925 - RNA, 22 nt, Homo sapiens
augggagcugagcuugucccag

SEQ ID NO: 20926 - RNA, 20 nt, Homo sapiens
ggacgagcauaucugccagg

SEQ ID NO: 20927 - RNA, 22 nt, Homo sapiens
auggugcccacucacaaguugg

SEQ ID NO: 20928 - RNA, 20 nt, Homo sapiens
cuuaguguguaggugccagg

SEQ ID NO: 20929 - RNA, 22 nt, Homo sapiens
acgagggacagaggggggggcg

SEQ ID NO: 20930 - RNA, 21 nt, Homo sapiens
ucugccccccgcucgccccgc

SEQ ID NO: 20931 - RNA, 22 nt, Homo sapiens
gggaagagaaauggggcagcag

SEQ ID NO: 20932 - RNA, 22 nt, Homo sapiens
uucucucuuguuuucuccuccc

SEQ ID NO: 20933 - RNA, 22 nt, Homo sapiens
acugggccaagagcgggggcac

SEQ ID NO: 20934 - RNA, 20 nt, Homo sapiens
uuucgccuuugggucagggc

SEQ ID NO: 20935 - RNA, 22 nt, Homo sapiens
ggcuuccuggagcagguguggg

SEQ ID NO: 20936 - RNA, 22 nt, Homo sapiens
ugcaccagcuucggggugcacc

SEQ ID NO: 20937 - RNA, 22 nt, Homo sapiens
accagcuuguuggccauguuac

SEQ ID NO: 20938 - RNA, 21 nt, Homo sapiens
ugaaugccaauuagccgggcu

SEQ ID NO: 20939 - RNA, 22 nt, Homo sapiens
aaugugacaaugggcuauuauu

SEQ ID NO: 20940 - RNA, 22 nt, Homo sapiens
uaauagcauguugucacaucuc

SEQ ID NO: 20941 - RNA, 22 nt, Homo sapiens
ucuccuuggucucguuccaggc

SEQ ID NO: 20942 - RNA, 21 nt, Homo sapiens
cucagggucugaggagaccgu

SEQ ID NO: 20943 - RNA, 22 nt, Homo sapiens
acugggagggggccagagaccc

SEQ ID NO: 20944 - RNA, 22 nt, Homo sapiens
uccuggcccccaacccagcagc

SEQ ID NO: 20945 - RNA, 22 nt, Homo sapiens
acacuacccccaggaaguguca

SEQ ID NO: 20946 - RNA, 22 nt, Homo sapiens
augcccuuggaggguagugggu

SEQ ID NO: 20947 - RNA, 22 nt, Homo sapiens
agcuuacaaucuagcugggggu

SEQ ID NO: 20948 - RNA, 22 nt, Homo sapiens
acacaacuagacugugagcuuc

SEQ ID NO: 20949 - RNA, 22 nt, Homo sapiens
uaaugccccuaaaaauccuuau

SEQ ID NO: 20950 - RNA, 22 nt, Homo sapiens
ugagggacuuuugggggcagau

SEQ ID NO: 20951 - RNA, 22 nt, Homo sapiens
auaaugccccuaaaaauccuua

SEQ ID NO: 20952 - RNA, 20 nt, Homo sapiens
uaaugccccuaaaaauccuu

SEQ ID NO: 20953 - RNA, 19 nt, Homo sapiens
ugccccuaaaaauccuuau

SEQ ID NO: 20954 - RNA, 22 nt, Homo sapiens
aaaggcuuugcugggcuuuguu

SEQ ID NO: 20955 - RNA, 20 nt, Homo sapiens
auuaggccuggcggucugag

SEQ ID NO: 20956 - RNA, 22 nt, Homo sapiens
aaguuuaccugcauggucuggc

SEQ ID NO: 20957 - RNA, 22 nt, Homo sapiens
uguggccauguggggaaacagg

SEQ ID NO: 20958 - RNA, 22 nt, Homo sapiens
caggcuguuggcuccaggguuc

SEQ ID NO: 20959 - RNA, 22 nt, Homo sapiens
gcucuggagucugcugucuugg

SEQ ID NO: 20960 - RNA, 22 nt, Homo sapiens
uacguccucuuccacagcucug

SEQ ID NO: 20961 - RNA, 22 nt, Homo sapiens
agcugugguggaguugaugagg

SEQ ID NO: 20962 - RNA, 22 nt, Homo sapiens
ggccccuggauucuuagaacuc

SEQ ID NO: 20963 - RNA, 22 nt, Homo sapiens
agggucugggagacagaugggg

SEQ ID NO: 20964 - RNA, 22 nt, Homo sapiens
uugucuccucuguguguguccu

SEQ ID NO: 20965 - RNA, 22 nt, Homo sapiens
gacauaaugcagagagggacac

SEQ ID NO: 20966 - RNA, 22 nt, Homo sapiens
uacaggucccagcaugcagugc

SEQ ID NO: 20967 - RNA, 22 nt, Homo sapiens
aaugcauacugggacuuguagu

SEQ ID NO: 20968 - RNA, 22 nt, Homo sapiens
aauuaaggaccaccuagggugg

SEQ ID NO: 20969 - RNA, 22 nt, Homo sapiens
ucugacccuaggaggucuacag

SEQ ID NO: 20970 - RNA, 22 nt, Homo sapiens
ucccugaguguauguggugaac

SEQ ID NO: 20971 - RNA, 22 nt, Homo sapiens
uuuccucauauucauucaggag

SEQ ID NO: 20972 - RNA, 22 nt, Homo sapiens
uaccugagacccgguccaggag

SEQ ID NO: 20973 - RNA, 22 nt, Homo sapiens
cuucugggcugggcuggggccu

SEQ ID NO: 20974 - RNA, 22 nt, Homo sapiens
ugacacuuuugccucuggugaa

SEQ ID NO: 20975 - RNA, 22 nt, Homo sapiens
uuugccacaggcaaaguuugcu

SEQ ID NO: 20976 - RNA, 22 nt, Homo sapiens
ccugacacccuucuuuccugug

SEQ ID NO: 20977 - RNA, 22 nt, Homo sapiens
aggaaaaggccagggugcgggg

SEQ ID NO: 20978 - RNA, 22 nt, Homo sapiens
gccuuuguacauaaugcagaac

SEQ ID NO: 20979 - RNA, 22 nt, Homo sapiens
ugguucuguauaauguaaggaa

SEQ ID NO: 20980 - RNA, 22 nt, Homo sapiens
uguucagaucccuuagguaccc

SEQ ID NO: 20981 - RNA, 22 nt, Homo sapiens
gauacacgaggggcaggagcaa

SEQ ID NO: 20982 - RNA, 22 nt, Homo sapiens
aggccagcccgcucuucucaug

SEQ ID NO: 20983 - RNA, 21 nt, Homo sapiens
ucugggggagccagggcuggg

SEQ ID NO: 20984 - RNA, 22 nt, Homo sapiens
gcccaugauugccuuguuuuag

SEQ ID NO: 20985 - RNA, 22 nt, Homo sapiens
uaaaacagaguaauaaugggaa

SEQ ID NO: 20986 - RNA, 22 nt, Homo sapiens
uuuagagagacagaccacuuca

SEQ ID NO: 20987 - RNA, 22 nt, Homo sapiens
gaauggugugcuuuuuacuggg

SEQ ID NO: 20988 - RNA, 22 nt, Homo sapiens
ucuucgcccguggggccccagu

SEQ ID NO: 20989 - RNA, 22 nt, Homo sapiens
ggucuggugggguuggagaggg

SEQ ID NO: 20990 - RNA, 22 nt, Homo sapiens
auggguuuucggaaaugaaagc

SEQ ID NO: 20991 - RNA, 20 nt, Homo sapiens
cacuuucaagggggccuggu

SEQ ID NO: 20992 - RNA, 22 nt, Homo sapiens
uagcugccaagggaacuaaaag

SEQ ID NO: 20993 - RNA, 22 nt, Homo sapiens
uuugguuuucucuuggcggaag

SEQ ID NO: 20994 - RNA, 22 nt, Homo sapiens
uuucccaucuaucuucuaccuu

SEQ ID NO: 20995 - RNA, 22 nt, Homo sapiens
ugguggggagaggggagggaau

SEQ ID NO: 20996 - RNA, 22 nt, Homo sapiens
cggcuggcugauggaugcaggc

SEQ ID NO: 20997 - RNA, 21 nt, Homo sapiens
uguaugacagcagccagcucu

SEQ ID NO: 20998 - RNA, 22 nt, Homo sapiens
uacagauuuaauuaacauuugc

SEQ ID NO: 20999 - RNA, 22 nt, Homo sapiens
aguguuaauuaaaccucuauuu

SEQ ID NO: 21000 - RNA, 22 nt, Homo sapiens
ccugaaugcuauuccuuggcga

SEQ ID NO: 21001 - RNA, 22 nt, Homo sapiens
gaguccggggaagccucucagg

SEQ ID NO: 21002 - RNA, 22 nt, Homo sapiens
ucugccuccacugccaccaugg

SEQ ID NO: 21003 - RNA, 20 nt, Homo sapiens
uuguggugaaagggggcaaa

SEQ ID NO: 21004 - RNA, 22 nt, Homo sapiens
ggugugggucaagcaaccaggu

SEQ ID NO: 21005 - RNA, 22 nt, Homo sapiens
uggaaagcuugaucugacgcuc

SEQ ID NO: 21006 - RNA, 22 nt, Homo sapiens
ucauuuggcuccagaccuuggc

SEQ ID NO: 21007 - RNA, 20 nt, Homo sapiens
caaggucggggcucaaguaa

SEQ ID NO: 21008 - RNA, 22 nt, Homo sapiens
cuucccagcggcagcgcugcac

SEQ ID NO: 21009 - RNA, 22 nt, Homo sapiens
cuggugccuugcugcaagggaa

SEQ ID NO: 21010 - RNA, 22 nt, Homo sapiens
gcaauauuguucccccagccug

SEQ ID NO: 21011 - RNA, 22 nt, Homo sapiens
gccugagagaacaaugaugcug

SEQ ID NO: 21012 - RNA, 22 nt, Homo sapiens
uugucggaacugcaucuuaucu

SEQ ID NO: 21013 - RNA, 22 nt, Homo sapiens
gugaggcaguucugggccugca

SEQ ID NO: 21014 - RNA, 22 nt, Homo sapiens
cgugccuacugagcugaaacac

SEQ ID NO: 21015 - RNA, 22 nt, Homo sapiens
uggcucaguucagcaggaacag

SEQ ID NO: 21016 - RNA, 22 nt, Homo sapiens
uccuuccugacacugauggaug

SEQ ID NO: 21017 - RNA, 21 nt, Homo sapiens
uccauccugugucaaucagaa

SEQ ID NO: 21018 - RNA, 22 nt, Homo sapiens
ugaagcuggaaggaguugauag

SEQ ID NO: 21019 - RNA, 22 nt, Homo sapiens
uauuaauccaagccagucauuc

SEQ ID NO: 21020 - RNA, 22 nt, Homo sapiens
cccucguugucccgggaauaaa

SEQ ID NO: 21021 - RNA, 20 nt, Homo sapiens
ucaucccgggauagaggucu

SEQ ID NO: 21022 - RNA, 22 nt, Homo sapiens
uuucuuugcuucccaucuucuc

SEQ ID NO: 21023 - RNA, 22 nt, Homo sapiens
aaaaaggguagcacaggaagcu

SEQ ID NO: 21024 - RNA, 22 nt, Homo sapiens
caugaucacaguaauguucuuu

SEQ ID NO: 21025 - RNA, 20 nt, Homo sapiens
aaagagcaucccuugguuag

SEQ ID NO: 21026 - RNA, 22 nt, Homo sapiens
agaccacagggguacuauuuua

SEQ ID NO: 21027 - RNA, 22 nt, Homo sapiens
aauaaugccccaauggacugga

SEQ ID NO: 21028 - RNA, 22 nt, Homo sapiens
ugggggucccgccaagccucac

SEQ ID NO: 21029 - RNA, 22 nt, Homo sapiens
guaugagcuugugggccuccag

SEQ ID NO: 21030 - RNA, 22 nt, Homo sapiens
caagaugcggguuaagggccag

SEQ ID NO: 21031 - RNA, 20 nt, Homo sapiens
cccuuaaacuagccaaucau

SEQ ID NO: 21032 - RNA, 22 nt, Homo sapiens
ucaaugucagaagagaauugga

SEQ ID NO: 21033 - RNA, 22 nt, Homo sapiens
uauaauucccucugacauugac

SEQ ID NO: 21034 - RNA, 22 nt, Homo sapiens
ccgggcggugcggggaugaggc

SEQ ID NO: 21035 - RNA, 22 nt, Homo sapiens
ucuugaugguucccgcaucccc

SEQ ID NO: 21036 - RNA, 22 nt, Homo sapiens
ccuuucuguguggaggccacgu

SEQ ID NO: 21037 - RNA, 22 nt, Homo sapiens
ugcaucugucauacagaaauug

SEQ ID NO: 21038 - RNA, 22 nt, Homo sapiens
uguguguauguguauauauuga

SEQ ID NO: 21039 - RNA, 22 nt, Homo sapiens
uauauauacaaacacauacuua

SEQ ID NO: 21040 - RNA, 22 nt, Homo sapiens
uggcugugauugggcccagggc

SEQ ID NO: 21041 - RNA, 22 nt, Homo sapiens
uagcugguuaaaucagagcucu

SEQ ID NO: 21042 - RNA, 22 nt, Homo sapiens
ugaugggcucgguugcaaggcu

SEQ ID NO: 21043 - RNA, 22 nt, Homo sapiens
cugaguuuugcaaagcccacac

SEQ ID NO: 21044 - RNA, 22 nt, Homo sapiens
uggagucuccugcuaccuaugc

SEQ ID NO: 21045 - RNA, 22 nt, Homo sapiens
guggguuggcugagggcucaug

SEQ ID NO: 21046 - RNA, 22 nt, Homo sapiens
ugcuuguuuuguggcuucagcu

SEQ ID NO: 21047 - RNA, 20 nt, Homo sapiens
caggaaggcuagaagcagga

SEQ ID NO: 21048 - RNA, 22 nt, Homo sapiens
ugcuuguuuuguggcuucagcu

SEQ ID NO: 21049 - RNA, 20 nt, Homo sapiens
caggaaggcuagaagcagga

SEQ ID NO: 21050 - RNA, 22 nt, Homo sapiens
uguccuccugaccccgaucagg

SEQ ID NO: 21051 - RNA, 20 nt, Homo sapiens
uggagugggauuuggaggaa

SEQ ID NO: 21052 - RNA, 22 nt, Homo sapiens
gagggcaaggacuggagucuca

SEQ ID NO: 21053 - RNA, 22 nt, Homo sapiens
uggacccagugcuugcuucuag

SEQ ID NO: 21054 - RNA, 22 nt, Homo sapiens
ugccuacugagcugaaacacag

SEQ ID NO: 21055 - RNA, 19 nt, Homo sapiens
uggcucaguucagcaggaa

SEQ ID NO: 21056 - RNA, 22 nt, Homo sapiens
gacgcccucugccccgcaggag

SEQ ID NO: 21057 - RNA, 22 nt, Homo sapiens
cugcggggccggggcgugccgg

SEQ ID NO: 21058 - RNA, 22 nt, Homo sapiens
gagugacagagugacauuuucu

SEQ ID NO: 21059 - RNA, 22 nt, Homo sapiens
uagaggauggcucuggucuucu

SEQ ID NO: 21060 - RNA, 22 nt, Homo sapiens
gucccaggcagcccuuggucuu

SEQ ID NO: 21061 - RNA, 20 nt, Homo sapiens
acugugggggagcaggagau

SEQ ID NO: 21062 - RNA, 22 nt, Homo sapiens
agggaggaggaggcucagggac

SEQ ID NO: 21063 - RNA, 22 nt, Homo sapiens
ucugggccucagucuccccuuc

SEQ ID NO: 21064 - RNA, 22 nt, Homo sapiens
ugauccgggucuggucugcagc

SEQ ID NO: 21065 - RNA, 22 nt, Homo sapiens
uguggagauggaaccuggguca

SEQ ID NO: 21066 - RNA, 22 nt, Homo sapiens
gauccugcccuaagauguuaua

SEQ ID NO: 21067 - RNA, 20 nt, Homo sapiens
auauuuuagggccaggagau

SEQ ID NO: 21068 - RNA, 22 nt, Homo sapiens
ucucugcccacaguuucauucc

SEQ ID NO: 21069 - RNA, 22 nt, Homo sapiens
augggggugggguggagcagaa

SEQ ID NO: 21070 - RNA, 22 nt, Homo sapiens
uggagaugaaaggcagcuuccu

SEQ ID NO: 21071 - RNA, 22 nt, Homo sapiens
uggugaagcuguuggucuccaa

SEQ ID NO: 21072 - RNA, 22 nt, Homo sapiens
ugcagggauggaggggaugggg

SEQ ID NO: 21073 - RNA, 20 nt, Homo sapiens
aucccguccgccccuuucag

SEQ ID NO: 21074 - RNA, 22 nt, Homo sapiens
ucauggcuucugucuuggaaac

SEQ ID NO: 21075 - RNA, 22 nt, Homo sapiens
uauuuaagacaggaaccaggag

SEQ ID NO: 21076 - RNA, 22 nt, Homo sapiens
uacuugucagcuucuuggauga

SEQ ID NO: 21077 - RNA, 22 nt, Homo sapiens
ugcuaacuagggaccuggcgag

SEQ ID NO: 21078 - RNA, 22 nt, Homo sapiens
ugguggugucuuccucuggccg

SEQ ID NO: 21079 - RNA, 18 nt, Homo sapiens
gagcagaaggcgccgccg

SEQ ID NO: 21080 - RNA, 22 nt, Homo sapiens
gggaccagcuccaggggaaggg

SEQ ID NO: 21081 - RNA, 22 nt, Homo sapiens
uucugccuguagaugguuccug

SEQ ID NO: 21082 - RNA, 22 nt, Homo sapiens
uucuuucagaugacuuugggaa

SEQ ID NO: 21083 - RNA, 22 nt, Homo sapiens
ucagucucaucaggaaagcaca

SEQ ID NO: 21084 - RNA, 22 nt, Homo sapiens
uuucagcccuugacauuccagg

SEQ ID NO: 21085 - RNA, 18 nt, Homo sapiens
ugucauuugggcugggcu

SEQ ID NO: 21086 - RNA, 22 nt, Homo sapiens
ugcuuuuucucuuuggggacaa

SEQ ID NO: 21087 - RNA, 20 nt, Homo sapiens
ccccuuggugaacaaggcua

SEQ ID NO: 21088 - RNA, 22 nt, Homo sapiens
ugucuccuugaaaguaacggca

SEQ ID NO: 21089 - RNA, 20 nt, Homo sapiens
cauuacuuucaaugggacuc

SEQ ID NO: 21090 - RNA, 22 nt, Homo sapiens
ucccaacuccccuucugccucc

SEQ ID NO: 21091 - RNA, 22 nt, Homo sapiens
caggggugagcgggagcugggg

SEQ ID NO: 21092 - RNA, 22 nt, Homo sapiens
uucccugccacucagcuccuga

SEQ ID NO: 21093 - RNA, 22 nt, Homo sapiens
ggagagggagguggcggggagc

SEQ ID NO: 21094 - RNA, 22 nt, Homo sapiens
uuggcccaggucccagagaguc

SEQ ID NO: 21095 - RNA, 18 nt, Homo sapiens
uggggcuugggcuggaug

SEQ ID NO: 21096 - RNA, 22 nt, Homo sapiens
ugggagguuuccuuuuggaucu

SEQ ID NO: 21097 - RNA, 20 nt, Homo sapiens
cagaaagaaggcuuccuuuc

SEQ ID NO: 21098 - RNA, 22 nt, Homo sapiens
uaacuggcacauauggaggugg

SEQ ID NO: 21099 - RNA, 22 nt, Homo sapiens
uuuucucaugugccagauuuuu

SEQ ID NO: 21100 - RNA, 22 nt, Homo sapiens
ucuacucggguggcgugucuug

SEQ ID NO: 21101 - RNA, 20 nt, Homo sapiens
agacaucuaucauagugaug

SEQ ID NO: 21102 - RNA, 22 nt, Homo sapiens
aaaagcugcucagauucuuuua

SEQ ID NO: 21103 - RNA, 22 nt, Homo sapiens
agagaaacugagcagcaccgca

SEQ ID NO: 21104 - RNA, 22 nt, Homo sapiens
uccgugauuggcucagccacuu

SEQ ID NO: 21105 - RNA, 22 nt, Homo sapiens
aaguggcugagacaccaauuuc

SEQ ID NO: 21106 - RNA, 22 nt, Homo sapiens
agagggaauggacuuagcugug

SEQ ID NO: 21107 - RNA, 22 nt, Homo sapiens
cuagcugccaccuucccuccuc

SEQ ID NO: 21108 - RNA, 22 nt, Homo sapiens
uggcuggguccugaaagcaugc

SEQ ID NO: 21109 - RNA, 22 nt, Homo sapiens
uaagcuaaucaggacuccaguc

SEQ ID NO: 21110 - RNA, 22 nt, Homo sapiens
uaccuaugcacaauagggugca

SEQ ID NO: 21111 - RNA, 22 nt, Homo sapiens
ugccccuguuguaauuagguau

SEQ ID NO: 21112 - RNA, 22 nt, Homo sapiens
ugaggugaggaggguuagccug

SEQ ID NO: 21113 - RNA, 22 nt, Homo sapiens
aagugaauccuccugauuucag

SEQ ID NO: 21114 - RNA, 22 nt, Homo sapiens
ucccugguguuaaaucaacacu

SEQ ID NO: 21115 - RNA, 22 nt, Homo sapiens
acugcugaguuuaacacuggga

SEQ ID NO: 21116 - RNA, 22 nt, Homo sapiens
ucagugcaucacagaacuuugu

SEQ ID NO: 21117 - RNA, 22 nt, Homo sapiens
ugaaguucuguuauacacucag

SEQ ID NO: 21118 - RNA, 22 nt, Homo sapiens
uuaaggugaaauugcuauguga

SEQ ID NO: 21119 - RNA, 22 nt, Homo sapiens
acguuuugugguuucgccucau

SEQ ID NO: 21120 - RNA, 22 nt, Homo sapiens
ugagccccuucucucucuccag

SEQ ID NO: 21121 - RNA, 22 nt, Homo sapiens
uagauggaguaggggcugggcu

SEQ ID NO: 21122 - RNA, 20 nt, Homo sapiens
uuuugcgauguguuccuaau

SEQ ID NO: 21123 - RNA, 22 nt, Homo sapiens
uuuugcgauguguuccuaauau

SEQ ID NO: 21124 - RNA, 64 nt, hsa
auagauagguuugugaaagucuaaauaaugguuguauagauauguauauaugguucacauaucu

SEQ ID NO: 21125 - RNA, 64 nt, hsa
cuuaagggauaguguugauagauaaauuagaauguauagauagguuugugaaagucuaaauaau

SEQ ID NO: 21126 - RNA, 64 nt, hsa
aaacauccuuacuuuuauuucacacaguuuuauauauagauagaagacuguacaauuugagccg

SEQ ID NO: 21127 - RNA, 64 nt, hsa
aaaguaucuauauauacauauguaaauauuuauauauagauauauguagcuuucuauauaugua

SEQ ID NO: 21128 - RNA, 64 nt, hsa
aggauauucuuuucuccacccuaguuuauuuauuuauagauaucuguuuacaaagucuguagua

SEQ ID NO: 21129 - RNA, 64 nt, hsa
uucauuauagaauugaaccaagaggcauuauacauauagauauauacauauguaaugugugcgu

SEQ ID NO: 21130 - RNA, 64 nt, hsa
acucuguuuauaauaucaaguauuuucuuaaagauauagauauuaaaccuugugcucaugcaac

SEQ ID NO: 21131 - RNA, 64 nt, hsa
gcauuugugguacuugugacuacguuuuuucaaauauagauagauuuaagcugcuaauuuuuuu

SEQ ID NO: 21132 - RNA, 64 nt, hsa
ucauuucuuaacugucacaucuauugaaaauggauauagauacagguuuuaaguauuuuaagua

SEQ ID NO: 21133 - RNA, 64 nt, hsa
cugucacaacauuuaggaauuaagacaguaacaguauagauaugggaucaaauaauuuagcaug

SEQ ID NO: 21134 - RNA, 64 nt, hsa
acaaggucaugcugaaauuuuauuuugcucuugcuauagauacuuagguaauguggauuuguuu

SEQ ID NO: 21135 - RNA, 64 nt, hsa
uagcaagguagucuacagaaccaugcucccacauuauagauaaagcugcuuaaacuuaaaaguc

SEQ ID NO: 21136 - RNA, 64 nt, hsa
gaaaaguacaguaauacaguaaacugaaagaguauauagauagcaauaaaauaacauaagugga

SEQ ID NO: 21137 - RNA, 64 nt, hsa
uaacuucauuagugucuuuggccuuuuuuguagguauagauauuuuuucuuuuuacacuaauaa

SEQ ID NO: 21138 - RNA, 64 nt, hsa
cugaugagagacugggaagggaaaagcauauauauauagauauauagagauauagauauauaua

SEQ ID NO: 21139 - RNA, 64 nt, hsa
aagggaaaagcauauauauauagauauauagagauauagauauauauacaggaaacaccgcauc

SEQ ID NO: 21140 - RNA, 64 nt, hsa
uagauaucuauggauauagaucuacaucuauagauauagauauacacacauauauauacucaca

SEQ ID NO: 21141 - RNA, 64 nt, hsa
guuagauagauaucuauggauauagaucuacaucuauagauauagauauacacacauauauaua

SEQ ID NO: 21142 - RNA, 64 nt, hsa
agugcugcucuuaaauccuaccuuccacucaacucccauacaacuuucuuuuguacauuuugau

SEQ ID NO: 21143 - RNA, 64 nt, hsa
acaugaaauggggaauaagugauuuuaaguacaucccauacauuuaaauaucuuugauaauugu

SEQ ID NO: 21144 - RNA, 64 nt, hsa
ggcucuuccaaggggccagcuggguccccggagucaguccuaggcuggaugggaggguggcccc

SEQ ID NO: 21145 - RNA, 64 nt, hsa
auucuauuuuuuuugguuggguucguuuuuaauucaguccuacaaaauggugguaagccccagu

SEQ ID NO: 21146 - RNA, 64 nt, hsa
cugccucauucccugacuuucucuaguuagaugucaguccuaaauagguuuuccucacuucagg

SEQ ID NO: 21147 - RNA, 64 nt, hsa
acccaccccugacauaccuacugucacccugccccaguccuaccccuuccucuccaugcaagug

SEQ ID NO: 21148 - RNA, 64 nt, hsa
ugacuagaugaguaaucugauugacuggcucccucaguccuauucuguagccuuuuuggauaaa

SEQ ID NO: 21149 - RNA, 64 nt, hsa
aagcucugaugcauuauaaggaggcuauucgaaucaguccuaccuuugcugaugccuacucuaa

SEQ ID NO: 21150 - RNA, 64 nt, hsa
guuggugucuuaacucuccugggaaaaggaggcuggcacacacugggaugccgcagccuggccg

SEQ ID NO: 21151 - RNA, 64 nt, hsa
uccugccucagccuccugaguagcugggauuacaggcacacaccaccacgcuugguuaauuuuu

SEQ ID NO: 21152 - RNA, 60 nt, hsa
gccccaagaagaagcugugaccugcccacuggcacacagcuggcacuggcacacaccugu

SEQ ID NO: 21153 - RNA, 64 nt, hsa
gcugugaccugcccacuggcacacagcuggcacuggcacacaccugucccaugcccacccugag

SEQ ID NO: 21154 - RNA, 64 nt, hsa
acaaaaaaaaaaaaaaaaaaaagccaggcaugguggcacacaccuguaaucccagcuacucggg

SEQ ID NO: 21155 - RNA, 64 nt, hsa
auacaaaaaaaaaaaaaaauuagcugggcaugguggcacacaccuguagucccagcuacuuggg

SEQ ID NO: 21156 - RNA, 64 nt, hsa
acgcacacacgcacaugcacagauaugccgccugggcacacagauaagcugcccaaaugcacgc

SEQ ID NO: 21157 - RNA, 64 nt, hsa
acacacgcacgcacacaugcagauaugcugccugggcacacacuuccggacacacaugcacaca

SEQ ID NO: 21158 - RNA, 64 nt, hsa
cacacaugcacacauacacgugcacacauacacaggcacacaugcaugcacacauacacaugca

SEQ ID NO: 21159 - RNA, 64 nt, hsa
cacaugcacacacacaugcacacauauaugcacaggcacacacauguacgcacacacacaugca

SEQ ID NO: 21160 - RNA, 64 nt, hsa
acuacuaaaaauacauaaauuauccuggugugguggcacacaccuguagucccagcugcucgag

SEQ ID NO: 21161 - RNA, 64 nt, hsa
uaaggaagucuagucauaaacuaucaaagagaaaggcacacagagagcuggaugcuauuuaggg

SEQ ID NO: 21162 - RNA, 64 nt, hsa
gcccuaacaggcacagagagcaggggcaacuccuggcacacaucaugggcuuuggaggcacaca

SEQ ID NO: 21163 - RNA, 64 nt, hsa
ggggcaacuccuggcacacaucaugggcuuuggaggcacacaagccuggauucgaaucugggcu

SEQ ID NO: 21164 - RNA, 64 nt, hsa
auggggagcugggccuuaccccugauguaggaggggcacacagcugggggugcagagcccaccu

SEQ ID NO: 21165 - RNA, 64 nt, hsa
ccggggagagaaccaguaugagaagugggggcagggcacacauucaucuuuguaggaaggucug

SEQ ID NO: 21166 - RNA, 64 nt, hsa
ccacucugugcccgccucugccgggagggagggaggcacacagguggagcugacccucgucuuu

SEQ ID NO: 21167 - RNA, 64 nt, hsa
gaauucuuggcuugugucgcauacugggugucacggcacacauuuacucugcauuguccccguc

SEQ ID NO: 21168 - RNA, 64 nt, hsa
gaaggggugauggcaugcggaguucuuuaucuucagugagaaugugccugcccgccugagagcc

SEQ ID NO: 21169 - RNA, 64 nt, hsa
cuucaggucauuuuaagguccacugcaggggguuagugagaaaggguauacuuugugguauguu

SEQ ID NO: 21170 - RNA, 64 nt, hsa
auuucagaagaggcagcuuguaggugauuguacaagugagaauuaaagagagaacagauauuua

SEQ ID NO: 21171 - RNA, 64 nt, hsa
gacuuccuacuuagaauguggcaguggcuuugugagugagaauccugaugaguuuuccaguggc

SEQ ID NO: 21172 - RNA, 64 nt, hsa
ccagauagacuaacaacccuuuagugcuccaagaagugagaauuuccgaaaaagaucugccggc

SEQ ID NO: 21173 - RNA, 64 nt, hsa
cucauucauucagcaaaucucuauugaguucuucagugagaaggagcaggcacugggccuggaa

SEQ ID NO: 21174 - RNA, 64 nt, hsa
ucgcacagaaggugauaaguuacuaucaaaugccagugagaaucuucuuauagaauaaccuggg

SEQ ID NO: 21175 - RNA, 64 nt, hsa
uaggcaaauaacaaucagcaaggaaaccuucaccagugagaagaacaaugaaugucaugaaccc

SEQ ID NO: 21176 - RNA, 64 nt, hsa
uuaaacucuuaaucgacuccugcaaaucuauaccagugagaaaucuuacaaauguauugaaugu

SEQ ID NO: 21177 - RNA, 64 nt, hsa
guuuacauaccuucucuguuguaucaguacuuugagugagaagacaguuuauuuaaaacuugag

SEQ ID NO: 21178 - RNA, 64 nt, hsa
augcgcuuuagacauauuucuuuaaaaugcaagcagugagaaauaagaccucucugaauuagua

SEQ ID NO: 21179 - RNA, 64 nt, hsa
augugugcacagaacaaagaccaggagaggacacagugagaaggcaguuaucugcaagcaaaga

SEQ ID NO: 21180 - RNA, 64 nt, hsa
agcaccuugaucuuugacuucuaaucuccagaauagugagaaauaaauuucuguuguuaagccg

SEQ ID NO: 21181 - RNA, 64 nt, hsa
aauugucagugaaauaaaugagauuuuggaauaaagugagaaugggagaagggauauguuguga

SEQ ID NO: 21182 - RNA, 64 nt, hsa
gaauuaauaauugugagcccauagacacaagggaagugagaaacagugcucuggugacaugaua

SEQ ID NO: 21183 - RNA, 64 nt, hsa
gauuugggaaaauuaaguaacaacgaccuagaaaagugagaacaaucucauuuaccaucaugua

SEQ ID NO: 21184 - RNA, 64 nt, hsa
cuuucuuaaugccacuggguuuuagucaggccacagugagaaggaacagcccuaacaggccucc

SEQ ID NO: 21185 - RNA, 64 nt, hsa
gagaaauaaaauccauucucacggcaggcaaaucagugagaaaaauguaaagaucuggaggauu

SEQ ID NO: 21186 - RNA, 64 nt, hsa
ccugcuuuucuaggaauugacuccaaugcagaauagugagaaaucaacaaaaagcaaaauaaga

SEQ ID NO: 21187 - RNA, 64 nt, hsa
agaaguuaaaauacccuuaaggagguucaagcagagugagaaguuaaaauacccuuaaggucuu

SEQ ID NO: 21188 - RNA, 64 nt, hsa
auccuugcgucccgaaggacggagguucaagcagagugagaaguuaaaauacccuuaaggaggu

SEQ ID NO: 21189 - RNA, 64 nt, hsa
uguuauucucaaauauaaugugugaccgugauauagugagaaagauucuaccaaccacuguuuc

SEQ ID NO: 21190 - RNA, 64 nt, hsa
uuaguuaaaauuggguauguucuuaauauucauuagugagaaucacaaaguauuuuguagaagg

SEQ ID NO: 21191 - RNA, 64 nt, hsa
acuugccuuggggauaaagugcucaauuggcauuagugagaagcccauccuaucccuugacaua

SEQ ID NO: 21192 - RNA, 64 nt, hsa
uuccccuugguucgauuccacgcaaggagccacaagugagaacuccacuguccuuagaagaaag

SEQ ID NO: 21193 - RNA, 64 nt, hsa
gggaacuaagggguaucucugcuacaggaaugggagugagaacauucacuuuuugaaggacaag

SEQ ID NO: 21194 - RNA, 64 nt, hsa
gccugcccucagcucucacacaugacuggagagaagugagaagacucccagaaucugccuuuua

SEQ ID NO: 21195 - RNA, 64 nt, hsa
ucaaggacugcgucaaaguccucaucacauucucgaaguagaucaaaguccagaucuaguucca

SEQ ID NO: 21196 - RNA, 64 nt, hsa
accuacgauagcuacuauagcaggagucggagucgaaguagaagccagagaagugacaguuacc

SEQ ID NO: 21197 - RNA, 64 nt, hsa
guugaaagaugggguuggguaaaguagauuaggugaaguagaacauaaaauugaauaguaccca

SEQ ID NO: 21198 - RNA, 64 nt, hsa
gcauuggaggugguuucuggccgugauuggaugugaaguagaagagguccucgaucaugguguu

SEQ ID NO: 21199 - RNA, 64 nt, hsa
uauauauauuuauauacauguauguauaugguauauuauacauuugguggcagaaaaagaagau

SEQ ID NO: 21200 - RNA, 64 nt, hsa
gaauaagaaaggcaaacauaggucugggcauuaaauuauacaaacugaaaauguguuacaagaa

SEQ ID NO: 21201 - RNA, 64 nt, hsa
aauuccgcugcgugguuagugaaugucuggcaugauuauacacguguauuggaaauaucuaguu

SEQ ID NO: 21202 - RNA, 64 nt, hsa
ccaaaguuuuggacccugucaguuuugcaacuacauuauacauuauuauaauauucuuuuuuuu

SEQ ID NO: 21203 - RNA, 64 nt, hsa
uuuauguguagcauauuuaaaaauauauauguauauuauacauacacaaguuugugugaaagau

SEQ ID NO: 21204 - RNA, 64 nt, hsa
gucuaaagcaccguaucuuggugcagaacagauaauuauacagagauggaaugggacaaccgca

SEQ ID NO: 21205 - RNA, 64 nt, hsa
aauuacagauccugauauauagaaguuauucaaaauuauacaguuuucaaaaaaucaagacaag

SEQ ID NO: 21206 - RNA, 64 nt, hsa
auaagcaauaacaucuguaugguaaaguaggcagauuauacauguguugcuuagugaaugauua

SEQ ID NO: 21207 - RNA, 64 nt, hsa
uuaauuuuuaagugaauuuaguuugaaaagcaugauuauacaggccucucaggcugagugcuac

SEQ ID NO: 21208 - RNA, 64 nt, hsa
aaauaauuuuuuugggaaacuacauuaucacaaaauuauacaaauuuuuuuacaaguauuuaca

SEQ ID NO: 21209 - RNA, 64 nt, hsa
uaacacagguuuuauuuugucuuuuugcugguagauuauacaagggacaacuuuagugaugagg

SEQ ID NO: 21210 - RNA, 64 nt, hsa
uggcuguguguuacuacuuacaagagucuugaaaauuauacagaacuuugccuucuuuuuuuaa

SEQ ID NO: 21211 - RNA, 64 nt, hsa
augugggaaagccuuuucucagugcucauuacuuauuauacauaugagaagucauacuggugag

SEQ ID NO: 21212 - RNA, 64 nt, hsa
gacugguagcauauaaaauaaaucuuaaaagcuaauuauacacaaugacaauaugaauguuuac

SEQ ID NO: 21213 - RNA, 64 nt, hsa
caguacaucuauauugauagagguucauguuuaaauuauacauauuuauuagcaucauauuguc

SEQ ID NO: 21214 - RNA, 64 nt, hsa
uauggguuuuguuuuuuacaugcaaacauuguaaauuauacagaagauaccacagauagcauuu

SEQ ID NO: 21215 - RNA, 64 nt, hsa
ugccuuucacagagcccuccauuccaaguuuaguuuuugucaaaauaugaaucauuuuauuuga

SEQ ID NO: 21216 - RNA, 64 nt, hsa
ugcagcaguaaaaaauuagugagaaaaagcaacuuuuugucacucuuaggaaauauuuugucuu

SEQ ID NO: 21217 - RNA, 64 nt, hsa
cugccuucacuaggauccacggauaugagaccauuuuugucauuuccugaagucacacuggcgu

SEQ ID NO: 21218 - RNA, 64 nt, hsa
ggacuguguauccucaaucauacuauacagcaguuuuugucaggggaacauaaaaauauccaag

SEQ ID NO: 21219 - RNA, 64 nt, hsa
cuuauacuaaguccagagacaugcaggugagcccuuuugucaggcugcaaaucaugacaugccg

SEQ ID NO: 21220 - RNA, 64 nt, hsa
uuuuuuuuuuuugacuaagaguguuugguugcuuuuuugucacaaguaacuuggaaaauagaag

SEQ ID NO: 21221 - RNA, 64 nt, hsa
gugcuggacuuggcacacgcucugaaaacugagauuuugucauugaacuggugacaggauguga

SEQ ID NO: 21222 - RNA, 64 nt, hsa
cgaguuagcugcucuugugauuuuucucaggcuguuuugucauuuuaaaauccagugguagaug

SEQ ID NO: 21223 - RNA, 64 nt, hsa
gagccuaacauucugaugaguccagaaaacuacguuuugucaguagcaauacacuaggaaguaa

SEQ ID NO: 21224 - RNA, 64 nt, hsa
uguacuugcauuauuuucuuuagccauaguaacuuuuugucacaauaacuaaguauucaauuau

SEQ ID NO: 21225 - RNA, 64 nt, hsa
auauuuauuauaauuauguaguacccucaaaucauuuugucaguuacaucaagaaagcagauuu

SEQ ID NO: 21226 - RNA, 64 nt, hsa
aacuguacauauuuaaaguacccaauaugauaaguuuugucauaugcauacagccaugaaauca

SEQ ID NO: 21227 - RNA, 64 nt, hsa
gaaaucacauaauaugaaccuuuuuuggucuagcuuuugucacuuagcauaguaauuuugugau

SEQ ID NO: 21228 - RNA, 64 nt, hsa
cuuugucaaacagcucuuugugccccuaucuuuguuuugucaaauguagaucaguuaauaaaca

SEQ ID NO: 21229 - RNA, 64 nt, hsa
cuaauagcugauuccucccaauuuaucuguuauguuuugucacuauucacauuuuagucuuuuc

SEQ ID NO: 21230 - RNA, 64 nt, hsa
gggcugguugguucugggcuaguuuuauuguuaauuuugucacagccuauuuaauuaaaagaac

SEQ ID NO: 21231 - RNA, 64 nt, hsa
ccucuucccaggaaggggacauugacacuugaauuuuugucaccuuuuuccucauuagaaggaa

SEQ ID NO: 21232 - RNA, 64 nt, hsa
acauagugggauuacaucauaaaccucccauaauuuuugucauucuguguuaaaucauuucagg

SEQ ID NO: 21233 - RNA, 64 nt, hsa
cagugccgguacauuuacuuaaaucuguuuuuauuuuugucauguagaauacuacuguggucau

SEQ ID NO: 21234 - RNA, 64 nt, hsa
ggucccccuugccuucacauaccugauguuuaaauuuugucacgguuagucuccaaacuucuca

SEQ ID NO: 21235 - RNA, 64 nt, hsa
guuccccuuugacuucacacacuugacguuuacauuuugucacaguuggucccccuugccuuca

SEQ ID NO: 21236 - RNA, 64 nt, hsa
uugcauacugaaaauccaauaaucagaaaaguaauuuugucacauuauuuauuaaaaauguucu

SEQ ID NO: 21237 - RNA, 64 nt, hsa
gaugcccucugacuaguagauuucuaugauccuuuuuugucauuuuaugaauaucauugauuuu

SEQ ID NO: 21238 - RNA, 64 nt, hsa
cugacagagaauucuuugagguccgcaguagugcuuuugucagcacagacugcuaaucuacauc

SEQ ID NO: 21239 - RNA, 64 nt, hsa
agugugaacaaggaaggucauguuuuuguggguauuuugucagacuuagagguuucauuucagg

SEQ ID NO: 21240 - RNA, 64 nt, hsa
caccguuagccccucuccucccggauggucauguuuuugucacauuagagaauaaacagccaca

SEQ ID NO: 21241 - RNA, 64 nt, hsa
uugguguguaauuuuuguacucuugguggcuaguuuuugucaaaucuuuuuuggaauauugcuu

SEQ ID NO: 21242 - RNA, 64 nt, hsa
aaaauguuuucacuguaggaaucacaaaauaaguuuuugucaaaauaacuguuguugaacguua

SEQ ID NO: 21243 - RNA, 64 nt, hsa
uauauguacagaagaaaaaaaguugaucauagcuuuuugucaaguagcauguuucccauucaca

SEQ ID NO: 21244 - RNA, 64 nt, hsa
uuuccuaagauuucugauuuacacugauauuuuuuuuugucauucuuaauugcaucacacaaua

SEQ ID NO: 21245 - RNA, 64 nt, hsa
uauaucuaccauuuagauucagcaguuguuaauguuuugucauuuguuuucucuauaccuauau

SEQ ID NO: 21246 - RNA, 64 nt, hsa
uuugguucugggugaagcaguuccugaaggaguguuuugucagaauauauuguuaggagaauag

SEQ ID NO: 21247 - RNA, 64 nt, hsa
aggcgugagccacugcgcccggccaaaaagaacauuuugucaaucugaacagagcacagaacau

SEQ ID NO: 21248 - RNA, 64 nt, hsa
ccaaccuggaguauaauauucagauauaaaacaguuuugucagucuuucuuagugccugugugg

SEQ ID NO: 21249 - RNA, 64 nt, hsa
uacccugcgauuuugccugugucugaagugguuguuuugucaugaauucuuaugcuuauaauau

SEQ ID NO: 21250 - RNA, 64 nt, hsa
cucuaaauauguuuugucauuuaauaacauacaguuuugucacuuuucaaguacuuucugacuc

SEQ ID NO: 21251 - RNA, 64 nt, hsa
agugagagauuuuuaaauaaagccucuaaauauguuuugucauuuaauaacauacaguuuuguc

SEQ ID NO: 21252 - RNA, 64 nt, hsa
uauuugcauauguauuuuguauuugcauauguauuuuugucauagcagcaaacagagugaaaug

SEQ ID NO: 21253 - RNA, 64 nt, hsa
aaucuaagaaaauuauguauuuuugucauauguauuuugucauauguauuuuguauuugcauau

SEQ ID NO: 21254 - RNA, 64 nt, hsa
uacuguaacuucuuaaucuaagaaaauuauguauuuuugucauauguauuuugucauauguauu

SEQ ID NO: 21255 - RNA, 64 nt, hsa
aagcuugagcucucaaagcaguuggcuggaauacuuuugucagaauacgguacauuucuauuac

SEQ ID NO: 21256 - RNA, 64 nt, hsa
ugauagcaauuaugaagauuguuuuaugacauucuuuugucaguuuggcuuucuaaaaaucucu

SEQ ID NO: 21257 - RNA, 64 nt, hsa
cuuuucuuuuuauacauguccuucagucucuuaauuuugucagguggagcuugaucuuaauuuu

SEQ ID NO: 21258 - RNA, 64 nt, hsa
auaaucacauuuaagacuugaacacaugcuacccuuuugucaucuucugacauaaguuuaccug

SEQ ID NO: 21259 - RNA, 55 nt, hsa
gugaccacagugaagucugagacccuuuugucacaguacagcucuugucuuuacc

SEQ ID NO: 21260 - RNA, 64 nt, hsa
gugcuguaaguugauguuuaaaauugagaaauacuuuugucauagguaauuuggaacauuuaca

SEQ ID NO: 21261 - RNA, 64 nt, hsa
gaaacuuacuuaaccauuguguccuucccaucuuuuuugucaucuuuguuuucuucaaaugccc

SEQ ID NO: 21262 - RNA, 64 nt, hsa
aguauucuuuauauucaguuccuauuuaagucauuuuugucauguccgccuaauugauguagua

SEQ ID NO: 21263 - RNA, 64 nt, hsa
uuuggguucaauagcauuuuaugauucuacaauauuuugucaccuagcuggaaguugcaauaaa

SEQ ID NO: 21264 - RNA, 64 nt, hsa
cuauauaagugauguaugaguugaguuauguaaauuuugucauuguaguguacauggagugauc

SEQ ID NO: 21265 - RNA, 64 nt, hsa
acuuucuguuuucggauuggagaagauguaccuuuuuugucaacucuuacuuuuaucagaugau

SEQ ID NO: 21266 - RNA, 64 nt, hsa
uuauuauauucuuuucaaagauucagagauuggcuuuugucauccacuauuguauguuuuguuu

SEQ ID NO: 21267 - RNA, 64 nt, hsa
uauauguuguaaauauuuguguguugugagaaauuuuugucauaagaaauuaaaagaacuuacc

SEQ ID NO: 21268 - RNA, 64 nt, hsa
uuugauuuauuugcuagauguuucccccuuggaguuuugucaguuucacacuguuugcuggccc

SEQ ID NO: 21269 - RNA, 64 nt, hsa
uuuucuuuuuguuaaaugugaugcacugaucaauuuuugucacagcauuuucauaccuucaugg

SEQ ID NO: 21270 - RNA, 64 nt, hsa
gagaugggugugggguggcaauagcauugugccauuuugucauagaauguaaaaauugguuaac

SEQ ID NO: 21271 - RNA, 64 nt, hsa
guuuuuuguccauuugacaucagucugugguuuauuuugucaucagauuacuuguggguauacc

SEQ ID NO: 21272 - RNA, 64 nt, hsa
gauuugggcuauuucuguaugauccaauaacuuauuuugucacagggcuuaauuugccauuuuu

SEQ ID NO: 21273 - RNA, 64 nt, hsa
ggccuuuuuuggauaccuuuaguaguuaacucucuuuugucaaacccucuuguauauaaccauc

SEQ ID NO: 21274 - RNA, 64 nt, hsa
uuaauuccauuucacaaucuguuuuguuuuuuuuuuuugucauugucugaccaaaauuccuucu

SEQ ID NO: 21275 - RNA, 64 nt, hsa
uuuuucauguuauuccuaaauccucuugucauacuuuugucauugaacaaugcucucccucucg

SEQ ID NO: 21276 - RNA, 64 nt, hsa
ucaccaggcaccugcagaagaggaaaaucacuguuuuugucaaggaugguuguguauguguuua

SEQ ID NO: 21277 - RNA, 64 nt, hsa
auauaacuuuauuuuuuaacucuauuacauuuuauuuugucauguacuaaaauuauuucuguau

SEQ ID NO: 21278 - RNA, 64 nt, hsa
uugcauuugugaguuauuggaugaucagacugaauuuugucaaguaucacauuguacaucuugc

SEQ ID NO: 21279 - RNA, 64 nt, hsa
acguaguuagaccaauagauuuauauagucagguuuuugucauguaauuuauuaacuaacuauu

SEQ ID NO: 21280 - RNA, 64 nt, hsa
gaauggcauauucguucucauuaguaaucagcuauuuugucacuuucuuguugacuccaucagu

SEQ ID NO: 21281 - RNA, 64 nt, hsa
aaaaauuauaauaaagccccaaaauuaagaauucuuuugucauuuugucacauuugcucuaugg

SEQ ID NO: 21282 - RNA, 64 nt, hsa
uaauaaagccccaaaauuaagaauucuuuugucauuuugucacauuugcucuauggggggaauu

SEQ ID NO: 21283 - RNA, 64 nt, hsa
ccuucucaauguuucuagcuagcuuugggggucauuuugucaucagagcauucugugcccaggg

SEQ ID NO: 21284 - RNA, 64 nt, hsa
gcucauaugguuggaguguuaagugaaccucugauuuugucaggguuuuucuacguguaggcgu

SEQ ID NO: 21285 - RNA, 64 nt, hsa
uugcuuuuuagcaaacauaagaaaccaugagucauuuugucauuuagaguauucugauaaaauc

SEQ ID NO: 21286 - RNA, 64 nt, hsa
aauccuguagaagucacuaauaaaggaguauuuuuuuugucagcuuaucaaucagacugaucua

SEQ ID NO: 21287 - RNA, 64 nt, hsa
gucaaguccaauuagcaaaacgugguaauaauuuuuuugucaguauuuucagauuacaugauaa

SEQ ID NO: 21288 - RNA, 64 nt, hsa
acuucccuuaacuuucauuaauaguguuuacaucuuuugucagcacagcaaacuuuuagaaagu

SEQ ID NO: 21289 - RNA, 64 nt, hsa
auuuuaaagcuaaacaauggagaaggguuugagaagaacccaacaaugugggagugcuacagca

SEQ ID NO: 21290 - RNA, 64 nt, hsa
ccagcagucuacaggcuggaagaaggcccucaccagaacccaacccuuggacuucagccuccag

SEQ ID NO: 21291 - RNA, 64 nt, hsa
acuuacuugccucacuggacucuuuauccuuagaagaacccaagaaauuauaaauaaauaucuc

SEQ ID NO: 21292 - RNA, 64 nt, hsa
uaggcucuuugucaucuuauaggaaaauauaugaagaacccaucauuuuaucgagagaaccuuc

SEQ ID NO: 21293 - RNA, 64 nt, hsa
uuacuuucaucuauguugguuucugucucguuccagaacccacagccuccacccguggcuggcg

SEQ ID NO: 21294 - RNA, 64 nt, hsa
gggcuugagaggagagcgcuggccaugccaggagagaacccacgcacaugcacaccacaacaca

SEQ ID NO: 21295 - RNA, 64 nt, hsa
cccggagcccagcccccugccccggcccugcuccagaacccagcccagaucggaggacaaguuc

SEQ ID NO: 21296 - RNA, 64 nt, hsa
aacccagcccagaucggaggacaaguuccucucuagaacccaauccaauuuggagccccagccc

SEQ ID NO: 21297 - RNA, 64 nt, hsa
aacccaauccaauuuggagccccagcccaacuccagaacccaacccuucucuagaauccagccc

SEQ ID NO: 21298 - RNA, 64 nt, hsa
cagcugcucaguucccagggcacauuucuggaucagaacccaugggaaacaggagguacuaagu

SEQ ID NO: 21299 - RNA, 64 nt, hsa
uuucaagucacaugucucucagaccccuggauucagaacccaaggccacaaaucauaggcauga

SEQ ID NO: 21300 - RNA, 64 nt, hsa
ucagucugcugugccuccagacugcagagcucucagaacccagaacagagacgaaaaggcuacc

SEQ ID NO: 21301 - RNA, 64 nt, hsa
cuuccuuguccucuguucccacccuccccugaacagaacccagcccauaagagacauucucaga

SEQ ID NO: 21302 - RNA, 64 nt, hsa
agucuuuuuaaaaaaaacauccuauacuaagggcagaacccacugccccggccucaauuaccuu

SEQ ID NO: 21303 - RNA, 64 nt, hsa
ccuccucggaagcucgcugcccagagccauguccagaacccagccggccaucuccauggugcca

SEQ ID NO: 21304 - RNA, 64 nt, hsa
gacagucccaguccuaugguaaugacuuaggaggaaugcagauaaaaguaccuuguaagauaaa

SEQ ID NO: 21305 - RNA, 64 nt, hsa
aacguuggaaauagaugagaaauggaugcagaauaaugcagauagugaucccauguuuguuaau

SEQ ID NO: 21306 - RNA, 64 nt, hsa
caacauuucuuguacuuuguaagucguuugcgagaaugcagaccaccucacuaaacuguaaacg

SEQ ID NO: 21307 - RNA, 64 nt, hsa
aaguuaacuggaauugauuuacugaaugaaauuaaaugcagauaucccuguuuuugaaauaaga

SEQ ID NO: 21308 - RNA, 64 nt, hsa
gcaaauauuuguugacuaaaauuauagcauuuuuaaugcagaaaauuauaaagaauuuggagau

SEQ ID NO: 21309 - RNA, 64 nt, hsa
uugauagugccaaaaaaaaaaucucagaaaucuuaaugcagaaauuauauagucuccucagauu

SEQ ID NO: 21310 - RNA, 64 nt, hsa
auuaaaaucugcaaaugcacauuaaugcaaauuaaaugcagagagaaaugauuauuuuuuucuu

SEQ ID NO: 21311 - RNA, 64 nt, hsa
uuuugugcuucaguaacuugaaguuuaaauuuaaaaugcagagagaccaaugguuaaaauguga

SEQ ID NO: 21312 - RNA, 64 nt, hsa
acuucacaaaguuuguguggggauuaaaugagcuaaugcagauucauucauucagaaaaauuuu

SEQ ID NO: 21313 - RNA, 64 nt, hsa
cagcagcaucagcaucaccugggagauuguuaggaaugcagauucucaggccccccuaagaccc

SEQ ID NO: 21314 - RNA, 64 nt, hsa
uacaugcaaggcacucugcuaguuauauucuaauaaugcagagauaauuagacaugguucccgc

SEQ ID NO: 21315 - RNA, 64 nt, hsa
gcccucaagaagcucacaaaaguauucaggaaauaaugcagacuagugauuuugcuauaaaauu

SEQ ID NO: 21316 - RNA, 64 nt, hsa
aauccaaaaguauuuuccauugccgugcucuuugaaugcagacuucuauuuccagaagugacag

SEQ ID NO: 21317 - RNA, 64 nt, hsa
aaauaaaaagacggcuguauauaacauauuggguaaugcagaccaaauuaaguguuuugccuug

SEQ ID NO: 21318 - RNA, 64 nt, hsa
ucacagagacugccuccaccacaggcauccugcaaaugcagacuccagaauccccagcaucagc

SEQ ID NO: 21319 - RNA, 64 nt, hsa
cuggcuucuuucuucugaacaaaguaggguucaaaaugcagacugucauauccagcgagucccu

SEQ ID NO: 21320 - RNA, 64 nt, hsa
cuuucauuuaauugggcuuuaggcacuccauucgaaugcagaaccucaccucuaguugagacca

SEQ ID NO: 21321 - RNA, 64 nt, hsa
auguuugugucuucaacuuauuagaauggaagauaaugcagauauuucugugggaaauaaaaua

SEQ ID NO: 21322 - RNA, 64 nt, hsa
gggaggaggagggaagggaauuagaaaagucaacaaugcagaugacuucccuaaucucuucaga

SEQ ID NO: 21323 - RNA, 64 nt, hsa
cguugucauggucacaccugaagaccuuaaagccaaugcagaauacauuaagauggcagaucac

SEQ ID NO: 21324 - RNA, 64 nt, hsa
guaaaauguuuugccucaucgugugcuaggaaauaaugcagaaaaaacuuaugaaaacauucaa

SEQ ID NO: 21325 - RNA, 64 nt, hsa
ccuuaagauaucugcaaagaagaguaauuucaugaaugcagacuacaugguuguuuauuuagug

SEQ ID NO: 21326 - RNA, 64 nt, hsa
agcaaugagaaggccaggaaaagaaagagcugaaaaugcagaaagccgaagaguuagaacuuuu

SEQ ID NO: 21327 - RNA, 64 nt, hsa
cauuucuguagcugagcacagcaggggagggguuaaugcagauggcaagugcaccaaggagaag

SEQ ID NO: 21328 - RNA, 64 nt, hsa
cauuuguguagcugagcacagcaagggagggguuaaugcagauggcaagugcaccaaggagaag

SEQ ID NO: 21329 - RNA, 64 nt, hsa
gggauuacaggcgugagccaccgcgccuggccaaaaugcagacauuuuauuagggggauaagga

SEQ ID NO: 21330 - RNA, 64 nt, hsa
ccagggcagaaaugccgggcacaggccaggacaaaaugcagacuuuuuuuuuuuuuuuuuuuuu

SEQ ID NO: 21331 - RNA, 64 nt, hsa
ccgcaugucacuuagucuaacgcugacagaaaugaaugcagaaggaagauuuucaguccugaac

SEQ ID NO: 21332 - RNA, 64 nt, hsa
aaaaagaaaaaaaaaaagcuuauguuucuugucaaaugcagaaauguuccuuccgccacucacu

SEQ ID NO: 21333 - RNA, 64 nt, hsa
aaauaacauuuucuaauuuguauaaaugguacuaugguacuaauaaaaaccuaaauucuccaac

SEQ ID NO: 21334 - RNA, 64 nt, hsa
cagcuguuaaauaacauuuucuaauuuguauaaaugguacuaugguacuaauaaaaaccuaaau

SEQ ID NO: 21335 - RNA, 64 nt, hsa
augguaaugacuuaggaggaaugcagauaaaaguaccuuguaagauaaauauaaauuggaguua

SEQ ID NO: 21336 - RNA, 64 nt, hsa
agauuucuaagcuaauuauuuuaccguuuuguugaccuuguacacaagaaugagauuaaucugu

SEQ ID NO: 21337 - RNA, 64 nt, hsa
auaaaaugacaaacuuggaccacaggcuuucuugaccuuguacaguauaguaaaaauacccuuu

SEQ ID NO: 21338 - RNA, 64 nt, hsa
gaaacuaucuguaacauauuuugcacuuugagaaaccuuguauauuaaauuaccauauguuuuu

SEQ ID NO: 21339 - RNA, 64 nt, hsa
gaauguaagauuaacuuuauuuuggucugaacaaaccuuguaaaguuccauuguauuaacgugu

SEQ ID NO: 21340 - RNA, 64 nt, hsa
ucuuauuuaaaagggauacuuuuguaaaaguaaaaccuuguauaaagaacaaaauguuucuuaa

SEQ ID NO: 21341 - RNA, 64 nt, hsa
auuauuuauugaugugauuacuuauuuguuauccaccuuguacuaguaaguuuuagcacugaau

SEQ ID NO: 21342 - RNA, 64 nt, hsa
uuuuagcagagacaccucguuaagcuccgggaugaccuuguaggagaucugucucccugugccu

SEQ ID NO: 21343 - RNA, 64 nt, hsa
gacacccagguuaaaaagggguucccuuuuugguaccuuguaaccuuuuaagauaccuuggggc

SEQ ID NO: 21344 - RNA, 64 nt, hsa
gaugaguguggcaacaccuuuggucaaaauucauaccuuguaauucaaaaggcaauucguauug

SEQ ID NO: 21345 - RNA, 64 nt, hsa
aaugaguguggcaagaccuucagucagaugucaaaccuuguauaccaucauagacuucauagug

SEQ ID NO: 21346 - RNA, 64 nt, hsa
auucacaccuuguaauuaaaaggucaaaauucacaccuuguaauucauaguggagagaaaccuu

SEQ ID NO: 21347 - RNA, 64 nt, hsa
aaugaguguggcaagaccguuggucaaaauucacaccuuguaauuaaaaggucaaaauucacac

SEQ ID NO: 21348 - RNA, 64 nt, hsa
auaagaaauuaguucuuuccauggcaaagcuauuaccuuguacgaugcucuaaucauauugcau

SEQ ID NO: 21349 - RNA, 64 nt, hsa
aaucauauugcauuuaauuuuauuuugcacagugaccuuguagccacaugagaaagcacucugu

SEQ ID NO: 21350 - RNA, 64 nt, hsa
uugcaggaaaagugcaacuuaaagcaguaccuucauucaugaagcuacuuuuuaauuugaugua

SEQ ID NO: 21351 - RNA, 64 nt, hsa
acccaaaugaaaauuucaaagucaauaccagcagauucaugaaaguaaauuuaguccuauaauu

SEQ ID NO: 21352 - RNA, 64 nt, hsa
augugaauaaggcaaaagccagaaaauagcccuuauucaugaugcuguuacugagaauaaugaa

SEQ ID NO: 21353 - RNA, 64 nt, hsa
uauuuggacuucuucuccugacaauuguggcuuaauucaugacuuguuuuugaaugcaggcagu

SEQ ID NO: 21354 - RNA, 64 nt, hsa
gaagucacuuaucaccaaggggauggcccaggccauucaugagggauccaccuuugugcuccaa

SEQ ID NO: 21355 - RNA, 64 nt, hsa
ggaguagugguaaauauuccagaauccauaugaaauucaugaguuuauuuaugucuaaaacacu

SEQ ID NO: 21356 - RNA, 64 nt, hsa
auauaaauuugaccuaaaauauuuucucaaacuaauucaugaaacagcaacuuuuaccaauacc

SEQ ID NO: 21357 - RNA, 64 nt, hsa
ucauucuaagccucuggagagacuguaaugauccauucaugagcugguaugaaaucagugggaa

SEQ ID NO: 21358 - RNA, 64 nt, hsa
ugagucuaggcguuguggugaauaugcaggaaucauucaugagacagaauguauuuuguuguau

SEQ ID NO: 21359 - RNA, 64 nt, hsa
caaaaugcugacuacuguagaaaaaaaggucaugauucaugauugaaagcagaacaauggagau

SEQ ID NO: 21360 - RNA, 64 nt, hsa
guuugaggaagauuggguaaugcugauguguuccauucaugaaacuguauuugauacauaaucc

SEQ ID NO: 21361 - RNA, 64 nt, hsa
uauccauauuuuaaggaaggagcuaaaaauggaaauucaugaaacauaaaugguaucaagaacu

SEQ ID NO: 21362 - RNA, 64 nt, hsa
ugaucuuucuauaaccaugccauucacuuaaauaauucaugaagggaaugguuuaauuuaaagg

SEQ ID NO: 21363 - RNA, 64 nt, hsa
uuuuauaagaaaaacacauaaaccauuaucauuuauucaugagccaaagccauuaagaagauaa

SEQ ID NO: 21364 - RNA, 64 nt, hsa
cuuguucagguuugcaugguaugaaaccaaauagauucaugaaaccuuggccaugagguuuguu

SEQ ID NO: 21365 - RNA, 64 nt, hsa
acgaggggagcgagacgaaaggagaacggugauuauucaugacaggccugauaucacucauccu

SEQ ID NO: 21366 - RNA, 64 nt, hsa
ugggaaagccuucagaucugccucacaccuucaaauucaugaaaggacacaaacacacauaaga

SEQ ID NO: 21367 - RNA, 64 nt, hsa
ugggaaagccuucagaucugccaagaaccuucgaauucaugaaaggacacaaacacacguaaga

SEQ ID NO: 21368 - RNA, 64 nt, hsa
aucucuguugcacauguuuaauuggcaaaaagcaauucaugauaaauaaaauuacugcuuucca

SEQ ID NO: 21369 - RNA, 64 nt, hsa
gagaauuugagagaaauaguaauuugauuauuucauucaugaagcggagugguaguuauccuuc

SEQ ID NO: 21370 - RNA, 64 nt, hsa
acaaguaaguuacucuuuuccuuuaaucuguaagauucaugaaauucggggccagggaaacagu

SEQ ID NO: 21371 - RNA, 64 nt, hsa
ugggacaagggugucuccuucauuacuuaaagauauucaugagggugggucacuacagauguug

SEQ ID NO: 21372 - RNA, 64 nt, hsa
uccuccucugucucucauccuccuuucucccaucaaagcaaaauauggccucaccaccagcccc

SEQ ID NO: 21373 - RNA, 64 nt, hsa
uaaaaacaagaugacuuuuccuggcacauauuccaaagcaaagacuuuguugccugcugcuuau

SEQ ID NO: 21374 - RNA, 64 nt, hsa
uagaaaggcagaauuagacauagcaugcuuuggaaaagcaaauaggaauuguugggaaugauuu

SEQ ID NO: 21375 - RNA, 64 nt, hsa
gguugguuuaaaauuauuccuguaaaccaacaauaaagcaaagaagagguucauuuuuguaaau

SEQ ID NO: 21376 - RNA, 64 nt, hsa
uuuuuugaaguuauagauauguucuccuauuuuaaaagcaaaaauaacaauugacauuccuuga

SEQ ID NO: 21377 - RNA, 64 nt, hsa
cuaccuauccugaaucaagccuugagccuaaaucaaagcaaaccaauaccauugauaagaagaa

SEQ ID NO: 21378 - RNA, 64 nt, hsa
agaagauaaaauuauuccuagaaaagauuuaaguaaagcaaaaggacaaaugguaauauaaaga

SEQ ID NO: 21379 - RNA, 64 nt, hsa
auugcaguuucauuuaagaaaaguuuaaaauuaaaaagcaaauuucaaagaauauuauggccug

SEQ ID NO: 21380 - RNA, 64 nt, hsa
caggaaccagcggaucugcaaagaccuacaaucaaaagcaaauccccauuuuccuuuuauaaaa

SEQ ID NO: 21381 - RNA, 64 nt, hsa
ugcuuuuaaaaauaaucaugaagagaaggcuguuaaagcaaaaauuuuuuuuuuuuaauuuuuu

SEQ ID NO: 21382 - RNA, 64 nt, hsa
cgcuugcauccaugcccagccaauauacaacuguaaagcaaauauagaaagucggcuguugaua

SEQ ID NO: 21383 - RNA, 64 nt, hsa
gggugggggagaaaaaaucacuguuuguuuuuaaaaagcaaaucuuucuguaaacagaauaaaa

SEQ ID NO: 21384 - RNA, 64 nt, hsa
auaagugauaguuuauuguagugauguuuuuauaaaagcaaaaggauauucacuuucagcgcuu

SEQ ID NO: 21385 - RNA, 64 nt, hsa
gagcuggagaugcaagcucuaggcugcgcuuccaaaagcaaaugauaauuauguuaaugucauu

SEQ ID NO: 21386 - RNA, 64 nt, hsa
uuuuaagacaucuauuuuaugcuuuuguuuaaaaaaagcaaaucuauuuucaaauugugcaaug

SEQ ID NO: 21387 - RNA, 64 nt, hsa
accugccccgggagggcagcggggaagacagagaaaagcaaacgcauuccuccucagcuccacc

SEQ ID NO: 21388 - RNA, 64 nt, hsa
ccuugcaucuaaaggccuugugguuuaaaaaaaaaaagcaaacuuuuuuuuguacagcuauagu

SEQ ID NO: 21389 - RNA, 64 nt, hsa
gagggaagccucggggcugcggggugagaggaagaaagcaaacccggggagcaggcggcugccg

SEQ ID NO: 21390 - RNA, 64 nt, hsa
uugacagagugacccuugucuccaagaaaaaaaaaaagcaaaugggauuaaggacucauggaau

SEQ ID NO: 21391 - RNA, 64 nt, hsa
ccacaguaaagcagacuccccuuucagcaaccucaaagcaaaaaaaaaaaaaaaaaaaccaguu

SEQ ID NO: 21392 - RNA, 64 nt, hsa
caaaaaguacauagugaauuuuaaaauguagaagaaagcaaaaaauaaaauaaguccuaaagug

SEQ ID NO: 21393 - RNA, 64 nt, hsa
acacauuauagaaauuacuggagccaugucuacaaaagcaaagugaagugaugagcugaaaagu

SEQ ID NO: 21394 - RNA, 51 nt, hsa
caacaucaacaaauaaauaagaaagcaaaaagaucugggauauguguugga

SEQ ID NO: 21395 - RNA, 64 nt, hsa
auucucaucaucucuguuauacaccuguaucaugaaagcaaaaagaaguaaacaucaggaguca

SEQ ID NO: 21396 - RNA, 64 nt, hsa
ugagcuagaaauacuucuuauuuauacauuuaggaaagcaaauaaugccuacuacuccgacuuu

SEQ ID NO: 21397 - RNA, 64 nt, hsa
uaccugccauuuuuacuaauuuuugucuuuaaaaaaagcaaaaaagcacauugaccuaaguuga

SEQ ID NO: 21398 - RNA, 56 nt, hsa
acauggauaauagugaaugaaagcagaaagcaaaguaauaaaaucacaaauguuug

SEQ ID NO: 21399 - RNA, 64 nt, hsa
cuuacaugccagugagugaagaucgaugauaaauaaagcaaaugcaucauauguucacauuuga

SEQ ID NO: 21400 - RNA, 64 nt, hsa
guugccucauucagcucaaacagauuucauagccaaagcaaaaggacugguacgguagucugug

SEQ ID NO: 21401 - RNA, 64 nt, hsa
uguaaacacuaauguauuaaacuugcuauacauuaaagcaaauaauauauauuuuuauuugaau

SEQ ID NO: 21402 - RNA, 64 nt, hsa
ccuagaaacucaguucuuaccggcuugugguaaaaaagcaaauguguuaucuuuuuauuuuuua

SEQ ID NO: 21403 - RNA, 64 nt, hsa
agggauagcuuugcaaccacuauuguuuuaauggaaagcaaaaaacccccccaaacuuaucaga

SEQ ID NO: 21404 - RNA, 64 nt, hsa
aauguuuuaaagaugccagggguacugaaucugcaaagcaaaugagcagccaaggaccagcauc

SEQ ID NO: 21405 - RNA, 64 nt, hsa
ucaaguuagugguaggaaacauugcccggaauugaaagcaaauuuauuuuauuauccuauuuuc

SEQ ID NO: 21406 - RNA, 64 nt, hsa
ugaacgacaaagcaugguauuugaauuuuaaauuaaagcaaaguaaauaaaaguacaaagcaua

SEQ ID NO: 21407 - RNA, 64 nt, hsa
uaccaccaccaagaaagccuucaagaugucaaauaaagcaaagugauauauauuuguuuaugaa

SEQ ID NO: 21408 - RNA, 64 nt, hsa
caacgaauuuggggcuacgaagaggaauagcgaaaaagcaaaucuguuucaacugaugggaacc

SEQ ID NO: 21409 - RNA, 64 nt, hsa
auuuauaaaaacuaaaaugcauuccauuccucugaaagcaaaacaaauucauaauugagugaua

SEQ ID NO: 21410 - RNA, 64 nt, hsa
acucauuugugaucuacugaaaagagguuauauuaaagcaaauuaaaauauuuuccuucucugu

SEQ ID NO: 21411 - RNA, 64 nt, hsa
cagugguucuuacagaucaguuaauuaacuccagaaagcaaauguuagacuacacauuuauuuu

SEQ ID NO: 21412 - RNA, 64 nt, hsa
gcaaggaguaaauggccccagcagauggaaaacuaaagcaaauguaaucaccugcauuuugaaa

SEQ ID NO: 21413 - RNA, 64 nt, hsa
auacuccaaucacaguuaaauuaauuuagacagaaaagcaaauagcaauugacuugaaaauaag

SEQ ID NO: 21414 - RNA, 64 nt, hsa
uuugcauuuaugauuucuccagaaauuuaccacaaaagcaaaauuuuuaaaacugcauuuuuaa

SEQ ID NO: 21415 - RNA, 64 nt, hsa
aggauuuuuuaaaaauuggcauuuuaaguguuuaaaagcaaauacugauuuucaaaaaaauguu

SEQ ID NO: 21416 - RNA, 64 nt, hsa
aagggaguuacagaggcugcuuaaaagauggagaaaagcaaaacccaguauuuaaagucuauaa

SEQ ID NO: 21417 - RNA, 64 nt, hsa
aaugccuacuauuuuauaugcauauauuaaaagaaaagcaaagaccugagccgaggagaggaug

SEQ ID NO: 21418 - RNA, 64 nt, hsa
aaucuugaauggaguauaaguuuuccguuguuaaaaagcaaacaaaaaaccaacaaaaaaucca

SEQ ID NO: 21419 - RNA, 64 nt, hsa
aucaaaaauccaaaguaagauuguucugaaauacaaagcaaaauaaauaaucauuagaaucuuc

SEQ ID NO: 21420 - RNA, 64 nt, hsa
aaaucuuacauuuuugcaauaacaaacauuaaugaaagcaaaacauuauaaaaguaauuuuaau

SEQ ID NO: 21421 - RNA, 64 nt, hsa
uuaaagaugaucaugguucagaauaucuucagagaaagcaaaaucuuuaauauugcagggagcc

SEQ ID NO: 21422 - RNA, 64 nt, hsa
ugaagauuuagaaguuauauaaaaaauuaauuuaaaagcaaaccaaaagagguuuccauuaaca

SEQ ID NO: 21423 - RNA, 64 nt, hsa
guguuuugccaauuaauauuauaugcuuguaauaaaagcaaaagaaaagcuuaagugaaagugu

SEQ ID NO: 21424 - RNA, 64 nt, hsa
ccaagcaaaaaucaggcugagaaaaagcaaaagaaaagcaaaaaaaagaagaagaaacagcaga

SEQ ID NO: 21425 - RNA, 64 nt, hsa
agaaaaagaagccaagcaaaaaucaggcugagaaaaagcaaaagaaaagcaaaaaaaagaagaa

SEQ ID NO: 21426 - RNA, 64 nt, hsa
guagcaaagcucuuggagaaaaugaagacugaagaaagcaaagcaaaaacuguauagagagauu

SEQ ID NO: 21427 - RNA, 64 nt, hsa
aaagcucuuggagaaaaugaagacugaagaaagcaaagcaaaaacuguauagagagauuuuuca

SEQ ID NO: 21428 - RNA, 64 nt, hsa
uucuccugaaguucagccacccugaggccucuggaaagcaaagggcuccucuccagucugaucu

SEQ ID NO: 21429 - RNA, 64 nt, hsa
uuacccuccuagcuuuccauuugguuuagaacauaaagcaaauagacacagucauacugucacu

SEQ ID NO: 21430 - RNA, 64 nt, hsa
acacaacucugagaauacccacugccagcaucaaaaagcaaagauacuaauuuuuuaagccaaa

SEQ ID NO: 21431 - RNA, 64 nt, hsa
guaguaccaaaaagguauuuuccuuucucauuuaaaagcaaaaaccucccuuuuuaauugccug

SEQ ID NO: 21432 - RNA, 64 nt, hsa
gaccauaacuggcaaaauccuuaguguacggacaaaagcaaauuggaaaagccagccauuuacu

SEQ ID NO: 21433 - RNA, 64 nt, hsa
gugcagcagaggacagucuggagaagguauuagcaaagcaaaaggcugagaaggaacagggaac

SEQ ID NO: 21434 - RNA, 64 nt, hsa
aacagaguauguccgaugguaucuggguaagaagaaagcaaaagcaagggaccuucaugcccuu

SEQ ID NO: 21435 - RNA, 64 nt, hsa
gaagaaauauuuuaaggaaaccuauuugaaaaaaaaagcaaagaccauuugauaaaagccugag

SEQ ID NO: 21436 - RNA, 64 nt, hsa
aauaauagaaaaauucuacuuuaauuuccauuaaaaagcaaauagcauugacacauuuaaagcu

SEQ ID NO: 21437 - RNA, 64 nt, hsa
ggacuccagaaccauuaauaaaacaaaacaaaacaaagcaaaauauugaugaucaggcagauuu

SEQ ID NO: 21438 - RNA, 64 nt, hsa
aaaaaugaaauuucugaucucaccccauauuacuaaagcaaaauuuccagggguagggacuggg

SEQ ID NO: 21439 - RNA, 64 nt, hsa
uguaccuuucagcauccuaggaauuuuuauacuaaaagcaaaauguuuuuuccaguuagucuuc

SEQ ID NO: 21440 - RNA, 64 nt, hsa
gaacauugguuaagaacuguuggaaacaaaacuaaaagcaaacucaacauaugugauguuuaug

SEQ ID NO: 21441 - RNA, 64 nt, hsa
cgaagacucaucgcaguguguuauaugacaggacaaagcaaaaacaaacaaaaagcaagccugu

SEQ ID NO: 21442 - RNA, 64 nt, hsa
guuguuuucuguggguugcgacccaugcaaucaaaaagcaaaauuuugauugagauuuuuuaca

SEQ ID NO: 21443 - RNA, 64 nt, hsa
gaauaagaaaauaauguuuaaagaaaaaaaaaaaaaagcaaaccuccaaaacguggaccuaacc

SEQ ID NO: 21444 - RNA, 64 nt, hsa
uaugacuuggauauaugguugaagaaucaaaacaaaagcaaaaaaaaaaagcaaaaaaagaaaa

SEQ ID NO: 21445 - RNA, 64 nt, hsa
uaugguugaagaaucaaaacaaaagcaaaaaaaaaaagcaaaaaaagaaaagagaaaaaaagaa

SEQ ID NO: 21446 - RNA, 64 nt, hsa
ucagaacaauguaacauuuacaaaugacauauugaaagcaaaggcuguuuuauuuagccaagau

SEQ ID NO: 21447 - RNA, 64 nt, hsa
ugauuaccauuaggaguuacuuuauguauuguugaaagcaaauuuuaaacaugauguuuuagaa

SEQ ID NO: 21448 - RNA, 64 nt, hsa
uguguauauguauaaauuaauacagaguacguuaaaagcaaaaagauguauauuugcauauuuu

SEQ ID NO: 21449 - RNA, 64 nt, hsa
agaguuugccacuccccuaaacuccaggauuuauaaagcaaauuacuccaagguuuauaaagca

SEQ ID NO: 21450 - RNA, 64 nt, hsa
cagaugaacucugcuguuuagaaguaaccacagaaaagcaaagucaguguacacucugagugaa

SEQ ID NO: 21451 - RNA, 64 nt, hsa
uaacucauuuccuugagcuuauacaaaacauagaaaagcaaacuguuaaaguagucaauaauua

SEQ ID NO: 21452 - RNA, 64 nt, hsa
cugcagguggccuauuuugacucagacggugaaaaaagcaaauuaacucauuuggacaccauaa

SEQ ID NO: 21453 - RNA, 64 nt, hsa
agaaagguaagaguucaaguucaacccgugugugaaagcaaaacaauggaaaacaggauuggcu

SEQ ID NO: 21454 - RNA, 64 nt, hsa
uggaagauaaucuuccucuuuggaaaugaauggaaaagcaaaaggcccuauuacuuuuaaccac

SEQ ID NO: 21455 - RNA, 64 nt, hsa
uugacaaguuaguucauguuaggugcaucuuuauaaagcaaagauguuguauauccuaggccuc

SEQ ID NO: 21456 - RNA, 64 nt, hsa
uuuuggaacuuguuucaagccaaaaacucucaagaaagcaaauugcaccucagcuggauugauu

SEQ ID NO: 21457 - RNA, 64 nt, hsa
caaaaauuaugaaaagguauauuugcuucucgggaaagcaaagaagcugcuuuaaaaaauaaaa

SEQ ID NO: 21458 - RNA, 64 nt, hsa
acaacaccugggucaacucuuuuaauuuauauacaaagcaaagaacaacauuaauggagaugca

SEQ ID NO: 21459 - RNA, 64 nt, hsa
aagaauuagaaugacuugagaacgggcaaauaacaaagcaaaccaauauaauuauauggucauu

SEQ ID NO: 21460 - RNA, 64 nt, hsa
ccaccgcaauaauucgguaaggacaggauauucuaaagcaaauuaaaggagauuucuguacaca

SEQ ID NO: 21461 - RNA, 64 nt, hsa
uugccuagcaagaaucacauucguuucccagugaaaagcaaaccagaacaaaacaaaaagccac

SEQ ID NO: 21462 - RNA, 64 nt, hsa
cugauuauuuguauugaagaaaacaaauuuaccaaaagcaaaagcauaaaccccucccucuuuu

SEQ ID NO: 21463 - RNA, 64 nt, hsa
uuccuuuuaccuuucuccaccauccagagccacaaaagcaaaccuucuaccuccuaccuacuuu

SEQ ID NO: 21464 - RNA, 64 nt, hsa
gaaaucagaagaacaaaaaagaagagcaagagaaaaagcaaauuugguaaguugugugugcucc

SEQ ID NO: 21465 - RNA, 64 nt, hsa
uuacuuugaaguuuggcaaccuucauguuaccccaaagcaaaaccauugugucaggagucaaac

SEQ ID NO: 21466 - RNA, 64 nt, hsa
aaaccauugugucaggagucaaacaaauguuuagaaagcaaacaugacgucucuauuguacaac

SEQ ID NO: 21467 - RNA, 64 nt, hsa
ugaaacuagaaaucuguccuguggcaugcaaaagaaagcaaauuauuuuuaaaagaaaaaaacc

SEQ ID NO: 21468 - RNA, 64 nt, hsa
aagccagucaucaucucuugauaaaggagagguuaaagcaaaccagccucagcggaccacucuu

SEQ ID NO: 21469 - RNA, 64 nt, hsa
caucuuucccucacagaaagaaacgaaagaaagcaaagcaaagucagugaaagacaaucuuuau

SEQ ID NO: 21470 - RNA, 64 nt, hsa
aaagucaucuuucccucacagaaagaaacgaaagaaagcaaagcaaagucagugaaagacaauc

SEQ ID NO: 21471 - RNA, 64 nt, hsa
cagcaccuuggccgugauucccaaggucccagccaaagcaaagggccaguuguuucaguuuaaa

SEQ ID NO: 21472 - RNA, 64 nt, hsa
caagaaauguacucgggcgacaccuuaccuguggaaagcaaaucuuuucaaaauaagccacugg

SEQ ID NO: 21473 - RNA, 64 nt, hsa
cugagugacagagagagauucaaaaaacaaaaaaaaagcaaaaauauacuuugcuauuggguaa

SEQ ID NO: 21474 - RNA, 64 nt, hsa
gauuucuuguguaauaccugacaaacaggcaaccaaagcaaaaguggacaaaugggaucacauc

SEQ ID NO: 21475 - RNA, 64 nt, hsa
gguuucucgcauugccucucagacuaagcacuaaaaagcaaagcaaaacagaacuaguucuguc

SEQ ID NO: 21476 - RNA, 64 nt, hsa
cucgcauugccucucagacuaagcacuaaaaagcaaagcaaaacagaacuaguucugucuuaau

SEQ ID NO: 21477 - RNA, 64 nt, hsa
uccacaaguaguuugucacaggcauuccacugggaaagcaaaguacagugaagaaugaauuuau

SEQ ID NO: 21478 - RNA, 64 nt, hsa
uuguacacugcuagcacugcuagcacacaguagcaaagcaaacagcuacauuaucuuuaacaua

SEQ ID NO: 21479 - RNA, 64 nt, hsa
cguuuguguguccuuguaaauauguuuuaggaagaaagcaaaagggacugaacuagccucuggu

SEQ ID NO: 21480 - RNA, 64 nt, hsa
gcuguuuucccccacccauccaguucuccucagcaaagcaaauuccuuaacaccuuugguggag

SEQ ID NO: 21481 - RNA, 64 nt, hsa
aaacuaugcgaaagggugagucuguuuagaagaaaaagcaaagacugagguacugugaauggag

SEQ ID NO: 21482 - RNA, 64 nt, hsa
ucaauguggaccuuggugacaauccugcuuuguuaaagcaaaaacuaugcgaaagggugagucu

SEQ ID NO: 21483 - RNA, 64 nt, hsa
aggggccauaucauucauggccaaaaaaaaccaaaaagcaaaaaacaaaaacaagucccauguc

SEQ ID NO: 21484 - RNA, 64 nt, hsa
ugacuuagcuauuaguauauuuaaaaacuguucaaaagcaaaagagaaggaacaggaaugaaag

SEQ ID NO: 21485 - RNA, 64 nt, hsa
uaucugucucauucugccuuuuauacugucuaaaaaagcaaaguuuuaaagugcaauuuuaaaa

SEQ ID NO: 21486 - RNA, 64 nt, hsa
aacuuuauucuuuuuuucccccauacugguagauaaagcaaacuuuauaagugggcuauugaaa

SEQ ID NO: 21487 - RNA, 64 nt, hsa
guccccauacugaugaauuggagcauccauauggaaagcaaaggcagaauuaucccagcuguau

SEQ ID NO: 21488 - RNA, 64 nt, hsa
augaaagaaaacuguuuauauagaccccauuggaaaagcaaaacgcucucacugagaucaggga

SEQ ID NO: 21489 - RNA, 64 nt, hsa
gcuaagccuggaagccauccugcccuucugacccaaagcaaaacaucacauuccagucugaagu

SEQ ID NO: 21490 - RNA, 64 nt, hsa
auaggugaugggcagaucuuuucuuuaaaauaaaaaagcaaaaacucuugugguaccuagucag

SEQ ID NO: 21491 - RNA, 64 nt, hsa
agguugaagagguaaaaaauaaauaaauacauaaaaagcaaacaagcggggacaccugcagucu

SEQ ID NO: 21492 - RNA, 64 nt, hsa
guagaccuugcuugaguauuuuuucuaauaaaacaaagcaaaucacauuuagcuucaaauugua

SEQ ID NO: 21493 - RNA, 64 nt, hsa
uuuugcuuacuauugugucuaugauaugugauacaaagcaaauauuuucuaaauauucauugac

SEQ ID NO: 21494 - RNA, 64 nt, hsa
uugacuccaaugcagaauagugagaaaucaacaaaaagcaaaauaagacaauuccagacacucc

SEQ ID NO: 21495 - RNA, 64 nt, hsa
guuaagcuagaugaugacagugaugaugaugaagaaagcaaagaaggccaagaaaguucuagua

SEQ ID NO: 21496 - RNA, 64 nt, hsa
aacuuacccaggaggagcuagaagcaaagcaagcaaagcaaaagcuggaagaucgccucgcagc

SEQ ID NO: 21497 - RNA, 64 nt, hsa
uuagaaguuaaaccacccgauaggccuucgagcaaaagcaaagauccaccgagagaagaagaga

SEQ ID NO: 21498 - RNA, 64 nt, hsa
uucgucauccaaguccaggucuagaucacacucaaaagcaaagcauucucuucccagugccuau

SEQ ID NO: 21499 - RNA, 64 nt, hsa
ccaguagucagggcagcagggcugccucucaucuaaagcaaaacuaccuuccucacagaaaacg

SEQ ID NO: 21500 - RNA, 64 nt, hsa
auugacagugucuccuuacuuugaaguuuucaccaaagcaaaaagguccauauccaauaguauc

SEQ ID NO: 21501 - RNA, 64 nt, hsa
ucaguggcuuucuaacccccugccaggcuuugccaaagcaaaaagacagaggcuuuuuuuuuuu

SEQ ID NO: 21502 - RNA, 64 nt, hsa
gaugccaggauucugauucaucuuccucccaagaaaagcaaagccaaaucaagaccacagauag

SEQ ID NO: 21503 - RNA, 64 nt, hsa
gagauggcgccauugcacuccagccugggugacaaaagcaaaaguccaucuuaagaaauauaua

SEQ ID NO: 21504 - RNA, 64 nt, hsa
uuuauggguaguaccgggaugaacccaccaccacaaagcaaauuagacaacuuaaugugaaauc

SEQ ID NO: 21505 - RNA, 64 nt, hsa
uguucacugaauaaauaaguaaauacauuauugaaaagcaaaucuguauaaaugugaaauuuuu

SEQ ID NO: 21506 - RNA, 64 nt, hsa
gauccaacuauuucuuucaucagaaaaaguccgaaaagcaaaccuuaauuugaaauaacagccu

SEQ ID NO: 21507 - RNA, 64 nt, hsa
aggcaagaaaaggacaaauaucuuuuuuggaacuaaagcaaauuuuagaacuuuaccuauggaa

SEQ ID NO: 21508 - RNA, 64 nt, hsa
gcaggccuaagacaugugaggaggaaaaggaaaaaaagcaaaaagcaagggagaaaagagaaac

SEQ ID NO: 21509 - RNA, 64 nt, hsa
uaagauuuagcaacugguguuggagaaaaaaagaaaagcaaaugaguguuuucagguuuuuuug

SEQ ID NO: 21510 - RNA, 64 nt, hsa
ggauaaagcaaggaaauaauaauuacuccuccuuaaagcaaaugggggggugagaagucauuac

SEQ ID NO: 21511 - RNA, 64 nt, hsa
cuccaacucggaaguaagcccaagagaacaacauaaagcaaacaacauaaagcacaauaaaaau

SEQ ID NO: 21512 - RNA, 64 nt, hsa
aacuguaugacaaacuuugcaggacuucccuuauaaagcaaaauaauuguucagcuuccaauua

SEQ ID NO: 21513 - RNA, 64 nt, hsa
gguuaaaggcaguaacagguauaaaguacuuagaaaagcaaagggugcuacguacaugugaggc

SEQ ID NO: 21514 - RNA, 64 nt, hsa
cccauaaauccugaccaauccaacucugaauuuuaaagcaaaagcgucaaaaaaaagauucccu

SEQ ID NO: 21515 - RNA, 64 nt, hsa
aguuuuaugaaagaugguauaguuuuuauugacaaaagcaaaguaaucuuacaacuaugugcau

SEQ ID NO: 21516 - RNA, 64 nt, hsa
ugaagauaaggaagauacguuaccauugucaaagaaagcaaaauuugauucauaauaauggcaa

SEQ ID NO: 21517 - RNA, 64 nt, hsa
agccaaauuaucauuucauguuauccauuucuucaaagcaaaacaugaaaugguuuuagcuaga

SEQ ID NO: 21518 - RNA, 64 nt, hsa
auaacauguaggccaggcaggucacugcacaacuaaagcaaaccagcuggguacaguuucuugg

SEQ ID NO: 21519 - RNA, 64 nt, hsa
uuucugaaaaaacacuccauguuauauucuggggaaagcaaaaacaaaaaaaaaaaacaaaaaa

SEQ ID NO: 21520 - RNA, 64 nt, hsa
uuugaagaaaacguauaaaucuuucuuaaccgugaaagcaaaagccuuuggguuuauuuuggga

SEQ ID NO: 21521 - RNA, 64 nt, hsa
gucagacaaauaauaaaggucugcuguggcuaaaaaagcaaaaacaaaaaagcuauccagacaa

SEQ ID NO: 21522 - RNA, 64 nt, hsa
uuuucguagugacaguguggagaucuuuuuaaugaaagcaaacuauguggccucugcaaagaaa

SEQ ID NO: 21523 - RNA, 64 nt, hsa
agagaaaggguagaaaaaagggacauuaaaauuaaaagcaaaaccacaagaagggaaagaccgc

SEQ ID NO: 21524 - RNA, 64 nt, hsa
uuccaugagaagccgacuccccacaccgaguuuuaaagcaaagcccuuuucuucugcugcccac

SEQ ID NO: 21525 - RNA, 64 nt, hsa
accggacacaccucugcuccaaaggaaauccaaaaaagcaaacacaagaaaucaaaauccaaaa

SEQ ID NO: 21526 - RNA, 64 nt, hsa
ggcuuuaaguaaaaauccaaaaaguuuuuuuaaaaaagcaaaggaagcauacuugugaacuacc

SEQ ID NO: 21527 - RNA, 64 nt, hsa
uuuugcagcuugcugauauuuuauauaaaaaagaaaagcaaagcaaaagagaagcugauagucu

SEQ ID NO: 21528 - RNA, 64 nt, hsa
cagcuugcugauauuuuauauaaaaaagaaaagcaaagcaaaagagaagcugauagucuugaau

SEQ ID NO: 21529 - RNA, 64 nt, hsa
cccagcaggaaaaucauguaaguuauaccaccagaaagcaaaaggagcaugguuuggugguuaa

SEQ ID NO: 21530 - RNA, 64 nt, hsa
augacaagagcugccagccaaccacacuauucaaaaagcaaaguguucaccacuaaagcuaacc

SEQ ID NO: 21531 - RNA, 64 nt, hsa
cuuugaagacuuugaggccacagaaaagacaguuaaagcaaagaagagaagugacuuuuccugg

SEQ ID NO: 21532 - RNA, 64 nt, hsa
auauaggaaacacaaaaguuuauugcuguuugcuaaagcaaaauagcagaaaauuuuguauaug

SEQ ID NO: 21533 - RNA, 64 nt, hsa
acacccccaaaauaagacuuucauucacauucacaaagcaaacaucuaguacaugucuuucacu

SEQ ID NO: 21534 - RNA, 64 nt, hsa
ucuagccugggugaccgagggaggcucugucucaaaagcaaagcaaaaacaaaaacaaaaacac

SEQ ID NO: 21535 - RNA, 64 nt, hsa
ccugggugaccgagggaggcucugucucaaaagcaaagcaaaaacaaaaacaaaaacaccuaaa

SEQ ID NO: 21536 - RNA, 64 nt, hsa
gcacuuuuuaaaacaaacaaacaaacaaaacaaaaaagcaaaccacauuuguuaucucaaauuu

SEQ ID NO: 21537 - RNA, 64 nt, hsa
cugcugacucacacugcuaacucuguuacugacaaaagcaaaucaauaacucuaaauucugggc

SEQ ID NO: 21538 - RNA, 64 nt, hsa
auaaugggcuuuguuagcacuuucaaaaaaaaaaaaagcaaaccauacuuguccacuguccugu

SEQ ID NO: 21539 - RNA, 64 nt, hsa
gagauuuuuugaguugcaaaaaguuuauaaaugcaaagcaaaaagaaaacauuuauuuucugag

SEQ ID NO: 21540 - RNA, 64 nt, hsa
gaagggaagggcagaaggaaggagggaagaaaagaaagcaaaggaacagaaggaaggaaagaaa

SEQ ID NO: 21541 - RNA, 64 nt, hsa
augacgcccucuucccucuugaugaugucuuuucaaagcaaaugaagugccuuuucccgaggcu

SEQ ID NO: 21542 - RNA, 64 nt, hsa
cucuccuagguagcccccucuucccugguaagaaaaagcaaaaggcauuucccacccugaacaa

SEQ ID NO: 21543 - RNA, 64 nt, hsa
agagaguuagcugacuuuacacggagcggauugcaaagcaaaccaacaagaauaaaggcagcug

SEQ ID NO: 21544 - RNA, 64 nt, hsa
cagggcccuggagcugcuggggccaagccaaggccuccccuaccucaaaccccagcugggcccg

SEQ ID NO: 21545 - RNA, 55 nt, hsa
gcuuuggcacgcaagccugaggacccuccccuaccaaggaccaggaaaagcagca

SEQ ID NO: 21546 - RNA, 64 nt, hsa
ccaaacuucauuacuuuccuuaggcccucugccccuccccuagcauauggcucuuucuccuauu

SEQ ID NO: 21547 - RNA, 64 nt, hsa
acuuuaucauuucagcuacacauaaaagguuucucuccccuauggauuuugcuaaugguugagu

SEQ ID NO: 21548 - RNA, 64 nt, hsa
aagaggcccuacccgugucuaaacccuccucucacuccccuaagccuggugaaagagucagaag

SEQ ID NO: 21549 - RNA, 64 nt, hsa
aaacuucaucuucuuggugucucauguccucauucuccccuauaugacaugcaaaaacgaucuu

SEQ ID NO: 21550 - RNA, 64 nt, hsa
aggguuggguguccauggugcccugggcuguguccuccccuagggaugagggucgggccuccac

SEQ ID NO: 21551 - RNA, 64 nt, hsa
aggguuggauguccaagaugcccugggcuguguacuccccuaggaaugagggcuggguguccaa

SEQ ID NO: 21552 - RNA, 64 nt, hsa
uuuuugcacaaugaaguuucagcuucucaaccuucuccccuacccagggcuguggacccagacu

SEQ ID NO: 21553 - RNA, 64 nt, hsa
gaauagucugggaacauggucaagguggaaggggcuccccuagagaggguggggguguaguuac

SEQ ID NO: 21554 - RNA, 64 nt, hsa
ggaguccauccuguacaucucaagcaagggguuccuccccuagcaccugggcuuggcagaaggg

SEQ ID NO: 21555 - RNA, 64 nt, hsa
gggcuuggcagaagggccauaguucauccagcuccuccccuagagcaaugcugaggagcggggg

SEQ ID NO: 21556 - RNA, 64 nt, hsa
cccaagugggucaggccuggcccagguccuuauacuccccuaucuuguccuagcccaggccucc

SEQ ID NO: 21557 - RNA, 64 nt, hsa
gguggcauugccccagagcucuccagagaugagccuccccuauccccacccuguccccgucccc

SEQ ID NO: 21558 - RNA, 64 nt, hsa
gagcccccaggagcugggagaggcaggaaggauccuccccuagagccuccagggggaacuggag

SEQ ID NO: 21559 - RNA, 64 nt, hsa
gaguccccaggagcugggagaggcaggaaggacccuccccuagagucucuggagggaacuggau

SEQ ID NO: 21560 - RNA, 64 nt, hsa
gccaggaccaguugaucagaacugaucuuauuggucugauaaccaaucuuauuugugaacugau

SEQ ID NO: 21561 - RNA, 64 nt, hsa
acauguccauuguaaaugcaauguaaaugagaguucugauaaaauauuuuuguauuuuguaaua

SEQ ID NO: 21562 - RNA, 64 nt, hsa
aggaccacacgcaggccucccugccucagcugcaucugauaaaguugagagacaguaacacaau

SEQ ID NO: 21563 - RNA, 64 nt, hsa
auucaggcuuauaacaaauauuguauccuuuauuucugauaagacaugaaagguuggccuuacu

SEQ ID NO: 21564 - RNA, 64 nt, hsa
ggcuugauuaaggaauucuacuuucaaaaauuaaucugauaauaguaacaagguauauuauacu

SEQ ID NO: 21565 - RNA, 64 nt, hsa
uauccaauuuuuaaauauuuuaauauaucuccuaucugauaacuuaauucuucuaaauuaccac

SEQ ID NO: 21566 - RNA, 64 nt, hsa
acacacuagagaaaaaccuuacaaaugugaagcaucugauaaauccugugaagcgucugauaaa

SEQ ID NO: 21567 - RNA, 64 nt, hsa
caaaugugaagcaucugauaaauccugugaagcgucugauaaauccuguaguccaagcucaggc

SEQ ID NO: 21568 - RNA, 64 nt, hsa
caugguguaagaacaguuuugcaguauaacacgaucugauaaucauucaguuauuaaauuguaa

SEQ ID NO: 21569 - RNA, 64 nt, hsa
gacaguuuauguauauauauaauucaguauucccucugauaacauaguugccaguguuuaauac

SEQ ID NO: 21570 - RNA, 64 nt, hsa
augcuuauaagaaauaaugaaaaguucauccauuucugauaaaguucucuauggcaaagucuuu

SEQ ID NO: 21571 - RNA, 64 nt, hsa
uaggaaaacuuuccaaauaaaauaaauguuauucucugauaaagagcuaauacagaaauguuca

SEQ ID NO: 21572 - RNA, 64 nt, hsa
acucauucacucuuucagaacaaaaagacagucaucugauaagaguaugacauggaugaaaugc

SEQ ID NO: 21573 - RNA, 64 nt, hsa
guuuucccuguaguucuuccuuuauagcuuuucuucugauaaccaugacuucaggagcuuuaaa

SEQ ID NO: 21574 - RNA, 64 nt, hsa
ugucuugagacaugggguuuggcugucuugcaggacuggagaagguggugguucuagcuugguc

SEQ ID NO: 21575 - RNA, 64 nt, hsa
gaacagaauggagggcucugggaggaggcagcucacuggagagccuacauuccuuacacaagug

SEQ ID NO: 21576 - RNA, 64 nt, hsa
ccagcuuagcuuuccaaaauucuguguggaacuuacuggagauguuuuuauauauuugaaaaua

SEQ ID NO: 21577 - RNA, 64 nt, hsa
gagggagacaaaaccucauggcaaucuuguccucacuggagacucagaaggggaagcauuggga

SEQ ID NO: 21578 - RNA, 64 nt, hsa
ugguagggacaagcagugaggugguggccaugacacuggagaccaagccucagcggagggauca

SEQ ID NO: 21579 - RNA, 64 nt, hsa
aauuaagugugcugucugcaccugcaaggggggcacuggagaggugcacugugagaaggugcag

SEQ ID NO: 21580 - RNA, 64 nt, hsa
ucagaauucacuggagaaggugugguugcagcccacuggagagaaguuugcuggcuugcccagg

SEQ ID NO: 21581 - RNA, 64 nt, hsa
acaaggaaaggcaggaaugaggguuucagaauucacuggagaaggugugguugcagcccacugg

SEQ ID NO: 21582 - RNA, 64 nt, hsa
auccuacaagcuuacuacacauaggaaaauucauacuggagagaaacuacaaaugugaagaaug

SEQ ID NO: 21583 - RNA, 64 nt, hsa
ucuucaaaccuuacugaaaguugagaaaauucguacuggagagaauccuacaaaugugaaaaau

SEQ ID NO: 21584 - RNA, 64 nt, hsa
auccucaacuuuuacuaaacauaagguaauucauacuggagaaaagccauacaaaugagaagaa

SEQ ID NO: 21585 - RNA, 64 nt, hsa
guccucacaccuuucuacacauaagauaauuuauacuggagaggaacucuauaguugugaagaa

SEQ ID NO: 21586 - RNA, 64 nt, hsa
accaauccucauaccuuacuauacagaaauucauacuggagagaaagccuacaauugugaagaa

SEQ ID NO: 21587 - RNA, 64 nt, hsa
guccgcaaagcucacugaacauaaguuaauucauacuggagaaaaacccuacaaauguaaagaa

SEQ ID NO: 21588 - RNA, 64 nt, hsa
guccucaacucuuacugcacauaagaucauucauacuggagagaaaccuuacaaaugugaggaa

SEQ ID NO: 21589 - RNA, 64 nt, hsa
guucucgaacuuuacuaugcauaagaaaauucaaacuggagagaaacucuacaaaugugaagaa

SEQ ID NO: 21590 - RNA, 64 nt, hsa
gucuucaacccuuucugcacauaauauaauucauacuggagagaaaccccacaaauaugaagaa

SEQ ID NO: 21591 - RNA, 64 nt, hsa
uuuccauccauucuguuacacuuuguauuuucuaacuggagaaaagagugaggaacagaauguu

SEQ ID NO: 21592 - RNA, 64 nt, hsa
gagggaccuuggaggaugaaggcgaguaugugacacuggagaaaaguggaccaggcaugucuuu

SEQ ID NO: 21593 - RNA, 64 nt, hsa
uuucucaacccuuacuaaacauaagaugauucauacuggagagaaguuacacaaaugugaugaa

SEQ ID NO: 21594 - RNA, 64 nt, hsa
auccucaaaacucauugaacacaagaaaauucauacuggagagaaaccuuacaagugugaagaa

SEQ ID NO: 21595 - RNA, 64 nt, hsa
aucuucaacccuuauuggacauaagagaauucauacuggagagaaacccuacaaaugugaagaa

SEQ ID NO: 21596 - RNA, 64 nt, hsa
ucugagccauuaggagacauuagugaauuggagcacuggagaauccuacaaauggccuaugucu

SEQ ID NO: 21597 - RNA, 64 nt, hsa
uaaaauaccuucugcuuagauccagggcccuucuacuggagauaggaaaaguagaauucaggaa

SEQ ID NO: 21598 - RNA, 64 nt, hsa
aaaauuuucuaauauucauuuggaaaaccucuccacuggagagguuucaucucugagagguuuu

SEQ ID NO: 21599 - RNA, 64 nt, hsa
uaagacguuuuuaguuuauuuguuguuaaguuaaacuggagaaaguuugucauccucauuuuca

SEQ ID NO: 21600 - RNA, 64 nt, hsa
aauuguuuuuuguucccaucaguuucaggccaggacuggagaggccacauuaccaaguagaaag

SEQ ID NO: 21601 - RNA, 64 nt, hsa
cgugcagccaggguagcugaaguuugggucugggacuggagauuggccauuaggccuccugaga

SEQ ID NO: 21602 - RNA, 64 nt, hsa
ugccaagucauuucaaauacaugaaaaaucuuacacuggagagaaacccuaugaguguaagcaa

SEQ ID NO: 21603 - RNA, 64 nt, hsa
cuucacuuccuuucgauaucaugaaaggacucacacuggagagaaccccuaugaguguaagcaa

SEQ ID NO: 21604 - RNA, 64 nt, hsa
ugucaaaaaucuucgauuucauaaaaggacacacacuggagagaaacccugugaauguaagaaa

SEQ ID NO: 21605 - RNA, 64 nt, hsa
uucuaguucccuucaauaucaugaaaggacucacacuggagagaagcccuaugaauauaagcaa

SEQ ID NO: 21606 - RNA, 64 nt, hsa
agccucgcaccuucaaaugcauggaaggacucacacuggagaaaaacccuaugaauguaagcag

SEQ ID NO: 21607 - RNA, 64 nt, hsa
ugccaaguuauuucaaacacaugaaaaaauucacacuggagagaaacccuauaaaugcaagcaa

SEQ ID NO: 21608 - RNA, 64 nt, hsa
ugucaagaaccuuucaauuuaugaaaggacacacacuggagagaaacccuaugaauguaagaaa

SEQ ID NO: 21609 - RNA, 64 nt, hsa
cugccaagaucguuugaauacaugcaaaacacacacuggagagaaaccuaugaauguaaggaau

SEQ ID NO: 21610 - RNA, 64 nt, hsa
ugccaagucauuucgaagacaugaaaaaacucacacuggagagaaacccuauaaaugcaugcca

SEQ ID NO: 21611 - RNA, 64 nt, hsa
uuccaguuccuuucaguaucaugaaaggacucacacuggagagaaacccuaugaguguaagcaa

SEQ ID NO: 21612 - RNA, 64 nt, hsa
ugugccccacaccuucgaaggcaugguaggacucacuggagagaaacccuaugaguguaaggaa

SEQ ID NO: 21613 - RNA, 64 nt, hsa
uuccaguuccuuuugguaccaugaaaggacucacacuggagagaaacccuaugaguguaagcaa

SEQ ID NO: 21614 - RNA, 64 nt, hsa
ugccccacaccuucgaauccaugguagaacucacacuggagagaaacccuaugaguguaaggaa

SEQ ID NO: 21615 - RNA, 64 nt, hsa
ugccaagucauuucaaauaccugaaaaaucuuacacuggagagaaacccuaugaguguaagcaa

SEQ ID NO: 21616 - RNA, 64 nt, hsa
uuucacuucuuuucgauaacaugaaaggacucacacuggagagaaacccuaugaguguaagcaa

SEQ ID NO: 21617 - RNA, 64 nt, hsa
gcccucaauucuuaacagacauaagauaauuuauacuggagagaaacucuacaaaucagaaaga

SEQ ID NO: 21618 - RNA, 64 nt, hsa
guugucacacuucauuguagguaagauaauucauacuggagaaaacgccuacaugugugaacaa

SEQ ID NO: 21619 - RNA, 64 nt, hsa
auccucauccauuaguaaacauaagauaauucauacuggagagaaaaccuacaaaugugaggaa

SEQ ID NO: 21620 - RNA, 64 nt, hsa
gucccuccaauuuacugcacauaagauaauuuauacuggagagaagcccuacaaaugugaaaaa

SEQ ID NO: 21621 - RNA, 64 nt, hsa
auuuucaaaccuuacuaaacauaagauaacucauacuggagaaaaaucuuacaaaugugaagaa

SEQ ID NO: 21622 - RNA, 64 nt, hsa
guccucaauuuuuacuaaacauaagaaaauucauacuggagagaaacccuaugauugugaaaaa

SEQ ID NO: 21623 - RNA, 64 nt, hsa
acccucaauucuuaauagauauaagauuauuccuacuggagagaaacuacaaaccugagagagg

SEQ ID NO: 21624 - RNA, 64 nt, hsa
auugucacacuugauuguagguaagauaauucauacuggagaaaacuaccagugugaacaacgu

SEQ ID NO: 21625 - RNA, 64 nt, hsa
uaggucgucccugcuucaacaucacaguauucauacuggagagaaaccuuacgaauguauuaaa

SEQ ID NO: 21626 - RNA, 64 nt, hsa
uaguucaaaccuuacuguacaucagagaauucauacuggagaaaagccauauaaauguagugag

SEQ ID NO: 21627 - RNA, 64 nt, hsa
guuccaagugcaucccuuauucuauaggaaauaaacuggagacaaaucucauuuaagagaugca

SEQ ID NO: 21628 - RNA, 64 nt, hsa
gaaagaaaaucucauuacacaucagaaaauucacacuggagagaaaccuuaugaaugcagugaa

SEQ ID NO: 21629 - RNA, 64 nt, hsa
gaaaucaaaccucacugaacaugagaaaauucauacuggagagaaaccuuaucauuguaaucaa

SEQ ID NO: 21630 - RNA, 64 nt, hsa
gagacaaaaucuucuugagcaugaaaaaauucauacuggagagaaaccauucaaauguaaugaa

SEQ ID NO: 21631 - RNA, 57 nt, hsa
agccuugcaugucaucauagacuucauacuggagagaaaccuuacaaaugugaagca

SEQ ID NO: 21632 - RNA, 64 nt, hsa
cagaucacgccuuaaaagacauaggagaauucauacuggagagaaaccuuacaaguguaaugag

SEQ ID NO: 21633 - RNA, 64 nt, hsa
ucguucauaccuugcaguucaucagugaacucauacuggagagaaaccuuacaaaugucaugac

SEQ ID NO: 21634 - RNA, 64 nt, hsa
auguucacaccucauuagacaucagagaaucccuacuggagagaaaucuuacaaaugucaucag

SEQ ID NO: 21635 - RNA, 64 nt, hsa
cagcuguacacugaagagucaucagagaguucacacuggagaaagaccuuuugaaugcagcauu

SEQ ID NO: 21636 - RNA, 64 nt, hsa
cagcuccacacucauuagucaugagagaguucauacuggagaaaagccuuaugagugcagugaa

SEQ ID NO: 21637 - RNA, 64 nt, hsa
caacuccagccucauuaaacaucggagaauucacacuggagagagaccuuaucagugcagugaa

SEQ ID NO: 21638 - RNA, 64 nt, hsa
aagguccaaccucauucaccaucagcgaguucauacuggagaaaggcaugagugcgggcagugu

SEQ ID NO: 21639 - RNA, 64 nt, hsa
aaaaucuagccuuauuauacaucugagaguucacacuggagaaaggccuuaugagugcagugac

SEQ ID NO: 21640 - RNA, 64 nt, hsa
aaacuccagccuuauuaaacacuugagaguucacacuggagaaaggccauaugaaugcauugau

SEQ ID NO: 21641 - RNA, 64 nt, hsa
ccuuacaggcuuucgagugcacaugagaaugcacacuggagagaaaccuuauaaauguaaggau

SEQ ID NO: 21642 - RNA, 64 nt, hsa
uuccaguuauauucauauacaugaacgaauucauacuggagagaaacccuaugaauguaaagaa

SEQ ID NO: 21643 - RNA, 64 nt, hsa
ucuugcagguuuccagauacaugaaagaacccacacuggagagaaaccuuaugaauguaaacag

SEQ ID NO: 21644 - RNA, 64 nt, hsa
cuacuacucagcucaaagacaugaaaggacucauacuggagagaaacccuacaaauguaaggaa

SEQ ID NO: 21645 - RNA, 64 nt, hsa
uccuuuagguuuucaagcacaugaaaguacucacacuggagauaaacccuuugaguguaaaaaa

SEQ ID NO: 21646 - RNA, 64 nt, hsa
ucacaacucugcucaaagacaugaaaagacucauacuggagagaaacccuacaaaugcaaggaa

SEQ ID NO: 21647 - RNA, 64 nt, hsa
uucuguagguuuucaagcacaugaaagaacucacacuggagaaaaacccuaugaauguaaaaaa

SEQ ID NO: 21648 - RNA, 64 nt, hsa
ccaccaaucugcucaaaaacaugaaaaggcucauacuggagagaaacccuacaaauguaaggaa

SEQ ID NO: 21649 - RNA, 64 nt, hsa
ucaacguucuuuccaaauacauggaaggacucacacuggagauaaacccuuuaaguguaaagaa

SEQ ID NO: 21650 - RNA, 64 nt, hsa
ucucucagguccuugcauagacauaaaaggacucacuggagagauacucuauaaaugugugaaa

SEQ ID NO: 21651 - RNA, 64 nt, hsa
uuuuuauuccuuucaaaaucaugaaauaucucacacuggagagaugcuguaugauauaaggaau

SEQ ID NO: 21652 - RNA, 64 nt, hsa
uuuuggucacuuaaagcaacaugaaaggauucacacuggagagaagccguaugaauguaaggaa

SEQ ID NO: 21653 - RNA, 64 nt, hsa
uagcucaagcuuucgaagacacaugacaaugcacacuggagauggaccucacaaaaugcaagau

SEQ ID NO: 21654 - RNA, 64 nt, hsa
uuccaguacacugcaaagucaugaaagaacucacacuggagagaagaaacucuaugaaugcaag

SEQ ID NO: 21655 - RNA, 64 nt, hsa
uuacaguucuugucuaagacaugaaaaaacucacacuggagagaaacucuguacauguaaacaa

SEQ ID NO: 21656 - RNA, 64 nt, hsa
cuagggcagugccugcccucagcucucacacaugacuggagagaagugagaagacucccagaau

SEQ ID NO: 21657 - RNA, 64 nt, hsa
cuccaguucauuuuaaaaccaugaaaccacccacacuggagagccaccuucuuaaauguaagca

SEQ ID NO: 21658 - RNA, 64 nt, hsa
ucacguaaucuuuuaaagacaccugagaauauauacuggagagaaacuauaaagaaaauucuau

SEQ ID NO: 21659 - RNA, 64 nt, hsa
gucccuaaaucuuacuaaacauaaaaaaacuuaaacuggagagaaacuacaaagcuggaagaca

SEQ ID NO: 21660 - RNA, 64 nt, hsa
uuuucaacuuuuauuaaaacacaagauaauucauacuggagagaaauccuacaaaugugauaaa

SEQ ID NO: 21661 - RNA, 64 nt, hsa
ugguauuuuuuaaugcacugaauaauuguuuuuaacuggagaguuugguuaucaauauaacuuu

SEQ ID NO: 21662 - RNA, 64 nt, hsa
guugucacacuugauuguagguaagguaaguuauacuggagaaaacuucuacaugugugaacag

SEQ ID NO: 21663 - RNA, 64 nt, hsa
uggcugucacacuugauuguagguaagauaauauacuggagaaaacuacuagaauaaacaaugu

SEQ ID NO: 21664 - RNA, 64 nt, hsa
guccuuaaggcuuacuacauauaagacaacucauacuggagagaaaccaugcaugugugaagaa

SEQ ID NO: 21665 - RNA, 64 nt, hsa
guccucaaaccuuguggaacauaagagaauucauacuggagagaaacccuacaaaugcgaagaa

SEQ ID NO: 21666 - RNA, 64 nt, hsa
ugauucucagucuaguaaacauaagaaaauucauacuggagagaaaaucuacaaaggugaagaa

SEQ ID NO: 21667 - RNA, 64 nt, hsa
ccaggcaucaaaaccggaacaucacaggguuuauacuggagaguaacuacacaaagauaaugua

SEQ ID NO: 21668 - RNA, 64 nt, hsa
gcauuaaagccuuguaagacauacaauaauuuauacuggagaaaaacuuugcaaguauaaugaa

SEQ ID NO: 21669 - RNA, 64 nt, hsa
ucguucacauauugcaggucaucggugaacucauacuggagagaaaccuuacaaaugucaugac

SEQ ID NO: 21670 - RNA, 64 nt, hsa
ugauucacaccuggaacaacauacuggacuucacacuggagagaaaccuuacaaguguaaugag

SEQ ID NO: 21671 - RNA, 64 nt, hsa
ggaaaucacaccuuaaagacauaggagaauuuauacuggagagaaagcuuacaaauguaagguu

SEQ ID NO: 21672 - RNA, 64 nt, hsa
ugauucacaccuggcacaccauacuagaauucacacuggagagaaaccuuacaagugcaaugag

SEQ ID NO: 21673 - RNA, 64 nt, hsa
cacaaaucacagcuugaaagacaggagaauucauacuggagaaaaaacauacaaauguaagguu

SEQ ID NO: 21674 - RNA, 64 nt, hsa
uaauucauaccuggcaaaacauauuagaauucaaacuggagagaaaccuuacaaaugugaugag

SEQ ID NO: 21675 - RNA, 64 nt, hsa
caauucaacccuuguaagucacaaagccauucauacuggagagaaacuuuacaaguguaaugaa

SEQ ID NO: 21676 - RNA, 64 nt, hsa
ugauucacacguggcaccccauacuagaauucacacuggagagaaaccuuacaagugcaaugag

SEQ ID NO: 21677 - RNA, 64 nt, hsa
acaaauccagcuucaaauacauaggagaauucacacuggagaaaagccauagaaauguaagguu

SEQ ID NO: 21678 - RNA, 64 nt, hsa
uaaugcauaucuggcaaaacauacuagaauucacacuggagagaaacucauuauaaguguaaug

SEQ ID NO: 21679 - RNA, 64 nt, hsa
aaaagcaaccuuugcacaucaccauagacuucauacuggagagaaaccuuacaaaugggaggaa

SEQ ID NO: 21680 - RNA, 64 nt, hsa
acaauucaacccuguaagucauaaggcaauucauacuggagagaaaccuuacaagcauaaugaa

SEQ ID NO: 21681 - RNA, 64 nt, hsa
gaacacuggagccugcaauaagggaggagagaggacuggagaguguggggaaugggaagaagua

SEQ ID NO: 21682 - RNA, 64 nt, hsa
ugccaccacgcccggcuaauuuuuuuguauuuucacuggagacgggguuucacuguguuagcca

SEQ ID NO: 21683 - RNA, 64 nt, hsa
aggcuaagucaggaacaucggaugccagggagggaggagaaagccgaagcgaaaggggucaggg

SEQ ID NO: 21684 - RNA, 64 nt, hsa
agggaauuuuagugacaccuuaugccauuucaagaggagaaaugcaggcuggcagagcaauuuc

SEQ ID NO: 21685 - RNA, 64 nt, hsa
aacuaacggaaacugcuuuuugacauuaaaagacaggagaaauuauauuuaacuaaguaaaagu

SEQ ID NO: 21686 - RNA, 64 nt, hsa
uuucauucauuucauuucccccguagcagauggaaggagaaaccucugagaaaaugaaaacauc

SEQ ID NO: 21687 - RNA, 64 nt, hsa
acauagguagaugguaaagagaaugaggagaaaaaggagaaaagggaaaagcagaaaggaaaaa

SEQ ID NO: 21688 - RNA, 64 nt, hsa
uggagggucacauagguagaugguaaagagaaugaggagaaaaaggagaaaagggaaaagcaga

SEQ ID NO: 21689 - RNA, 64 nt, hsa
ggcaggguuggugugaugccaaggcaaaguggugaggagaaaacaggaaacgggcuuucucuga

SEQ ID NO: 21690 - RNA, 64 nt, hsa
cccgcucccaccauugccccuccucagcugugcaaggagaaagcaugcuuaggaaguuuucagg

SEQ ID NO: 21691 - RNA, 64 nt, hsa
auuaucaaucucgguuuuuuuguggugcaguggaaggagaaauaggucuaguuucugccucuga

SEQ ID NO: 21692 - RNA, 64 nt, hsa
caguuuugaaagauaggcaaaaaaaaaaaaguauaggagaaacugaagaauguacacuuuuuua

SEQ ID NO: 21693 - RNA, 64 nt, hsa
acuaacauucacuguuagagaguguaggcgcugcaggagaaagagaaagugcccacgaaaauua

SEQ ID NO: 21694 - RNA, 64 nt, hsa
gaaauuccuaaggaggaauucuuaggaauuccuaaggagaaacagagugaggccuuuuuaaccu

SEQ ID NO: 21695 - RNA, 52 nt, hsa
cugagaguucucucuccugagcaggagaaaggagggugguuuccgugggggc

SEQ ID NO: 21696 - RNA, 64 nt, hsa
aggugcccugcuggauaucugggucuggaacaggaggagaaagggugucugcugccuggugagg

SEQ ID NO: 21697 - RNA, 64 nt, hsa
ggaugcuguuuuuauugggcaugucaucuaagagaggagaaauagcuggguuuugggucuaauu

SEQ ID NO: 21698 - RNA, 64 nt, hsa
gaaacuuaucucaaauggagauuuuggugggaggaggagaaaacaauuguuuuuaaaucacaca

SEQ ID NO: 21699 - RNA, 64 nt, hsa
aauguugaucgguagggcagccauauguguaggaaggagaaaacagaauuugguggauaccuag

SEQ ID NO: 21700 - RNA, 64 nt, hsa
ucuuuuauaauccuuaaugugaggcuaagguauaaggagaaaggagauugguaaggaaguguga

SEQ ID NO: 21701 - RNA, 64 nt, hsa
auauaaacauaauucaaauauuuaaauauuuaagaggagaaaaguaacuagaaaaccaaugaaa

SEQ ID NO: 21702 - RNA, 64 nt, hsa
ucacaguauuucuauuuaaggcagcuauaaauauaggagaaaaauguuuuuggagagcugugaa

SEQ ID NO: 21703 - RNA, 64 nt, hsa
auggcuccucugugacaaaacacaaguuggaccaaggagaaagcccuuuggagaaacuggaccc

SEQ ID NO: 21704 - RNA, 64 nt, hsa
aaauugguauuuauuuuaaauauuaguuauucuaaggagaaaaaaaugcuucugcaagauuuuc

SEQ ID NO: 21705 - RNA, 64 nt, hsa
accucucagaaaagagaaaaaagaaugucaguuuaggagaaaagcuuccuuuuuacuugugugg

SEQ ID NO: 21706 - RNA, 64 nt, hsa
gugacaguaauuccagcucggucccuccaggcaaaggagaaacgggacuuacuucacaggacag

SEQ ID NO: 21707 - RNA, 64 nt, hsa
uaguuucuggacguuugugcaguauugaaaagacaggagaaaagaaaacagaaaccugguuaua

SEQ ID NO: 21708 - RNA, 64 nt, hsa
gaguucauaaggaggugagaaguaauuuuuuuaaaggagaaaaauuuuuuggcuuuagauuuaa

SEQ ID NO: 21709 - RNA, 64 nt, hsa
aaccuagacuucagagagaaugagcagagagcaaaggagaaaucuggcuguccuuccauuuuca

SEQ ID NO: 21710 - RNA, 64 nt, hsa
cacugaauaucaacucugaaagagcaaaccuaacaggagaaaggacaaccaggaugaggauguc

SEQ ID NO: 21711 - RNA, 64 nt, hsa
cggcacagcagcucccucaaggaggagaagagugaggagaaaggaaacucaagucucaccauuc

SEQ ID NO: 21712 - RNA, 64 nt, hsa
aaugcuauguuuacucguucuuggguuccaauaaaggagaaacagggcacaggagucggaagga

SEQ ID NO: 21713 - RNA, 64 nt, hsa
uauuauggacugggcaaagcccacuauaaacuauaggagaaagaaguucugauaaaccucuuag

SEQ ID NO: 21714 - RNA, 64 nt, hsa
aaauguuugugaaauaaaacugauuuuaacuggaaggagaaacagguuaauggacuuuguguuu

SEQ ID NO: 21715 - RNA, 64 nt, hsa
uaaaaguauaagccuaacuuugucgcuaguccuaaggagaaaccuuuaaccacaaaguuuuuau

SEQ ID NO: 21716 - RNA, 64 nt, hsa
ggcuugagacuuuccuuugugugguaggacuuggaggagaaauccccuggacuuucacuaaccc

SEQ ID NO: 21717 - RNA, 64 nt, hsa
ugcccuuugcuguagcuacacuucagauuaaaguaggagaaagaaugugcugaguguuuuccuc

SEQ ID NO: 21718 - RNA, 64 nt, hsa
agggggcaucuuuguguaaaagaugcauggagucaggagaaaaccaccuucauaaacugcucug

SEQ ID NO: 21719 - RNA, 64 nt, hsa
auagguuugaacagugggagauaccagaggugggaggagaaaaaguuauuuauuaccguucccu

SEQ ID NO: 21720 - RNA, 64 nt, hsa
uguaauauauguuuaacuggagucccagaaggagaggagaaaaugaagaggcaugaagaaguau

SEQ ID NO: 21721 - RNA, 64 nt, hsa
uaugcaaagaagcaauaaaauaugacuuauaaccaggagaaaaaucaguagaaacccagaaaag

SEQ ID NO: 21722 - RNA, 64 nt, hsa
uuggugaguuuucuaaaaguauuuccccauggaaaggagaaagugguuugggacagaaagaaau

SEQ ID NO: 21723 - RNA, 64 nt, hsa
agacaaagcagagauggaaauaaugcgccucuugaggagaaaagcaauaaugaauaaaaggacu

SEQ ID NO: 21724 - RNA, 64 nt, hsa
cauggucucugcccuucggagcuuauauuccaguaggagaaaaagcaaaaauaaaauaauuaua

SEQ ID NO: 21725 - RNA, 64 nt, hsa
cagguuauuggugacuuacuggacuggcaccgccaggagaaaauucuccugcuaacuuuuuuuc

SEQ ID NO: 21726 - RNA, 64 nt, hsa
uuuuccuaguauuuaacagaacccaagugaacagaggagaaaugagauugccagaaagugauua

SEQ ID NO: 21727 - RNA, 64 nt, hsa
uaaugaugacuaguucacacauaaaguccuuuuaaggagaaaaucuaaaaugaaaaguggauaa

SEQ ID NO: 21728 - RNA, 64 nt, hsa
ucaagcuggacuguggguuccaaauuacucauagaggagaaaaccagagaaagaugaagaggag

SEQ ID NO: 21729 - RNA, 64 nt, hsa
cuucaggguaggugggcacaggcuuggacuagagaggagaaagauugguguaaucugcuuuccu

SEQ ID NO: 21730 - RNA, 64 nt, hsa
aaaaccauaggaaagugacauguaggagggcuauaggagaaacugaugauuuuacauuuucuag

SEQ ID NO: 21731 - RNA, 64 nt, hsa
acucagagcuuucuauccaucugagagccaacacaggagaaaaaccauaggaaagugacaugua

SEQ ID NO: 21732 - RNA, 64 nt, hsa
cuuuaguuuuccugaaaucaccaggucaggcacaaggagaaaagguuccuggauacugacuaac

SEQ ID NO: 21733 - RNA, 64 nt, hsa
ggauacugacuaacuuggguggguggaucuagccaggagaaagacaguaacauguguucuguac

SEQ ID NO: 21734 - RNA, 64 nt, hsa
uggggagaagacaaaauugguguuuagauucuggaggagaaaaaaugaguuacaaugucaggug

SEQ ID NO: 21735 - RNA, 64 nt, hsa
auucuaaauuaccauuuacuuccagauagagcagaggagaaacaccucacugcaguuucaacau

SEQ ID NO: 21736 - RNA, 64 nt, hsa
uuauguaagaaggcagggcaggggggcuuuuuacaggagaaaaaaaaaugacuuauaagagaaa

SEQ ID NO: 21737 - RNA, 64 nt, hsa
ccaucuuuauaauuucuuugucucacagaagacuaggagaaagaucuuuuuuaaauaaucuuuu

SEQ ID NO: 21738 - RNA, 64 nt, hsa
guuuagaacucuucaacuucgguaaugaggaagaaggagaaagagcugggggaagggcagaaga

SEQ ID NO: 21739 - RNA, 64 nt, hsa
gggcagaagacugguuuaggaggaaaaggaaauaaggagaaaagagaaugggagagugagagaa

SEQ ID NO: 21740 - RNA, 64 nt, hsa
gccagagggccucagggagcugcaaaacucauccaggagaaaaaggcaggagcagcaagugacc

SEQ ID NO: 21741 - RNA, 64 nt, hsa
gaaagagaguggagauacggaagggggagaggagaggagaaauguggacagagggcuugaagac

SEQ ID NO: 21742 - RNA, 64 nt, hsa
caaauuaugcuagagcaauuagacacccauggcgaggagaaaaaagaaccucuacuuaaaccuc

SEQ ID NO: 21743 - RNA, 64 nt, hsa
auacauaaaacuagauaacuuugaaaaaagccacaggagaaaaaucuucaggaucuugggcuag

SEQ ID NO: 21744 - RNA, 64 nt, hsa
gaaagcugugcucagaggaggugagaggagaggaaggagaaaacugcaucauaacuuuacagaa

SEQ ID NO: 21745 - RNA, 64 nt, hsa
auuuuuuccuuucaaaucagacgaugagacuagaaggagaaauacuuucugucuuauuaaaauu

SEQ ID NO: 21746 - RNA, 64 nt, hsa
gguugaggacagugacugccauuuguauauaaaaaggagaaaaaugguaaguacauaauuguga

SEQ ID NO: 21747 - RNA, 64 nt, hsa
gagguaggauguuuccuagaccauuuggggucugaggagaaacaggcuggggccucgagaagga

SEQ ID NO: 21748 - RNA, 64 nt, hsa
uuaaguagccuuaugacaaacaguaugagauacuuaugacaaacucgcucugucacccaggcug

SEQ ID NO: 21749 - RNA, 64 nt, hsa
cucuacauaaaucuagauacucauuaaguagccuuaugacaaacaguaugagauacuuaugaca

SEQ ID NO: 21750 - RNA, 64 nt, hsa
gcuaugcauagcuugggcaauagcccuaaauugcuaugacaacuaaugaaccagcuacguauac

SEQ ID NO: 21751 - RNA, 64 nt, hsa
aauuguuuaucaucuugacaugguuggucauuucuaugacaauuuacuucaaacuguguacugu

SEQ ID NO: 21752 - RNA, 64 nt, hsa
accacauuuuaaccccagcgcuauucauaacuuuuaugacaauauuggauuuguagguccugug

SEQ ID NO: 21753 - RNA, 64 nt, hsa
cuuucaggcuuugcauuuuguauaugggaagaaauaugacaauccuagguaauuaaaccauaga

SEQ ID NO: 21754 - RNA, 64 nt, hsa
ggccaguugaauauauucuauuccauguccauacuaugacaaucuuauugucaacacuauauaa

SEQ ID NO: 21755 - RNA, 64 nt, hsa
uuaugucuuuggaaaucggguucagaacacuuuuuaugacaaaaauuggguggaggggauaacu

SEQ ID NO: 21756 - RNA, 64 nt, hsa
ucauaauaaaacuuggcagauucuacaagucuauuaugacaaaccaggaacuaauucuauaaug

SEQ ID NO: 21757 - RNA, 64 nt, hsa
uaggaacuacuugaaauaguaauuuguuaaaagauaugacaaaaugaaaaugcuuaaacuacag

SEQ ID NO: 21758 - RNA, 64 nt, hsa
cuuauuugcagaagugguguaguucuauaaaacggcaaaugaaguucaacuuaauauucucuau

SEQ ID NO: 21759 - RNA, 64 nt, hsa
uugaaaguaugaaugugcucuuuccuaaaacauggcaaaugaauagauguagagaauaacaaua

SEQ ID NO: 21760 - RNA, 64 nt, hsa
uuuuauuccuuccuuucuacccccaaccagucgagcaaaugagcaauuuuguguuucuaauaca

SEQ ID NO: 21761 - RNA, 64 nt, hsa
ugcugccuuagccugacaaccgguuguccucaaagcaaaugaacuuaagcauuugggauugagg

SEQ ID NO: 21762 - RNA, 64 nt, hsa
cuaaaaaaguggaccuucucagaaaaaaagggcagcaaaugaccaagggcgccccuucuggccg

SEQ ID NO: 21763 - RNA, 64 nt, hsa
ccuuuaagccuuuuuuuucuuuuuuuuuuuuuuggcaaaugaauguaccauuucaacuuugauu

SEQ ID NO: 21764 - RNA, 64 nt, hsa
uuucagaucauauuucacaauccuguggaucugggcaaaugaaaauguuucaggaaguuucugc

SEQ ID NO: 21765 - RNA, 64 nt, hsa
caauuucacugauguaaguguuguggaaauagaagcaaaugacaaaaagccuuuuccagaagau

SEQ ID NO: 21766 - RNA, 64 nt, hsa
aaaauugugaauucuguuguugugauaaauaugagcaaaugaaguguaauaucuauagaaaagu

SEQ ID NO: 21767 - RNA, 64 nt, hsa
auuugcaaaaaauuguuuuaugcuuuauuauaucgcaaaugagugucagauuuuugaguaccaa

SEQ ID NO: 21768 - RNA, 64 nt, hsa
auggaauuacucuacuguucuuucuuuaauaguggcaaaugaaagcauaagcuuaagcauuuuu

SEQ ID NO: 21769 - RNA, 64 nt, hsa
ugccugcagaaagaccagcaguugauauuaaagcgcaaaugaauucaaccucagcccugaaaau

SEQ ID NO: 21770 - RNA, 64 nt, hsa
uggaaauguaacuaacugaaaugaagaauaaaaggcaaaugagcuggggauaaacuugaauguu

SEQ ID NO: 21771 - RNA, 64 nt, hsa
uucuuuaaucaauuacuuuuuugugaguuuuguggcaaaugaagcuuguacgugucuuuaaaac

SEQ ID NO: 21772 - RNA, 64 nt, hsa
aaaucuuucuggucacuauaaagaucuuggaacagcaaaugauuaaaugucaguuccccuaaac

SEQ ID NO: 21773 - RNA, 64 nt, hsa
agaaggcuguccugcauuaggaacaagugaacacgcaaaugacaugaaguauuuguugcagagc

SEQ ID NO: 21774 - RNA, 64 nt, hsa
ugacaagauggagaaagcaagaucaugaaggugugcaaaugauucuuacggcauggacaaggau

SEQ ID NO: 21775 - RNA, 64 nt, hsa
guuuguuuugcacuuuaaaaaagagagaacacaugcaaaugaacuugcuuguguguauuugaug

SEQ ID NO: 21776 - RNA, 64 nt, hsa; identical to SEQ ID NO: 21775

SEQ ID NO: 21777 - RNA, 64 nt, hsa
ugacaagauggagaaagcaagaucaugaaggugugcaaaugauucuuacggcaugggcgaggau

SEQ ID NO: 21778 - RNA, 64 nt, hsa
guuugucuugcacuuuaaaaaagagagaacacaugcaaaugaacuugcuuguguguauuugaug

SEQ ID NO: 21779 - RNA, 64 nt, hsa
ugacaagauggagaaagcaagaucacgaaggugugcaaaugauucuuaaggcauggacgaggau

SEQ ID NO: 21780 - RNA, 64 nt, hsa
ugauuucuacucagcguuuccagaaaucaggucugcaaaugacuagucagaaccuugcuuaaca

SEQ ID NO: 21781 - RNA, 64 nt, hsa
caauuugaauucagggaaaaguuggucacagccugcaaaugacuucauuuggaagucugauugu

SEQ ID NO: 21782 - RNA, 64 nt, hsa
aaugacacuuugagaguagucuuucaaucugaagauguaagacuuccugaaacaaguucucaag

SEQ ID NO: 21783 - RNA, 64 nt, hsa
uguagcucaaaacuauuugugaucuacuguuugcauguaagagaccaggauauguaacucuuau

SEQ ID NO: 21784 - RNA, 64 nt, hsa
aaugaaacuaaucugcugccucuaauuuccaaaaauguaagaaauuuuacaauugugaaaaccu

SEQ ID NO: 21785 - RNA, 64 nt, hsa
cuuuugauauacucaaagccagaaagcuuaacuaauguaagauuagcuauuauuuguaggacug

SEQ ID NO: 21786 - RNA, 64 nt, hsa
gaggucaaugggagaugugcccucccuauggaggauguaagaagcagaggccauuucugcccca

SEQ ID NO: 21787 - RNA, 64 nt, hsa
uuacugaauguggauuuuauuucucuuuuuaaugauguaagaaaauugucaggagaauggcucu

SEQ ID NO: 21788 - RNA, 64 nt, hsa
aaagauggccagcacacugcuaaccagucaccaaauguaagacccauaagaaacccauauuuaa

SEQ ID NO: 21789 - RNA, 64 nt, hsa
gagcauuuuuaaugcaacuagccccuauauuuuaauguaagaguuacucugcaaucuaagcaaa

SEQ ID NO: 21790 - RNA, 64 nt, hsa
guuaaaagucaguguaucagaaaagaaagcagccauguaagaggcuaacuuaaauagaagugcu

SEQ ID NO: 21791 - RNA, 64 nt, hsa
ggcaguggauuucuaaugcuuuuggcuguauguuauguaagauuuaauauguuguuacuguaag

SEQ ID NO: 21792 - RNA, 64 nt, hsa
gcaaagcuuuuaacugauucucaacucuuacuacauguaagaguauuuauacuggaaagaaacc

SEQ ID NO: 21793 - RNA, 64 nt, hsa
augacacuuucuaugaaagaauaaggacauuaaaauguaagaugcaugaugaaaaccugaguga

SEQ ID NO: 21794 - RNA, 64 nt, hsa
auacuaacaguuaaccauuagaagugguucaaugauguaagagucacacugcuucaacuuuuuc

SEQ ID NO: 21795 - RNA, 64 nt, hsa
gguuucaaacauguuuaauuuacauuagguuuuuauguaagagugucauggaagcacucagcaa

SEQ ID NO: 21796 - RNA, 64 nt, hsa
gguguggcuaucugagaaaucaacuuugggggaaauguaagauucugagcucucucucuguuuu

SEQ ID NO: 21797 - RNA, 64 nt, hsa
auuuaccuaggcuugaagauuuggaagaaauaauauguaagaauggccucaaggcagaccacuu

SEQ ID NO: 21798 - RNA, 64 nt, hsa
acuuuucuaggugcuggggauugagaacgaaucgauguaagauuccuccuuuagggcagagaca

SEQ ID NO: 21799 - RNA, 64 nt, hsa
guaggugccgggaacgggcaagacauguuuugaaauguaagaucacagacuguuuuuugcaaga

SEQ ID NO: 21800 - RNA, 64 nt, hsa
gauucccuaaguaugcuacacagcaucauauuagauguaagauguaagacuugcaaaggacaga

SEQ ID NO: 21801 - RNA, 64 nt, hsa
uaaguaugcuacacagcaucauauuagauguaagauguaagacuugcaaaggacagaaggaauc

SEQ ID NO: 21802 - RNA, 64 nt, hsa
cacuuuuucccaucaagucauuuguuaaaacuaaauguaagaaaaaucugcuagaggaaaacuu

SEQ ID NO: 21803 - RNA, 64 nt, hsa
ucaaccagaagaaagggccuucacaguguccuuuauguaagaaugauauaaccaaaagguauau

SEQ ID NO: 21804 - RNA, 64 nt, hsa
cacacauaaugcacucuguagagagaccuuauaaauguaagauaugugggaggggcuuuuauuc

SEQ ID NO: 21805 - RNA, 64 nt, hsa
auaaaaggacacacacuggagagaaacccugugaauguaagaaauguagaaaagcauuccauaa

SEQ ID NO: 21806 - RNA, 64 nt, hsa
acauaagaauacacucuggagaaagaccuuauaaauguaagacaugugggaaaggcuuuuauuc

SEQ ID NO: 21807 - RNA, 64 nt, hsa
acguaagaaugcacucuguagaaagaccuuauaaauguaagauaugugggaaaggcuuuuauuc

SEQ ID NO: 21808 - RNA, 64 nt, hsa
acaugauaaggcacacuagagauggaccucauaaauguaagauaugugggaaaggcuuugauug

SEQ ID NO: 21809 - RNA, 64 nt, hsa
aucagggaagaucaauacgaaagucacaggauaaauguaagaugcgauaugguagagcgcuucg

SEQ ID NO: 21810 - RNA, 64 nt, hsa
uuacuagagauuuaugaaauuaaauuaagagauaauguaagaaaauacauuuuuuugguucuau

SEQ ID NO: 21811 - RNA, 64 nt, hsa
uucagugguugccucacuugcguuuuccuacaagauguaagacuguuuauaauuaaacuuuuuu

SEQ ID NO: 21812 - RNA, 64 nt, hsa
uuucuccaugcuuaauggugugaggcgucaggagagaggccaaguacauaaaaaaaaaaaaagc

SEQ ID NO: 21813 - RNA, 64 nt, hsa
gaauucuguucucccagagcugcaccugccucgcagaggccagcaccccacucuccugccucca

SEQ ID NO: 21814 - RNA, 64 nt, hsa
gacugguggggaaugaguguucagaagccuugggagaggccaaagagccauucuagcaugaucu

SEQ ID NO: 21815 - RNA, 64 nt, hsa
gccauucuagcaugaucugagaaaaccuuccugcagaggccagaaaccuugagcuuaggugccu

SEQ ID NO: 21816 - RNA, 64 nt, hsa
ccaggcuguuuggggugggagccaaaaagaguugagaggccagggcccuugguggaaaggggca

SEQ ID NO: 21817 - RNA, 64 nt, hsa
agcucccugucccccucacucuugccccaagaaaagaggccaaagcaagagcagauucccuagg

SEQ ID NO: 21818 - RNA, 64 nt, hsa
ggccuacccugaaugcuucuugcuaaccaggccgagaggccacacacuugcccccccaucccca

SEQ ID NO: 21819 - RNA, 64 nt, hsa
gaggccccaucccugacccuguccuggagggggcagaggccaggccccagugcugacgaggagc

SEQ ID NO: 21820 - RNA, 64 nt, hsa
gcccagggaggaacggaggaggacucgcgcuacaagaggccacucccagggacccagggaggcg

SEQ ID NO: 21821 - RNA, 64 nt, hsa
acucccagggacccagggaggcgauggccaccccagaggccaccuuuugcuccacggagguggg

SEQ ID NO: 21822 - RNA, 64 nt, hsa
uccuucggcauuucugcaaggaggacuugaagcaagaggccaagugaggggcugcccaguucuc

SEQ ID NO: 21823 - RNA, 64 nt, hsa
ccaacagccacucugagggaggggagaagggagcagaggccacgcagaaugaaccgauggggua

SEQ ID NO: 21824 - RNA, 64 nt, hsa
uggccuuuauuuuuccucauuucucaugggcaacagaggccaaagaaacgaagcaagacaaaca

SEQ ID NO: 21825 - RNA, 64 nt, hsa
cacugcucugggcugcagcuuccagcacugaaucagaggccacacagcccaaagauuagcuuca

SEQ ID NO: 21826 - RNA, 64 nt, hsa
auggggcagaggacaggggagcugagguugguucagaggccagccugcauagccucuguccuca

SEQ ID NO: 21827 - RNA, 64 nt, hsa
gaaaucagaaguggggcugugucucugacuggcuagaggccaggccuuguggguuucuaucugc

SEQ ID NO: 21828 - RNA, 64 nt, hsa
aucaccgugcgcuguugcgaucuggaccccgagaagaggccauccuuugugaagcuggaacacu

SEQ ID NO: 21829 - RNA, 64 nt, hsa
acgcuugggugcgugggagggcgcacaucagggcagaggccaaguuccaggugucuguguuccc

SEQ ID NO: 21830 - RNA, 64 nt, hsa
ccacccaguagguuuucuguuguggucccgugggagaggccagacuggauuauuccuccuuugc

SEQ ID NO: 21831 - RNA, 64 nt, hsa
ggaacacuggcccauugccccuggcacuccuugcagaggccacccacgaucuucuuugggcuuc

SEQ ID NO: 21832 - RNA, 50 nt, hsa
ucggcgggcgcuggaaguagagaggccagaaaggccccucgaggcagaga

SEQ ID NO: 21833 - RNA, 64 nt, hsa
ccugucaggggcucccugacaguccuggggguggagaggccaucccggggcgucccccgcgucu

SEQ ID NO: 21834 - RNA, 64 nt, hsa
augucccuauuucuaccccggccagaacauggacagaggccagaagccuuccggacaggcgcug

SEQ ID NO: 21835 - RNA, 64 nt, hsa
aggucuacccaggagccucgggucugaucaagggagaggccaggcgcagcucacugcggcggcu

SEQ ID NO: 21836 - RNA, 64 nt, hsa
ucaacaucgagcucuguuguaaauacgucgcaccagaggccacugugaugccacugucuccucu

SEQ ID NO: 21837 - RNA, 64 nt, hsa
cccagucguacucuuccagguuuggaagacccagagaggccaagaucccauccuuagccauagc

SEQ ID NO: 21838 - RNA, 64 nt, hsa
gggaagaggggcaauacaacagggucaagggugcagaggccaggcagagugggugcagaguggg

SEQ ID NO: 21839 - RNA, 64 nt, hsa
agggggccauguuucccagcggggacccaccaacagaggccaguuucaaagucagcugaggggc

SEQ ID NO: 21840 - RNA, 64 nt, hsa
cuaaaucacuggaaaggcuggaggagcagaaggcagaggccaccacuggacuauugguuucaau

SEQ ID NO: 21841 - RNA, 64 nt, hsa
auugguuucaauauuagaccacuguagccgaaucagaggccagagagcagccacugcuacugcu

SEQ ID NO: 21842 - RNA, 64 nt, hsa
uaaggggacagagcccagcagaucccagcugugaagaggccacugcauggcugacacaaaacac

SEQ ID NO: 21843 - RNA, 64 nt, hsa
uuuuuuuucugcuguuuuuuauggaugggauuugagaggccaaaggugagugggcuauuggccu

SEQ ID NO: 21844 - RNA, 64 nt, hsa
acagugcucaugugccuuccagacgguucaaggcagaggccacugugcucaguguagucuguga

SEQ ID NO: 21845 - RNA, 64 nt, hsa
aagagaauacccauacaaaucgucccaccgcccuagaggccacagaauuagcccaaaauuauca

SEQ ID NO: 21846 - RNA, 64 nt, hsa
gcuagagaggguggcaggccugcugcuggaccccagaggccacugugaccgccaaggggccuuu

SEQ ID NO: 21847 - RNA, 64 nt, hsa
ccucugugugccucaguuuuccuauuuguaaaauagaggccauagugguaccuauuuugaagac

SEQ ID NO: 21848 - RNA, 64 nt, hsa
ggaaccaggcccugcucuccuguguaggccucagagaggccaagaagggaagcuuugggcuucg

SEQ ID NO: 21849 - RNA, 64 nt, hsa
ucugugucugugcggaagacuacugccccaccccagaggccacaccccaggccgggcccccgcc

SEQ ID NO: 21850 - RNA, 64 nt, hsa
cugcaaacugugcgcauucuccagccagggaugcagaggccacccagaggcccuuccugagggc

SEQ ID NO: 21851 - RNA, 64 nt, hsa
cuacacacaggagggaucagcuccugggugugucagaggccagccuggggagcucuggccacug

SEQ ID NO: 21852 - RNA, 64 nt, hsa
cauggccacaauucuagacaaaaaccaaagacccagaggccagagcaaaguaggaccuucugaa

SEQ ID NO: 21853 - RNA, 64 nt, hsa
uauuuuuguuguuguuuuguuucuuaaagaguacagaggccauugaagccuuuugcuccucuua

SEQ ID NO: 21854 - RNA, 64 nt, hsa
cauccagugugggugguguccucauaagauaaggagaggccaggccugguggcucacgccugua

SEQ ID NO: 21855 - RNA, 64 nt, hsa
ccugguggcucacgccuguaaucccagcacuuuaagaggccaaggcggauggaucacuugagcc

SEQ ID NO: 21856 - RNA, 64 nt, hsa
gaugaaaaauugaucuuguuuugaaauugaagagagaggccaggcgcgguggcucacaccugua

SEQ ID NO: 21857 - RNA, 64 nt, hsa
caaucccucaugaguugaagcauuaauagauaugagaggccauaagcaagagacaucauguaaa

SEQ ID NO: 21858 - RNA, 64 nt, hsa
cugaagugcagaucacugacccagggcucagagcagaggccagaaccacugggccggccggcau

SEQ ID NO: 21859 - RNA, 64 nt, hsa
uggacucaggaacccacagcuuacugaaaaagccagaggccaugacugcccccagaaacuugcc

SEQ ID NO: 21860 - RNA, 64 nt, hsa
accagacucuauuuaaugaacugugaauuuacacagaggccauuuuaaaugggucaccccauuu

SEQ ID NO: 21861 - RNA, 64 nt, hsa
gcucgguggcucacgccuguaaucccagacuuugagaggccaaggcggucacgaggucaggagu

SEQ ID NO: 21862 - RNA, 64 nt, hsa
cuacaguaguggguaaacaaaugcccaccggccaagaggccauuaacaaaucguccuuguccug

SEQ ID NO: 21863 - RNA, 64 nt, hsa
ugugaagucacauaaucuacggggcuagggcgagagaggccagggauuuguucacagauacuug

SEQ ID NO: 21864 - RNA, 64 nt, hsa
gccuugccgugguuggcgcgccccgggugcagcgagaggccauccccgagcgcuaccuccccgg

SEQ ID NO: 21865 - RNA, 64 nt, hsa
ggcggaggggugguucuuuuccuucuccuccgccagaggccacgggcgcccuuguucccgccgg

SEQ ID NO: 21866 - RNA, 64 nt, hsa
cucaguucugugccccaccaaaugcccaggggcaagaggccacccuggaagcugccaaucuucc

SEQ ID NO: 21867 - RNA, 64 nt, hsa
gcucccaggcccuugggcaggcuggggugacggcagaggccacagcaccagcucugacaagucc

SEQ ID NO: 21868 - RNA, 64 nt, hsa
gaucaccaggcaagagaguugccugcaccagguaagaggccaaagccccugggguaacaguccc

SEQ ID NO: 21869 - RNA, 64 nt, hsa
uacuugaagaaaaagaauuauuuuugcauaugaaagaggccagaacccacaggaaaaacuucaa

SEQ ID NO: 21870 - RNA, 64 nt, hsa
aagggcauuuuugguuuuuagcuuguucaaaaacagaggccagcacagaugacauuuuagauac

SEQ ID NO: 21871 - RNA, 64 nt, hsa
gcugccugggagcugaggcacccgugccaguggcagaggccacagccccagccuuaggccaggc

SEQ ID NO: 21872 - RNA, 64 nt, hsa
gagggcuuccugccuguuuggcaaagucccaggcagaggccaaggaugaggccugacucggcuc

SEQ ID NO: 21873 - RNA, 64 nt, hsa
guuuuggaaaguguagugggaauauucagacaaaagaggccauuuuccauuuuuaaagcuucuu

SEQ ID NO: 21874 - RNA, 64 nt, hsa
uuaugauggagcuguguuauaaauuccuuaugucagaggccagugcgguagccuuugucccuuc

SEQ ID NO: 21875 - RNA, 64 nt, hsa
caugccccaguucuaagcccuguggccaggugcugucacacagcaaaggggacuuugcaggugg

SEQ ID NO: 21876 - RNA, 64 nt, hsa
gccaugcugugccugggguccacagagccgggaggucacacauguacauccuggaagcugccca

SEQ ID NO: 21877 - RNA, 64 nt, hsa
ggucagcugcccccaaacccccuccuuacgcuuugucacacaaaaagugucucugccuugaguc

SEQ ID NO: 21878 - RNA, 64 nt, hsa
uucagaaaauauuuucagccuacaguuauguucagucacacacacauacaaaauguuccuuuug

SEQ ID NO: 21879 - RNA, 64 nt, hsa
gagagagaccacuuuucauaaccuagccuuagaagucacacaguauuacuucugcuacauauau

SEQ ID NO: 21880 - RNA, 64 nt, hsa
aagggcccagagaggguggugaccucugccugaagucacacagugagucgaggacagggaggug

SEQ ID NO: 21881 - RNA, 64 nt, hsa
gaggauguucugggacacaguucaauucucauuugucacacacuuuggcuauuagagaucaacc

SEQ ID NO: 21882 - RNA, 64 nt, hsa
gacgcggcgauggcaucacacagacggugaugaugucacacacagacacagugacaacacacac

SEQ ID NO: 21883 - RNA, 64 nt, hsa
cgucacgggccaugucgacgucacacauauuaaugucacacagacgcggcgauggcaucacaca

SEQ ID NO: 21884 - RNA, 64 nt, hsa
gagaugcagcaacgacgucacgggccaugucgacgucacacauauuaaugucacacagacgcgg

SEQ ID NO: 21885 - RNA, 64 nt, hsa
uccauucuaggcuuucuuaauaaaucuugaggcuaugggauaaucacauuuaaagaaugguucc

SEQ ID NO: 21886 - RNA, 64 nt, hsa
gaaugguuccugaaaugaagucaguagaaauggcaugggauaagagcagagcucacacuuuuac

SEQ ID NO: 21887 - RNA, 64 nt, hsa
aucucuccaucugaggcuccuucacuuucucuccaugggauagggguuggggguacucccuaga

SEQ ID NO: 21888 - RNA, 64 nt, hsa
ccuggccaggccgcaccccuugcugucucagcagaugggauauaggaagcuccugggcuuagcu

SEQ ID NO: 21889 - RNA, 64 nt, hsa
cagcuucaucuuuaccuugccagaguugacaauuaugggauacucuagucuacuuauacuugug

SEQ ID NO: 21890 - RNA, 64 nt, hsa
uugauuugggugcuguaaggcaauuugcuaggacaugggauaaucagauuacacaaaaucuagg

SEQ ID NO: 21891 - RNA, 64 nt, hsa
aagaacugccauaaacacuacacagauggagggcaugggauaggacaggagaggaggugaugua

SEQ ID NO: 21892 - RNA, 64 nt, hsa
gccaggucuguggauuugccuguuggguguugggaugggauaucagaggaagaagcauacaagu

SEQ ID NO: 21893 - RNA, 64 nt, hsa
aagacauuuaugggauaucuuauuuggcuuaucuaugggauaugaguaacuauguuuuaccugc

SEQ ID NO: 21894 - RNA, 64 nt, hsa
cuaaccauuauaguuuauaaguuuuaagacauuuaugggauaucuuauuuggcuuaucuauggg

SEQ ID NO: 21895 - RNA, 64 nt, hsa
ccaaaucuguguucuuuccacugacaaaugagauaugggauauggugcaucuuuacaguacuau

SEQ ID NO: 21896 - RNA, 64 nt, hsa
guguacauguuauauuuauuuugaaaccaguuuaaugggauacaaccagcauuuuaaaaaauga

SEQ ID NO: 21897 - RNA, 64 nt, hsa
gucccaaacaucaauuucuuaacaugagcuccaguuuaccuaaauguucacugacacaaaggau

SEQ ID NO: 21898 - RNA, 64 nt, hsa
auuuucuucccgucugccugccuucuuucuuuucuuuaccuacucucauuccucucuuuucuca

SEQ ID NO: 21899 - RNA, 64 nt, hsa
ccauuagcauagaaaaacuguucucaguuuuauuuuuaccuaacacuaacaugaguaaccuaag

SEQ ID NO: 21900 - RNA, 64 nt, hsa
gcugacccccuauccagaaucacaugcacaaguuuuuaccuagccaguuguuucugaggaccag

SEQ ID NO: 21901 - RNA, 64 nt, hsa
ugaacuagaacaaauaggaauauuuucauggaauuuuaccuauuuuuauaauuauuauuucuua

SEQ ID NO: 21902 - RNA, 64 nt, hsa
acuuuagcaaaauguuuucauauaaucucaucuguuuaccuagaagauagguuaaggaaauaua

SEQ ID NO: 21903 - RNA, 64 nt, hsa
ccauacaucuucugaaaacuaggcggagguuuccaaaucucaauucuugacuucugugcaccug

SEQ ID NO: 21904 - RNA, 64 nt, hsa
agccaaaccauaucauucuaccccuggccccuccaaaucucauguccucacuauucaaaaccaa

SEQ ID NO: 21905 - RNA, 64 nt, hsa
uuuuuaucauauacuguaauucaaaaauuuaccuaaaucucaauguaaaauucuuuuuuuucuu

SEQ ID NO: 21906 - RNA, 64 nt, hsa
uuaacuaccuuuauuuaaaaauaagucaauaugaaaaucucaguuggagugaauuauuugcuaa

SEQ ID NO: 21907 - RNA, 64 nt, hsa
ccaccuaaaauugucauugguacaaauuuuuauaaaaucucauuuaccaucacuaaauaauauc

SEQ ID NO: 21908 - RNA, 64 nt, hsa
uacacuagugccaggucacuauuguaagauguuaaaaucucaagaaaauuucacagagcuaaag

SEQ ID NO: 21909 - RNA, 64 nt, hsa
aaauaacuuauuuauaaauaauuuuuaaagagaaaaaucucauauaauuugucauaaccuuuca

SEQ ID NO: 21910 - RNA, 64 nt, hsa
cuguuaaaucauggccugauaucaucuuaaaaaaaaaucucagaaucugaaauaagcccuaaau

SEQ ID NO: 21911 - RNA, 64 nt, hsa
ggauauuuuaauguuggaagaggccuuaaugaucaaaucucacccuuucugcuucugaaguaug

SEQ ID NO: 21912 - RNA, 64 nt, hsa
ccaaagcagcauauuagagcauaggcuugaacuuaaaucucagcucagucaccugcaggacuuu

SEQ ID NO: 21913 - RNA, 64 nt, hsa
aucaucuugauguuuaacaacucuuauuauauuaaaaucucaguauccuaaaacuuagaaccuu

SEQ ID NO: 21914 - RNA, 64 nt, hsa
aaaaaaauuuguuaaaauuuguaaauguucagcuaaaucucagauauacugugggaugaguauc

SEQ ID NO: 21915 - RNA, 64 nt, hsa
uuaauuuaaacaaagguucacuauggaaccagacaaaucucauuagccauguguuaaguauuug

SEQ ID NO: 21916 - RNA, 64 nt, hsa
uuguguaagagaugagauaacaaaggagcgagagaaaucucaugugaauuuccaaguuuuaauu

SEQ ID NO: 21917 - RNA, 64 nt, hsa
cuauuucagugugaugaaucacuguugcuuugaaaaaucucauuauuucugggccgggcauggu

SEQ ID NO: 21918 - RNA, 64 nt, hsa
aaaaaaaagaaaaaaagaaaaaaagaaaaaagaaaaaucucauuauuucaaaaugauagacaua

SEQ ID NO: 21919 - RNA, 64 nt, hsa
aaauagcaagagugugaaaucucagauacuuaugaaaucucacagauguaaggacucaagugua

SEQ ID NO: 21920 - RNA, 64 nt, hsa
uuguguuugacacuaagaaaauagcaagagugugaaaucucagauacuuaugaaaucucacaga

SEQ ID NO: 21921 - RNA, 64 nt, hsa
gaaaaagaucucuugcccauuaagaaguguaucaaaaucucauaaggaaugagggagagaaggg

SEQ ID NO: 21922 - RNA, 64 nt, hsa
agccaaaccauaucauucuaccccuggcaccuccaaaucucauguccucacauuucaaaaccaa

SEQ ID NO: 21923 - RNA, 64 nt, hsa
aacuggugcuuugaaaaucuuuuuuaagggagaaaaaucucaaccaaaguuaugcucauccaga

SEQ ID NO: 21924 - RNA, 64 nt, hsa
uauucgcaacucauaauccguagacuacaagaugaaaucucaauaaauuauuuuugaguuuauu

SEQ ID NO: 21925 - RNA, 64 nt, hsa
uaagccaaccugccuucuguaagucacagugcuuaaaucucaggauuuuucauuaggagagacc

SEQ ID NO: 21926 - RNA, 64 nt, hsa
ggcugauuaagaggcugaacugcaugaaucugcuaaaucucauuauuucuccuuaauauguuac

SEQ ID NO: 21927 - RNA, 64 nt, hsa
guucagagggagucugcuacaaacuaucagggcaaaaucucacuggauuucuccacugaaaacc

SEQ ID NO: 21928 - RNA, 64 nt, hsa
augguauuuuccucaaguagcucauaauacugccaaaucucaaaaguuaagcugaauuucacac

SEQ ID NO: 21929 - RNA, 64 nt, hsa
ggcuagugguauauuuauguaagaaaaugacuguaaaucucaagaaaaaucucagcagcuaaua

SEQ ID NO: 21930 - RNA, 64 nt, hsa
auuuauguaagaaaaugacuguaaaucucaagaaaaaucucagcagcuaauagcaacucauuua

SEQ ID NO: 21931 - RNA, 64 nt, hsa
cuguaguauaaaaaagagguauuaauguuuuaugaaaucucaugcaucaguucauagcauaaaa

SEQ ID NO: 21932 - RNA, 64 nt, hsa
ucagcaucuggauccugauucuccuuuuaagcuaaaaucucaucaaggcuucaauaagaagaug

SEQ ID NO: 21933 - RNA, 64 nt, hsa
guagucauggcggagaagguuucagccagauugcaaaucucagucugaacaagaaaacuccuuc

SEQ ID NO: 21934 - RNA, 64 nt, hsa
ggaacauugaagagcaguacaaaaaccaggggagaaaucucagaaaucauaugguagagagacu

SEQ ID NO: 21935 - RNA, 64 nt, hsa
agaaacaaugaccugauucugucuuuaaaaaaaaaaaucucagaauucuuuuuuuguuuguguu

SEQ ID NO: 21936 - RNA, 64 nt, hsa
gggauuacaggcgugagccaccuugccuggccaaaaaucucagaauucuuuaagacuguuuuaa

SEQ ID NO: 21937 - RNA, 64 nt, hsa; identical to SEQ ID NO: 21897

SEQ ID NO: 21938 - RNA, 64 nt, hsa; identical to SEQ ID NO: 21898

SEQ ID NO: 21939 - RNA, 64 nt, hsa; identical to SEQ ID NO: 21899

SEQ ID NO: 21940 - RNA, 64 nt, hsa; identical to SEQ ID NO: 21900

SEQ ID NO: 21941 - RNA, 64 nt, hsa; identical to SEQ ID NO: 21901

SEQ ID NO: 21942 - RNA, 64 nt, hsa; identical to SEQ ID NO: 21902

SEQ ID NO: 21943 - RNA, 64 nt, hsa; identical to SEQ ID NO: 21903

SEQ ID NO: 21944 - RNA, 64 nt, hsa; identical to SEQ ID NO: 21904

SEQ ID NO: 21945 - RNA, 64 nt, hsa; identical to SEQ ID NO: 21905

SEQ ID NO: 21946 - RNA, 64 nt, hsa; identical to SEQ ID NO: 21906

SEQ ID NO: 21947 - RNA, 64 nt, hsa; identical to SEQ ID NO: 21907

SEQ ID NO: 21948 - RNA, 64 nt, hsa; identical to SEQ ID NO: 21908

SEQ ID NO: 21949 - RNA, 64 nt, hsa; identical to SEQ ID NO: 21909

SEQ ID NO: 21950 - RNA, 64 nt, hsa; identical to SEQ ID NO: 21910

SEQ ID NO: 21951 - RNA, 64 nt, hsa; identical to SEQ ID NO: 21911

SEQ ID NO: 21952 - RNA, 64 nt, hsa; identical to SEQ ID NO: 21912

SEQ ID NO: 21953 - RNA, 64 nt, hsa; identical to SEQ ID NO: 21913

SEQ ID NO: 21954 - RNA, 64 nt, hsa; identical to SEQ ID NO: 21914

SEQ ID NO: 21955 - RNA, 64 nt, hsa; identical to SEQ ID NO: 21915

SEQ ID NO: 21956 - RNA, 64 nt, hsa; identical to SEQ ID NO: 21916

SEQ ID NO: 21957 - RNA, 64 nt, hsa; identical to SEQ ID NO: 21917

SEQ ID NO: 21958 - RNA, 64 nt, hsa; identical to SEQ ID NO: 21918

SEQ ID NO: 21959 - RNA, 64 nt, hsa; identical to SEQ ID NO: 21919

SEQ ID NO: 21960 - RNA, 64 nt, hsa; identical to SEQ ID NO: 21920

SEQ ID NO: 21961 - RNA, 64 nt, hsa; identical to SEQ ID NO: 21921

SEQ ID NO: 21962 - RNA, 64 nt, hsa; identical to SEQ ID NO: 21922

SEQ ID NO: 21963 - RNA, 64 nt, hsa; identical to SEQ ID NO: 21923

SEQ ID NO: 21964 - RNA, 64 nt, hsa; identical to SEQ ID NO: 21924

SEQ ID NO: 21965 - RNA, 64 nt, hsa; identical to SEQ ID NO: 21925

SEQ ID NO: 21966 - RNA, 64 nt, hsa; identical to SEQ ID NO: 21926

SEQ ID NO: 21967 - RNA, 64 nt, hsa; identical to SEQ ID NO: 21927

SEQ ID NO: 21968 - RNA, 64 nt, hsa; identical to SEQ ID NO: 21928

SEQ ID NO: 21969 - RNA, 64 nt, hsa; identical to SEQ ID NO: 21929

SEQ ID NO: 21970 - RNA, 64 nt, hsa; identical to SEQ ID NO: 21930

SEQ ID NO: 21971 - RNA, 64 nt, hsa; identical to SEQ ID NO: 21931

SEQ ID NO: 21972 - RNA, 64 nt, hsa; identical to SEQ ID NO: 21932

SEQ ID NO: 21973 - RNA, 64 nt, hsa; identical to SEQ ID NO: 21933

SEQ ID NO: 21974 - RNA, 64 nt, hsa; identical to SEQ ID NO: 21934

SEQ ID NO: 21975 - RNA, 64 nt, hsa; identical to SEQ ID NO: 21935

SEQ ID NO: 21976 - RNA, 64 nt, hsa; identical to SEQ ID NO: 21936

SEQ ID NO: 21977 - RNA, 64 nt, hsa; identical to SEQ ID NO: 21897

SEQ ID NO: 21978 - RNA, 64 nt, hsa; identical to SEQ ID NO: 21898

SEQ ID NO: 21979 - RNA, 64 nt, hsa; identical to SEQ ID NO: 21899

SEQ ID NO: 21980 - RNA, 64 nt, hsa; identical to SEQ ID NO: 21900

SEQ ID NO: 21981 - RNA, 64 nt, hsa; identical to SEQ ID NO: 21901

SEQ ID NO: 21982 - RNA, 64 nt, hsa; identical to SEQ ID NO: 21902

SEQ ID NO: 21983 - RNA, 64 nt, hsa; identical to SEQ ID NO: 21903

SEQ ID NO: 21984 - RNA, 64 nt, hsa; identical to SEQ ID NO: 21904

SEQ ID NO: 21985 - RNA, 64 nt, hsa; identical to SEQ ID NO: 21905

SEQ ID NO: 21986 - RNA, 64 nt, hsa; identical to SEQ ID NO: 21906

SEQ ID NO: 21987 - RNA, 64 nt, hsa; identical to SEQ ID NO: 21907

SEQ ID NO: 21988 - RNA, 64 nt, hsa; identical to SEQ ID NO: 21908

SEQ ID NO: 21989 - RNA, 64 nt, hsa; identical to SEQ ID NO: 21909

SEQ ID NO: 21990 - RNA, 64 nt, hsa; identical to SEQ ID NO: 21910

SEQ ID NO: 21991 - RNA, 64 nt, hsa; identical to SEQ ID NO: 21911

SEQ ID NO: 21992 - RNA, 64 nt, hsa; identical to SEQ ID NO: 21912

SEQ ID NO: 21993 - RNA, 64 nt, hsa; identical to SEQ ID NO: 21913

SEQ ID NO: 21994 - RNA, 64 nt, hsa; identical to SEQ ID NO: 21914

SEQ ID NO: 21995 - RNA, 64 nt, hsa; identical to SEQ ID NO: 21915

SEQ ID NO: 21996 - RNA, 64 nt, hsa; identical to SEQ ID NO: 21916

SEQ ID NO: 21997 - RNA, 64 nt, hsa; identical to SEQ ID NO: 21917

SEQ ID NO: 21998 - RNA, 64 nt, hsa; identical to SEQ ID NO: 21918

SEQ ID NO: 21999 - RNA, 64 nt, hsa; identical to SEQ ID NO: 21919

SEQ ID NO: 22000 - RNA, 64 nt, hsa; identical to SEQ ID NO: 21920

SEQ ID NO: 22001 - RNA, 64 nt, hsa; identical to SEQ ID NO: 21921

SEQ ID NO: 22002 - RNA, 64 nt, hsa; identical to SEQ ID NO: 21922

SEQ ID NO: 22003 - RNA, 64 nt, hsa; identical to SEQ ID NO: 21923

SEQ ID NO: 22004 - RNA, 64 nt, hsa; identical to SEQ ID NO: 21924

SEQ ID NO: 22005 - RNA, 64 nt, hsa; identical to SEQ ID NO: 21925

SEQ ID NO: 22006 - RNA, 64 nt, hsa; identical to SEQ ID NO: 21926

SEQ ID NO: 22007 - RNA, 64 nt, hsa; identical to SEQ ID NO: 21927

SEQ ID NO: 22008 - RNA, 64 nt, hsa; identical to SEQ ID NO: 21928

SEQ ID NO: 22009 - RNA, 64 nt, hsa; identical to SEQ ID NO: 21929

SEQ ID NO: 22010 - RNA, 64 nt, hsa; identical to SEQ ID NO: 21930

SEQ ID NO: 22011 - RNA, 64 nt, hsa; identical to SEQ ID NO: 21931

SEQ ID NO: 22012 - RNA, 64 nt, hsa; identical to SEQ ID NO: 21932

SEQ ID NO: 22013 - RNA, 64 nt, hsa; identical to SEQ ID NO: 21933

SEQ ID NO: 22014 - RNA, 64 nt, hsa; identical to SEQ ID NO: 21934

SEQ ID NO: 22015 - RNA, 64 nt, hsa; identical to SEQ ID NO: 21935

SEQ ID NO: 22016 - RNA, 64 nt, hsa; identical to SEQ ID NO: 21936

SEQ ID NO: 22017 - RNA, 64 nt, hsa
uggggcuggguggggggagaagaccgacuaacagcugaaguaaugacagauuguugcuggguca

SEQ ID NO: 22018 - RNA, 64 nt, hsa
agaggaaaaagaaaaacauuuccucuuauaacuucugaaguaauuuguaaaaaagauuuguaga

SEQ ID NO: 22019 - RNA, 64 nt, hsa
ccauaaaaccugggaaggauuuucugaccuuccccugaaguagaucauaagacugucauguaag

SEQ ID NO: 22020 - RNA, 64 nt, hsa
uggcucaugccuguaaucccaacacuuugggaggcugaaguaggaggaucgucuugagcccagg

SEQ ID NO: 22021 - RNA, 64 nt, hsa
cugcuuuuugucagugaaauagacaucuugccuccugaaguagcuucaucacagagugucauga

SEQ ID NO: 22022 - RNA, 64 nt, hsa
agacauuuauauuaugaaauauguaccuuuguuccugaaguaaccgccaguggucuuuaaacua

SEQ ID NO: 22023 - RNA, 64 nt, hsa
cuagagauuuguggggggauacugaaccucuagacugaaguacuuaccggggagcacaguggac

SEQ ID NO: 22024 - RNA, 64 nt, hsa
acacaguuuaaccauaggccaauuuuaggggccucugaaguaucuuucuacaaacgcagacaag

SEQ ID NO: 22025 - RNA, 64 nt, hsa
ccggccauguuugaaugccaguuucucuucuuugcugaaguacuuuaugauaaaaguaagccua

SEQ ID NO: 22026 - RNA, 64 nt, hsa
cugccuaaggugugaaaagcugaagauucuaccacugaaguacugaauauguugucuaguugug

SEQ ID NO: 22027 - RNA, 64 nt, hsa
uuggaaaugcaaauaagugaagccucccaagggacugaaguauacauuuaguuaacacacauau

SEQ ID NO: 22028 - RNA, 64 nt, hsa
aacagaugauccauuugaacaguuggcuguaugacugaaguaauaacugaugagauacauuuga

SEQ ID NO: 22029 - RNA, 64 nt, hsa
aguggaauuugcuacugacucauuggacugaaagcugaaguaccuggcaaaaaaaaaaaaaaga

SEQ ID NO: 22030 - RNA, 64 nt, hsa
gauguguuaaggugcuucaaaggaacucugaccucugaaguacuugagcuacuuuaguaugucc

SEQ ID NO: 22031 - RNA, 64 nt, hsa
uugacauuuccuaccuuuugaggacuugauccuucuccaggaagaaggugcuuucugcuuacug

SEQ ID NO: 22032 - RNA, 64 nt, hsa
ggagggggaggcgccaagguggaggagcuucccacuccaggacuguugaugaaagggacagauu

SEQ ID NO: 22033 - RNA, 64 nt, hsa
uccacggcucuagguggggcgggaaagccagugacuccaggagaggagcgggaccuguggcucu

SEQ ID NO: 22034 - RNA, 64 nt, hsa
uguggcucuacaacugaguccuuaaacagggcaucuccaggaaggcggggcuucaaccuugaga

SEQ ID NO: 22035 - RNA, 64 nt, hsa
cccagaaggaacccggucccaggccgcauggccccuccaggaacauucccacauaauacauucc

SEQ ID NO: 22036 - RNA, 64 nt, hsa
ggcuccaggcuccaggcugacugggggccucugccuccaggagggcaucagcuuucccuggcuc

SEQ ID NO: 22037 - RNA, 64 nt, hsa
gguaaaggagcuucguugcgaacuugaucagcuucuccaggauaaaauuaaaaacccaagcauu

SEQ ID NO: 22038 - RNA, 64 nt, hsa
agaaguggaagaagaccuaaggcucucccuucaccuccaggaucaggauucugucaaagaugca

SEQ ID NO: 22039 - RNA, 64 nt, hsa
aggggaggaagaauuccugccaugccccagccuucuccaggacaaccugcuggaacgcaguggu

SEQ ID NO: 22040 - RNA, 64 nt, hsa
agccacauggcgcaugaaggagagcccagucucccuccaggaaaggccugaggauguaagucag

SEQ ID NO: 22041 - RNA, 64 nt, hsa
aaugcaugcccagucagaaaucuguucuauucugcuccaggaaaaucggaaaccugugagucag

SEQ ID NO: 22042 - RNA, 64 nt, hsa
ggauagauugcuucagcaaagugaacugugagaucuccaggacagagggagaaagaucugaucc

SEQ ID NO: 22043 - RNA, 64 nt, hsa
ccaggauggucucgaucuccaggauggucucgaucuccaggauggucucgaucuccugacgucg

SEQ ID NO: 22044 - RNA, 64 nt, hsa
gggguuucacuguguuagccaggauggucucgaucuccaggauggucucgaucuccaggauggu

SEQ ID NO: 22045 - RNA, 64 nt, hsa
cagaggaccgguugcagcuuacccagaaccacuccuccaggagagcuggauguuuugcgugcaa

SEQ ID NO: 22046 - RNA, 64 nt, hsa
uugcccacuucccacugcucagcccacaccagaccuccaggagacauccccccuugaggcagag

SEQ ID NO: 22047 - RNA, 64 nt, hsa
gagggauggggggcacaggagcugggagccccgucuccaggaaaaggagagggguuaagaugca

SEQ ID NO: 22048 - RNA, 64 nt, hsa
gcagugcccgcgccauggggugcucugugggcuucuccaggagcagggaggguggaggggaggg

SEQ ID NO: 22049 - RNA, 64 nt, hsa
cgaugucugagcagaaucaguguuugggucaccccuccaggaaugaucucuucuuuuggcuucc

SEQ ID NO: 22050 - RNA, 64 nt, hsa
augguuauuuucuuuucuuucaacuugcauccaacuccaggauagugggcaccccacugcaauc

SEQ ID NO: 22051 - RNA, 64 nt, hsa
gacccagggagaacccacugcuuuucccaggaggcuccaggauuaggaaauguguguauuuagu

SEQ ID NO: 22052 - RNA, 64 nt, hsa
guguguuccccauguguguguacaacacuggugacuccaggaaccauuuucaccuauuaccagu

SEQ ID NO: 22053 - RNA, 64 nt, hsa
gaucggggcuuucagccccacccugaugccugcccuccaggauggcugguuuagucugggucca

SEQ ID NO: 22054 - RNA, 64 nt, hsa
agucuggguccaugucccagaccccucuauucugcuccaggacagcaggacuucaggucuuccu

SEQ ID NO: 22055 - RNA, 64 nt, hsa
caccuguagcccugagguucuuuucccaggauggcuccaggauaaggaucacuguaggugguug

SEQ ID NO: 22056 - RNA, 64 nt, hsa
acagggauauuuuuaaucccguuauggacucugucuccaggagaggggucuauccaccccugcu

SEQ ID NO: 22057 - RNA, 64 nt, hsa
gucugcuuuccaccgaguacuguguuuauucucucuccaggaaagcagaucaaaagaaaguuag

SEQ ID NO: 22058 - RNA, 64 nt, hsa
gggauggguaauaggugagaguagaaacccuucccuccaggaggcccccgcugacucccacaga

SEQ ID NO: 22059 - RNA, 64 nt, hsa
uguucuagcugagagggccuggcccuggggugggcuccaggaaaacgcugguuaggccugggau

SEQ ID NO: 22060 - RNA, 64 nt, hsa
ccugggggcggccauguuguccaggcccaggccccuccaggacuguggcugccuccccuccacg

SEQ ID NO: 22061 - RNA, 64 nt, hsa
cguacacuugcucaaccuggaccagccccccagccuccaggaccagacacagaagaaguucgug

SEQ ID NO: 22062 - RNA, 64 nt, hsa
cugugagcagcugcgggcgcagcagcggaguucgcuccaggagaaggcugcgcacccacacccg

SEQ ID NO: 22063 - RNA, 64 nt, hsa
cuuucuaggacugugccucccugcuugaccuaugcuccaggacccugcccucaacccuugucag

SEQ ID NO: 22064 - RNA, 64 nt, hsa
uccugcuguggcuugggugccgggcgucucccgccuccaggaucuccucucaccugcccccauu

SEQ ID NO: 22065 - RNA, 64 nt, hsa
auugaguguaaagaugggaagagaacugggcugacuccaggaccuccaggaugaggcagaggca

SEQ ID NO: 22066 - RNA, 64 nt, hsa
aaagaugggaagagaacugggcugacuccaggaccuccaggaugaggcagaggcaugaugcuuc

SEQ ID NO: 22067 - RNA, 64 nt, hsa
gcaugaugcuuccugcucaccugggccacccucucuccaggacuugucagcuggugguucagcc

SEQ ID NO: 22068 - RNA, 52 nt, hsa
ugaugcucucccgccacugaggcuccaggagggaauaucuguugccccugcg

SEQ ID NO: 22069 - RNA, 64 nt, hsa
agccagacccaggcugcaggccucccccaggagccuccaggauggagauggagacccagcagcc

SEQ ID NO: 22070 - RNA, 64 nt, hsa
ccuugccucuuagcauguuugauuuaagaaaagccuccaggaaaucuugagagccugucuuggc

SEQ ID NO: 22071 - RNA, 64 nt, hsa
cuugcagcuccccagucucuaccugucaggaugacuccaggaagacagcuggaguacugcauuu

SEQ ID NO: 22072 - RNA, 64 nt, hsa
accagcagagcggaguucuuuauaccgggaccuccuccaggagaaccccggagcuccuucuagc

SEQ ID NO: 22073 - RNA, 64 nt, hsa
ggcuccgagccugcccccagagacgucccugccccuccaggaccugacagccccucccauccug

SEQ ID NO: 22074 - RNA, 64 nt, hsa
ccagcagaagccugggguaccuagucaccaggaucuccaggacucccagggagcagagucuucu

SEQ ID NO: 22075 - RNA, 64 nt, hsa
gggaggaggaggagugugcucugcacuugccuugcuccaggaugggguggcagcagaggaaugu

SEQ ID NO: 22076 - RNA, 64 nt, hsa
aaaccucacuuucagagagauguggguccuuugucuccaggauccacacccuagauuuuaacac

SEQ ID NO: 22077 - RNA, 64 nt, hsa
uuucuguuacauccaccuuugaggcuggucauaccuccaggaacaauacagagccagucaacuu

SEQ ID NO: 22078 - RNA, 64 nt, hsa
ucaccugagcgcaccaccaccuggcguguagaaucuccaggaagccuggcugcagcuucccauu

SEQ ID NO: 22079 - RNA, 64 nt, hsa
uucccuuuauuugcuucccccuccuccccucggccuccaggaagccaccguggccggccaagca

SEQ ID NO: 22080 - RNA, 64 nt, hsa
uuauuuaugaaggcccugggagcagcguuaagggcuccaggauccagcucucuuugcauuuggu

SEQ ID NO: 22081 - RNA, 64 nt, hsa
ugaucugaugauuuauuuaaagagccguugaugccuccaggaaacuuaaguauuuuauuaauau

SEQ ID NO: 22082 - RNA, 64 nt, hsa
cuaaagcuaguuaaugucagugacauuaaacuaacuccaggauucaggaguuuuaauguuagaa

SEQ ID NO: 22083 - RNA, 53 nt, hsa
cccacuaccgcuggugguagagucuccaggaggagcccagggcccucugccgc

SEQ ID NO: 22084 - RNA, 64 nt, hsa
uuguaaagagggagcacauugacuugggaauuuccuccaggaaacucagggcuguuuucucuuc

SEQ ID NO: 22085 - RNA, 64 nt, hsa
aguuucuuccccgaguggagcuucgacccacccacuccaggaacccagagccacauuagaaguu

SEQ ID NO: 22086 - RNA, 64 nt, hsa
aacagauuuaaagacagguggccacugacagccacuccaggaacuugaacugcaggggcagagc

SEQ ID NO: 22087 - RNA, 64 nt, hsa
auugauuacaaguucucugcugugguugcugcagcuccaggaaguccccgcaaugucucacguu

SEQ ID NO: 22088 - RNA, 64 nt, hsa
caccaagccugugucucccucuucuaucaccucucuccaggaucucugcugucucuuggauccc

SEQ ID NO: 22089 - RNA, 64 nt, hsa
cuuguuugccaggucucuagcaucuccagcaggacuccaggaugguucagcccagcaccaucca

SEQ ID NO: 22090 - RNA, 64 nt, hsa
agagagugacagcugcucaggcccuaacccuuggcuccaggagacacagggcccagcacccagg

SEQ ID NO: 22091 - RNA, 64 nt, hsa
uugagacgcaucccaggaggugacgaggcaggggcuccaggaaaggaaucagagacaauucaca

SEQ ID NO: 22092 - RNA, 64 nt, hsa
uuuuggauguguaucaguauuuuuguuuuuaauaaugauugauuuguggagcauuguuuuuuca

SEQ ID NO: 22093 - RNA, 64 nt, hsa
gaagauacaaauauaugguagcuauuguuuaaaaaugauugauuuacuugcagauuuuucagag

SEQ ID NO: 22094 - RNA, 64 nt, hsa
uaauauaauucuggugaaguaauaguuucaguggaugauugaaaacaacaacaacaaaaacaaa

SEQ ID NO: 22095 - RNA, 64 nt, hsa
cuuuguguggaaauguuauaucugggguacuuacaugauugagguugacuauaugagguacugu

SEQ ID NO: 22096 - RNA, 64 nt, hsa
uuugcauacaucagaagcuagguacauaaguuaaaugauugagaguuggcuguauuuagauuua

SEQ ID NO: 22097 - RNA, 64 nt, hsa
cuccuguaguccugccucguacuccccuuccccuaugauugaaaaguaaacaaaacccacauuu

SEQ ID NO: 22098 - RNA, 64 nt, hsa
ggugacagaaugagacccugucucaaaaaaaaaaaugauugaaauuaaaauucagcuuuagcuu

SEQ ID NO: 22099 - RNA, 64 nt, hsa
uuggaugccugaauuuuaaaagggcuagaaaaaaaugauugaccagccugggaaacauaacaag

SEQ ID NO: 22100 - RNA, 64 nt, hsa
guuuaaguacaaucuuuuuauuugcauuuuauugaugauugauugugguugaaaggagugguga

SEQ ID NO: 22101 - RNA, 64 nt, hsa
cuccagaaguccuagaaacaucucaucauugacuaugauugaauuuuauuuauuaauacuuccc

SEQ ID NO: 22102 - RNA, 64 nt, hsa
aacuuauucuguaaguuggaacuuauuuccaaacaugauugaaaaaaaaccccgcacuuggcaa

SEQ ID NO: 22103 - RNA, 64 nt, hsa
ccaaguaauaauaaaacuauuucagauguauuauaugauugagcaaaugagaaaacauguugau

SEQ ID NO: 22104 - RNA, 64 nt, hsa
uuuuuagaauuuucuacccuuggcaugaggggaaaugauugauauucaagcaaguucucuagga

SEQ ID NO: 22105 - RNA, 64 nt, hsa
caggauugauuucuuuccuaaagucccuagugacaugauugagcaguaaagaacggccaaauca

SEQ ID NO: 22106 - RNA, 64 nt, hsa
ggaugcaguagaggaaaguggugguacaagugccaugauugauuagcaaugucugcacuggaua

SEQ ID NO: 22107 - RNA, 64 nt, hsa
cagaccucuggcugcagaggagucugagacauguaugauugaaugggugccaagugccaggggg

SEQ ID NO: 22108 - RNA, 64 nt, hsa
augguauuuuguuagauuguucaacaggaagcacaugauugagaacaucuugggacagaccaaa

SEQ ID NO: 22109 - RNA, 64 nt, hsa
gaucuauugggggaguguggccacagaccgggggaugauugaauuguucagaaccugauuggac

SEQ ID NO: 22110 - RNA, 64 nt, hsa
gaaacauuguauauuuaguguguguauuuugauaaugauugaucuuaaaucuguauacagaaua

SEQ ID NO: 22111 - RNA, 64 nt, hsa
cacugagugcugugcugcucgacgugagggugaaaugauugacuugugaccugccagguugccc

SEQ ID NO: 22112 - RNA, 64 nt, hsa
uguaccacuuccaaacuuuucagcguuggauaaaaugauugaugaggcaggcagaaggaaugua

SEQ ID NO: 22113 - RNA, 64 nt, hsa
aguuaauagguuuaguagcuuuuauggacuaaaaaugauugauuguaucuugacccuggucuca

SEQ ID NO: 22114 - RNA, 64 nt, hsa
aaagcagggacugccacugcauuucauaucacacuguuaaaaguuguguuuugaaauuuuaugu

SEQ ID NO: 22115 - RNA, 64 nt, hsa
uugcucauuuuuuaaaaaauggacucuugaaaucuguuaaaauaaaauuguacauuuggagaug

SEQ ID NO: 22116 - RNA, 64 nt, hsa
aacaagaaaacauaagagagccuugguucaucaguguuaaaaaauuuuugaaaaggcgguacua

SEQ ID NO: 22117 - RNA, 64 nt, hsa
cuaguucagacacuuuggaaguuuguguucuguuuguuaaaacuggcaucugacacaaaaaaag

SEQ ID NO: 22118 - RNA, 64 nt, hsa
uaaacaaaaaauaaaaugaacaucucuugaaaccuguuaaaacaaccaguuaaagccacagaug

SEQ ID NO: 22119 - RNA, 64 nt, hsa
uuauuuuucuguggguuuuguguugucuuuuuuauguuaaaaagaaauccaguuuguguuuuuc

SEQ ID NO: 22120 - RNA, 64 nt, hsa
uuuaagugggguugauaacaccuuggacuguuaguguuaaaaaucuaguggguugaccuuuaaa

SEQ ID NO: 22121 - RNA, 64 nt, hsa
uauguuuaacuggauuacauagauuuuuaucuuuuguuaaaauguguauaccccguggaccaac

SEQ ID NO: 22122 - RNA, 64 nt, hsa
gagaagagaccugccagauuaucagaccucuucauguuaaaagaccaucuccuguaaaacugac

SEQ ID NO: 22123 - RNA, 64 nt, hsa
ucugauuccugugauaacuuaaaaggcucuuuuauguuaaaagagaggugaaucuucuuugaca

SEQ ID NO: 22124 - RNA, 64 nt, hsa
uucacuuuaguuucucacagaaucauugcaauuauguuaaaagaaaucucuacauaaaucguau

SEQ ID NO: 22125 - RNA, 64 nt, hsa
uuuucaccaagaguauaaaccuuuuuagugugacuguuaaaacuuccuuuuaaaucaaaaugcc

SEQ ID NO: 22126 - RNA, 64 nt, hsa
cuguaaaaucaguagaaauuuuacuacaauugcuuguuaaaauauuuuauaagugauguuccuu

SEQ ID NO: 22127 - RNA, 64 nt, hsa
gaaauauauuugacacacacauucacauauaaauuguuaaaaacugaaggcagaauggaacuaa

SEQ ID NO: 22128 - RNA, 64 nt, hsa
guaugcguacauaguuuaccagguaguagaaguguguuaaaauguuccuguaaaagaaacauug

SEQ ID NO: 22129 - RNA, 64 nt, hsa
uucacugccaugacacuaggcaaaaaauauuuccuguuaaaagaaagagaaaaagagagggaua

SEQ ID NO: 22130 - RNA, 64 nt, hsa
cugguuuuauaagugaccguauauuguaaagagcuguuaaaaaguauuauagaccuauucaugu

SEQ ID NO: 22131 - RNA, 64 nt, hsa
gguaguaaaaugacacauuuuguaaauaacuuuuuguuaaaauucauaggaaauguuauuuugu

SEQ ID NO: 22132 - RNA, 64 nt, hsa
uguuucuucuagauguucugaaguaccugauacauguuaaaauuagagguaguaaaaugacaca

SEQ ID NO: 22133 - RNA, 64 nt, hsa
uuucuuaucugugugucugacgugccaucuuuaauguuaaaauuaagguguuaaaauuaagccu

SEQ ID NO: 22134 - RNA, 64 nt, hsa
gucugacgugccaucuuuaauguuaaaauuaagguguuaaaauuaagccuaguuauauagacga

SEQ ID NO: 22135 - RNA, 64 nt, hsa
ccaucccuuugggccuguacaaagaaauucuggauguuaaaauaauauauacucaucacagaaa

SEQ ID NO: 22136 - RNA, 64 nt, hsa
guauucuugacaguuagaauauugguagggacuuuguuaaaauucacuugaauuucaagcucag

SEQ ID NO: 22137 - RNA, 64 nt, hsa
aaaauguagccacauuuuuuaugggaagacuuuguguuaaaagugaacauuuugaagguuuuua

SEQ ID NO: 22138 - RNA, 64 nt, hsa
acauuauaacugauuguugugaauggggugaauuuguuaaaaugaguaacuuugauaaaguuuu

SEQ ID NO: 22139 - RNA, 64 nt, hsa
gucacugauaguauguauuucuuuaguaagaauguguuaaaauuacaaugaucuuuuaaaaaga

SEQ ID NO: 22140 - RNA, 64 nt, hsa
uugccuccuuauccuugagauuucacuaccuuuauguuaaaaguuguguauaauuguuaaaauc

SEQ ID NO: 22141 - RNA, 64 nt, hsa
uuucacuaccuuuauguuaaaaguuguguauaauuguuaaaaucugugaaagaauaaaaagugg

SEQ ID NO: 22142 - RNA, 64 nt, hsa
guuaguuacauuauagaauauuacuuauuuuucuuguuaaaauguaguuuuucauuuccuacau

SEQ ID NO: 22143 - RNA, 64 nt, hsa
aauaaaauuuauuuucuacuguauccauuucaaauguuaaaauauuguuuaauauuuuugaaau

SEQ ID NO: 22144 - RNA, 64 nt, hsa
uugaauaaauucaguugcuaaaguagauccaaaguguuaaaaaugcugaagucaugucaaguac

SEQ ID NO: 22145 - RNA, 64 nt, hsa
aaagggaaccgagauuuaauuuggagaucaucacuguuaaaacgauaccagacauuugucacag

SEQ ID NO: 22146 - RNA, 64 nt, hsa
uuugugugaaugugaaugauacugaucuuauaucuguuaaaaguuguuuuaaaaagcuguggca

SEQ ID NO: 22147 - RNA, 64 nt, hsa
aauguccuccucuaagaccauauuguaagagucuuguuaaaaugauggauucaacuucugccuc

SEQ ID NO: 22148 - RNA, 64 nt, hsa
uguaagaaaauuugaaguaaaggauugaucacuuuguuaaaaauauuuucugaauuauuauguc

SEQ ID NO: 22149 - RNA, 64 nt, hsa
uuaaaggagauauggcuaguggcaauaaguuccauguuaaaauagacaacucuuccauuuauug

SEQ ID NO: 22150 - RNA, 64 nt, hsa
uuaaauugguggguuguauaaggguagcuuuuguuguuaaaaaaacaguagagaguuaaguucc

SEQ ID NO: 22151 - RNA, 64 nt, hsa
uccuauaaauugugauuguuuauucuauuacuauuguuaaaaacuugaaugguauuuauauugg

SEQ ID NO: 22152 - RNA, 64 nt, hsa
auauugugaauguauacuaaaaaaacauuuuaaauguuaaaauuauaauuucagauucauauaa

SEQ ID NO: 22153 - RNA, 64 nt, hsa
cauuaaaauaauaguggugaauuauauguuauuguguuaaaaccucacuugccaaauucuggcu

SEQ ID NO: 22154 - RNA, 64 nt, hsa
uucuuugaaacugaauuaacuugggaauauuuguuguuaaaaacuucuuuuugcccaaaauaac

SEQ ID NO: 22155 - RNA, 64 nt, hsa
uuaucugaaaauauauaauuucuggucauguguauguuaaaauagaaaauuuugaggaaaaaug

SEQ ID NO: 22156 - RNA, 64 nt, hsa
gacuuguauaccuuguaauuugaaauauuuucuuuguuaaaauagaaugguaucaauaaauaga

SEQ ID NO: 22157 - RNA, 64 nt, hsa
uacauaagagaccacuucaccaauaaguauucuguguuaaaaauguucuauuuuaauuauaccg

SEQ ID NO: 22158 - RNA, 64 nt, hsa
uguaaaaaaaaguauauauacauaucuuuugaaguguuaaaaggaaacuaguacuuuauauucu

SEQ ID NO: 22159 - RNA, 64 nt, hsa
cacugacagauucuaaauauuuugugagaagaaauguuaaaaauuuuuagcuugacagguuucu

SEQ ID NO: 22160 - RNA, 64 nt, hsa
aaaguuuuuuauauaugaauauuacauguaaagcuguuaaaauacauaacuucagugcaagaga

SEQ ID NO: 22161 - RNA, 64 nt, hsa
gccauuuguuacaguuucuucaugcauuacuuacuguuaaaacuguaccuuuugcgauuucaca

SEQ ID NO: 22162 - RNA, 64 nt, hsa
uagcuggccaucugaauacucccccaucacuaauuguuaaaaaaagaaucaacuguucuuacuc

SEQ ID NO: 22163 - RNA, 64 nt, hsa
aaauuuagcuuacaucagaaucacuuggaaggcuuguuaaaacccaaggcugcuaggcccaccc

SEQ ID NO: 22164 - RNA, 64 nt, hsa
aauacuuugaaagacaaagaacuuagacuaagcauguuaaaauuauuacuuuguuuuccuugug

SEQ ID NO: 22165 - RNA, 64 nt, hsa
cauuaugucuuaagcuguuagucuuaaagauuauuguuaaaaaauucagaagaaaagagagaca

SEQ ID NO: 22166 - RNA, 64 nt, hsa
aguucauagauuuuaaaaguaaaauacuucugacuguuaaaacuauauaaagaaaaucucauuu

SEQ ID NO: 22167 - RNA, 64 nt, hsa
aaucucauuugucuaauugcaauuaaaagaaaaauguuaaaauauuaaaaugaaaauaaaagca

SEQ ID NO: 22168 - RNA, 64 nt, hsa
ucccaugaguaugcaaaucaauaguuuuaaccauuguuaaaaugcaaucauagugacuucagaa

SEQ ID NO: 22169 - RNA, 64 nt, hsa
aauucuaaguugccaacuggcaaagaaagucuaauguuaaaaacaacuuugccuuugaaacguu

SEQ ID NO: 22170 - RNA, 64 nt, hsa
ucuuuuuuguuauuguuaugccaccauaccauuuuguuaaaauguuuucuuugugaaacauuug

SEQ ID NO: 22171 - RNA, 64 nt, hsa
agcauuugguagucugaaauggugacagauuacuuguuaaaauugugaaaacucuguugugucc

SEQ ID NO: 22172 - RNA, 64 nt, hsa
aagaguuuaagggcuaauaauuuaauuuguuguuuguuaaaaauuaaaaucuccguucuuuccg

SEQ ID NO: 22173 - RNA, 64 nt, hsa
gauguaugcacagaccugucuguaugcugaacuuuguuaaaaauaucugccaguuauuaaaaag

SEQ ID NO: 22174 - RNA, 64 nt, hsa
aguccuacauuuaagaauagagcuaugcaaacucuguuaaaaacuaugaggaaaacuuauauua

SEQ ID NO: 22175 - RNA, 64 nt, hsa
aauacuuuuuaaguccugagugcuuacagguaguuguuaaaaaaauuuuaaggccaggcauggu

SEQ ID NO: 22176 - RNA, 64 nt, hsa
uauauaaaauaauccuuuaauauccaaaugaaucuguuaaaauguuugauuccuugggaauggc

SEQ ID NO: 22177 - RNA, 64 nt, hsa
gguuaagcauggacagccagagcuuucuauguacuguuaaaauugaggucacauauuuucuuuu

SEQ ID NO: 22178 - RNA, 64 nt, hsa
ccaaguaagguucucaaauguagaaaauuauaaauguuaaaaggaaguuauugaagaaaauaaa

SEQ ID NO: 22179 - RNA, 64 nt, hsa
acucuaugguauuuuucuuauucuuguuugaucauguuaaaaauuggaccuaauaaaaguauuu

SEQ ID NO: 22180 - RNA, 64 nt, hsa
uauguaccagaaccaaauaaguauauuuagaacuuguuaaaaauacauuuuaauuuaugauaua

SEQ ID NO: 22181 - RNA, 64 nt, hsa
uuuaauuuaugauauacauauuauuuuaauuacuuguuaaaauuuugaguuaaguugcauuucu

SEQ ID NO: 22182 - RNA, 64 nt, hsa
gauguauacaaguaccuuuauaguuaucgaucacuguuaaaacuuucauuuuaaaauccuauua

SEQ ID NO: 22183 - RNA, 64 nt, hsa
ucaaauacauggaggcacaucuucagggcaccaguguuaaaauuuuggagucuuaauuuucaug

SEQ ID NO: 22184 - RNA, 64 nt, hsa; identical to SEQ ID NO: 22133

SEQ ID NO: 22185 - RNA, 64 nt, hsa; identical to SEQ ID NO: 22134

SEQ ID NO: 22186 - RNA, 64 nt, hsa; identical to SEQ ID NO: 22134

SEQ ID NO: 22187 - RNA, 64 nt, hsa; identical to SEQ ID NO: 22133

SEQ ID NO: 22188 - RNA, 64 nt, hsa
gcaaauaaugaguuugaaaagaaacaaugaaauguguuaaaaauuugaccauauuagauaaauu

SEQ ID NO: 22189 - RNA, 64 nt, hsa
aaagacuggugaaucuuuuauuacaaaauguuucuguuaaaaugggaucaucaucuuugaaagg

SEQ ID NO: 22190 - RNA, 64 nt, hsa
gccuuugcuagugcaguguauuuuuucaaggugcuguuaaaagaaagucauguugucguuuacu

SEQ ID NO: 22191 - RNA, 64 nt, hsa
gaacaaggagaauuuucaaugaaauacuugauucuguuaaaaugcagaggugcuauaacauuca

SEQ ID NO: 22192 - RNA, 64 nt, hsa
acagauuuuuagcacaaaaauagccauuguaaaguguuaaaauuuacgauaaguauucuauugg

SEQ ID NO: 22193 - RNA, 64 nt, hsa
ccucaccaauuugcccgucuuuaauaaaaucuuguguuaaaauuugcaucacgucgccuuccua

SEQ ID NO: 22194 - RNA, 64 nt, hsa
cagugugcuugccuucccucaggccucucccaucuguuaaaacuuguuuugugauccggcucuc

SEQ ID NO: 22195 - RNA, 64 nt, hsa
auugucaaggccaugacuguuguuuuaguaaacuuguuaaaaucagaugaugucagaguugugu

SEQ ID NO: 22196 - RNA, 64 nt, hsa
caaguaaaugcuuguuuuuguaguaguuuguucuuguuaaaaauguuuauaugauaaugucugu

SEQ ID NO: 22197 - RNA, 64 nt, hsa
aaagaguacccaaauucuaggacaaugcuuaaaguguuaaaauacccuagauacuguguuaugu

SEQ ID NO: 22198 - RNA, 64 nt, hsa
guauucacugcacauaugaugaaaucaucagaauuguuaaaacuuuugccaguggaauggauaa

SEQ ID NO: 22199 - RNA, 64 nt, hsa
ggguaacuugccagcccaagauaaauacuuuaauuguuaaaagucagaagagacagaauaugua

SEQ ID NO: 22200 - RNA, 64 nt, hsa
gauuuuuguaaauguuaaaacaucuauauuuaaauguuaaaacacuaaauauagagaggggcuu

SEQ ID NO: 22201 - RNA, 64 nt, hsa
guugugacuucuauauucaauagauuuuuguaaauguuaaaacaucuauauuuaaauguuaaaa

SEQ ID NO: 22202 - RNA, 64 nt, hsa
uggcauuuuauaauauuauguguguacuucacaguguuaaaaauacccucauacguuauugcau

SEQ ID NO: 22203 - RNA, 64 nt, hsa
gacaaggauaugcaugauucuuaaccaggcuauauguuaaaaaaaaauuggaaaaugcaauaca

SEQ ID NO: 22204 - RNA, 64 nt, hsa
uccuuuuaucuacauguaauuggacauguaaacuuguuaaaaaucaaaaucuuacugauuguac

SEQ ID NO: 22205 - RNA, 64 nt, hsa
uuggaaacagucaaguguacuucacacuacuagauguuaaaacuauaugauuauuggcauauac

SEQ ID NO: 22206 - RNA, 64 nt, hsa
uauucuuagcuguauauacauuuuuuuaaaaguuuguuaaaauaugcuugacuagaguuuccag

SEQ ID NO: 22207 - RNA, 64 nt, hsa
ucagugaagcuauccaaauaacuggccaacuaguuguuaaaagcuaacagcucaaucucuuaaa

SEQ ID NO: 22208 - RNA, 64 nt, hsa
guaggaaugugagcaggauggugauggggguuuuuguuaaaaugcaucugagcaagucagccag

SEQ ID NO: 22209 - RNA, 64 nt, hsa
uucucucucucucucuuuuuuuuuuuuuuguuguuguuaaaaagggccuacuacauuggcgcua

SEQ ID NO: 22210 - RNA, 64 nt, hsa
cuuuuauuuuacuguuuucuuuuuagaaacccacuguuaaaauuuaaaaaggugcuuuaaaaua

SEQ ID NO: 22211 - RNA, 64 nt, hsa
uugcuggauuugcuaccuuugguuacuugugcaguguuaaaaguaauccacuuucuuguuuaau

SEQ ID NO: 22212 - RNA, 64 nt, hsa
uaaugugguagcaccuguaacuguguucuuguucuguuaaaaggauugauuugcuuuuauaguc

SEQ ID NO: 22213 - RNA, 64 nt, hsa
ucaagucaguugauuuuuuuucuauuaaaacuguuguuaaaauauuuuuuaaaacaaaaacauu

SEQ ID NO: 22214 - RNA, 64 nt, hsa
uguucauuaaagaggcaacuacagccaaaaucacuguuaaaaucuuacuacuucauggaguagc

SEQ ID NO: 22215 - RNA, 64 nt, hsa
uugaaaaccagcuguaaguugugcauugagauuauguuaaaagccuuggcuuaagaauuugaaa

SEQ ID NO: 22216 - RNA, 64 nt, hsa
acucuuucaaaugcaaaaaaccuauuuuaugcuuuguuaaaauuauggugucacuuagauugac

SEQ ID NO: 22217 - RNA, 64 nt, hsa
agauaaauucuaaggagguuucuaauuuuguaauuguuaaaaauagaguuaauuuugacuuugu

SEQ ID NO: 22218 - RNA, 64 nt, hsa
aaaccagaaauccuggaauuagaggguuuaauauuguuaaaaaaugcauaccaaaugaagacug

SEQ ID NO: 22219 - RNA, 64 nt, hsa
agaauuacuaguucagaauuggcauagauucugguguuaaaauagacuggaucuguauuaucug

SEQ ID NO: 22220 - RNA, 64 nt, hsa
aauguuauugacuuuuguaacuuacuaauagggauguuaaaaguaacaaaaccaagucaaacuu

SEQ ID NO: 22221 - RNA, 64 nt, hsa
gaaaaaugauauauaguuauguugucuuuuauaguguuaaaauuaguauuuauaugaaagucaa

SEQ ID NO: 22222 - RNA, 64 nt, hsa
cuaugaaaagacagcuuaaggaagagcuaaauucuguuaaaauauuuggggcauguuugugcac

SEQ ID NO: 22223 - RNA, 64 nt, hsa
aacagaucacugauuucaaagacuugguguauaguguuaaaaauuaaagcuuaaaaggugguua

SEQ ID NO: 22224 - RNA, 64 nt, hsa
aaauagguauuuuaaaacauuguuuaaaacagaauguuaaaacacuguuguuuaagcauguuua

SEQ ID NO: 22225 - RNA, 64 nt, hsa
gaccuuuuaagaauguuuaauuuuaugaauacuauguuaaaauguaaaucuguugguuuuuuuu

SEQ ID NO: 22226 - RNA, 64 nt, hsa
ccauaucuccuuucccuacaaaagaaaagcauacuguuaaaaugugcuuaccaauacuguguuu

SEQ ID NO: 22227 - RNA, 64 nt, hsa
cuuuuaaaacucccaccagcuuuuaacaguauaauguuaaaaauauacuguaauuuuuguuaau

SEQ ID NO: 22228 - RNA, 64 nt, hsa
ucuguuuuugggguuuuuauguuuuauuauacuuuguuaaaaaggacaaauuguacauuuuuag

SEQ ID NO: 22229 - RNA, 64 nt, hsa
auaauacucuuaucgaaaaugcuaaagucuucaauguuaaaauacugauugguaaaaucuugca

SEQ ID NO: 22230 - RNA, 64 nt, hsa
gaaaaggcuuuugauaaaauucaacuugacuucauguuaaaaacccucaacaaaccaggcgucg

SEQ ID NO: 22231 - RNA, 64 nt, hsa
acauuccauacuuauggauaggaagaaucaauauuguuaaaauggccauacuacccaaagcaau

SEQ ID NO: 22232 - RNA, 64 nt, hsa
acugacaucaaaaguucuucuggaaacaaaccuuuguuaaaaaaaaaaaguauuaaauuguuuu

SEQ ID NO: 22233 - RNA, 64 nt, hsa
guuagccaaagcaucaccauuacaaguccaugaauguuaaaauguacaggugggauugugaaga

SEQ ID NO: 22234 - RNA, 64 nt, hsa
uaacuguucacuuucagauguaauggcaaacaauuguuaaaaguuauuaacugaucacagauuu

SEQ ID NO: 22235 - RNA, 64 nt, hsa
uugguuccaugaaaaguaugcuuuguguuuuaacuguuaaaauaauuuaaaaauuaauuauuuu

SEQ ID NO: 22236 - RNA, 64 nt, hsa
uacauauauuguauaaaaagguauauuuugguuuuguuaaaacccuuguugacuuuucuacacu

SEQ ID NO: 22237 - RNA, 64 nt, hsa
uuaggaaagcuauuucaacaaauuacaguuuuauuguuaaaacagagucuuauuugagauguau

SEQ ID NO: 22238 - RNA, 64 nt, hsa
auucuuuugcauuauaguaagaacauuuaaguuuuguuaaaauuaaaaaauuaguacguuauuu

SEQ ID NO: 22239 - RNA, 64 nt, hsa
ugcuucagacauuacacuauaucaaagugcugacuguuaaaaaugaucccaaacuaacgguaga

SEQ ID NO: 22240 - RNA, 64 nt, hsa
gauuuuccuauuaagccucuugguaagaggcauuuguuaaaagugcaagcuuacuccugcuucu

SEQ ID NO: 22241 - RNA, 64 nt, hsa
caggaaauacugugugguuucuaaaagcccugguuguuaaaaguagggacucugccuuuuuguu

SEQ ID NO: 22242 - RNA, 64 nt, hsa
auuauucuauguauuauuaaauauuuacuaguucuguuaaaagcagagcagaaguuagacacua

SEQ ID NO: 22243 - RNA, 64 nt, hsa
aaaaaauagcguucauggcuacgaauauguagaauguuaaaagcacagcaaacugcacugcacu

SEQ ID NO: 22244 - RNA, 64 nt, hsa
ugcacugcaguuauuuaccagaaguuuaaaucuuuguuaaaauauaguguuguguuacaauaag

SEQ ID NO: 22245 - RNA, 64 nt, hsa
uaccugccuugccuguuaggucuguugaagugcauguuaaaauaauuauaugaagcagaaugag

SEQ ID NO: 22246 - RNA, 64 nt, hsa
uuuaaauuuaaaguuuucuacaaggggagaaaaguguuaaaauuuuuaaaauauguuuuccagg

SEQ ID NO: 22247 - RNA, 64 nt, hsa
auauuugacauaguucuuuuuagucaaaucuacuuguuaaaaaaaggguagcaguuuauucauc

SEQ ID NO: 22248 - RNA, 64 nt, hsa
uaauuuucuuguauuuauauguuaaaaucaaaaauguuaaaaucaaugaaauaaauuugcaguu

SEQ ID NO: 22249 - RNA, 64 nt, hsa
cuuuucugauuuauuuaauuuucuuguauuuauauguuaaaaucaaaaauguuaaaaucaauga

SEQ ID NO: 22250 - RNA, 64 nt, hsa
uugcaugauauguaagauuuugugcauucauaauuguuaaaaaucuguguuccaaaaguggaca

SEQ ID NO: 22251 - RNA, 64 nt, hsa
aggaacuguggaacugugauguugucuuuuguguuguuaaaauaagaaaugucuuaucuguaua

SEQ ID NO: 22252 - RNA, 64 nt, hsa
uaccuuuaguuuaccuaaacuuuuguucagauaauguuaaaagguauacguacucuagccuuuu

SEQ ID NO: 22253 - RNA, 64 nt, hsa
gaagugcaauaacugcccuaauuaagcaacuauuuguuaaaaagggccccuuuuuacuuuaaua

SEQ ID NO: 22254 - RNA, 64 nt, hsa
ucuaccuguggucuaucuuuaauuucauuucuuuuguuaaaaauaaaacaaugaguauguuugg

SEQ ID NO: 22255 - RNA, 64 nt, hsa
ugccaauuuuugauauccucucuccuagaguuacuguuaaaagguugguucguaaaguccacac

SEQ ID NO: 22256 - RNA, 64 nt, hsa
ccccagguccuuccuucugcaucucaccaccccuaguuacaaauaacuccauugaacagcaucu

SEQ ID NO: 22257 - RNA, 64 nt, hsa
ugguuagcaacuaugaaacagaaauaggacacucaguuacaaacauuaucuccuuuaguuuuuc

SEQ ID NO: 22258 - RNA, 64 nt, hsa
agggguuaaagcagacagucacacugguuuggucaguuacaaaguaauuucuuugaucuggaca

SEQ ID NO: 22259 - RNA, 64 nt, hsa
uuggugugauugcacagaauuuguauguauuuucaguuacaagauuguaaguaaauugccugau

SEQ ID NO: 22260 - RNA, 64 nt, hsa
uguauuucuuguaacugcuggguguuacaaaauaaguuacaauguuuuacacuuuaaaaaaaaa

SEQ ID NO: 22261 - RNA, 64 nt, hsa
uuuguacuauauagaauccauauauuugacugcaaguuacaaaguuuuaagaacaugaugguug

SEQ ID NO: 22262 - RNA, 64 nt, hsa
gcuucauuguuucuuucucaguauuagaaauuauaguuacaaugaauugcauaugaagaaggca

SEQ ID NO: 22263 - RNA, 64 nt, hsa
guagauaugguaaauuuuauauuuguauauuuacaguuacaaaacaaauguacuuuuaccuuuu

SEQ ID NO: 22264 - RNA, 64 nt, hsa
auuuuccccuauacccucaagcauuuauccauugaguuacaaacaauccaguuacaaucuuuuu

SEQ ID NO: 22265 - RNA, 64 nt, hsa
cucaagcauuuauccauugaguuacaaacaauccaguuacaaucuuuuuaaguuauuauuauua

SEQ ID NO: 22266 - RNA, 64 nt, hsa
uagcauugggaaaagcccuuauucuugaaucuagaguuacuauuuuuguauauauuugcauagu

SEQ ID NO: 22267 - RNA, 64 nt, hsa
ucuguaauguguacaugaagugucaauuuagaacaguuacuaggauaaacuccauuauugccau

SEQ ID NO: 22268 - RNA, 64 nt, hsa
uccucuuaguuuuaaauauauugccuagagacucaguuacuacccaguuugugguuuuuuggga

SEQ ID NO: 22269 - RNA, 64 nt, hsa
uuucaaugagaagagcucuuguuaauguauuaacaguuacuaguuuuggcaccugcaacuuucu

SEQ ID NO: 22270 - RNA, 64 nt, hsa
gacacucugcuaguuuugaauaaguaaccaucaaaguuacuaaaacauggccaggcgcaguggc

SEQ ID NO: 22271 - RNA, 64 nt, hsa
gagcgagaaccugucucaaaaaaaacaaaaacaaaguuacuaaaaugucaccuucacagaacag

SEQ ID NO: 22272 - RNA, 64 nt, hsa
uucaguggguaacaguaucaucauauuccuuuauaguuacuaaguuucuggucuaaccgauaac

SEQ ID NO: 22273 - RNA, 64 nt, hsa
cuggcauugucagguugaacuuauaaauacgaauaguuacuacucugacuuguaaauguagcug

SEQ ID NO: 22274 - RNA, 64 nt, hsa
ucaggaaaugccagcauuggaauuuuguggcauuaguuacuaccuucuuucuuauaauauguug

SEQ ID NO: 22275 - RNA, 64 nt, hsa
auuaguuacuaccuucuuucuuauaauauguuguaguuacuagugaauucuuuuaaaagcaaua

SEQ ID NO: 22276 - RNA, 64 nt, hsa
aagaauuauaagaugaaaauuauauauuuugcccaguuacuaaaaugguacauuaaaaauucaa

SEQ ID NO: 22277 - RNA, 64 nt, hsa
uuaucaaagugagaggacuuauauuccuacaucaaguuacuacugagaguaaauuuauuuugag

SEQ ID NO: 22278 - RNA, 64 nt, hsa
guacacauacuaaagugacacaaagagaaugaagcagaaguagagaagaaagacuguaugugac

SEQ ID NO: 22279 - RNA, 64 nt, hsa
aaaaagauagaaaaaagaaaaaguuucagaagagcagaaguaaacacaaaaaacauaaguccuc

SEQ ID NO: 22280 - RNA, 64 nt, hsa
gaaguuuuuaaaaaugucauuacuuucaaaggaacagaaguaguuaaccaaacuaacaagcaaa

SEQ ID NO: 22281 - RNA, 64 nt, hsa
cagggcuaaagucauccagugaaacuuuuagagccagaaguaacuuugucccaguccuacaaug

SEQ ID NO: 22282 - RNA, 64 nt, hsa
uuucuggagaaggcagcaaacuuuuacuucccugcagaaguaguuaaguacauaguguuuucuc

SEQ ID NO: 22283 - RNA, 64 nt, hsa
aaaaauacuuaguuuagcuuuaguuuaguaaguucagaaguagaaacaaacuuauuuaaaacca

SEQ ID NO: 22284 - RNA, 64 nt, hsa
cuuuacugcaugaaugaaacugaugguucaauuucagaaguaaugauuaacaguuaugugguca

SEQ ID NO: 22285 - RNA, 64 nt, hsa
acuuuagagguagauuuaauacgauuaagauauucagaaguauauuuuagaaucccugccuguu

SEQ ID NO: 22286 - RNA, 64 nt, hsa
uaaaauuuuggguauaugaaagaaggcagcaauucagaaguaaagaagauacuaacguauuuca

SEQ ID NO: 22287 - RNA, 64 nt, hsa
aagggcugucuggaaagggagggacaaaaggacccagaaguagaagaauggggauggaguggug

SEQ ID NO: 22288 - RNA, 64 nt, hsa
gaagugcaauauguuagauacucagcagaaguaucagaaguagugguauggauauaaccuauuu

SEQ ID NO: 22289 - RNA, 64 nt, hsa
aagucugaagaagugcaauauguuagauacucagcagaaguaucagaaguagugguauggauau

SEQ ID NO: 22290 - RNA, 64 nt, hsa
gggcaaacugaaauguacgccugaauuuuguaaacagaaguauuaaaugucucuuucuacagcc

SEQ ID NO: 22291 - RNA, 64 nt, hsa
ggcucugcucugcccugcccugcaccccccucgucagaaguacaugaggggcgcagagaugagc

SEQ ID NO: 22292 - RNA, 64 nt, hsa
aggauuuuuagacacugagggucacuccaaggaucagaaguauggaauuuucugccaggcucaa

SEQ ID NO: 22293 - RNA, 64 nt, hsa
aaaaaagaaugaguaaugugaucgcuugguuauccagaaguauuguuuacauuaaacucccuuu

SEQ ID NO: 22294 - RNA, 64 nt, hsa
guucauuuuucagccaucaguucaagagccaaugccuuuuuaaaauaaagcuucuguggucuug

SEQ ID NO: 22295 - RNA, 64 nt, hsa
uugaauuguugcaguguuggagaugccauuuucaccuuuuuaaaaagaugcauuuuauuugcag

SEQ ID NO: 22296 - RNA, 64 nt, hsa
cagacacuuuuagaucaagaaaacacuucaacagccuuuuuagaaauuggcacacuccuauagu

SEQ ID NO: 22297 - RNA, 64 nt, hsa
auauauauauauauauauuuuacagucuuaucugccuuuuuaucuuugccaaaucuuuaccacu

SEQ ID NO: 22298 - RNA, 64 nt, hsa
caggcaaacacauaucuuucugauaaaaacaucuccuuuuuauucuacuuacuuggggcccagg

SEQ ID NO: 22299 - RNA, 64 nt, hsa
auuuagaacaugaagaaacuuugaaugucuugacccuuuuuaaagauuuuuuaggcaauaacag

SEQ ID NO: 22300 - RNA, 64 nt, hsa
aagcagaugguuuuucacugcauuggacaucaucccuuuuuaccauccauucauaacacccaaa

SEQ ID NO: 22301 - RNA, 64 nt, hsa
ugggagguuagauuuuuuuccucuacccagagucccuuuuuaguuuaccccacggcuuaguuug

SEQ ID NO: 22302 - RNA, 64 nt, hsa
ggagccuuucagaaauuccauguagugcuaauaaccuuuuuacuugcaaaugauaaaguaacug

SEQ ID NO: 22303 - RNA, 64 nt, hsa
cacgauuucucccgcaauuuguuccuucuuuuuaccuuuuuaaaaaucuguuagaagaaaaaaa

SEQ ID NO: 22304 - RNA, 64 nt, hsa
ucaguaagcaacuuuuccaugcucuuaauguauuccuuuuuaguaggaauccggaaguauuaga

SEQ ID NO: 22305 - RNA, 64 nt, hsa
cauacagggugucauccuucuuuccuucaagaaaccuuuuuacacaucuccauuccuuauucca

SEQ ID NO: 22306 - RNA, 64 nt, hsa
aauugagccgguuucuuauccuaaauguuuccucccuuuuuacaaucucuguccagcaccucuu

SEQ ID NO: 22307 - RNA, 64 nt, hsa
uguccuuuauaagcuuugaguaucuuacagcuugccuuuuuaauguuagucacaauguuuuugu

SEQ ID NO: 22308 - RNA, 64 nt, hsa
cuucugaaucaaggauuuaauuaaggccacaauaccuuuuuaauacucaguguucuguuuuuuu

SEQ ID NO: 22309 - RNA, 64 nt, hsa
ugaucaagccucaguccccuucauauuacccucuccuuuuuaaaaauuacgugugcacagagag

SEQ ID NO: 22310 - RNA, 64 nt, hsa
aauuuuuccacuucaguuuuauucuagaaaauacccuuuuuagaaauccaguuuuaguuuuguc

SEQ ID NO: 22311 - RNA, 64 nt, hsa
aguuacacuaaacacuuuuggcagcuuaauaugaccuuuuuaaauuuuuuuuauuuuuuuuauu

SEQ ID NO: 22312 - RNA, 64 nt, hsa
cccugcaugggagagagcaggguuuucucagauuccuuuuuaaucucuauuuaucugguuguuu

SEQ ID NO: 22313 - RNA, 64 nt, hsa
uuggcugauggguuguucuugguaugcauggugaccuuuuuauuucugugugcuuccuagagag

SEQ ID NO: 22314 - RNA, 64 nt, hsa
uucauuuauucauguuauaaagcaaagcccugguccuuuuuaaacuacuaguuuuaaaaaccug

SEQ ID NO: 22315 - RNA, 64 nt, hsa
ugcauuguaccuaaaggagaguaacuaaugguaaccuuuuuaauagaguaugugaaagguagug

SEQ ID NO: 22316 - RNA, 64 nt, hsa
uaagacuguuauucuauagcuccaacuuaaggugccuuuuuaauucccuacaguuuuaugggug

SEQ ID NO: 22317 - RNA, 64 nt, hsa
auuaucaccuuugccacuuaaaauauauaaauauccuuuuuacuucaugaggaaggaagaauuu

SEQ ID NO: 22318 - RNA, 64 nt, hsa
aggggacuguuaggaugcauuauaaacugaaaagccuuuuuaaaauuuuauguauuaauauaug

SEQ ID NO: 22319 - RNA, 64 nt, hsa
gacaagcaaagacucagggguuaccuccaugugcccuuuuuagggaagcuguuggagaaaauac

SEQ ID NO: 22320 - RNA, 64 nt, hsa
ccaucugcccucccauuuuaacuaucuacuguggccuuuuuauggaaacagagcaagaucaaug

SEQ ID NO: 22321 - RNA, 64 nt, hsa
auugauguuuaucucauagaugcauugaguagugccuuuuuagcuuuuucacauuacuuuguca

SEQ ID NO: 22322 - RNA, 64 nt, hsa
cucuacggcccaaaaaaagacaaaaauaaaaauuccuuuuuauuccugucaacuggauggaaac

SEQ ID NO: 22323 - RNA, 64 nt, hsa
accuuugaccauuuuuauguccauuggauacuuuccuuuuuaucaucuuaaaaaaagauaacua

SEQ ID NO: 22324 - RNA, 64 nt, hsa
gaugagcucuguuaaccuccugacugucguguuuccuuuuuauuacagaggugggucacuguuu

SEQ ID NO: 22325 - RNA, 64 nt, hsa
gcuuacuuuugauagaaaucuagguugguucaaaccuuuuuacucuuaaaacaaugcugcaguu

SEQ ID NO: 22326 - RNA, 64 nt, hsa
uaucuuuagagagaagauauuuuaaaaagaaauaccuuuuuaaaaauuauuuuauuauuuuuua

SEQ ID NO: 22327 - RNA, 64 nt, hsa
uaaauguuucuuucaagaaaauauauuuggauggccuuuuuaaaguaacaggauauuuaauaag

SEQ ID NO: 22328 - RNA, 64 nt, hsa
gagagcaccagccaccuaggaaaacuguauguuaccuuuuuacucaaaggaguccccccugccc

SEQ ID NO: 22329 - RNA, 64 nt, hsa
ccuaaucuuuugggaguuuugcuuguugauauaaccuuuuuaguuaaccugaaagauuccaaaa

SEQ ID NO: 22330 - RNA, 64 nt, hsa
ugagagagaauuuuucucuccuuaauagaagcauccuuuuuaaagagaaguugccuugguccac

SEQ ID NO: 22331 - RNA, 64 nt, hsa
gacuuuguuuuagaaagcuguuuauagcuuuggaccuuuuuaguguuaaaucuguaacauuacu

SEQ ID NO: 22332 - RNA, 64 nt, hsa
aauauuuuccuuaaauaugugauuucagacuauuccuuuuuaaaaucauuuguguuuauucuuc

SEQ ID NO: 22333 - RNA, 64 nt, hsa
uuuccaguuccacccuuuccuggggcaccaccacccuuuuuauauugcugaauuccaaccuccc

SEQ ID NO: 22334 - RNA, 64 nt, hsa
aacuguuauauacacauacauauaauuuuguuuuccuuuuuaagagaggauucuuuucauccua

SEQ ID NO: 22335 - RNA, 64 nt, hsa
cuguuaacucauuauuguaaguaaucucugaaagccuuuuuacuuuaaccaaaucuacaugguu

SEQ ID NO: 22336 - RNA, 64 nt, hsa
ugacaccccccuucccaaauguuaaaugccuucuccuuuuuaccgauauuucuguuucuuuuaa

SEQ ID NO: 22337 - RNA, 64 nt, hsa
aguaauaguuuuacguuguacauaauaguguaaaccuuuuuaaaaaggaaaguauaaaaacaaa

SEQ ID NO: 22338 - RNA, 64 nt, hsa
aucugcugcuuaggaaacucaaugaaaugacaugccuuuuuagcaggaagcaaaguugguuucu

SEQ ID NO: 22339 - RNA, 64 nt, hsa
agccaguucaauuuugcaaaggugcaguaccucuccuuuuuaagggguugguuuauucuuuuuu

SEQ ID NO: 22340 - RNA, 64 nt, hsa
cuuauuugagcugccuuuuuaauuuauugcauauccuuuuuauuaucuuauuuugguauuauuc

SEQ ID NO: 22341 - RNA, 64 nt, hsa
uuuuaaacugcaugccugccccuuauuugagcugccuuuuuaauuuauugcauauccuuuuuau

SEQ ID NO: 22342 - RNA, 64 nt, hsa
uccugcugacuccccuuauggaucucaguuugcuccuuuuuauggaccuuuaauggagagagag

SEQ ID NO: 22343 - RNA, 64 nt, hsa
accugauuacaaacucucauagauguuggaacuaccuuuuuacuccccauacuuuguaaguaau

SEQ ID NO: 22344 - RNA, 64 nt, hsa
uuuuauuuuauuuugagugggaagaauuuuaaaaccuuuuuaugucaauuaccaucuuguuucu

SEQ ID NO: 22345 - RNA, 64 nt, hsa
ggugcauuguuuuuuccacccaaacuuaacauagccuuuuuauacauuuuuaugaaaaauuuca

SEQ ID NO: 22346 - RNA, 64 nt, hsa
guuucugcucauaagugcuuuuggaagucaccuaccuuuuuaacacagccgaacuagucccaac

SEQ ID NO: 22347 - RNA, 64 nt, hsa
uuguccguuugcuaugccgaaugcagccaaaauuccuuuuuacaauuugugaugccuuaccgau

SEQ ID NO: 22348 - RNA, 64 nt, hsa
uauuuauguacuuuuauuuuacacagaaacacugccuuuuuauuuauauguacuguuuuaucug

SEQ ID NO: 22349 - RNA, 64 nt, hsa
ugcgcucuguggaugccagggccgaccagaggagccuuuuuaaaacacauguuuuuauacaaaa

SEQ ID NO: 22350 - RNA, 64 nt, hsa
ucccuauuucgcuuucuccucggcucacuuucucccuuuuuauuuuucaccaaaccauuuguag

SEQ ID NO: 22351 - RNA, 64 nt, hsa
aguagucagaauuuuaucuagaaaucuuuuaacaccuuuuuagugguuauuucuaaaaucacug

SEQ ID NO: 22352 - RNA, 64 nt, hsa
cucuucagguaccagcaccaggaagacugaauauccuuuuuaaugcaccaugaauccugggaga

SEQ ID NO: 22353 - RNA, 64 nt, hsa
augaaaauuguuuucugaaaguaucaucacuuuuccuuuuuaaagaaggcugcuaauuggauuu

SEQ ID NO: 22354 - RNA, 64 nt, hsa
ggcugaguuccuaguccuacacaaucagaauuugccuuuuuaagucacgcugcaacuauuccgg

SEQ ID NO: 22355 - RNA, 64 nt, hsa
ccucuccaugaaauugcaaaaacccaucuucauuccuuuuuauggggcuccaggucauaaggau

SEQ ID NO: 22356 - RNA, 64 nt, hsa
aaaucacuacaauagccuagugcuuuuuuggaagccuuuuuagggaagaauguuagguucaugg

SEQ ID NO: 22357 - RNA, 64 nt, hsa
uucuacauuucaugcucuuagucaaauucuguuaccuuuuuaauaacucuucccacugcauauu

SEQ ID NO: 22358 - RNA, 64 nt, hsa
guuuauaaaaguucauuuguugaaaaauaaggauccuuuuuaauaccacagcauuuguacuguu

SEQ ID NO: 22359 - RNA, 64 nt, hsa
ggauccuuuuuaauaccacagcauuuguacuguuccuuuuuaauauacugaaaauauaaaagga

SEQ ID NO: 22360 - RNA, 64 nt, hsa
uuauacuucaacagcccaaauauuuugguuuauuccuuuuuauccauaaagucuuuauucuuca

SEQ ID NO: 22361 - RNA, 64 nt, hsa
guuauuuuacugagcuguggaaacucauuuuuacccuuuuuaaagucauaaauauggacuuaau

SEQ ID NO: 22362 - RNA, 64 nt, hsa
auugugaugaaacagaucuuuugcuuauguuuuuccuuuuuaucuucucucaucccagcauacu

SEQ ID NO: 22363 - RNA, 64 nt, hsa
cugaguuauuuauuaauuaguugauuuauuuuugccuuuuuaaauuuuaacuuauaucagucac

SEQ ID NO: 22364 - RNA, 64 nt, hsa
gaagaauccucaacggcacccuggggugcuagcuccuuuuuagaaugucagcagagcugagauu

SEQ ID NO: 22365 - RNA, 64 nt, hsa
ccacucuucacaggcuauucuacuuuaaaggaagccuuuuuauuuugcugcacacaaucuagca

SEQ ID NO: 22366 - RNA, 64 nt, hsa
ccaagcuucccugccagccugaaguccauuuuccccuuuuuauuuuaaaauuugacuccucuuc

SEQ ID NO: 22367 - RNA, 64 nt, hsa
gacauucugaaauaauuuccgguuacagaauuacccuuuuuaggaucaucuucuaauucagaua

SEQ ID NO: 22368 - RNA, 64 nt, hsa
uuggaugaaucucccaucaucccaucccuuaaccccuuuuuacagaaauuuuaguuacaaucug

SEQ ID NO: 22369 - RNA, 64 nt, hsa
accagauaacuugcugcuucaacaaaaagauuuaccuuuuuaaauaaauguuguagaauacuua

SEQ ID NO: 22370 - RNA, 64 nt, hsa
acaaaucuuuaucuguuuccacccacccugggauccuuuuuacuuguagcccauuccugcccuc

SEQ ID NO: 22371 - RNA, 64 nt, hsa
gcuauacauuuaucuuuaugaacucauuuauauuccuuuuuaaugacucguuguucuaacauuu

SEQ ID NO: 22372 - RNA, 64 nt, hsa
uggaguuuaaguacagugaugguuggcuugaguaccuuuuuaaaucuagcccaguauaaacauu

SEQ ID NO: 22373 - RNA, 64 nt, hsa
gauaagaauaucauuuagaguguagauacuuuugccuuuuuaaaaaagccauuauuuuaugaga

SEQ ID NO: 22374 - RNA, 64 nt, hsa
uuuauagaauucuaugugccuuuuuaccucguggccuuuuuauugguaguaagguacagaagug

SEQ ID NO: 22375 - RNA, 64 nt, hsa
ucauuuaaauauguuuuuuauagaauucuaugugccuuuuuaccucguggccuuuuuauuggua

SEQ ID NO: 22376 - RNA, 64 nt, hsa
agccaaauauuagacuugaugugcaaucuucgguccuuuuuaaucugggguauuauaggcagua

SEQ ID NO: 22377 - RNA, 64 nt, hsa
ucauagaaaguagcuaauccaguguaaucuuuuaccuuuuuaaaaaccaagauagaguaucuau

SEQ ID NO: 22378 - RNA, 64 nt, hsa
uaacauuauauacauguguauauaagacaguggaccuuuuuaugacacauaaucagaagagaaa

SEQ ID NO: 22379 - RNA, 64 nt, hsa
uuaugugaaacugaagaguugcuuuucuuguuuuccuuuuuagaaguuuuuuuccuuaauguga

SEQ ID NO: 22380 - RNA, 64 nt, hsa
aaguuuuuuacuuugguuuagucuuuuuuuccuuccuuuuuauucagcuagaauuucugguggg

SEQ ID NO: 22381 - RNA, 64 nt, hsa
ugaggguuucugaucuguacuuuguguuuagcuaccuuuuuauauuuaaaaaauuaaaaaugaa

SEQ ID NO: 22382 - RNA, 64 nt, hsa
caucaagagaccauuuuauaaaacaugguaagacccuuuuuaaaacaaacuccaggcccuuggu

SEQ ID NO: 22383 - RNA, 64 nt, hsa
uguauccugcuucagacuuagguacaauugcuccccuuuuuauauauagacacacacaggacac

SEQ ID NO: 22384 - RNA, 64 nt, hsa
uugaaauaauauguaaaaccuacugaaaguuaauccuuuuuaaaaacuuuauuuaaaaagaaaa

SEQ ID NO: 22385 - RNA, 64 nt, hsa
cuaaauuguaaacaauuaucuaguaccaauuuucccuuuuuauuuuucagcaucaagagaaaac

SEQ ID NO: 22386 - RNA, 64 nt, hsa
caacacagcuaauuuacucuuggaucucauucucccuuuuuauccugaguuaccaucagugcua

SEQ ID NO: 22387 - RNA, 64 nt, hsa
cuuauagcuuuguuagauguugccaaauauuucuccuuuuuauguuaaaaaguuuuuuucauga

SEQ ID NO: 22388 - RNA, 64 nt, hsa
cauaaaacuaaugaacacaaagucccucaugcuaccuuuuuaugcuuacacuccauccaaaccu

SEQ ID NO: 22389 - RNA, 64 nt, hsa
ucauagggguagaggcuccugagauuaggagaacccuuuuuaggcuuuacucuauguaccucuu

SEQ ID NO: 22390 - RNA, 64 nt, hsa
agucuguagcuuccccccuuguauaaccugcuuuccuuuuuacauuuauuaaaaguggauuuug

SEQ ID NO: 22391 - RNA, 64 nt, hsa
auguuuugccuuuuuuuuuucuuuuuggccaauuccuuuuuauaugugcccacaacagaggugg

SEQ ID NO: 22392 - RNA, 64 nt, hsa
accuccaccuccccugagcccugugagaggcacgacugucuaugccaaugaggcucgguggggg

SEQ ID NO: 22393 - RNA, 64 nt, hsa
cagacauggaggcucggcugaaccaggacuccucacugucuaccugagagaaugagcaccccuc

SEQ ID NO: 22394 - RNA, 64 nt, hsa
uugucauuguuauguuuuguuauugauucucauuacugucuaauuuuuuuucugguauuagucu

SEQ ID NO: 22395 - RNA, 64 nt, hsa
cugcauagaggaacuagucagaaguggggaaaacacugucuaauuuuuaucagucugguauaaa

SEQ ID NO: 22396 - RNA, 64 nt, hsa
ugacuuaucucuugcuuucuaaaccuuguuucuaacugucuaucaaauaucuucauuagacauc

SEQ ID NO: 22397 - RNA, 64 nt, hsa
ggugggaugccaucauauuuaggggugguugggaacugucuacugcuuuagcauuugugucuuc

SEQ ID NO: 22398 - RNA, 64 nt, hsa
acagugaucauaucugauugauuuccauguguccacugucuagcacagggcaauaaaaaauaca

SEQ ID NO: 22399 - RNA, 64 nt, hsa
gcccuccugugugccaccuuacagcucaugcagaacugucuacuugaucuggagggcauugaca

SEQ ID NO: 22400 - RNA, 64 nt, hsa
uuuuuuucuucucagcuuuaugaagagaagggaaacugucuaggauucagcugaaccaccagga

SEQ ID NO: 22401 - RNA, 64 nt, hsa
uagguagcuagucacacuuuucagaccaauucaaacugucuaugcacaaaauucccgugggccu

SEQ ID NO: 22402 - RNA, 64 nt, hsa
cuguccccucuaaaguuaaagucaauacaagaaaacugucuauuuuuagccuaaaguaaaggcu

SEQ ID NO: 22403 - RNA, 64 nt, hsa
aguauuaguuguauuacuaaucauauguugauuaacugucuacuuaaagucaagguaccuguau

SEQ ID NO: 22404 - RNA, 64 nt, hsa
gagaaagauaaugguaaguaguugcuacuggccaacugucuagcacuuaccugaaaacuuagua

SEQ ID NO: 22405 - RNA, 64 nt, hsa
uucccaacccccauugugacaguuucuuuuugucacugucuagaauuuuguauuuuauuucaga

SEQ ID NO: 22406 - RNA, 64 nt, hsa
auccuaaaugagaaaauuauguuuuucuuacuggauuuuguacaaacauaaucuauuauuugcu

SEQ ID NO: 22407 - RNA, 64 nt, hsa
acuuggcugaggaagcagagaccgagcgcuggucauuuuguaguaccugcauccagcuuagcug

SEQ ID NO: 22408 - RNA, 64 nt, hsa
ugcuuucuuguuuaucacuauguaaaucugaaauauuuuguacuucauuuguuuuuauccauuc

SEQ ID NO: 22409 - RNA, 64 nt, hsa
uacauuuuugagauuuuuaugacauuagauuuuuauuuuguauauguagaauauuauaauuuuu

SEQ ID NO: 22410 - RNA, 64 nt, hsa
acuuugaaauaauucacuuucaucugcuuucuagauuuuguacaucucaguccauaaagcaaag

SEQ ID NO: 22411 - RNA, 64 nt, hsa
aguggccuuuucaaggccuagucccagggaaaacauuuuguagaguauaggggagugggaggaa

SEQ ID NO: 22412 - RNA, 64 nt, hsa
augauaggaaguuucucgaguuagccuucaugcaauuuuguagauuaaaacauaaaauuugucc

SEQ ID NO: 22413 - RNA, 64 nt, hsa
cugggauuacaggcaugcgccacuaccccagcuaauuuuguauuuuuaguagagaugggguuuc

SEQ ID NO: 22414 - RNA, 64 nt, hsa
cagccgucuuuguuuauaguguagaauucuuuauauuuuguacaaaaacuaauucuuuugguaa

SEQ ID NO: 22415 - RNA, 64 nt, hsa
gauuuuuuuuccccucaucuuggucagagaguggauuuuguauuuuguauuuaacuugcauuca

SEQ ID NO: 22416 - RNA, 64 nt, hsa
uuuccccucaucuuggucagagaguggauuuuguauuuuguauuuaacuugcauucaaaaaaca

SEQ ID NO: 22417 - RNA, 64 nt, hsa
uauaaaauaaaauuguauggcuuauguguaaauuauuuuguaucugagauaccaguuccuuuuc

SEQ ID NO: 22418 - RNA, 64 nt, hsa
auaaaaguuuucuuguguuuuucugugagugaaaauuuuguaauaaauuaacaaauuuguacaa

SEQ ID NO: 22419 - RNA, 64 nt, hsa
guguuuuguacaguauauaacuacaagauaguacauuuuguagcaguucaaagccaaaguugcu

SEQ ID NO: 22420 - RNA, 64 nt, hsa
auuuaauuacugagcagaaguaaauacuguuggcauuuuguacauaaucuaauuuuuauaugca

SEQ ID NO: 22421 - RNA, 64 nt, hsa
cucuagaguggacauacggaaagacugugacuuuauuuuguaaugggaggaagaaauuuucuca

SEQ ID NO: 22422 - RNA, 64 nt, hsa
cuucguaauuuuggaguaggagguucccuccucaauuuuguauuuuuaaaaguacaugguaaaa

SEQ ID NO: 22423 - RNA, 64 nt, hsa
aguauauuggauguuaaauccauauaugauguauauuuuguaaaauugggaaaaucacuaccuu

SEQ ID NO: 22424 - RNA, 64 nt, hsa
cacuuguuuuaacuauuuauuuugccauguuuacauuuuguaucuuguaaaaauaaauccaacu

SEQ ID NO: 22425 - RNA, 64 nt, hsa
acccugaaggacagugacuuauuauguaaguucaauuuuguaaguucauuauguaagauccuuu

SEQ ID NO: 22426 - RNA, 64 nt, hsa
uauugugaauaccuugguucuguucaauagaaacauuuuguauauauuaaauacugaaauauca

SEQ ID NO: 22427 - RNA, 64 nt, hsa
uaaguuaauuuaaguaaucauuuauuaagacagaauuuuguauaaacuauuuauugugcucucu

SEQ ID NO: 22428 - RNA, 64 nt, hsa
uaguaccugcagaauaguuuuugaauacacccacauuuuguacguuuccauguaagcugacaua

SEQ ID NO: 22429 - RNA, 64 nt, hsa
acauaucuguuuaguuuggguucauuucuauaacauuuuguaagaaaauaaaaguuugagcacc

SEQ ID NO: 22430 - RNA, 64 nt, hsa
gaucuauuuuuauagguucuuuuucagaaguaaaauuuuguacauauauacauguacauaucug

SEQ ID NO: 22431 - RNA, 64 nt, hsa
uaaagaaagugcuuuguauuuuguugaagucaguauuuuguauaaacauuuauguugacccacu

SEQ ID NO: 22432 - RNA, 64 nt, hsa
auguaacuguaucaaaaauaaaaagcugucacauauuuuguaaauuuuuaccuuguaaagucac

SEQ ID NO: 22433 - RNA, 64 nt, hsa
gaauagcaaaauuccuguguucaauauuuagaaaauuuuguauuaauuucugauaaaguuccuu

SEQ ID NO: 22434 - RNA, 64 nt, hsa
aaaucuguaauugauaauaggugggggaaaaugaauuuuguaugcugaauuucuaagcgccuau

SEQ ID NO: 22435 - RNA, 64 nt, hsa
aaccagauuauagauuuaaaaguauaugacauguauuuuguauuuaaaacuagaauagccagua

SEQ ID NO: 22436 - RNA, 64 nt, hsa
aauuauauuaauagugaguuucaggccccugggcauuuuguaccauguaauuauccucugguga

SEQ ID NO: 22437 - RNA, 64 nt, hsa
uguguauauagaguuggcuugcauuuuaggggccauuuuguauaaaaagugcauaugauuaaaa

SEQ ID NO: 22438 - RNA, 64 nt, hsa
uuucauugucucuacuuuauaauuaucaaaacuuauuuuguauugcuacuaccuuaaauugaaa

SEQ ID NO: 22439 - RNA, 64 nt, hsa
ggaauguaagacucaaucuguagcuaguaugaauauuuuguauuuugaacaagaaauguugugu

SEQ ID NO: 22440 - RNA, 64 nt, hsa
guuugguucucauaauguauuguuucuuaagaacauuuuguaauugggcuaugauuuuaugauc

SEQ ID NO: 22441 - RNA, 64 nt, hsa
uuucuuauuguugaauuuuaaguguuccuuguauauuuuguauaacagaccuuuaucagauagg

SEQ ID NO: 22442 - RNA, 64 nt, hsa
guaccuuguuauauauacagauacuuucauggucauuuuguauguauguuaaaguaguagaagu

SEQ ID NO: 22443 - RNA, 64 nt, hsa
ggucauuuuguauguauguuaaaguaguagaaguauuuuguagcuuaaagucucuaguauguaa

SEQ ID NO: 22444 - RNA, 64 nt, hsa
ugggauuacaggcaugcuccaccaugcccagcuaauuuuguauuuuuaguagaaacgggguuuc

SEQ ID NO: 22445 - RNA, 64 nt, hsa
cauaccaguuuccauccuaauaggaaugaaauuaauuuuguaucuacugauaacagaaucuggg

SEQ ID NO: 22446 - RNA, 64 nt, hsa
uuuuacuguguaaauuguauucuuaacauuuuguauuuuguaggauugaucuuauuuugagaca

SEQ ID NO: 22447 - RNA, 64 nt, hsa
aaaucauuuuuacuguguaaauuguauucuuaacauuuuguauuuuguaggauugaucuuauuu

SEQ ID NO: 22448 - RNA, 64 nt, hsa
uauaguacucaaacuggcagugcucaguauauacauuuuguaagcuuugucagugaaaccauca

SEQ ID NO: 22449 - RNA, 64 nt, hsa
gaaauauuagucauguuaauuaauaaacuguauuauuuuguauagcuuuuuauuugcuuaccug

SEQ ID NO: 22450 - RNA, 64 nt, hsa
uuguuguggugcugccaguuuugcuuuauucuaaauuuuguaccaaagcaacuuuagaauaauc

SEQ ID NO: 22451 - RNA, 64 nt, hsa
augcucuaccguuggaacuagccagauggccauuauuuuguauuuuaaauacauaaauaggauu

SEQ ID NO: 22452 - RNA, 64 nt, hsa
ugcuaacuguggucuucuugacacauuaagauguauuuuguauuuuaagagucucaugcucuac

SEQ ID NO: 22453 - RNA, 64 nt, hsa
caagauaccucuaagcuguuuugaacccucugauauuuuguauuuauguguuugucugucuccc

SEQ ID NO: 22454 - RNA, 64 nt, hsa
ucauagcuagggaacauuucacaaauaaggugagauuuuguaaccaauaauaaaaaugaauguu

SEQ ID NO: 22455 - RNA, 64 nt, hsa
ucucaguacacucuuuuaggucauaguaguugccauuuuguaaaauuucuuuuuucuucuuugc

SEQ ID NO: 22456 - RNA, 64 nt, hsa
gagacagaaucucucacugaaacucauggucaugauuuuguauaauauaguucauacugugucu

SEQ ID NO: 22457 - RNA, 64 nt, hsa
ugccucuauuaagcagaggauggaaguauuaaggauuuuguaacaccuuuuaugaaaauguuga

SEQ ID NO: 22458 - RNA, 64 nt, hsa
aguggcaccaaauggcuggguacaaucaagugauauuuuguagcaccucacuaucugaaaggcc

SEQ ID NO: 22459 - RNA, 64 nt, hsa
uuuuuuuacauguuuuacaucagaucauuguggaauuuuguaaacggauuuugauguuucucuu

SEQ ID NO: 22460 - RNA, 64 nt, hsa
agaaauagauugcaguucuucuugcacuaucuuuauuuuguaugucaguauuccuucugaacaa

SEQ ID NO: 22461 - RNA, 64 nt, hsa
agcuucuuguauuugucuaaaacaacaagccagaauuuuguaucuccuuugauaaaaagugugu

SEQ ID NO: 22462 - RNA, 64 nt, hsa
uuugcuccuuguaugauguaaguggcccaccccaauuuuguaacaugaugcaagugucuggcac

SEQ ID NO: 22463 - RNA, 64 nt, hsa
uaauuuaaaauaagcaauaauuaaggcacaguugauuuuguagaguauugguccauacagagaa

SEQ ID NO: 22464 - RNA, 64 nt, hsa
uugaagauuggucuucuguugaucuaagaugauuauuuuguaaaagacuuucuaguguacaaga

SEQ ID NO: 22465 - RNA, 64 nt, hsa
cuuuauauucucuaaaaugcuuaaugccuuugaaauuuuguaaucaaaaaaaagcuuugaaaaa

SEQ ID NO: 22466 - RNA, 64 nt, hsa
gcaaauuuguuaaaaugccaaaaaggacaguuuaauuuuguacagauuaugcuuaccucagguu

SEQ ID NO: 22467 - RNA, 64 nt, hsa
aaaaauagaaaaaaauuaaugacuguauuugaauauuuuguaaugcacugcuauuuauuauaua

SEQ ID NO: 22468 - RNA, 64 nt, hsa
cagugaaauuuugugauuaagaggacaugcuaauauuuuguaaagcugggaccagaacccaagu

SEQ ID NO: 22469 - RNA, 64 nt, hsa
gacacaaaugucacaccuaagaggacaaucaaucauuuuguaugauuuuguaaguaaaugacag

SEQ ID NO: 22470 - RNA, 64 nt, hsa
ucacaccuaagaggacaaucaaucauuuuguaugauuuuguaaguaaaugacagaaugcuuuua

SEQ ID NO: 22471 - RNA, 64 nt, hsa
uuuuuaaauuauacuguagcugaugaaacuccugauuuuguaguuaauuuauuaagucugggau

SEQ ID NO: 22472 - RNA, 64 nt, hsa
guacaaguuuuguauaaauaauaaagaacuccuuauuuuguauuacaucuaaugcuucaagugu

SEQ ID NO: 22473 - RNA, 64 nt, hsa
agcuguuucagucaccagugaagagccuaugugcauuuuguaguagauaauguaaaauuuguca

SEQ ID NO: 22474 - RNA, 64 nt, hsa
ggucuucacacagcagucauccgugucauuuaucauuuuguaauauuaaauuauggcaauuuua

SEQ ID NO: 22475 - RNA, 64 nt, hsa
uugagggcauuuauucugugugacuguggguuuuauuuuguauucugguuaagaaaauaaugua

SEQ ID NO: 22476 - RNA, 64 nt, hsa
uucgucagcauuacaggugaucuauuuugguggcauuuuguacuucucucugcuucuaaccacu

SEQ ID NO: 22477 - RNA, 64 nt, hsa
cugacagcuugguaaagucuagguagaguuucugauuuuguauuauguccuaagacuugaaagu

SEQ ID NO: 22478 - RNA, 64 nt, hsa
gucaaagcaaagaaaugaagggcugguaaaaugaauuuuguaauauccucaggauacuuuuauc

SEQ ID NO: 22479 - RNA, 64 nt, hsa
aggauacuuuuaucuuaaaaguauguuguuaaagauuuuguaaauuguauuucaacaauuuuaa

SEQ ID NO: 22480 - RNA, 64 nt, hsa
gcuuauccaaaauuaucucuguuuacuuuuuagaauuuuguacauuaucuuuugggauccuuaa

SEQ ID NO: 22481 - RNA, 64 nt, hsa
aguuuugguucuaguuuuauuucguagauuuugcauuuuguaccuuuugagacuauguauuuau

SEQ ID NO: 22482 - RNA, 64 nt, hsa
ugcauucuugauuaccuacugugugccaaacaagauuuuguagaauauugcaaaaaugaccaua

SEQ ID NO: 22483 - RNA, 64 nt, hsa
ugggauuagaggcauaguccagcacgccuggcuaauuuuguauuuuuaguagagacgggguuuc

SEQ ID NO: 22484 - RNA, 64 nt, hsa
aggugcauuucuugguuuaugucuuguucuugagauuuuguauauuuaggaaaaccucaagcag

SEQ ID NO: 22485 - RNA, 64 nt, hsa
aauggugcgugaaggcucucagaccuuacacaccauuuuguaaguuauguuuuacaugccccgu

SEQ ID NO: 22486 - RNA, 64 nt, hsa
aacuccaguugacaguaaaaugaagcuucuagguauuuuguauuguacauauuuccuccuacug

SEQ ID NO: 22487 - RNA, 64 nt, hsa
uacuuuggauauguuuuuucaaugccaucugaagauuuuguaauugaguagcaguaaauauaca

SEQ ID NO: 22488 - RNA, 64 nt, hsa
auauguagucuacucacauuuucauuauuuagcaauuuuguacaaaaauagcaauuaauuugua

SEQ ID NO: 22489 - RNA, 64 nt, hsa
gggugugggaauuucuuuuccuacgggguacgugauuuuguaaaaaggaaguauuucucccaaa

SEQ ID NO: 22490 - RNA, 64 nt, hsa
uguaaaaaaaaacaaaaaaaagcuuuuaugauggauuuuguaaauagauuuguuacagggugac

SEQ ID NO: 22491 - RNA, 64 nt, hsa
aucuuaccacuucaaauggguguaauuugaauaaauuuuguaugguaaaggaucaauaaaauga

SEQ ID NO: 22492 - RNA, 64 nt, hsa
ucuugguuuggggagaaauaaauuuuguuucagaauuuuguauauuguaggaauccuuugagaa

SEQ ID NO: 22493 - RNA, 64 nt, hsa
cuuuugauggggagaaagggcaaauuauuuuaauauuuuguauuuucaacuuuauaaagauaaa

SEQ ID NO: 22494 - RNA, 64 nt, hsa
ucgugugauuuccuacagaaauacugcucugaauauuuuguaauaaaggucuuugcacauguga

SEQ ID NO: 22495 - RNA, 64 nt, hsa
ucaucauugagauugguuugcuuaaaauuaacuuauuuuguagaagacaaaaugaauugcacuu

SEQ ID NO: 22496 - RNA, 64 nt, hsa
auacgaugugaugaaauuugcuuuuuauccaaauauuuuguaucuuguaaauauggcuaauuau

SEQ ID NO: 22497 - RNA, 64 nt, hsa
gggaugcuuugccaggucaugugcuuauugucucauuuuguagucuuuuaaaguuguaugaacc

SEQ ID NO: 22498 - RNA, 64 nt, hsa
ugcguauacuggcaagcuuuugaaaauguauuuaauuuuguauuguuuaccaaugauuuauuua

SEQ ID NO: 22499 - RNA, 64 nt, hsa
aaguagggcugccuccaagaggaaccucugauuuauuuuguaugaaauauaugugaaaggauau

SEQ ID NO: 22500 - RNA, 64 nt, hsa
gauguccauuuuuacaaguuauaguacuagagauauuuuguaaaauguauuauguccugugaga

SEQ ID NO: 22501 - RNA, 64 nt, hsa
gacuacucuuuuucuguuuuaucauguaugcauuauuuuguauauguacagggcaaguagguau

SEQ ID NO: 22502 - RNA, 64 nt, hsa
ugcagguuaucagagaucaaagauuguaauaauaauuuuguaaauuguaagcaaaaaguuauuu

SEQ ID NO: 22503 - RNA, 64 nt, hsa
ggccuauuuaacaagauguuucauuuuacuguauauuuuguaguuaauauaaauguugcucuaa

SEQ ID NO: 22504 - RNA, 64 nt, hsa
gauuuuccauuaacuauuuuuuucaaagacucaaauuuuguaccaaguaaauccaggcuuuaug

SEQ ID NO: 22505 - RNA, 64 nt, hsa
cugacuuacuagucauuuuaguguuauaaauggcauuuuguacaaaauagucuauucaguucgu

SEQ ID NO: 22506 - RNA, 64 nt, hsa
aauuuuggaaugauguaucuuuguagaguuaaugauuuuguacauuugcacauguaaucaucau

SEQ ID NO: 22507 - RNA, 64 nt, hsa
uauuuugucauauguauuuuguauuugcauauguauuuuguauuugcauauguauuuuugucau

SEQ ID NO: 22508 - RNA, 64 nt, hsa
uauguauuuuugucauauguauuuugucauauguauuuuguauuugcauauguauuuuguauuu

SEQ ID NO: 22509 - RNA, 64 nt, hsa
agccugaagguaacucuauacaguauuuuaaauaauuuuguacaugaaacaaaguauugauugu

SEQ ID NO: 22510 - RNA, 64 nt, hsa
uggcuacuguguuggcccaguagaaauugacaguauuuuguauauaugugcccauuuaucuuuu

SEQ ID NO: 22511 - RNA, 64 nt, hsa
cucauaaggaaguacuggugcuagguuuugcaagauuuuguauacacuuugcuccuugcccuag

SEQ ID NO: 22512 - RNA, 64 nt, hsa
ugaauucuaaacauguaaaaugugacagccugcaauuuuguagacagugaaguaauggcugcua

SEQ ID NO: 22513 - RNA, 64 nt, hsa
ucuuauuuuuuucauuaauuacauaucaacauuaauuuuguaucuugaagcaaauugauuuugu

SEQ ID NO: 22514 - RNA, 64 nt, hsa
uaucaacauuaauuuuguaucuugaagcaaauugauuuuguauaauuaaaugugucaagcaucu

SEQ ID NO: 22515 - RNA, 64 nt, hsa
gauauuucuuugaggcuuucauuuauauaauuuuauuuuguacaauguuuuuuuuaaaugugca

SEQ ID NO: 22516 - RNA, 64 nt, hsa
uuuaacuuuuguuuuuuaacauuuagaauauuacauuuuguauuauacaguaccuuucucagac

SEQ ID NO: 22517 - RNA, 64 nt, hsa
uuacauuuuguauuauacaguaccuuucucagacauuuuguagaauucauuucggcagcucacu

SEQ ID NO: 22518 - RNA, 64 nt, hsa
uuuauuaaaaauccaaagauaagucuuuagguauauuuuguaccaaauuaaauuagaagacaaa

SEQ ID NO: 22519 - RNA, 64 nt, hsa
auuccaucaccauuuacccuuuuuuuuuuuuuaaauuuuguagccauucuuaugaugcucuuga

SEQ ID NO: 22520 - RNA, 64 nt, hsa
aaauugaaucaugcaucuauuuauaauucuaauuauuuuguaaaagaagacaaaauuaugaauc

SEQ ID NO: 22521 - RNA, 64 nt, hsa
ccacauggagccaaguuuaauguuucuaguucacauuuuguacuucugucaugcuuauuucaaa

SEQ ID NO: 22522 - RNA, 64 nt, hsa
ugcaugggguugcucgcccacagggcugccucagauuuuguacaaccccgaagcguccucugcg

SEQ ID NO: 22523 - RNA, 64 nt, hsa
gcuuggugaggaaaguaguugucaccagggccucauuuuguaguugagccuuacaaugcuuagu

SEQ ID NO: 22524 - RNA, 64 nt, hsa
uacugcuggggccuuccuucauccucugagggcuauuuuguacuuucugcagcaaucagcuuaa

SEQ ID NO: 22525 - RNA, 64 nt, hsa
gcuuuccuauuucuacaacugauuguacuuaugcauuuuguaccaguggaacuuuuuauacugg

SEQ ID NO: 22526 - RNA, 64 nt, hsa
aguuuagaaagccccuuauuuuucaacaaaggggauuuuguacacauaacauggguuauuuagu

SEQ ID NO: 22527 - RNA, 64 nt, hsa
auuuaguuuaacucuggcaaaaaaaaaaaaaaaaauuuuguauguugauguuuguauaccguuc

SEQ ID NO: 22528 - RNA, 64 nt, hsa
uuucuuaaaucuaguaauuuguagauuccucuggauuuuguauaugcauagucauguaagcuga

SEQ ID NO: 22529 - RNA, 64 nt, hsa
gcuuuuuaccaaguuucagguauuaagaaaaucuauuuuguaacuuucucuaugaacucuguuu

SEQ ID NO: 22530 - RNA, 64 nt, hsa
agaagucacuuuggaacuaaauugccuccauuuuauuuuguacgaguaaggguuugaucuacaa

SEQ ID NO: 22531 - RNA, 64 nt, hsa
cauaucaauuauaaauauuguauuuaucuuugaaauuuuguacauugcuuuucccaccuuuucc

SEQ ID NO: 22532 - RNA, 64 nt, hsa
uucccaugaacacuugcaguugcuaagggacuuuauuuuguaacauaucaauuauaaauauugu

SEQ ID NO: 22533 - RNA, 64 nt, hsa
aguccugaagaauaaggaaaacaaagcgacgccuauuuuguauaaaguuuccgacuccgucuug

SEQ ID NO: 22534 - RNA, 64 nt, hsa
ccauggagaguuuuaaagaaacauauguagcaugauuuuguaggagaggaaaaagauuauuuaa

SEQ ID NO: 22535 - RNA, 64 nt, hsa
aguuuacuauuuaagguuuuauaaauguaaauauauuuuguauauuuuucuaugagaagcacuu

SEQ ID NO: 22536 - RNA, 64 nt, hsa
auuuggcauauugacccuauauaaaaaagugggcauuuuguaacauuccuucaggaagaauaga

SEQ ID NO: 22537 - RNA, 64 nt, hsa
uucauuacacugucaauguuaacaucauugcugcauuuuguacuuugaacacacacauaauaua

SEQ ID NO: 22538 - RNA, 64 nt, hsa
uuucauuucaggagagcagcaguuaaacccguggauuuuguaguuaggaaccuggguucaaacc

SEQ ID NO: 22539 - RNA, 64 nt, hsa
agcuccucaggucagcaagucuacuucucugccuauuuuguauacucucuuuaauaugugccua

SEQ ID NO: 22540 - RNA, 64 nt, hsa
aagccuugaauugaaauuuaacuaauacuugaacauuuuguauauauuucuuuguauauaauuu

SEQ ID NO: 22541 - RNA, 64 nt, hsa
gaauuggucuuugguuuccagugcaucacagcauauuuuguaaaaucaucuacuacugcacuug

SEQ ID NO: 22542 - RNA, 64 nt, hsa
gccagcuaugcagcaguauaccaucuguuuaauuauuuuguagguccuguguguggaaccaacu

SEQ ID NO: 22543 - RNA, 64 nt, hsa
aaauuagcccuccuuacauaaauuaaaugucaaaauuuuguaaaauauuaaucagaauaaauac

SEQ ID NO: 22544 - RNA, 64 nt, hsa
ugggauuacaggcgccugccuccaugccuggcuaauuuuguauuuuuaguagagacaggguuuc

SEQ ID NO: 22545 - RNA, 64 nt, hsa
ugcagacaaaguagaaacugugcugcaugauguuauuuuguaaacagaugacauuuucugacca

SEQ ID NO: 22546 - RNA, 64 nt, hsa
ucuguaagauauaccucuuccucauauguuaaauauuuuguaaaguuuaccaauuugagauaua

SEQ ID NO: 22547 - RNA, 64 nt, hsa
guuuauacugagugaaggaaagguaaaaaguaguauuuuguauauuuuuguaacaaaauauaaa

SEQ ID NO: 22548 - RNA, 64 nt, hsa
aaaucuaaaaugucuuauguuaucagauuaugcuauuuuguauaaagcaccacugauagcaaau

SEQ ID NO: 22549 - RNA, 64 nt, hsa
ugcaaggaaaguacauuuguuugccugucuuuucauuuuguacauucuucccauucuguauucu

SEQ ID NO: 22550 - RNA, 64 nt, hsa
uucccucuuuuuuccugggaauauuuuguacaauauuuuguacaaagacaggcaugaggagugc

SEQ ID NO: 22551 - RNA, 64 nt, hsa
ugagcccuucuuuucccucuuuuuuccugggaauauuuuguacaauauuuuguacaaagacagg

SEQ ID NO: 22552 - RNA, 64 nt, hsa
ggauugcagguacccaucagcccaugcccagcuaauuuuguauuuuuaguagagaugggguuuc

SEQ ID NO: 22553 - RNA, 64 nt, hsa
cuuacugcccugccugugacaguuguaugccuucauuuuguauccaacagcaaagucuacaaua

SEQ ID NO: 22554 - RNA, 64 nt, hsa
aaguuaguggacuuugucuccauuuuuaaaguauauuuuguaaauguuaauucugugguccugu

SEQ ID NO: 22555 - RNA, 64 nt, hsa
guacaccaaacauuuuauaaaucaaucaguaaauauuuuguaagacccaaaauccuggcauauu

SEQ ID NO: 22556 - RNA, 64 nt, hsa
uuaagcuauuuaguuccucaucuguugcuuuuucauuuuguauacugcaaguucccaggcaacu

SEQ ID NO: 22557 - RNA, 64 nt, hsa
gacagcacuacugauaaccaaacuggagucagguauuuuguacuuugcaguauuucucuuguau

SEQ ID NO: 22558 - RNA, 64 nt, hsa
gagacuauggacauucaaaucaugggagaaaauaauuuuguagauuauguuccauugcuaauga

SEQ ID NO: 22559 - RNA, 64 nt, hsa
agcaagaaaaccacaacuaaaacuggaaauguauauuuuguauauuugagaaaacagggaauac

SEQ ID NO: 22560 - RNA, 64 nt, hsa
uacauauaugaguugccuauauuugcuauucaaaauuuuguaaauaugcaaaucagcuuuauag

SEQ ID NO: 22561 - RNA, 64 nt, hsa
aaaagauguaaauagaugacaaacgauguaaauaauuuuguaagaggcuucaaaauguuuauac

SEQ ID NO: 22562 - RNA, 64 nt, hsa
ugguguucuuuuuaagguuugcaaauuucagccaauuuuguagcuaagauuguucugaucagcu

SEQ ID NO: 22563 - RNA, 64 nt, hsa
ggaaaaauguguguggcucuuacguuuucugggaauuuuguaacaaguuacacgcacaaguguu

SEQ ID NO: 22564 - RNA, 64 nt, hsa
acuuugguggcaaagagaauuuuagcuucuaucgauuuuguaagucuucagcugaaccacuaau

SEQ ID NO: 22565 - RNA, 64 nt, hsa
aaaacaaguugguaaugcauaucauggaaggcauauuuuguauguauaaauucaccacaauuaa

SEQ ID NO: 22566 - RNA, 64 nt, hsa
uuuugccaaauggcgcaaauauaccuccauuuauauuuuguaucuuaaaauguaguuuaaaaau

SEQ ID NO: 22567 - RNA, 64 nt, hsa
caaguagcuacugaacugcucacaccauuggaagauuuuguauuuucauaccaauuaguaaaaa

SEQ ID NO: 22568 - RNA, 64 nt, hsa
auacaccaaaguuuugacgguuuaccaucauuccauuuuguaccaguuaaaggcauuuugauga

SEQ ID NO: 22569 - RNA, 64 nt, hsa
gaauagcuuuaaugauaugcuuguaacuaaaauaauuuuguaauguaucaaauacauuuaaaac

SEQ ID NO: 22570 - RNA, 64 nt, hsa
auuuuccuguugucaagaauagcauuguaaaagcauuuuguaauaauaaagaauagcuuuaaug

SEQ ID NO: 22571 - RNA, 64 nt, hsa
uguacugugcuguaccacauuuauuucuauauucauuuuguaaaaaauuuaaaagugcuauuuu

SEQ ID NO: 22572 - RNA, 64 nt, hsa
ccuaauaaauggaccaauaagccaaacuaucaguauuuuguauauccugcauaaacucuaauuu

SEQ ID NO: 22573 - RNA, 64 nt, hsa
cuuuuaccaauggguagcuauaagguuacagcuuauuuuguaacuauuuuauaucucaauaucu

SEQ ID NO: 22574 - RNA, 64 nt, hsa
augaaauagacaaguagagauuuaauuagcaaaaauuuuguagggaaguaaaauuuuuucuaag

SEQ ID NO: 22575 - RNA, 64 nt, hsa
aaguguugaagcuuuucauauuugcugcgugagcauuuuguaaaauauugaaagugguuugaga

SEQ ID NO: 22576 - RNA, 64 nt, hsa
agauagugguauaagaaagcauuucuuaugacuuauuuuguaucauuuguuuuccucaucuaaa

SEQ ID NO: 22577 - RNA, 64 nt, hsa
uugaaauauuaauguuuauuacaugcaaauaacuauuuuguaucuacagucggauaauggauuu

SEQ ID NO: 22578 - RNA, 64 nt, hsa
uauuuuguaucuacagucggauaauggauuuuuuauuuuguauauuuauucuauuuuguauauu

SEQ ID NO: 22579 - RNA, 64 nt, hsa
ggauaauggauuuuuuauuuuguauauuuauucuauuuuguauauuguuaagugcaauaaaguu

SEQ ID NO: 22580 - RNA, 64 nt, hsa
aucagaaaauaaaauauucacucuccauuagaaaauuuuguaaaacaaugccaugaacaaauuc

SEQ ID NO: 22581 - RNA, 64 nt, hsa
cucuuugauaacaaaaaauaaauuuuaaaaaggaauuuuguaaaguuucuagaauuuuauauca

SEQ ID NO: 22582 - RNA, 64 nt, hsa
ucuaucugggauggccauuugaucucuaaaaggaauuuuguacacuccacagaacuccuaucua

SEQ ID NO: 22583 - RNA, 64 nt, hsa
auaguaucuguacuccuuguauuuuucaagagcuauuuuguaaacagaugauguauuucuccau

SEQ ID NO: 22584 - RNA, 64 nt, hsa
auaugaagcucaccuguugcuuacaauuuuuuuaauuuuguauuuuccaagugugcauauugua

SEQ ID NO: 22585 - RNA, 64 nt, hsa
ucuuaauuuugguuguauucuuugauguuaacacauuuuguauaauuguaucguauagcuguau

SEQ ID NO: 22586 - RNA, 64 nt, hsa
gcuugauaauuuucacaauagaaagagaccaaauauuuuguacuauauuuugugacauagaagu

SEQ ID NO: 22587 - RNA, 64 nt, hsa
gccaauucuaguaagaaauuaauaaaacuaccuuauuuuguauuucacuuaagguggaggaccu

SEQ ID NO: 22588 - RNA, 64 nt, hsa
cuuuaaauuaaaucaucuauuccuugggaaagguauuuuguaccauaugggacugaaaucauuu

SEQ ID NO: 22589 - RNA, 64 nt, hsa
gaaaucauuucucuggaugaauuuuauaaaaugaauuuuguaauuuuuuucugagaaaaaaaag

SEQ ID NO: 22590 - RNA, 64 nt, hsa
ccuagguaacucuagauuaggccaguucagguguauuuuguaucuuaguaauggaucauaucgu

SEQ ID NO: 22591 - RNA, 64 nt, hsa
uaugccaaucacugagacugcaucagaguuugcaauuuuguauguuucauugccaaagaaggcu

SEQ ID NO: 22592 - RNA, 64 nt, hsa
gucuuccugucugauuuuuguuuuguaguauuuaauuuuguauuccucugcaguuuuaagaaac

SEQ ID NO: 22593 - RNA, 64 nt, hsa
ggcuuuacccuuugagaaaaaggcagcccuccagauuuuguagacauuuuucuuaauauuuuua

SEQ ID NO: 22594 - RNA, 64 nt, hsa
aacaaaaacaaaaaauggaaaaaaaaaaccuuguauuuuguaaauauuuucuuuuccugcuuug

SEQ ID NO: 22595 - RNA, 64 nt, hsa
gggggaggggggagaagacucuuuuuuuuuggccauuuuguaaucguauaaaaauaguagacaa

SEQ ID NO: 22596 - RNA, 64 nt, hsa
aacugaaagcauguauuuuggaagaaagagauacauuuuguaugcuuucuuuuccuuuuguaga

SEQ ID NO: 22597 - RNA, 64 nt, hsa
ggccgggggcgggggcucucuacagagaauuuuuauuuuguaauagaagugaacugucucugaa

SEQ ID NO: 22598 - RNA, 64 nt, hsa
aauuauuaugggaaacaaaacuaucuauguucauauuuuguaauauuucauuuguuaaguuuau

SEQ ID NO: 22599 - RNA, 64 nt, hsa
uuaguauauaaaaauagauaaugcucuuggacacauuuuguauuauucaugaucugaauaguag

SEQ ID NO: 22600 - RNA, 64 nt, hsa
uaggggguugaaguguuuaucugauuuguuuaaaauuuuguauaucaccaaauuuuuaaaaagu

SEQ ID NO: 22601 - RNA, 64 nt, hsa
uguucuuaauauucauuagugagaaucacaaaguauuuuguagaaggcccaaaucacagaauaa

SEQ ID NO: 22602 - RNA, 64 nt, hsa
cauacugacgcgucuguaaucuguucuuaugcucauuuuguauuuuccuuucaacuccaggaau

SEQ ID NO: 22603 - RNA, 64 nt, hsa
cagcuuaggcauuuuuacuuuaaccccuaaauugauuuuguaaaugccacaaaugcauagaauu

SEQ ID NO: 22604 - RNA, 64 nt, hsa
aguaacaggggcaguuccugaauucaaauaaaccauuuuguauguuuggauuuugaauggguua

SEQ ID NO: 22605 - RNA, 64 nt, hsa
cuauuuuuugguuuuguuuuguguuuucuuuugcauuuuguaucuuguauuuaucccugaacau

SEQ ID NO: 22606 - RNA, 64 nt, hsa
uagauauaugggccucuguguggcugaacaguauauuuuguaaauauaaguacuaguccuaauu

SEQ ID NO: 22607 - RNA, 64 nt, hsa
aagguucugcuuuuaaugcacuuuuuauuuuauaauuuuguauugaaauauuuuagaaauguug

SEQ ID NO: 22608 - RNA, 64 nt, hsa
aucaaagaagagucaacauugauccagucauuuuauuuuguaauauugagggauaauugguuau

SEQ ID NO: 22609 - RNA, 64 nt, hsa
gaagagggaaauguacacuuuuuacagcagcaauauuuuguauauuauguuuauuucauguggu

SEQ ID NO: 22610 - RNA, 64 nt, hsa
caccaucaaauagauguaaucuuauuaauuacacauuuuguauuuuaauuauuucaaggaguga

SEQ ID NO: 22611 - RNA, 64 nt, hsa
ugacacuguaucuuauuaaaauaggaugauuugcauuuuguaaaauuauccugcacaucaagcu

SEQ ID NO: 22612 - RNA, 64 nt, hsa
ugaaaacagaaugaaucgugaacauuaucucaauauuuuguauaauagacaagaccacaguguu

SEQ ID NO: 22613 - RNA, 64 nt, hsa
gauuuucggaggaucuugcauuuuucuagggaauauuuuguaguuguguguguguguuuuugcc

SEQ ID NO: 22614 - RNA, 64 nt, hsa
uaggauuacaggugugagccaccacgccuggcuaauuuuguauuuuuaguagagaugggguuuc

SEQ ID NO: 22615 - RNA, 64 nt, hsa
ugggauuacaggcaugcgccaccaugcccggcuaauuuuguauuuuuaguagagacggaguugc

SEQ ID NO: 22616 - RNA, 64 nt, hsa
auguuaccaagcaugguaguuaaaggauacuucaauuuuguaucuauuucuuauuaaaaagaaa

SEQ ID NO: 22617 - RNA, 64 nt, hsa
ggugugcugaguucuauaauauaagcugccauauauuuuguagacaaguauggcuccuccauau

SEQ ID NO: 22618 - RNA, 64 nt, hsa
guuuuuaacaccuuuuacucuucuuacuggugcuauuuuguagaauaaggaacaacguugacaa

SEQ ID NO: 22619 - RNA, 64 nt, hsa
ugggauuacaggcacgcgccaccacaccuggcugauuuuguauuuuuaguagacacggguuuuc

SEQ ID NO: 22620 - RNA, 64 nt, hsa
acuucuggaagugaacacucguuuugaaagcuugauuuuguagcuuuggaagcuggaagcgaug

SEQ ID NO: 22621 - RNA, 64 nt, hsa
uguaacuuuuguaagacaaagguuuuccucuucuauuuuguaaacucaaaauauuuguacauag

SEQ ID NO: 22622 - RNA, 64 nt, hsa
cgugacgucacuggaccacugggcaaugauggcaauuuuguaacgaagacacagacugcgauuu

SEQ ID NO: 22623 - RNA, 64 nt, hsa
caaugaccagcaguugguaugaagaaccuuugacauuuuguaaaaggccauuucuugggaguuu

SEQ ID NO: 22624 - RNA, 64 nt, hsa
cccaaguuuugaugaaacuguauuuguaaaaaaaauuuuguaguuuaaguauugucauacagug

SEQ ID NO: 22625 - RNA, 64 nt, hsa
uggaaguauaauaacucauugacuugguuccagaauuuuguaauucuggaucuguauaaggaau

SEQ ID NO: 22626 - RNA, 64 nt, hsa
gccuuauaauuauuuuuagcuuaaaauuaaacagauuuuguaauaauguaacuuuguuaauagg

SEQ ID NO: 22627 - RNA, 64 nt, hsa
caguguggaauguuaaauaacgcuuuuauacuguauuuuguacuaugauguaacuccccuuccu

SEQ ID NO: 22628 - RNA, 64 nt, hsa
uuccacagggcuaaugccaccaucuccccucaaaauuuuguagagguucuaaaaagaaaguggu

SEQ ID NO: 22629 - RNA, 64 nt, hsa
auuauaccuuuaagaauguggggccuuuuuuaugauuuuguaaguucccauaaguugugugcac

SEQ ID NO: 22630 - RNA, 64 nt, hsa
aauaauuuaaauuaaugcuggugaucuuaacaauauuuuguaaaaugaugcuucccccuucucc

SEQ ID NO: 22631 - RNA, 64 nt, hsa
aaaugaugcuucccccuucuccauggucuagucaauuuuguacaauuagguaucugacuuuaca

SEQ ID NO: 22632 - RNA, 64 nt, hsa
uuuaaaauauuugugcaaagcuauuaauauacacauuuuguaaaaaaaaaaaaaaaacacguau

SEQ ID NO: 22633 - RNA, 64 nt, hsa
aaccugcuuuccuuuuuacauuuauuaaaaguggauuuuguaaaagcauuucauugacacgcga

SEQ ID NO: 22634 - RNA, 64 nt, hsa
cuuacuuacuaucaguuuaugauguagaaaauauauuuuguaauuauaagaaaacaagacuuuu

SEQ ID NO: 22635 - RNA, 64 nt, hsa
acuaguaaucuaauagccuauaguuuauauuauuauuuuguauuauuugcacgcuguuacauag

SEQ ID NO: 22636 - RNA, 64 nt, hsa
ucacacaaucuuuuuaaaaaaaauuugaaauggcauuuuguauugccacagagguaggaugagc

SEQ ID NO: 22637 - RNA, 64 nt, hsa
agguaggaugagccauauauuagugaaauguuuuauuuuguaaaauauaaauggauuauuugcc

SEQ ID NO: 22638 - RNA, 64 nt, hsa
gauacauuaauucagacuaaucuuugggggcuuuauuuuguaaguuagaacuuucaagggaaac

SEQ ID NO: 22639 - RNA, 64 nt, hsa
aauugcuuccuaguugcauuauauggcaaaugagauuuuguacauggaguugacauaauacuuu

SEQ ID NO: 22640 - RNA, 64 nt, hsa
cacuacacuuauuaucuauuaaccaaagcuuaaaauuuuguauucuucuguuagauaagaccuu

SEQ ID NO: 22641 - RNA, 64 nt, hsa
cacgagucacuuaaaauaucgacgguaaacuacuauuuuguagagaaacucaggaagauuuaaa

SEQ ID NO: 22642 - RNA, 64 nt, hsa
agucaauaucuccuauugauuaacuuagacauagauuuuguaauguauaacuugauauuuaauu

SEQ ID NO: 22643 - RNA, 64 nt, hsa
cuugauauuuaauuuaugauuaaacuguguguaaauuuuguaacauaaacugugguaauugcau

SEQ ID NO: 22644 - RNA, 64 nt, hsa
aagugaagggacaaugauauuucauggucaguuuauuuuguaagagacagaagaaauuauaucu

SEQ ID NO: 22645 - RNA, 64 nt, hsa
uacaaugaaucauuguucaaccuugaaaaauaaaauuuuguaaaacaucgguugaugucauuau

SEQ ID NO: 22646 - RNA, 64 nt, hsa
guuuaguuaagagcauguuacuaaaaugcugaggauuuuguaggcuugcauaguaguuguuuuu

SEQ ID NO: 22647 - RNA, 64 nt, hsa
uaggcuugcauaguaguuguuuuuuaacuagcugauuuuguaaccauaaaaacaagcuaucugc

SEQ ID NO: 22648 - RNA, 64 nt, hsa
gucuuaauuccagauuuacugaaaaugucagaucauuuuguauuaaucuauuuucaucuuugug

SEQ ID NO: 22649 - RNA, 64 nt, hsa
uuaugccucaagcaaauugagaucuuacuaauuuauuuuguaaaugccuaaugaggcagauuuu

SEQ ID NO: 22650 - RNA, 64 nt, hsa; identical to SEQ ID NO: 22641

SEQ ID NO: 22651 - RNA, 64 nt, hsa; identical to SEQ ID NO: 22642

SEQ ID NO: 22652 - RNA, 64 nt, hsa
uauaacuugauauuuaauuuaugauuaaacuguaauuuuguaacauaaacugugguaauugcau

SEQ ID NO: 22653 - RNA, 64 nt, hsa
cugucacugauccguauuaccacuuuuggaaaaaaauaaauaaauaaauaaauaaaaggcagcu

SEQ ID NO: 22654 - RNA, 64 nt, hsa
cacugauccguauuaccacuuuuggaaaaaaauaaauaaauaaauaaauaaaaggcagcuugag

SEQ ID NO: 22655 - RNA, 64 nt, hsa
gauccguauuaccacuuuuggaaaaaaauaaauaaauaaauaaauaaaaggcagcuugaguuuc

SEQ ID NO: 22656 - RNA, 64 nt, hsa
cguauuaccacuuuuggaaaaaaauaaauaaauaaauaaauaaaaggcagcuugaguuuccaaa

SEQ ID NO: 22657 - RNA, 64 nt, hsa
agagcgagacucuggcucauaaaauaauaauaauaauaaauaaauaaaaaauaaauguuuucag

SEQ ID NO: 22658 - RNA, 64 nt, hsa
cgagacucuggcucauaaaauaauaauaauaauaaauaaauaaaaaauaaauguuuucaguaaa

SEQ ID NO: 22659 - RNA, 64 nt, hsa
cgacagcaagagacuucauuucgauaaauaaguaaauaaauaaauaaagucugaagcuccacug

SEQ ID NO: 22660 - RNA, 64 nt, hsa
agcaagagacuucauuucgauaaauaaguaaauaaauaaauaaagucugaagcuccacugguca

SEQ ID NO: 22661 - RNA, 64 nt, hsa
auuuuuucucugaaaauuuugugugugauugcacaauaaauaauuuuuagagaaacaaaggcuc

SEQ ID NO: 22662 - RNA, 64 nt, hsa
ucaaaauagaaguguauuuuuucagguuucuggaaauaaauaguaaaauaaauggcacaaauag

SEQ ID NO: 22663 - RNA, 64 nt, hsa
agcuaaggaauuccaagggccacaugcgaguauuaauaaauaaagacaccauuggccugacgca

SEQ ID NO: 22664 - RNA, 64 nt, hsa
aaagaaauuauauuuuguucuauugcuaggguaaaauaaauacauuuguguccaacugaaauau

SEQ ID NO: 22665 - RNA, 64 nt, hsa
gaauuugucuuuuaaaaugaguacauauauaggcaauaaauauauaugcucagaucaauauacu

SEQ ID NO: 22666 - RNA, 64 nt, hsa
uaccugcuuguuagagaagcuuuaauuugguucuaauaaauacaguaugguaguguuuauagga

SEQ ID NO: 22667 - RNA, 64 nt, hsa
ucuguuuaguuuuaguaugguuuugucucuaaugaauaaauaauuccuucuuauuaagaagaag

SEQ ID NO: 22668 - RNA, 64 nt, hsa
ugcucuauuuuaaaguguagaagaauacacugcuaauaaauaauaaaaguuuuauucaauuuac

SEQ ID NO: 22669 - RNA, 64 nt, hsa
gguaacuuugucaauuucccauuuuauuuuuuuaaauaaauauaugaucuaaaagccaacuuuu

SEQ ID NO: 22670 - RNA, 64 nt, hsa
uuuuaaauuuaagcaaaauuuauuucuguucuuuaauaaauaagaaaaugugguccacugcauu

SEQ ID NO: 22671 - RNA, 64 nt, hsa
guaucauuguuucauuuaguauuugguacaaucuaauaaauacuaauccaguccaauacuaauc

SEQ ID NO: 22672 - RNA, 64 nt, hsa
acuaauaauacuaacaguaguauugauacaaucuaauaaauaauguguuugacaguguagcaga

SEQ ID NO: 22673 - RNA, 64 nt, hsa
uuuaaaaacuugcauuuauuccucagauuuuaaaaauaaauaaauaauucauuuaagauucuuc

SEQ ID NO: 22674 - RNA, 64 nt, hsa
aaaacuugcauuuauuccucagauuuuaaaaauaaauaaauaauucauuuaagauucuucuuuc

SEQ ID NO: 22675 - RNA, 64 nt, hsa
cagagcaagacuccaucucaaaaaaaauaauaauaauaaauaaauaaaaaaucccaauuacaga

SEQ ID NO: 22676 - RNA, 64 nt, hsa
gcaagacuccaucucaaaaaaaauaauaauaauaaauaaauaaaaaaucccaauuacagaacag

SEQ ID NO: 22677 - RNA, 64 nt, hsa
ggagacucaugagcaccccaggcagcucaagcugaauaaauagcugcagacauggccaacaaca

SEQ ID NO: 22678 - RNA, 64 nt, hsa
uguuuugauuacccucguguuacuacaagauggcaauaaauacuaugggauuguuuguauuaaa

SEQ ID NO: 22679 - RNA, 64 nt, hsa
guauugggagguggagaaggggaggguucagaaaaauaaauaagaguuauugcacuaacaaaag

SEQ ID NO: 22680 - RNA, 64 nt, hsa
ggaagauaugauuggaaaaucaagaguguagaagaauaaauacuguuuuacuguccaaagacau

SEQ ID NO: 22681 - RNA, 64 nt, hsa
ugaaguauauucaaccaaauacuuuaauguauaaaauaaauauuauacaauauacuuguauagc

SEQ ID NO: 22682 - RNA, 64 nt, hsa
cacccugggcaacagagcaagaccccaucucaaaaauaaauaaauauauauaaaaaauaaaaag

SEQ ID NO: 22683 - RNA, 64 nt, hsa
cugggcaacagagcaagaccccaucucaaaaauaaauaaauauauauaaaaaauaaaaagcuau

SEQ ID NO: 22684 - RNA, 64 nt, hsa
uuaagacucugucucaaauauaaauaaauaaauaaauaaauaaaaauaaagcgagauguugccc

SEQ ID NO: 22685 - RNA, 64 nt, hsa
aguguuaagacucugucucaaauauaaauaaauaaauaaauaaauaaauaaauaaauaaaaaua

SEQ ID NO: 22686 - RNA, 64 nt, hsa
caacaguguuaagacucugucucaaauauaaauaaauaaauaaauaaauaaauaaauaaauaaa

SEQ ID NO: 22687 - RNA, 64 nt, hsa
ugggcaacaguguuaagacucugucucaaauauaaauaaauaaauaaauaaauaaauaaauaaa

SEQ ID NO: 22688 - RNA, 64 nt, hsa
aauccaaaauaaaauucacuuaaguagaacuauaaauaaauaucuagaaucugacuggcucauc

SEQ ID NO: 22689 - RNA, 64 nt, hsa
ggaaauauugcuaaaaugaucugggccuaccauaaauaaauaucuccuuuucugagcucuaaga

SEQ ID NO: 22690 - RNA, 64 nt, hsa
accuagggaaaaagaacuaugguuccauauucaaaauaaauauuauagacccuuuuccuaagua

SEQ ID NO: 22691 - RNA, 64 nt, hsa
aauucuucauuaguuuacgaaccacaaaauugcaaauaaauaagcuaugaacuuugauguacac

SEQ ID NO: 22692 - RNA, 64 nt, hsa
ugggugacagagugagacucugucucaaaaaauaaauaaauaaaauaaaaugaaauagaucuua

SEQ ID NO: 22693 - RNA, 64 nt, hsa
agucugggugacagagugagacucugucucaaaaaauaaauaaauaaaauaaaaugaaauagau

SEQ ID NO: 22694 - RNA, 64 nt, hsa
guucauucccagaagggcacaaaaugaaugaauaaauaaauaaaugaauaaagacaaaagccaa

SEQ ID NO: 22695 - RNA, 64 nt, hsa
ccugguucauucccagaagggcacaaaaugaaugaauaaauaaauaaaugaauaaagacaaaag

SEQ ID NO: 22696 - RNA, 64 nt, hsa
gggcgacagagcgagacuccgucucaaaaaaauaaauaaauacauuuugucugaaaaauaacug

SEQ ID NO: 22697 - RNA, 64 nt, hsa
gccugggcgacagagcgagacuccgucucaaaaaaauaaauaaauacauuuugucugaaaaaua

SEQ ID NO: 22698 - RNA, 64 nt, hsa
cagaaugcauaacacugaguguuaauucuugugaaauaaauaagcuagacugccuucucuuuaa

SEQ ID NO: 22699 - RNA, 64 nt, hsa
ugaagaaauaucuuuuuucuuugauucauuuuugaauaaauauaaaaugaauaacuauuaaggu

SEQ ID NO: 22700 - RNA, 64 nt, hsa
ccagcuuggcgacagagcaagacccccucucaaaaauaaauaaaauaaaguaaaauaaauauaa

SEQ ID NO: 22701 - RNA, 64 nt, hsa
agacccccucucaaaaauaaauaaaauaaaguaaaauaaauauaaauaauuguggccgggugca

SEQ ID NO: 22702 - RNA, 64 nt, hsa
gugaccaagaacacaaggagcauccauauggccaaauaaauacacugaauuuuagaaaaacaua

SEQ ID NO: 22703 - RNA, 64 nt, hsa
uuuuuuuuuaccuccugucuugcccccuaaaagaaauaaauagagcaaacaucuugacucuccc

SEQ ID NO: 22704 - RNA, 64 nt, hsa
cagagcuggagaguuuuuugaaauggcaguggcaaauaaauaaauacuuuuuuuuaaauggaaa

SEQ ID NO: 22705 - RNA, 64 nt, hsa
gcuggagaguuuuuugaaauggcaguggcaaauaaauaaauacuuuuuuuuaaauggaaagacu

SEQ ID NO: 22706 - RNA, 64 nt, hsa
auucugccucaaaaauaaacaaauaaauuuuaaaaauaaauaaauaauaaaaggaaguguuaga

SEQ ID NO: 22707 - RNA, 64 nt, hsa
ugccucaaaaauaaacaaauaaauuuuaaaaauaaauaaauaauaaaaggaaguguuagacaau

SEQ ID NO: 22708 - RNA, 64 nt, hsa
cuguauuugggaaaauuuuccaagguuagauuccaauaaauaucuauuuauuauuaaauauuaa

SEQ ID NO: 22709 - RNA, 64 nt, hsa
ccagccggggugacagagugagacuccgacugaaaauaaauaaauaaauaaauaaauaaauaaa

SEQ ID NO: 22710 - RNA, 64 nt, hsa
ccggggugacagagugagacuccgacugaaaauaaauaaauaaauaaauaaauaaauaaauaaa

SEQ ID NO: 22711 - RNA, 64 nt, hsa
ggugacagagugagacuccgacugaaaauaaauaaauaaauaaauaaauaaauaaauaaauauu

SEQ ID NO: 22712 - RNA, 64 nt, hsa
acagagugagacuccgacugaaaauaaauaaauaaauaaauaaauaaauaaauaaauauuaugg

SEQ ID NO: 22713 - RNA, 64 nt, hsa
agugagacuccgacugaaaauaaauaaauaaauaaauaaauaaauaaauaaauauuauggaugg

SEQ ID NO: 22714 - RNA, 64 nt, hsa
agacuccgacugaaaauaaauaaauaaauaaauaaauaaauaaauaaauauuauggauggugaa

SEQ ID NO: 22715 - RNA, 64 nt, hsa
uccgacugaaaauaaauaaauaaauaaauaaauaaauaaauaaauauuauggauggugaaggga

SEQ ID NO: 22716 - RNA, 64 nt, hsa
acugaaaauaaauaaauaaauaaauaaauaaauaaauaaauauuauggauggugaagggaaugg

SEQ ID NO: 22717 - RNA, 64 nt, hsa
auccugcagcuugguuuaaugaguguguucaugaaauaaauaauggaggaauugucauguguug

SEQ ID NO: 22718 - RNA, 64 nt, hsa
aagcauuccuuacauuaguagcaauaaauauuagaauaaauaugaaauugaacuauuuucagaa

SEQ ID NO: 22719 - RNA, 64 nt, hsa
uuggauaucaagaagcauuccuuacauuaguagcaauaaauauuagaauaaauaugaaauugaa

SEQ ID NO: 22720 - RNA, 64 nt, hsa
ccugggcaacagagcaagacuucgucucaaaauaaauaaauaaaguggcucuuggggaaaagca

SEQ ID NO: 22721 - RNA, 64 nt, hsa
cacuccugggcaacagagcaagacuucgucucaaaauaaauaaauaaaguggcucuuggggaaa

SEQ ID NO: 22722 - RNA, 64 nt, hsa
ugacagagcaagacuccaucucaguaaauaaauaaauaaauaaaaagcgcugcaguagcugugg

SEQ ID NO: 22723 - RNA, 64 nt, hsa
ugggugacagagcaagacuccaucucaguaaauaaauaaauaaauaaaaagcgcugcaguagcu

SEQ ID NO: 22724 - RNA, 64 nt, hsa
agccugggugacagagcaagacuccaucucaguaaauaaauaaauaaauaaaaagcgcugcagu

SEQ ID NO: 22725 - RNA, 64 nt, hsa
ucuaaaagauaaguguguuugcaaaaaaaaagaaaauaaauacauaaaaaagggacaagcaugu

SEQ ID NO: 22726 - RNA, 64 nt, hsa
uuuggcuuuuuaaauuauuuugugccuauuuaugaauaaauauuacaaauucuaaaagauaagu

SEQ ID NO: 22727 - RNA, 64 nt, hsa
acucugucucaaaaauaaauaaauaaaauagauaaauaaauauaugauuaacuaauuuuaaaaa

SEQ ID NO: 22728 - RNA, 64 nt, hsa
ugggcaacaagaguaaaacucugucucaaaaauaaauaaauaaaauagauaaauaaauauauga

SEQ ID NO: 22729 - RNA, 64 nt, hsa
agccugggcaacaagaguaaaacucugucucaaaaauaaauaaauaaaauagauaaauaaauau

SEQ ID NO: 22730 - RNA, 64 nt, hsa
ucuauuuuuguguuuaaaaaagcuguaccuaccaaauaaauaaauaguuuauaaaauguauuac

SEQ ID NO: 22731 - RNA, 64 nt, hsa
uuuuuguguuuaaaaaagcuguaccuaccaaauaaauaaauaguuuauaaaauguauuacuuaa

SEQ ID NO: 22732 - RNA, 64 nt, hsa
ggcgguacucugaacaauuuccucagaaccucuuaauaaauaaguuugguaaugcugaggccag

SEQ ID NO: 22733 - RNA, 64 nt, hsa
gguuuucaauguacacuguaccaaaauuucuauaaauaaauaacuuuguacauaaaaguaauac

SEQ ID NO: 22734 - RNA, 60 nt, hsa
uagacuugggauuucucugaccagaguacuaauaaauauagaucauuuagaaaagugguc

SEQ ID NO: 22735 - RNA, 64 nt, hsa
cacuccagcuugagcaacacagugauacugucucaauaaauaaauaaauagaagaaaucaugag

SEQ ID NO: 22736 - RNA, 64 nt, hsa
ccagcuugagcaacacagugauacugucucaauaaauaaauaaauagaagaaaucaugaguaaa

SEQ ID NO: 22737 - RNA, 64 nt, hsa
cuugagcaacacagugauacugucucaauaaauaaauaaauagaagaaaucaugaguaaaauug

SEQ ID NO: 22738 - RNA, 64 nt, hsa
cuccagccagggcaagagagcgagacccugucucaauaaauaaauaaauaaauaaauaaauaaa

SEQ ID NO: 22739 - RNA, 64 nt, hsa
agccagggcaagagagcgagacccugucucaauaaauaaauaaauaaauaaauaaauaaauaaa

SEQ ID NO: 22740 - RNA, 64 nt, hsa
agggcaagagagcgagacccugucucaauaaauaaauaaauaaauaaauaaauaaauaaauaaa

SEQ ID NO: 22741 - RNA, 64 nt, hsa
caagagagcgagacccugucucaauaaauaaauaaauaaauaaauaaauaaauaaauaaaaaca

SEQ ID NO: 22742 - RNA, 64 nt, hsa
acccugucucaauaaauaaauaaauaaauaaauaaauaaauaaauaaauaaauaaaaacaaagu

SEQ ID NO: 22743 - RNA, 64 nt, hsa
ugucucaauaaauaaauaaauaaauaaauaaauaaauaaauaaauaaauaaaaacaaaguugau

SEQ ID NO: 22744 - RNA, 64 nt, hsa
ucaauaaauaaauaaauaaauaaauaaauaaauaaauaaauaaauaaaaacaaaguugauuaag

SEQ ID NO: 22745 - RNA, 64 nt, hsa
uaaauaaauaaauaaauaaauaaauaaauaaauaaauaaauaaaaacaaaguugauuaagaaag

SEQ ID NO: 22746 - RNA, 64 nt, hsa
uauuuuuuuuaauuuaaguccuaaauauaguuaaaauaaauaauguuuuaguaaaaugauacac

SEQ ID NO: 22747 - RNA, 64 nt, hsa
gugacauagcgagauccugucuaaaaaaauaaaaaauaaauaauggaacacagcaaguccuagg

SEQ ID NO: 22748 - RNA, 64 nt, hsa
ccauguugaagaguguguauaggaaaggucuagaaauaaauaggcuugugcauaccuaggcauu

SEQ ID NO: 22749 - RNA, 64 nt, hsa
cacuccccuccccuccccacccccaauagauucaaauaaauaaaauccugagcaaauuaauagc

SEQ ID NO: 22750 - RNA, 64 nt, hsa
cagacaugguggcaugcgcuuguuuaaaaaaacaaauaaauaaauaaucgacucaaaaauaagu

SEQ ID NO: 22751 - RNA, 64 nt, hsa
caugguggcaugcgcuuguuuaaaaaaacaaauaaauaaauaaucgacucaaaaauaagucaug

SEQ ID NO: 22752 - RNA, 64 nt, hsa
agauaguuauuaccaaaaaaagagaguuauuacaaauaaauaugucucuuuauuuuuaaaaaug

SEQ ID NO: 22753 - RNA, 64 nt, hsa
caauguuuguacuuaugcauuccccauggguaaaaauaaauaauagcauuguuaaagauaguua

SEQ ID NO: 22754 - RNA, 64 nt, hsa
gaccaugugauuauggacaucgauaugaaaaauaaauaaauaaaacuaaggaacccuggaaacu

SEQ ID NO: 22755 - RNA, 64 nt, hsa
uauugaccaugugauuauggacaucgauaugaaaaauaaauaaauaaaacuaaggaacccugga

SEQ ID NO: 22756 - RNA, 64 nt, hsa
aggacaaacagugaauuuaagcaugaguggccuuaauaaauauaguugucuuucuuugcugcug

SEQ ID NO: 22757 - RNA, 64 nt, hsa
uucuucauguaaucccaccuucuaacaaaaaauaaauaaauauuuaaauuccaaggagaagugu

SEQ ID NO: 22758 - RNA, 64 nt, hsa
cuuauucuucauguaaucccaccuucuaacaaaaaauaaauaaauauuuaaauuccaaggagaa

SEQ ID NO: 22759 - RNA, 64 nt, hsa
cguucaugcuuuuucguauucuuuauggcuuuuaaauaaauauacaaugguuaauaguaaaaca

SEQ ID NO: 22760 - RNA, 64 nt, hsa
cuaaaucccuguauuccaaaaccugcugcaucauaauaaauauaucuauauauauuuagcauaa

SEQ ID NO: 22761 - RNA, 64 nt, hsa
guacauggcgcugcauuuggcuauuuucuuuggaaauaaauaaugugauguuucucuuccucuu

SEQ ID NO: 22762 - RNA, 64 nt, hsa
ccaaaacuccuguggugguuuuaaaggugguuuaaauaaauaaggaugugcuggucccccuacu

SEQ ID NO: 22763 - RNA, 64 nt, hsa
caaagacuacguuuugcaguuuugcuuuccucccaauaaauauuaauguauguaauucuagagg

SEQ ID NO: 22764 - RNA, 64 nt, hsa
aaaaagcauguauugggccaccggaagacaagcuaauaaauaggcuggaaguaauauucuacca

SEQ ID NO: 22765 - RNA, 64 nt, hsa
caucugugguugaccucuguuauuguuuaaaaaaaauaaauaaaaauuaaaaaaaucugugcaa

SEQ ID NO: 22766 - RNA, 64 nt, hsa
cuaagguaggguagcauuugcuauugguaaagagaauaaauacacuuaauuucacaauacauug

SEQ ID NO: 22767 - RNA, 64 nt, hsa
cacuugcagguuuauggaaacagcaguauuugaaaauaaauaaaaagugggagaauuccuugcu

SEQ ID NO: 22768 - RNA, 64 nt, hsa
acacugggcagacuucagagcaguuuuuuaaaaaaauaaauauucuaauguagcuaucucgcca

SEQ ID NO: 22769 - RNA, 64 nt, hsa
gccuuuuauuccuuuaaaauuucgccuggcaaaaaauaaauaaauggaacuaucacuuuauaag

SEQ ID NO: 22770 - RNA, 64 nt, hsa
uaaugcaaacaaauuauuuuuuacaaaaaaacaaaauaaauaaaauuagacuuccuucccucac

SEQ ID NO: 22771 - RNA, 64 nt, hsa
uuuguucauaacauuaaaacaauaaagggcucauaauaaauaaauauauuuuugacacaauuaa

SEQ ID NO: 22772 - RNA, 64 nt, hsa
uucauaacauuaaaacaauaaagggcucauaauaaauaaauauauuuuugacacaauuaaauau

SEQ ID NO: 22773 - RNA, 64 nt, hsa
ucuuagaauaaauuagugaagaauuuaauuuuagaauaaauaauccaaucugaaauaauuauac

SEQ ID NO: 22774 - RNA, 64 nt, hsa
uuggccucucauaguuuucucucucuuuaaagagaauaaauagagggccaggugugguggcuca

SEQ ID NO: 22775 - RNA, 64 nt, hsa
aaaaaaaaaaaaaaaaaaaaaaagagagagagagaauaaauagaaaagaauguggcugggaauu

SEQ ID NO: 22776 - RNA, 64 nt, hsa
uuuauaucuguuccuaaaacaguuaauccugugaaauaaauauugaacauaauccagaagaauc

SEQ ID NO: 22777 - RNA, 64 nt, hsa
agucucaauccuacugucauucuuuuuauuuuaaaauaaauaaauaagccuaucuuuuugugcu

SEQ ID NO: 22778 - RNA, 64 nt, hsa
ucaauccuacugucauucuuuuuauuuuaaaauaaauaaauaagccuaucuuuuugugcuuaca

SEQ ID NO: 22779 - RNA, 64 nt, hsa
uauguauguacguauuucagguccuugaaauuuuaauaaauauuacaguuaaauccugauauga

SEQ ID NO: 22780 - RNA, 64 nt, hsa
aauaaccaguauuuaaguaaauguauaacgaaugaauaaauacaugcauaauauuuucaaaguu

SEQ ID NO: 22781 - RNA, 64 nt, hsa
aggagcuuuaaauaagaugauuuuaguagauugaaauaaauaaccaguauuuaaguaaauguau

SEQ ID NO: 22782 - RNA, 64 nt, hsa
ugacaugccaccgaaguacaaaguaaaauaaauaaauaaauacacauuuuggccuauuagcaaa

SEQ ID NO: 22783 - RNA, 64 nt, hsa
uaacugacaugccaccgaaguacaaaguaaaauaaauaaauaaauacacauuuuggccuauuag

SEQ ID NO: 22784 - RNA, 64 nt, hsa
auaauaacugacaugccaccgaaguacaaaguaaaauaaauaaauaaauacacauuuuggccua

SEQ ID NO: 22785 - RNA, 64 nt, hsa
guccagguacuuaaguaauuuuuuuuucauuucaaauaaauaccuauuuaccaccaaaagaaag

SEQ ID NO: 22786 - RNA, 64 nt, hsa
acacucucccucccccaucaccaucuucaauucuaauaaauaaugcugauguucaacaguugca

SEQ ID NO: 22787 - RNA, 64 nt, hsa
gaaagucagugcaaaauuaugaauaggauauacuaauaaauacaaaguaauaacaaaagucaaa

SEQ ID NO: 22788 - RNA, 64 nt, hsa
guaauaaauucuguaugaauaagcauaaaaaauaaauaaauaugcaauaacauuaaauuaaaug

SEQ ID NO: 22789 - RNA, 64 nt, hsa
gaaaguaauaaauucuguaugaauaagcauaaaaaauaaauaaauaugcaauaacauuaaauua

SEQ ID NO: 22790 - RNA, 64 nt, hsa
ugagaaaaaaauggucgguaaaguguucuuucauaauaaauaaucagacauggucccauuugca

SEQ ID NO: 22791 - RNA, 64 nt, hsa
auuucuaaugaggauucacauuaauauaauauaaaauaaauaggucaguuacuggucucuuucu

SEQ ID NO: 22792 - RNA, 64 nt, hsa
ccgaauguuauguuuugcuuuuaucucacaguaaaauaaauauaauuaaugguuugcaugugaa

SEQ ID NO: 22793 - RNA, 64 nt, hsa
uuuaaaaacauaacauaaauuuuuugaagucuuuaauaaauaacccauaauugaaguguauaau

SEQ ID NO: 22794 - RNA, 64 nt, hsa
caguuguaccaagugaaauuauuuuggagauuauaauaaauauauacauucaaucugaguugca

SEQ ID NO: 22795 - RNA, 64 nt, hsa
aacauuaaaucgcacuuuuaaagugagucauugaaauaaauaguacugaaaugauucucuaugu

SEQ ID NO: 22796 - RNA, 64 nt, hsa
uucauaauuuacaaaugggaauuucauuuauaauaauaaauaugaguguccuuuauuugccuag

SEQ ID NO: 22797 - RNA, 64 nt, hsa
uccagccugggcgacagagugagacuaucucaaaaauaaauaaauaaauaaauaaauaguauuu

SEQ ID NO: 22798 - RNA, 64 nt, hsa
gccugggcgacagagugagacuaucucaaaaauaaauaaauaaauaaauaaauaguauuuuuga

SEQ ID NO: 22799 - RNA, 64 nt, hsa
gggcgacagagugagacuaucucaaaaauaaauaaauaaauaaauaaauaguauuuuugagccu

SEQ ID NO: 22800 - RNA, 64 nt, hsa
gacagagugagacuaucucaaaaauaaauaaauaaauaaauaaauaguauuuuugagccuucaa

SEQ ID NO: 22801 - RNA, 64 nt, hsa
gagugagacuaucucaaaaauaaauaaauaaauaaauaaauaguauuuuugagccuucaagaua

SEQ ID NO: 22802 - RNA, 64 nt, hsa
ucauucuuuaaauauuauugacuuacaguuuaaaaauaaauaaauaaaagcauacuauaguugu

SEQ ID NO: 22803 - RNA, 64 nt, hsa
ucuuuaaauauuauugacuuacaguuuaaaaauaaauaaauaaaagcauacuauaguuguaaaa

SEQ ID NO: 22804 - RNA, 64 nt, hsa
gagaaaaaucucauauaauuugucauaaccuuucaauaaauaaaacuguuaaaucauggccuga

SEQ ID NO: 22805 - RNA, 64 nt, hsa
acuucucaauuaugccaaaguugcacuugcaugaaauaaauauuauuuuguccuuguauagacu

SEQ ID NO: 22806 - RNA, 64 nt, hsa
cuggacaacagagugagacuccuucucaaaaguaaauaaauaaauagcaaccaguacuccaggu

SEQ ID NO: 22807 - RNA, 64 nt, hsa
acaacagagugagacuccuucucaaaaguaaauaaauaaauagcaaccaguacuccaggugauu

SEQ ID NO: 22808 - RNA, 64 nt, hsa
cuguauggaauuuugucacuuaagaugagcugcaaauaaauaauaccuucaauggauaaccuug

SEQ ID NO: 22809 - RNA, 64 nt, hsa
gguucaaaagugguuuuuguuuauuaaauuugguaauaaauauauauaauacacagacaggaua

SEQ ID NO: 22810 - RNA, 64 nt, hsa
gaguaauggauguuuguuuuuuguguaauuugugaauaaauaguuuuuuucugcauuuugaaga

SEQ ID NO: 22811 - RNA, 64 nt, hsa
auaaaaaaguagggcuguuauuagagugccaaugaauaaauaacuuaagcacaaaauacauaga

SEQ ID NO: 22812 - RNA, 64 nt, hsa
uauaccuuuuauccggaaauauugguuuaaggcaaauaaauaaaacugugcuugcucuaaagcu

SEQ ID NO: 22813 - RNA, 64 nt, hsa
uguaauuauguuacauaaaagcaauguaaaucagaauaaauauguuagaccagaauaaaauuaa

SEQ ID NO: 22814 - RNA, 64 nt, hsa
ugcacagugugauuguuuacaaaaugauauuauaaauaaauaaaauacuucuucugucaguuug

SEQ ID NO: 22815 - RNA, 64 nt, hsa
caguugcaauauuuacugguuuuuaguagguuuuaauaaauauuucucugaguaauucacuggu

SEQ ID NO: 22816 - RNA, 64 nt, hsa
uacauaaauuauaucucaguaaagcuguuaaauaaauaaauauaguaaaaauuuuagaacuaaa

SEQ ID NO: 22817 - RNA, 64 nt, hsa
auaguacauaaauuauaucucaguaaagcuguuaaauaaauaaauauaguaaaaauuuuagaac

SEQ ID NO: 22818 - RNA, 64 nt, hsa
guggaguuggagggcuaacauauuuaauuaaauaaauaaauaaaucugggucugcaucucuuau

SEQ ID NO: 22819 - RNA, 64 nt, hsa
aaauguggaguuggagggcuaacauauuuaauuaaauaaauaaauaaaucugggucugcaucuc

SEQ ID NO: 22820 - RNA, 64 nt, hsa
uaauuuucagauaaguguaacuaagcacuuguguaauaaauauuagucauuuuauuucaaucua

SEQ ID NO: 22821 - RNA, 64 nt, hsa
uagaacugugauauuuugcuauuacuucaaugugaauaaauaagguaaaguauaucauuuauug

SEQ ID NO: 22822 - RNA, 64 nt, hsa
cauucuuccuggaaugguaugaaagcuucagcaaaauaaauaaaagucagaaucuuugcugguc

SEQ ID NO: 22823 - RNA, 64 nt, hsa
gcaugauagcaguguuuaaaaauacuuaggauuaaauaaauaauauggauuguuuuaaaaaaua

SEQ ID NO: 22824 - RNA, 64 nt, hsa
ggggcguuuguuuuauucuugguguuuucagugcaauaaauagcuacaaacuucugugcacucu

SEQ ID NO: 22825 - RNA, 64 nt, hsa
agaugcaaaauaauaauaauaauaauaauaaauaaauaaauaaaaauccaaacccaagucaaaa

SEQ ID NO: 22826 - RNA, 64 nt, hsa
cuuuagaugcaaaauaauaauaauaauaauaauaaauaaauaaauaaaaauccaaacccaaguc

SEQ ID NO: 22827 - RNA, 64 nt, hsa
cauccuuuagaugcaaaauaauaauaauaauaauaauaaauaaauaaauaaaaauccaaaccca

SEQ ID NO: 22828 - RNA, 64 nt, hsa
accaaguauaguaaaaugcugacaucuaaaacuaaauaaauagaaaacaccaggccagaacuau

SEQ ID NO: 22829 - RNA, 64 nt, hsa
uaacaagaugaucugaacaccucuccuuuguaucaauaaauagcccuguuauucugaagugaga

SEQ ID NO: 22830 - RNA, 64 nt, hsa
ggcggcuggauuccaggacaggagugaauguaaaaauaaauaucgcuuagaaugcaggagaagg

SEQ ID NO: 22831 - RNA, 64 nt, hsa
auuaucgaggaguuuuaaaguacuguaacuuuaaaauaaauaacuacaaagcuucuuuguccaa

SEQ ID NO: 22832 - RNA, 64 nt, hsa
uauauaaacuguacaaucuguaaaguuuuuauagaauaaauauucagcugugaaaacugguuaa

SEQ ID NO: 22833 - RNA, 64 nt, hsa
agcuaaugcaccuugagaaaaaucuggcauacugaauaaauaacauuaacuugggagccaagag

SEQ ID NO: 22834 - RNA, 64 nt, hsa
aauuuguaugccaccaauuuguauuauuugucucaauaaauacuuagucaucaaugcaucugua

SEQ ID NO: 22835 - RNA, 64 nt, hsa
uagccggagugacagaguaagacucugucucaaaaauaaauaaauaaauaaauaaauaaauaaa

SEQ ID NO: 22836 - RNA, 64 nt, hsa
cggagugacagaguaagacucugucucaaaaauaaauaaauaaauaaauaaauaaauaaauaaa

SEQ ID NO: 22837 - RNA, 64 nt, hsa
gugacagaguaagacucugucucaaaaauaaauaaauaaauaaauaaauaaauaaauaaauaaa

SEQ ID NO: 22838 - RNA, 64 nt, hsa
cagaguaagacucugucucaaaaauaaauaaauaaauaaauaaauaaauaaauaaauaaauaaa

SEQ ID NO: 22839 - RNA, 64 nt, hsa
guaagacucugucucaaaaauaaauaaauaaauaaauaaauaaauaaauaaauaaauaaauaaa

SEQ ID NO: 22840 - RNA, 64 nt, hsa
gacucugucucaaaaauaaauaaauaaauaaauaaauaaauaaauaaauaaauaaauaaaaaau

SEQ ID NO: 22841 - RNA, 64 nt, hsa
cugucucaaaaauaaauaaauaaauaaauaaauaaauaaauaaauaaauaaauaaaaaauaaua

SEQ ID NO: 22842 - RNA, 64 nt, hsa
cucaaaaauaaauaaauaaauaaauaaauaaauaaauaaauaaauaaauaaaaaauaauaauac

SEQ ID NO: 22843 - RNA, 64 nt, hsa
aaaauaaauaaauaaauaaauaaauaaauaaauaaauaaauaaauaaaaaauaauaauacaagu

SEQ ID NO: 22844 - RNA, 64 nt, hsa
uaaauaaauaaauaaauaaauaaauaaauaaauaaauaaauaaaaaauaauaauacaaguuuuc

SEQ ID NO: 22845 - RNA, 64 nt, hsa
cagccugggugacagcaagagaucuugucucagaaauaaauaaauaaaauuuaaaaauaaaaau

SEQ ID NO: 22846 - RNA, 64 nt, hsa
cugggugacagcaagagaucuugucucagaaauaaauaaauaaaauuuaaaaauaaaaauaaua

SEQ ID NO: 22847 - RNA, 64 nt, hsa
aaacuugguaacuguuuuacaaauauaaaaguauaauaaauaugcagcccaguuaaauauugau

SEQ ID NO: 22848 - RNA, 64 nt, hsa
guuggucauaaguuaacuguauuaagaacaguaaaauaaauaaaaaccaauaguacuaauuuug

SEQ ID NO: 22849 - RNA, 64 nt, hsa
ccagccugggugacaaagcaagacugugucucaaaauaaauaaauaaaauaaaauaaaaugacg

SEQ ID NO: 22850 - RNA, 64 nt, hsa
ccugggugacaaagcaagacugugucucaaaauaaauaaauaaaauaaaauaaaaugacguaca

SEQ ID NO: 22851 - RNA, 64 nt, hsa
ggaauuacuuuuuaaaauuccugugacaauuaauaauaaauaacgugucagcauuuaguaagca

SEQ ID NO: 22852 - RNA, 64 nt, hsa
guuucacaugguccaggugagguaaaacaauuaaaauaaauaaauaaauggucucagguuuaau

SEQ ID NO: 22853 - RNA, 64 nt, hsa
cacaugguccaggugagguaaaacaauuaaaauaaauaaauaaauggucucagguuuaauuugu

SEQ ID NO: 22854 - RNA, 64 nt, hsa
augccuacuauuauccugauuauggggucuccugaauaaauagaguauuaguccuuaugucauc

SEQ ID NO: 22855 - RNA, 64 nt, hsa
ugccuuuugucaaauaaucuugacaaugcuguauaauaaauauuuucuauuuauuaaaugugua

SEQ ID NO: 22856 - RNA, 64 nt, hsa
gccccacccugccucacccacccuuuuuuaaauaaauaaauagcuagacuggugacugauucuu

SEQ ID NO: 22857 - RNA, 64 nt, hsa
agaagccccacccugccucacccacccuuuuuuaaauaaauaaauagcuagacuggugacugau

SEQ ID NO: 22858 - RNA, 64 nt, hsa
auaaauacaaacuuguacuuaaaauguagcucucaauaaauaugcauuaugauuuacauacgaa

SEQ ID NO: 22859 - RNA, 64 nt, hsa
uaccaauaccuuccucauaggguacauaagauuaaauaaauacaaacuuguacuuaaaauguag

SEQ ID NO: 22860 - RNA, 64 nt, hsa
ggugacagagugagacccugucucuaaauaaauaaauaaauaaaauauaaaaauaacagucauc

SEQ ID NO: 22861 - RNA, 64 nt, hsa
ccuaggugacagagugagacccugucucuaaauaaauaaauaaauaaaauauaaaaauaacagu

SEQ ID NO: 22862 - RNA, 64 nt, hsa
ccagccuaggugacagagugagacccugucucuaaauaaauaaauaaauaaaauauaaaaauaa

SEQ ID NO: 22863 - RNA, 64 nt, hsa
gccugggcaacagagugagauccugacucaaauaaauaaauaagaagagcaguugccuaccaca

SEQ ID NO: 22864 - RNA, 64 nt, hsa
ucuagccugggcaacagagugagauccugacucaaauaaauaaauaagaagagcaguugccuac

SEQ ID NO: 22865 - RNA, 64 nt, hsa
gcacaugccaccacacuuggguaauuaaaaaauaaauaaauacuuuuuuguagagacagggucu

SEQ ID NO: 22866 - RNA, 64 nt, hsa
acaggcacaugccaccacacuuggguaauuaaaaaauaaauaaauacuuuuuuguagagacagg

SEQ ID NO: 22867 - RNA, 64 nt, hsa
accaaaaaugggcuuuuaucaaaauguaauaaaaaauaaauacaacuuuuccaaugacaaaacu

SEQ ID NO: 22868 - RNA, 64 nt, hsa
aggagugagccaccgcucccggcccagaacuuuuaauaaauauaaauacacagguaauuuuaac

SEQ ID NO: 22869 - RNA, 64 nt, hsa
uuuuuugcauccauagcacugguuacuuugaacaaauaaauaaaagcuuucuguaguugcuucc

SEQ ID NO: 22870 - RNA, 64 nt, hsa
uuuacuuuauuguaaauacuggugaacagugguuaauaaauaguuuuauauuccuuuaugcaau

SEQ ID NO: 22871 - RNA, 64 nt, hsa
auuuuaaagcauucuuugauacuguugcuuuugcaauaaauauggauaaucuugguuauaaggg

SEQ ID NO: 22872 - RNA, 64 nt, hsa
aaucuugguuauaagggaguuaaaacaaugcuguaauaaauaaagugcuucaugugaucaaaau

SEQ ID NO: 22873 - RNA, 64 nt, hsa
ccagccugggcaacagagcgagacuccaucucuaaauaaauaaauaaauaaauaaauaaauaaa

SEQ ID NO: 22874 - RNA, 64 nt, hsa
ccugggcaacagagcgagacuccaucucuaaauaaauaaauaaauaaauaaauaaauaaauaaa

SEQ ID NO: 22875 - RNA, 64 nt, hsa
ggcaacagagcgagacuccaucucuaaauaaauaaauaaauaaauaaauaaauaaauaaauaaa

SEQ ID NO: 22876 - RNA, 64 nt, hsa
acagagcgagacuccaucucuaaauaaauaaauaaauaaauaaauaaauaaauaaauaaauaaa

SEQ ID NO: 22877 - RNA, 64 nt, hsa
agcgagacuccaucucuaaauaaauaaauaaauaaauaaauaaauaaauaaauaaauaaacaaa

SEQ ID NO: 22878 - RNA, 64 nt, hsa
agacuccaucucuaaauaaauaaauaaauaaauaaauaaauaaauaaauaaauaaacaaaccag

SEQ ID NO: 22879 - RNA, 64 nt, hsa
uccaucucuaaauaaauaaauaaauaaauaaauaaauaaauaaauaaauaaacaaaccagucuu

SEQ ID NO: 22880 - RNA, 64 nt, hsa
ucucuaaauaaauaaauaaauaaauaaauaaauaaauaaauaaauaaacaaaccagucuuuauu

SEQ ID NO: 22881 - RNA, 64 nt, hsa
uaaauaaauaaauaaauaaauaaauaaauaaauaaauaaauaaacaaaccagucuuuauuuuaa

SEQ ID NO: 22882 - RNA, 64 nt, hsa
ugaaaagaaucucaacauagaagaaagaagaaacaauaaauauucugcagauuaaugcagcaaa

SEQ ID NO: 22883 - RNA, 64 nt, hsa
gaugcuucuuaugaucagaacucuuuuuuaauaaaauaaauaacauaaaucguugaacauaaug

SEQ ID NO: 22884 - RNA, 64 nt, hsa
uuguacuccagugccuaguauauaagagauacucaauaaauaaauauuugucaaaucaacuaau

SEQ ID NO: 22885 - RNA, 64 nt, hsa
acuccagugccuaguauauaagagauacucaauaaauaaauauuugucaaaucaacuaauugau

SEQ ID NO: 22886 - RNA, 64 nt, hsa
uuuuguaaauaucuuuguauauuuuucugcaauaaauaaauauaaaaaauuuagagaaccuuag

SEQ ID NO: 22887 - RNA, 64 nt, hsa
auuguuuuguaaauaucuuuguauauuuuucugcaauaaauaaauauaaaaaauuuagagaacc

SEQ ID NO: 22888 - RNA, 64 nt, hsa
gcaugcuucauaaccauaauucuuauuuuucuuuaauaaauauuuuucuacuuguaacacugug

SEQ ID NO: 22889 - RNA, 64 nt, hsa
augucauaagagaaacagaugugcauauacacacaauaaauaagaaaauuaauaauuguauuaa

SEQ ID NO: 22890 - RNA, 64 nt, hsa
agcagaguuuacgggucuuaggaugucuguaauaaauaaauauacucaaguuucagguaugcuu

SEQ ID NO: 22891 - RNA, 64 nt, hsa
ccagagcagaguuuacgggucuuaggaugucuguaauaaauaaauauacucaaguuucagguau

SEQ ID NO: 22892 - RNA, 64 nt, hsa
uguuguaauuguaguauuguuuuuguaauuuaacaauaaauaagccugcuacauguaaaaagaa

SEQ ID NO: 22893 - RNA, 64 nt, hsa
aguauauacuaagcucuacagggacagaaugcuuaauaaauacuuuaauaagauaugggaaaau

SEQ ID NO: 22894 - RNA, 64 nt, hsa
aaaucuccuuucuacugguuauguaaauaaaucaaauaaauauaucaaaaugagugcagauaag

SEQ ID NO: 22895 - RNA, 64 nt, hsa
auuuuuauuuucuaugauuucuagaaacaaauguaauaaauauuuuuaaaaucuccuuucuacu

SEQ ID NO: 22896 - RNA, 64 nt, hsa
agaacucuuuccacuggacugguauuugcucaaaaauaaauaaugguagagaagaaaacuauaa

SEQ ID NO: 22897 - RNA, 64 nt, hsa
uccagccugggcaacagaguaacucuccuucucaaauaaauaaauaaauaaauaagaaacacug

SEQ ID NO: 22898 - RNA, 64 nt, hsa
gccugggcaacagaguaacucuccuucucaaauaaauaaauaaauaaauaagaaacacugaugu

SEQ ID NO: 22899 - RNA, 64 nt, hsa
gggcaacagaguaacucuccuucucaaauaaauaaauaaauaaauaagaaacacugaugugucu

SEQ ID NO: 22900 - RNA, 64 nt, hsa
cauuuguaaggcugcaacauaauauuaaaaugugaauaaauaaauguucugauaaaauagaaaa

SEQ ID NO: 22901 - RNA, 64 nt, hsa
aagcaaccugucuuacauucuuacauuaucuuaaaauaaauauuucugcccuugaaucaagaaa

SEQ ID NO: 22902 - RNA, 64 nt, hsa
uucucuguucaaccucaguguuucaaaaguuccuaauaaauaaacucauuugaguugaaccuac

SEQ ID NO: 22903 - RNA, 64 nt, hsa
aaacucauuugaguugaaccuacuuuuauguagaaauaaauaaguuucuucaucauucagauag

SEQ ID NO: 22904 - RNA, 64 nt, hsa
gucucguggucuuguaaugcacugguaaaaacaaaauaaauagaugaauaaauaaagagugaga

SEQ ID NO: 22905 - RNA, 64 nt, hsa
uguaaugcacugguaaaaacaaaauaaauagaugaauaaauaaagagugagagaagagagaauc

SEQ ID NO: 22906 - RNA, 64 nt, hsa
gcagaaaggcauggcuaauaauguugguggugaaaauaaauaaauaaguaaacaaaaugaagau

SEQ ID NO: 22907 - RNA, 64 nt, hsa
aaaggcauggcuaauaauguugguggugaaaauaaauaaauaaguaaacaaaaugaagauugcc

SEQ ID NO: 22908 - RNA, 64 nt, hsa
guuauauaugaaauacucauauguuuaugaccaaaauaaauaugaaaccucauauuaaaaaggu

SEQ ID NO: 22909 - RNA, 64 nt, hsa
uaauuuuagagguauauagccauauuuauuuauaaauaaauauuuauuuauuuauuuauaagua

SEQ ID NO: 22910 - RNA, 64 nt, hsa
guacaaccuugaaucacuugagcauguaauaacuaauaaauaaugcagauccaugugauuauua

SEQ ID NO: 22911 - RNA, 64 nt, hsa
uuuuuauggaaccuguugcgccuauuuaugaaauaauaaauauagguguuuguaaguaaauuug

SEQ ID NO: 22912 - RNA, 64 nt, hsa
gugauaauacaacuuguuauaaaauuuauuccucaauaaauauaauuucucuacuaugcaaaaa

SEQ ID NO: 22913 - RNA, 64 nt, hsa
cuugagccaaucugagagcaaaauaauugagaaaaauaaauaacaagauaauugagaaaaaaau

SEQ ID NO: 22914 - RNA, 64 nt, hsa
gacuuuuuguaaacauaggagucccuuuauuuuaaauaaauaacuagucauaucauuaggucca

SEQ ID NO: 22915 - RNA, 64 nt, hsa
cagagaagaaaaacgugaggacucaggaaaaauaaauaaauaaaagaacagccuuuucccuuag

SEQ ID NO: 22916 - RNA, 64 nt, hsa
uugucagagaagaaaaacgugaggacucaggaaaaauaaauaaauaaaagaacagccuuuuccc

SEQ ID NO: 22917 - RNA, 64 nt, hsa
gcuuagccaguuuauuuucucuaauuuaauggauaauaaauauuaagcucuugguuaaauguuu

SEQ ID NO: 22918 - RNA, 64 nt, hsa
cugacaugguaauuuggauagggugaagcuuugaaauaaauacugcaccaaaaaugugaaaaag

SEQ ID NO: 22919 - RNA, 64 nt, hsa
uugucuaaagccaaggagucauaaaaccaugagaaauaaauaggaaucaauaguuaguagugac

SEQ ID NO: 22920 - RNA, 62 nt, hsa
gaauguuuuaacagugucauaugaaaaagaacaaaauaaauauuuugauuuugugauucuau

SEQ ID NO: 22921 - RNA, 64 nt, hsa
aacacaauguugacauuguaguuacacaaacacaaauaaauauuuuauuuaaaauucuggaagu

SEQ ID NO: 22922 - RNA, 64 nt, hsa
augcuuuugggauacagaccuauguuuacaauauaauaaauauuauugcuaucuuuuaaagaua

SEQ ID NO: 22923 - RNA, 64 nt, hsa
aggacuaagugagaaaaacugcuuauaagugcuuaauaaauacuaguuauuuacaacuuuugcu

SEQ ID NO: 22924 - RNA, 64 nt, hsa
aaaacacucaguugauaaaccuuaguacucagauaauaaauaagagaccaaaaguaggcuauca

SEQ ID NO: 22925 - RNA, 64 nt, hsa
agucugggugacagagcaagacuccaucucaaaaaauaaauaaauagaaagagagagagaggaa

SEQ ID NO: 22926 - RNA, 64 nt, hsa
ugggugacagagcaagacuccaucucaaaaaauaaauaaauagaaagagagagagaggaaaaaa

SEQ ID NO: 22927 - RNA, 64 nt, hsa
agccuaauugagcccuauuauuuuaacuuaacaaaauaaauacagaaguaccuauuucuaaaca

SEQ ID NO: 22928 - RNA, 64 nt, hsa
aggaaugagccaggagaacaaacuaauuccuuuaaauaaauaaaaaaaaaaaaugcaaaugucc

SEQ ID NO: 22929 - RNA, 64 nt, hsa
ggcagcauuguugagagauugguaacacugagcaaauaaauauguugagaaugaugacagcaag

SEQ ID NO: 22930 - RNA, 64 nt, hsa
aauagaacucauaucuuuuaaauauauaggaacaaauaaauaaauuguugugugugcacauaug

SEQ ID NO: 22931 - RNA, 64 nt, hsa
uagcuaacaggaaacaacuacuguguuucaacauaauaaauauaauagaaaaauauuuuauuug

SEQ ID NO: 22932 - RNA, 64 nt, hsa
acacaaaaugauauacacugaaguugaugaagcaaauaaauauucuggcuucuuuuucaaggua

SEQ ID NO: 22933 - RNA, 64 nt, hsa
aacaagagcgaaacugucucaaaaaaaagaagaaaauaaauaaauaaaaaucagagcacaagaa

SEQ ID NO: 22934 - RNA, 64 nt, hsa
agagcgaaacugucucaaaaaaaagaagaaaauaaauaaauaaaaaucagagcacaagaaguac

SEQ ID NO: 22935 - RNA, 64 nt, hsa
cucgaaauaacagaaacaaagucaauaaagugaaaauaaauaaaaauccuugaacaaauccgaa

SEQ ID NO: 22936 - RNA, 64 nt, hsa
ucguuuugauucuuuuucuuuugugcacauaagaaauaaauaauaauaauaaauaaagaauaaa

SEQ ID NO: 22937 - RNA, 64 nt, hsa
uuuucuuuugugcacauaagaaauaaauaauaauaauaaauaaagaauaaaauuuuguauguca

SEQ ID NO: 22938 - RNA, 64 nt, hsa
ugcuaguaaaagcugccucauacauacugaguaaaauaaauacggaauuguauuuuuuuuguaa

SEQ ID NO: 22939 - RNA, 64 nt, hsa
ucaacugcuacaaauaaaugucaaaagguugaauaauaaauauuacaaugagccauuaaguuua

SEQ ID NO: 22940 - RNA, 64 nt, hsa
caaacgauuuuacuagacuuuauguuuaaaaauaaauaaauaagggaaauuccuaacuuugccc

SEQ ID NO: 22941 - RNA, 64 nt, hsa
auggcaaacgauuuuacuagacuuuauguuuaaaaauaaauaaauaagggaaauuccuaacuuu

SEQ ID NO: 22942 - RNA, 64 nt, hsa
guuuucucauuucuuaaaccagaaguuuaugacaaauaaauaugccauguaauaugaaagcugc

SEQ ID NO: 22943 - RNA, 64 nt, hsa
agugacccaaacaggauuauaaagucaagugaggaauaaauagcagaaaaauaccuuaaaggaa

SEQ ID NO: 22944 - RNA, 64 nt, hsa
cccugauauugguuccugaugcccccccaacaaaaauaaauaaauaaauuauggcugcuuuauu

SEQ ID NO: 22945 - RNA, 64 nt, hsa
gauauugguuccugaugcccccccaacaaaaauaaauaaauaaauuauggcugcuuuauuuaaa

SEQ ID NO: 22946 - RNA, 64 nt, hsa
agagcaagacucugucucaaaaaaaauaaaauaaaauaaauaaaaaaagauauaguauuaaugc

SEQ ID NO: 22947 - RNA, 64 nt, hsa
caauguacaugaaauuauauguguguggugugugaauaaauauguaugaauauauggucugugu

SEQ ID NO: 22948 - RNA, 64 nt, hsa
aagaauuuaauagguacagaaguuuauucuggauaauaaauaaauaaggaucacacuguauuag

SEQ ID NO: 22949 - RNA, 64 nt, hsa
auuuaauagguacagaaguuuauucuggauaauaaauaaauaaggaucacacuguauuaggggu

SEQ ID NO: 22950 - RNA, 64 nt, hsa
cagcccggccuacaagaacaaaacuccaucucaaaauaaauaaaaaaauaaauaaaaauaaaaa

SEQ ID NO: 22951 - RNA, 64 nt, hsa
caagaacaaaacuccaucucaaaauaaauaaaaaaauaaauaaaaauaaaaauagacuauauau

SEQ ID NO: 22952 - RNA, 64 nt, hsa
cauuuauucuuuauuauuuauuuauuuguggucaaauaaauaaauaagguuauuuauuuauuuc

SEQ ID NO: 22953 - RNA, 64 nt, hsa
uauucuuuauuauuuauuuauuuguggucaaauaaauaaauaagguuauuuauuuauuucguuc

SEQ ID NO: 22954 - RNA, 64 nt, hsa
uggcugaggcagggccuucagcuaucauuugguuaauaaauacauuuuaguauuugcauuuccu

SEQ ID NO: 22955 - RNA, 64 nt, hsa
auggacaccaugagauguuaauauucauacauguaauaaauagaaugaugaagaaacuuuguuu

SEQ ID NO: 22956 - RNA, 64 nt, hsa
augaaguauggcauauuuugauuuuuuuaauuguaauaaauauucuuaaaguuaccacauccca

SEQ ID NO: 22957 - RNA, 64 nt, hsa
uggcaacagagcaagacuccgucucacaaaaaugaauaaauaaaauaaaaauaaaaauguuacu

SEQ ID NO: 22958 - RNA, 64 nt, hsa
ccagccuggcgacagagcaagacuccaucucaaaaauaaauaaauaaauaaauaaauaaauaaa

SEQ ID NO: 22959 - RNA, 64 nt, hsa
ccuggcgacagagcaagacuccaucucaaaaauaaauaaauaaauaaauaaauaaauaaauaaa

SEQ ID NO: 22960 - RNA, 64 nt, hsa
gcgacagagcaagacuccaucucaaaaauaaauaaauaaauaaauaaauaaauaaauaaauaaa

SEQ ID NO: 22961 - RNA, 64 nt, hsa
cagagcaagacuccaucucaaaaauaaauaaauaaauaaauaaauaaauaaauaaauaaauaaa

SEQ ID NO: 22962 - RNA, 64 nt, hsa
ccaucucaaaaauaaauaaauaaauaaauaaauaaauaaauaaauaaauaaauaaauaaauaaa

SEQ ID NO: 22963 - RNA, 64 nt, hsa
cucaaaaauaaauaaauaaauaaauaaauaaauaaauaaauaaauaaauaaauaaauaaaauag

SEQ ID NO: 22964 - RNA, 64 nt, hsa
aaaauaaauaaauaaauaaauaaauaaauaaauaaauaaauaaauaaauaaauaaaauaguaca

SEQ ID NO: 22965 - RNA, 64 nt, hsa
uaaauaaauaaauaaauaaauaaauaaauaaauaaauaaauaaauaaauaaaauaguacagaca

SEQ ID NO: 22966 - RNA, 64 nt, hsa
uaaauaaauaaauaaauaaauaaauaaauaaauaaauaaauaaauaaaauaguacagacagaca

SEQ ID NO: 22967 - RNA, 64 nt, hsa
uaaauaaauaaauaaauaaauaaauaaauaaauaaauaaauaaaauaguacagacagacacaug

SEQ ID NO: 22968 - RNA, 64 nt, hsa
agagcaacauagugagaccacaucucuaccaguaaauaaauaaauaaauaaauaaauaaauaaa

SEQ ID NO: 22969 - RNA, 64 nt, hsa
caacauagugagaccacaucucuaccaguaaauaaauaaauaaauaaauaaauaaauaaauaaa

SEQ ID NO: 22970 - RNA, 64 nt, hsa
auagugagaccacaucucuaccaguaaauaaauaaauaaauaaauaaauaaauaaauaaauaaa

SEQ ID NO: 22971 - RNA, 64 nt, hsa
ugagaccacaucucuaccaguaaauaaauaaauaaauaaauaaauaaauaaauaaauaaauagc

SEQ ID NO: 22972 - RNA, 64 nt, hsa
accacaucucuaccaguaaauaaauaaauaaauaaauaaauaaauaaauaaauaaauagcuggg

SEQ ID NO: 22973 - RNA, 64 nt, hsa
caucucuaccaguaaauaaauaaauaaauaaauaaauaaauaaauaaauaaauagcugggcaua

SEQ ID NO: 22974 - RNA, 64 nt, hsa
ucuaccaguaaauaaauaaauaaauaaauaaauaaauaaauaaauaaauagcugggcauagugg

SEQ ID NO: 22975 - RNA, 64 nt, hsa
ccaguaaauaaauaaauaaauaaauaaauaaauaaauaaauaaauagcugggcauaguggcuca

SEQ ID NO: 22976 - RNA, 64 nt, hsa
uaaauaaauaaauaaauaaauaaauaaauaaauaaauaaauagcugggcauaguggcucaugcc

SEQ ID NO: 22977 - RNA, 64 nt, hsa
uaugcauuugcuuuuaaaccauuucuuuuguuuaaauaaauaaauaaguaaauaaagcuaguuc

SEQ ID NO: 22978 - RNA, 64 nt, hsa
cauuugcuuuuaaaccauuucuuuuguuuaaauaaauaaauaaguaaauaaagcuaguucuauu

SEQ ID NO: 22979 - RNA, 64 nt, hsa
gcagaguuauuuuccuauaucucacaguauuaaaaauaaauaauuaaaaauuaagaauaaauaa

SEQ ID NO: 22980 - RNA, 64 nt, hsa
ucacaguauuaaaaauaaauaauuaaaaauuaagaauaaauaaacgaguugaccucggucacaa

SEQ ID NO: 22981 - RNA, 64 nt, hsa
uguaacuuuuugugucuugucaugucagagaauaaauaaauauucuaaguagaugcugcugucu

SEQ ID NO: 22982 - RNA, 64 nt, hsa
aaguuguaacuuuuugugucuugucaugucagagaauaaauaaauauucuaaguagaugcugcu

SEQ ID NO: 22983 - RNA, 64 nt, hsa
uguguuauucuuaguacccacugauaaauugugcaauaaauaaucuuucgcaagugauuuuagc

SEQ ID NO: 22984 - RNA, 64 nt, hsa
cuacugugaauauaaaauguuauuagccuuaucaaauaaauaaaugagcacagcucuuuguucg

SEQ ID NO: 22985 - RNA, 64 nt, hsa
gaaauacaauaaauacagaaaagucauaugguugaauaaauaauuauaaauugagcacugaugg

SEQ ID NO: 22986 - RNA, 64 nt, hsa
acuuuuuucccaaacuuuuaaaaguaggaaauacaauaaauacagaaaagucauaugguugaau

SEQ ID NO: 22987 - RNA, 64 nt, hsa
ucuaaucaugguuaacuauuuuguuauuguuuguaauaaauauauguacuuuuauauccugauc

SEQ ID NO: 22988 - RNA, 64 nt, hsa
uaaucuacagauaauuucuacugaagacaguuacaauaaauaacuuuaugcagauuaauauaua

SEQ ID NO: 22989 - RNA, 64 nt, hsa
acaacagcaaaacuccaucucaaaaaauaaaauaaauaaauaaacaaauaaaaaauucauaaug

SEQ ID NO: 22990 - RNA, 64 nt, hsa
ggcaacaacagcaaaacuccaucucaaaaaauaaaauaaauaaauaaacaaauaaaaaauucau

SEQ ID NO: 22991 - RNA, 64 nt, hsa
gugggucaaacagaaucaaaacaaaacccaaagaaauaaauaaaaaacaaaauggcuaaauagu

SEQ ID NO: 22992 - RNA, 64 nt, hsa
uuaaagauuaacuacaaagauaaacauggccaaaaauaaauaaauaaauauggccauauguccg

SEQ ID NO: 22993 - RNA, 64 nt, hsa
agauuaacuacaaagauaaacauggccaaaaauaaauaaauaaauauggccauauguccguugu

SEQ ID NO: 22994 - RNA, 64 nt, hsa
uaacuacaaagauaaacauggccaaaaauaaauaaauaaauauggccauauguccguuguugcu

SEQ ID NO: 22995 - RNA, 52 nt, hsa
agaagagguugaagagguaaaaaauaaauaaauacauaaaaagcaaacaagc

SEQ ID NO: 22996 - RNA, 56 nt, hsa
agaagagguugaagagguaaaaaauaaauaaauacauaaaaagcaaacaagcgggg

SEQ ID NO: 22997 - RNA, 64 nt, hsa
uccagccugggugacagagugagacuccaucauaaauaaauaaauaaauaaaugggucacauua

SEQ ID NO: 22998 - RNA, 64 nt, hsa
gccugggugacagagugagacuccaucauaaauaaauaaauaaauaaaugggucacauuaagcc

SEQ ID NO: 22999 - RNA, 64 nt, hsa
gggugacagagugagacuccaucauaaauaaauaaauaaauaaaugggucacauuaagccuuua

SEQ ID NO: 23000 - RNA, 64 nt, hsa
aaagugaaugacguuuguuuagccaguaggagaaaauaaauaaauaaauaaaucccuucguguu

SEQ ID NO: 23001 - RNA, 64 nt, hsa
ugaaugacguuuguuuagccaguaggagaaaauaaauaaauaaauaaaucccuucguguuaccc

SEQ ID NO: 23002 - RNA, 64 nt, hsa
ugacguuuguuuagccaguaggagaaaauaaauaaauaaauaaaucccuucguguuacccuccu

SEQ ID NO: 23003 - RNA, 64 nt, hsa
aucuacuuccuacagagccaaaaugccauuuagcaauaaauaacacuugucagccucagagcau

SEQ ID NO: 23004 - RNA, 64 nt, hsa
cacguuuuuacauacuuuugcaaaauaaguaaauaauaaauaaaauaaaagccaaccuucaaag

SEQ ID NO: 23005 - RNA, 64 nt, hsa
cugugcuuaaacaaaaugccauuaaugggauuauaauaaauauaaugugguagaauucaaguuu

SEQ ID NO: 23006 - RNA, 64 nt, hsa
auuaacugaggaauaaaagacugaagaaagacauaauaaauaguuaaaggauuauggaaaagau

SEQ ID NO: 23007 - RNA, 64 nt, hsa
auauucaccugaaaacuccaaacucuuuuagaaaaauaaauaaauauuuauagaccucuuuuag

SEQ ID NO: 23008 - RNA, 64 nt, hsa
ucaccugaaaacuccaaacucuuuuagaaaaauaaauaaauauuuauagaccucuuuuagauau

SEQ ID NO: 23009 - RNA, 64 nt, hsa
gugguguauaugagacuuucaagggaauuaaauaaauaaauaagaauguuauugauuugaguuu

SEQ ID NO: 23010 - RNA, 64 nt, hsa
cuuagugguguauaugagacuuucaagggaauuaaauaaauaaauaagaauguuauugauuuga

SEQ ID NO: 23011 - RNA, 64 nt, hsa
cucccagaacuuaaaguaaaauaaaaaauaaauaaauaaauaaaaucuuuuccacagagaaagg

SEQ ID NO: 23012 - RNA, 64 nt, hsa
uuuccucccagaacuuaaaguaaaauaaaaaauaaauaaauaaauaaaaucuuuuccacagaga

SEQ ID NO: 23013 - RNA, 64 nt, hsa
gucuuuuccucccagaacuuaaaguaaaauaaaaaauaaauaaauaaauaaaaucuuuuccaca

SEQ ID NO: 23014 - RNA, 64 nt, hsa
aaaaugugaauucauguggaagggacauuaauccaauaaauaaggaaagaagcuguugcauuac

SEQ ID NO: 23015 - RNA, 64 nt, hsa
aaaguguaaaaaaaaauaaaaauaaaaauaaauaaauaaauaaaauuaaaaaaaauaaaaacca

SEQ ID NO: 23016 - RNA, 64 nt, hsa
ugcuaaaguguaaaaaaaaauaaaaauaaaaauaaauaaauaaauaaaauuaaaaaaaauaaaa

SEQ ID NO: 23017 - RNA, 64 nt, hsa
aaagugcuaaaguguaaaaaaaaauaaaaauaaaaauaaauaaauaaauaaaauuaaaaaaaau

SEQ ID NO: 23018 - RNA, 64 nt, hsa
gcugguguuuaaaaaacaucacuuaaaaaaaaagaauaaauaguucuaaaagcaaguuuggcaa

SEQ ID NO: 23019 - RNA, 64 nt, hsa
agcucugaaauaacaagagcucuguaauaacaguaauaaauagcucugaaauaacaguccuaag

SEQ ID NO: 23020 - RNA, 64 nt, hsa
cagccugggcaacauggcgaaaccccgucucuacaauaaauacaaaaaauuauccuggcggagu

SEQ ID NO: 23021 - RNA, 64 nt, hsa
acaaugaaucuaaaaugcuuaucacaguacuuucaauaaauagcuauuagccaggugcgguggc

SEQ ID NO: 23022 - RNA, 64 nt, hsa
ccaggacauguaaaaaaaaaaaaaaaacaacaacaauaaauagggcaugugaaauguuaaguua

SEQ ID NO: 23023 - RNA, 64 nt, hsa
aaucguuuaugccaugauaaauacaagauugguaaauaaauacauugauugguaaauuaugaga

SEQ ID NO: 23024 - RNA, 64 nt, hsa
ucuauuuguaaaguuuauuugucuuaacucauuuaauaaauauacuguuuaucuguuucugaau

SEQ ID NO: 23025 - RNA, 64 nt, hsa
uuccuuuuguuuuugaaacuuguuuguaaacauaaauaaauaugcccuuuuauuaaauaaauuc

SEQ ID NO: 23026 - RNA, 64 nt, hsa
uagagaacugauguuucaauuuaccccucugcuaaauaaauauuaaaacuaucaugugacuuca

SEQ ID NO: 23027 - RNA, 64 nt, hsa
accuggcaaaaucuuguuaaugucauugcuaaaaaauaaauaaaagcuagauacuggaaaccua

SEQ ID NO: 23028 - RNA, 64 nt, hsa
uggcaaagugagacucugucucaauaaauaaauaaauaaauaaaaauaagccuguggccuguuu

SEQ ID NO: 23029 - RNA, 64 nt, hsa
ugaguggcaaagugagacucugucucaauaaauaaauaaauaaauaaaaauaagccuguggccu

SEQ ID NO: 23030 - RNA, 64 nt, hsa
agccugaguggcaaagugagacucugucucaauaaauaaauaaauaaauaaaaauaagccugug

SEQ ID NO: 23031 - RNA, 64 nt, hsa
cuccagccugaguggcaaagugagacucugucucaauaaauaaauaaauaaauaaaaauaagcc

SEQ ID NO: 23032 - RNA, 64 nt, hsa
cucgugccuuauauuugugugccaauuaaugccuaauaaauaccaugugcuuaaacaaguacaa

SEQ ID NO: 23033 - RNA, 64 nt, hsa
ucuguguugacaagaguuguggacaaaaagccaaaauaaauauucuuccugauuaaaaaaauuu

SEQ ID NO: 23034 - RNA, 64 nt, hsa
agauaagacccaaucuuuauuuaaaaaauaaauaaauaaauagccaaaaaaacuuaguguggug

SEQ ID NO: 23035 - RNA, 64 nt, hsa
agugagauaagacccaaucuuuauuuaaaaaauaaauaaauaaauagccaaaaaaacuuagugu

SEQ ID NO: 23036 - RNA, 64 nt, hsa
acagagugagauaagacccaaucuuuauuuaaaaaauaaauaaauaaauagccaaaaaaacuua

SEQ ID NO: 23037 - RNA, 64 nt, hsa
gaagagccuuuuaaaaacauuugccaaccucaagaauaaauacugaaagucuugaaaguauggu

SEQ ID NO: 23038 - RNA, 64 nt, hsa
cauuuuuuuucuucuguacaacuggucagauuucaauaaauaaucauugaugguuuacugugua

SEQ ID NO: 23039 - RNA, 64 nt, hsa
auuuucacugaaugaaugaaucagugaguuaaugaauaaauaaacaaaugggagguguucuccu

SEQ ID NO: 23040 - RNA, 64 nt, hsa
acauacuaguaacaaauguaaaauacaugaaacaaauaaauauuuccuguguccucugaacuuu

SEQ ID NO: 23041 - RNA, 64 nt, hsa
uaucaccccucucccuaucauuaacuaucaaauaaauaaauaaaagcaaucugauuuccaacgu

SEQ ID NO: 23042 - RNA, 64 nt, hsa
guucuaucaccccucucccuaucauuaacuaucaaauaaauaaauaaaagcaaucugauuucca

SEQ ID NO: 23043 - RNA, 64 nt, hsa
ucgguuugugagggguguuugaugacuuugacagaauaaauaucuaaacaauuauccuuguuac

SEQ ID NO: 23044 - RNA, 64 nt, hsa
gguuuuuguuaaggcaugacagaugauuuaaacaaauaaauagcaugcaacaaaaugucuuuau

SEQ ID NO: 23045 - RNA, 64 nt, hsa
cagccuaggugacagagugagacccugucucaaaaauaaauaauaaauaaauaaauguucagau

SEQ ID NO: 23046 - RNA, 64 nt, hsa
ggugacagagugagacccugucucaaaaauaaauaauaaauaaauaaauguucagauccuuggc

SEQ ID NO: 23047 - RNA, 64 nt, hsa
acagagugagacccugucucaaaaauaaauaauaaauaaauaaauguucagauccuuggcuucu

SEQ ID NO: 23048 - RNA, 64 nt, hsa
agauauguuuauucuauuauuguaaauuucaaacaauaaauaaauaagaauccaugacuuccuu

SEQ ID NO: 23049 - RNA, 64 nt, hsa
auguuuauucuauuauuguaaauuucaaacaauaaauaaauaagaauccaugacuuccuucagu

SEQ ID NO: 23050 - RNA, 64 nt, hsa
acagggcugggcuacuaagcuuuuucaguugaaaaauaaauaaauaaauaaauaaacaccacac

SEQ ID NO: 23051 - RNA, 64 nt, hsa
ggcugggcuacuaagcuuuuucaguugaaaaauaaauaaauaaauaaauaaacaccacacccag

SEQ ID NO: 23052 - RNA, 64 nt, hsa
gggcuacuaagcuuuuucaguugaaaaauaaauaaauaaauaaauaaacaccacacccagcuaa

SEQ ID NO: 23053 - RNA, 64 nt, hsa
uacuaagcuuuuucaguugaaaaauaaauaaauaaauaaauaaacaccacacccagcuaauuuu

SEQ ID NO: 23054 - RNA, 64 nt, hsa
gccucggcgacagagcaagaccuuguuucucaaaaauaaauaaauagaaggaaauaaauguaaa

SEQ ID NO: 23055 - RNA, 64 nt, hsa
cggcgacagagcaagaccuuguuucucaaaaauaaauaaauagaaggaaauaaauguaaaaaug

SEQ ID NO: 23056 - RNA, 64 nt, hsa
uacaucuacuuuauaucucauauugcuguaagauaauaaauagguauuuuaaaacauuguuuaa

SEQ ID NO: 23057 - RNA, 64 nt, hsa
aaaauagcauagaaaucauauauuuauuucauaaaauaaauagaaacuuugucuccuguguucc

SEQ ID NO: 23058 - RNA, 64 nt, hsa
uccuagaaagauuuuaaugugagcuuaagauguaaauaaauaauuuugcaaacaugccuuuugu

SEQ ID NO: 23059 - RNA, 64 nt, hsa
aguuuuucuaaauagacccuuaugggaguuugaaaauaaauacucacauauuucacuacuuaaa

SEQ ID NO: 23060 - RNA, 64 nt, hsa
gccugguacagugccaagcacauacuugguauccaauaaauauuuguuggaugaauguaugcau

SEQ ID NO: 23061 - RNA, 64 nt, hsa
cacaauucuggaacuauaauacuguaagccuuagaauaaauaauacuuucaaguuccaaucuaa

SEQ ID NO: 23062 - RNA, 64 nt, hsa
cagccugggcaacaagagugaaacuccgucucaaaauaaauaaauaauaaaggaagaagucagc

SEQ ID NO: 23063 - RNA, 64 nt, hsa
cugggcaacaagagugaaacuccgucucaaaauaaauaaauaauaaaggaagaagucagcuggg

SEQ ID NO: 23064 - RNA, 64 nt, hsa
aacuuugggacauccccuggaguuuuuaaaaauaaauaaauauauauauauauaaaaaaaacuc

SEQ ID NO: 23065 - RNA, 64 nt, hsa
uacuaacuuugggacauccccuggaguuuuuaaaaauaaauaaauauauauauauauaaaaaaa

SEQ ID NO: 23066 - RNA, 64 nt, hsa
cuccagccuggguaacagagcgagaccccgacucaauaaauaaauaaggauggauaaauuguag

SEQ ID NO: 23067 - RNA, 64 nt, hsa
agccuggguaacagagcgagaccccgacucaauaaauaaauaaggauggauaaauuguagcgua

SEQ ID NO: 23068 - RNA, 64 nt, hsa
aaaugguuuucuauucucaaaagugacccaagccaauaaauagcauuaguagcuucuguggggg

SEQ ID NO: 23069 - RNA, 64 nt, hsa
aaauauugacaaauggauaugguuagccuuuauaaauaaauaaaaaaaaaaguguugcuuucuu

SEQ ID NO: 23070 - RNA, 64 nt, hsa
acuccagccugggcgacagagccagacugucucaaauaaauaaauaugagauaaugcagucggg

SEQ ID NO: 23071 - RNA, 64 nt, hsa
cagccugggcgacagagccagacugucucaaauaaauaaauaugagauaaugcagucgggagaa

SEQ ID NO: 23072 - RNA, 64 nt, hsa
aaugcccauaaaaucuggcucgucuuugaugaacaauaaauauuuguugaacaaauaaauaacu

SEQ ID NO: 23073 - RNA, 64 nt, hsa
ucgucuuugaugaacaauaaauauuuguugaacaaauaaauaacugcccugcauuaagucugua

SEQ ID NO: 23074 - RNA, 64 nt, hsa
uugcagaucuugguguuaauagaccaaauaaauaaauaaauauucccagcagcuugaaguucug

SEQ ID NO: 23075 - RNA, 64 nt, hsa
uuuuuugcagaucuugguguuaauagaccaaauaaauaaauaaauauucccagcagcuugaagu

SEQ ID NO: 23076 - RNA, 64 nt, hsa
guuguuuuuugcagaucuugguguuaauagaccaaauaaauaaauaaauauucccagcagcuug

SEQ ID NO: 23077 - RNA, 64 nt, hsa
caaccuuaccaaaaaaaaaaaaaaaaaaagaauaaauaaauaacuuuuuaaaaaaggaagcuug

SEQ ID NO: 23078 - RNA, 64 nt, hsa
cauucaaccuuaccaaaaaaaaaaaaaaaaaaagaauaaauaaauaacuuuuuaaaaaaggaag

SEQ ID NO: 23079 - RNA, 64 nt, hsa
cauguaucccagaacuuaaaguauaauaaaaauaaauaaauaauuucaguaagaaccugaucaa

SEQ ID NO: 23080 - RNA, 64 nt, hsa
agcacauguaucccagaacuuaaaguauaauaaaaauaaauaaauaauuucaguaagaaccuga

SEQ ID NO: 23081 - RNA, 64 nt, hsa
ucugcuuuuuuuguuuaauucuuguaauguaagcaauaaauauggagugucaguagucuccuuc

SEQ ID NO: 23082 - RNA, 64 nt, hsa
cauauagaaguauauuguuaacauuuuccaugucaauaaauauucuucuauggcuuaaaugucu

SEQ ID NO: 23083 - RNA, 64 nt, hsa
aagaauaaguagguaucccuccaugcccuucuguaauaaauaucuggaaaaaacauuaaacaau

SEQ ID NO: 23084 - RNA, 64 nt, hsa
uaugucuguaucuuauauucaauugcaaguauauaauaaauaaaccugcuuccaaacaacaaua

SEQ ID NO: 23085 - RNA, 64 nt, hsa
ccccagcacacacuugggauuauguguauacauaaauaaauauugggcuguuucccucuuccug

SEQ ID NO: 23086 - RNA, 64 nt, hsa
agaaauucucaaucacugaaaugaguaacugcaaaauaaauaguugauuguacuguucucaugc

SEQ ID NO: 23087 - RNA, 64 nt, hsa
uugaaguaaacacuuuucaguuucuuucuacuucaauaaauaguaugauuauaugcaaaccuua

SEQ ID NO: 23088 - RNA, 64 nt, hsa
gcuaucuggauuuuaaccugcacuugauauaagcaauaaauauugugguuuuaucuacguuauu

SEQ ID NO: 23089 - RNA, 64 nt, hsa
uuuaucuuuucccaaauuuuuauaaagagaaauuaauaaauauuuuauuacaacauuguaaagg

SEQ ID NO: 23090 - RNA, 64 nt, hsa
uaauuuacaagauuuuucaaauugguggggagugaauaaauacaauuuaaaagucagaaaucag

SEQ ID NO: 23091 - RNA, 64 nt, hsa
gguauuucugucuuauacauaggaaaacauuuaaaauaaauaguuuuuaauuguaggcucaaca

SEQ ID NO: 23092 - RNA, 64 nt, hsa
agccuggaugacagagugagacuccaucucaaaaaauaaauaaauaaauaaaaaugaaauuaaa

SEQ ID NO: 23093 - RNA, 64 nt, hsa
uggaugacagagugagacuccaucucaaaaaauaaauaaauaaauaaaaaugaaauuaaaaaau

SEQ ID NO: 23094 - RNA, 64 nt, hsa
ugacagagugagacuccaucucaaaaaauaaauaaauaaauaaaaaugaaauuaaaaaauaaaa

SEQ ID NO: 23095 - RNA, 64 nt, hsa
uggguaacagagggagacuccuccgucucaaaaaaauaaauaaauaaacuugugagcuggcccc

SEQ ID NO: 23096 - RNA, 64 nt, hsa
uaacagagggagacuccuccgucucaaaaaaauaaauaaauaaacuugugagcuggccccaacc

SEQ ID NO: 23097 - RNA, 64 nt, hsa
uccagcuuggugacagagugagauccugucucuaaauaaauaaauaaaaugcgggccaggcaca

SEQ ID NO: 23098 - RNA, 64 nt, hsa
gcuuggugacagagugagauccugucucuaaauaaauaaauaaaaugcgggccaggcacagugg

SEQ ID NO: 23099 - RNA, 64 nt, hsa
uagcuugggcaacagagcaagacucugucucuuaaauaaauaaauaaauagauuaccagaaaaa

SEQ ID NO: 23100 - RNA, 64 nt, hsa
uugggcaacagagcaagacucugucucuuaaauaaauaaauaaauagauuaccagaaaaaugaa

SEQ ID NO: 23101 - RNA, 64 nt, hsa
gcaacagagcaagacucugucucuuaaauaaauaaauaaauagauuaccagaaaaaugaaaaga

SEQ ID NO: 23102 - RNA, 64 nt, hsa
cuuuaaaagaguauuuggcacacagcauuuuaucaauaaauauugcuuuauuuuuuucauuggg

SEQ ID NO: 23103 - RNA, 64 nt, hsa
agaagugucccugcaaaauucacagacauaaauaaauaaauacguauuuucaauaaccauguuu

SEQ ID NO: 23104 - RNA, 64 nt, hsa
acugagaagugucccugcaaaauucacagacauaaauaaauaaauacguauuuucaauaaccau

SEQ ID NO: 23105 - RNA, 64 nt, hsa
uagggaguugaugcugacaggaugaagauuuaggaauaaauaugccugggaagagacugggaag

SEQ ID NO: 23106 - RNA, 64 nt, hsa
agggcaauggcagugacauguuugucauuuuaauaauaaauaacaucuauugagugcuuaagag

SEQ ID NO: 23107 - RNA, 64 nt, hsa
aaggccacaaaaguucccucucacuuucaguaaaaauaaauaaaacagcagcagcaaacaaaua

SEQ ID NO: 23108 - RNA, 64 nt, hsa
caaacaaauaaaaugaaauaaaagaaacaaaugaaauaaauauuguguugugcagcauuaaaaa

SEQ ID NO: 23109 - RNA, 64 nt, hsa
uaaaaaguaaacagggaucagugacuguauuccaaauaaauaugaaucccuaagggccguggac

SEQ ID NO: 23110 - RNA, 64 nt, hsa
ccuaggcaacaagagugaaauuccgucucaaaaaaauaaauaaauaaauaaauaaauaaguuaa

SEQ ID NO: 23111 - RNA, 64 nt, hsa
ggcaacaagagugaaauuccgucucaaaaaaauaaauaaauaaauaaauaaauaaguuaaaauu

SEQ ID NO: 23112 - RNA, 64 nt, hsa
acaagagugaaauuccgucucaaaaaaauaaauaaauaaauaaauaaauaaguuaaaauuaauu

SEQ ID NO: 23113 - RNA, 64 nt, hsa
gagugaaauuccgucucaaaaaaauaaauaaauaaauaaauaaauaaguuaaaauuaauucuuu

SEQ ID NO: 23114 - RNA, 64 nt, hsa
gaaauuccgucucaaaaaaauaaauaaauaaauaaauaaauaaguuaaaauuaauucuuuaucc

SEQ ID NO: 23115 - RNA, 64 nt, hsa
agccugggcgacagagcaagacucugucucaauaaauaaauaauuaauuaaaauaaaaaacagc

SEQ ID NO: 23116 - RNA, 64 nt, hsa
cuccagccugggcgacagagcaagacucugucucaauaaauaaauaauuaauuaaaauaaaaaa

SEQ ID NO: 23117 - RNA, 64 nt, hsa
uacuuucuaucagcugagcaaccucucaagaaaaaauaaauaaauaaauaaaccucucuuuaaa

SEQ ID NO: 23118 - RNA, 64 nt, hsa
uucuaucagcugagcaaccucucaagaaaaaauaaauaaauaaauaaaccucucuuuaaauagc

SEQ ID NO: 23119 - RNA, 64 nt, hsa
aucagcugagcaaccucucaagaaaaaauaaauaaauaaauaaaccucucuuuaaauagcacca

SEQ ID NO: 23120 - RNA, 64 nt, hsa
gccuagaugacagaacgagaccccaucucuaaugaauaaauaaauauggcugggcacaauggcu

SEQ ID NO: 23121 - RNA, 64 nt, hsa
agaugacagaacgagaccccaucucuaaugaauaaauaaauauggcugggcacaauggcucagg

SEQ ID NO: 23122 - RNA, 64 nt, hsa
cauacuauuuugccauauuugcuucugauuuuuaaauaaauaaaauguuacucuuuuguacuuc

SEQ ID NO: 23123 - RNA, 64 nt, hsa
ucuauuaaugguuuaauuucuuuguauauuuaaaaauaaauaugaaaaaccccuaaauuacaga

SEQ ID NO: 23124 - RNA, 64 nt, hsa
gggugacugagcaagacucugccucaaaaaaacaaauaaauaaauaaaauccugacauccugcc

SEQ ID NO: 23125 - RNA, 64 nt, hsa
gacugagcaagacucugccucaaaaaaacaaauaaauaaauaaaauccugacauccugccaucu

SEQ ID NO: 23126 - RNA, 64 nt, hsa
ugagcccuucacuccugagaaaaaggaaagaugaaauaaauaaauaaacauauauauauagaua

SEQ ID NO: 23127 - RNA, 64 nt, hsa
cccuucacuccugagaaaaaggaaagaugaaauaaauaaauaaacauauauauauagauauaca

SEQ ID NO: 23128 - RNA, 64 nt, hsa
aacuugcuaucugcucuguuucuaguuaaaauauaauaaauauuaucuuccugugcuguacuuu

SEQ ID NO: 23129 - RNA, 64 nt, hsa
auaaaauucucuuucagcuagagaaguuaacaggaauaaauauaugaacaaaaaagcugcaagg

SEQ ID NO: 23130 - RNA, 64 nt, hsa
ccugggcaacagugaaacuccaucucaaaaaauaaauaaauaaaauaaauucuuaguucauacc

SEQ ID NO: 23131 - RNA, 64 nt, hsa
ccagccugggcaacagugaaacuccaucucaaaaaauaaauaaauaaaauaaauucuuaguuca

SEQ ID NO: 23132 - RNA, 64 nt, hsa
uguuuuucauguucuuguauugcaaccuaaaauaaauaaauauuaaaguguguuauacuauaaa

SEQ ID NO: 23133 - RNA, 64 nt, hsa
auacuguuuuucauguucuuguauugcaaccuaaaauaaauaaauauuaaaguguguuauacua

SEQ ID NO: 23134 - RNA, 64 nt, hsa
uggaaaagauguucaugacacauuguaaaaaauaaauaaauaaagaacaguuugcagaaccucg

SEQ ID NO: 23135 - RNA, 64 nt, hsa
ugcauggaaaagauguucaugacacauuguaaaaaauaaauaaauaaagaacaguuugcagaac

SEQ ID NO: 23136 - RNA, 64 nt, hsa
ggcuaauugcacguguguauugcaaugggaaauaaauaaauaauauagccuggugugauugaug

SEQ ID NO: 23137 - RNA, 64 nt, hsa
cauuggcuaauugcacguguguauugcaaugggaaauaaauaaauaauauagccuggugugauu

SEQ ID NO: 23138 - RNA, 64 nt, hsa
agaccuagaguuuaaaguuuuaagucaauaaauaaauaaauauuuacucuuaaauaauauagaa

SEQ ID NO: 23139 - RNA, 64 nt, hsa
cuggagaccuagaguuuaaaguuuuaagucaauaaauaaauaaauauuuacucuuaaauaauau

SEQ ID NO: 23140 - RNA, 64 nt, hsa
gccucuggagaccuagaguuuaaaguuuuaagucaauaaauaaauaaauauuuacucuuaaaua

SEQ ID NO: 23141 - RNA, 64 nt, hsa
acaggaaguucguuucaagauaggugagauuuaaaauaaauaggaugagguugaagaaaaguau

SEQ ID NO: 23142 - RNA, 64 nt, hsa
acuugauauaaguauuaauaguaaugaaucaaugaauaaauaaugagcuaggguuugugaggcu

SEQ ID NO: 23143 - RNA, 64 nt, hsa
ugccauugucuuuccaauccccaguagaccaguaaauaaauaacacaucagugucuucuagaag

SEQ ID NO: 23144 - RNA, 64 nt, hsa
caacugcucuaggcugugcaggggguuuaaauggagaucagaacaaaggcucaccugguauuga

SEQ ID NO: 23145 - RNA, 64 nt, hsa
gucacauuuacaacuggaaaagaacuacauugggagaucagagaaagccaaguggccaaguccu

SEQ ID NO: 23146 - RNA, 64 nt, hsa
guacaucaacaucaagaaggaauacgccugagagagaucagaguauauagaugaauaugaacaa

SEQ ID NO: 23147 - RNA, 64 nt, hsa
auuaaacaccagcucauuggaaacucauuggaugagaucagaaaacguucaugaaaaaucauau

SEQ ID NO: 23148 - RNA, 64 nt, hsa
uuaacaguaaaggguacauaugcauagugggaggagaucagaccuuuacaagugaaggaaagca

SEQ ID NO: 23149 - RNA, 64 nt, hsa
cuuuaaauaccugucacaccguaugaauauggugagaucagacucccuaagacucuuuucaggu

SEQ ID NO: 23150 - RNA, 64 nt, hsa
accacaugguuguguagaucagaccuguguauuuagaucagaccuguguaucacguaagugugu

SEQ ID NO: 23151 - RNA, 64 nt, hsa
agauuuuaaaagcgguagcaccacaugguuguguagaucagaccuguguauuuagaucagaccu

SEQ ID NO: 23152 - RNA, 64 nt, hsa
uaguauauuuuaaaugacagaacuauaauuacagagaucagaucagauagguaaacugcaagau

SEQ ID NO: 23153 - RNA, 64 nt, hsa
uauuuuaaaugacagaacuauaauuacagagaucagaucagauagguaaacugcaagauagaua

SEQ ID NO: 23154 - RNA, 64 nt, hsa
gcugagauaguuccuaauucaucaacguaacaaacaaagcuauuggguguccaugauauaccag

SEQ ID NO: 23155 - RNA, 64 nt, hsa
uuucuugcuccugaggagcguauagaaggacccacaaagcuacagaguuaaagagggauaugua

SEQ ID NO: 23156 - RNA, 64 nt, hsa
acagagaugaaauuguaaacuguauccagauuaucaaagcuaauuugacuaguuugaaccucgu

SEQ ID NO: 23157 - RNA, 64 nt, hsa
cucuccaacuucuccuggucuucacauauacucucaaagcuagucugaaagugaccuuacuuuc

SEQ ID NO: 23158 - RNA, 64 nt, hsa
cugaggucaggaguucgagaccacccuggccaacauggugaaaccccaucucuacaguuuugua

SEQ ID NO: 23159 - RNA, 64 nt, hsa
cugagguuagaaguuugagaccagccuggccaacauggugaaaccuggccucuacuaaaaauac

SEQ ID NO: 23160 - RNA, 64 nt, hsa
aaaaauuacaaaggccuagaccagccugggcaacauggugaaaccccaucucuacaaaaaauuu

SEQ ID NO: 23161 - RNA, 64 nt, hsa
acgaggucaggagaucaagaccauccuggccaacauggugaaaccccaucucuacugaauacac

SEQ ID NO: 23162 - RNA, 64 nt, hsa
uugaggucgggaguuugagaccagccuggccaacauggugaaacccugucuuuacuaaaaauac

SEQ ID NO: 23163 - RNA, 64 nt, hsa
aguccuauuuuauaaggauauucauaaaaauuccauggugaauccuugucugaaauagguccuc

SEQ ID NO: 23164 - RNA, 64 nt, hsa
acaaggucaggaguucaagaccagccuggccaauauggugaaaguccgucucuacuaaaauuac

SEQ ID NO: 23165 - RNA, 64 nt, hsa
uugagggcaugaguucgagaccagccuggccaacauggugaaacccugucucuacuaaaaauac

SEQ ID NO: 23166 - RNA, 64 nt, hsa
acgaggucaggagauggagaccauccuggcuaacauggugaaaccccgucucuacuaaaaauac

SEQ ID NO: 23167 - RNA, 64 nt, hsa
aaugaugaggcuccaguugucuauucauugacugauggugaaauggcuggagugauucugaauc

SEQ ID NO: 23168 - RNA, 64 nt, hsa
uauuaauacugcauaaaaagugccuguagaugacauggugaaaauauuugacaggcuuauggaa

SEQ ID NO: 23169 - RNA, 64 nt, hsa
acgaggucaggagauugagaccagccugacuaacauggugaaaucccgucucuacuaaaaauac

SEQ ID NO: 23170 - RNA, 64 nt, hsa
acgaggucaagagaucaagaccauccuggccaacauggugaaauccugccucuacuaaaaauac

SEQ ID NO: 23171 - RNA, 64 nt, hsa
augaggucaggaguucaagaccagccugaccaacauggugaaaccccauuucuacuaaaaaaaa

SEQ ID NO: 23172 - RNA, 64 nt, hsa
cagaggucaggaguucgagaccagccuggccaacauggugaaaccccgucucuauuaaaaauac

SEQ ID NO: 23173 - RNA, 64 nt, hsa
accugugaggggcagaacacguaagccacagaacauggugaaaacuaagugucacuaggaaaag

SEQ ID NO: 23174 - RNA, 64 nt, hsa
aagcccauucggaacaauguuuuucacuuggaggauggugaacccuacugugagacugguaaga

SEQ ID NO: 23175 - RNA, 64 nt, hsa
augaggucaggaguuugagaucagccuggccaacauggugaaaccccaucucuacuaaaaauac

SEQ ID NO: 23176 - RNA, 64 nt, hsa
augaggucaagagaucaagaucauccuggccaacauggugaaacccugucucuacuaaaaauac

SEQ ID NO: 23177 - RNA, 64 nt, hsa
uugaggucagaaguuugagaccagccaggccaacauggugaaacuucaucucuacuaaaaauac

SEQ ID NO: 23178 - RNA, 64 nt, hsa
uugaggucaggaguucaaaaccaaccuggucuacauggugaaaccccaucucaacuaaaaauac

SEQ ID NO: 23179 - RNA, 64 nt, hsa
acaaggucaagagaucgagaccauccuggccaacauggugaaacccugucucuauuaaaaauac

SEQ ID NO: 23180 - RNA, 64 nt, hsa
guaggaagucucauauucuacuguucuaucuaggauggugaaauuccaaaggugccuaacuuga

SEQ ID NO: 23181 - RNA, 64 nt, hsa
ucaaaaaacaaaagguggcagcagcacaauguucauggugaauuaucucauaguaucuagauug

SEQ ID NO: 23182 - RNA, 64 nt, hsa
aaguuuguagaaauuuuaaaauaaguuuuaugaaauggugaaauaauaugcaugauuuuaagua

SEQ ID NO: 23183 - RNA, 64 nt, hsa
guguucccuuuguauaacugaaguauuuucagauauggugaaugcauugacuggaagcuccuuu

SEQ ID NO: 23184 - RNA, 64 nt, hsa
cugaggucaggaguucaagacuagccuggccaacauggugaaaccccgucucuacuaaaaauac

SEQ ID NO: 23185 - RNA, 64 nt, hsa
cugaggucaggaguucaagaccagccuguccaacauggugaaacccccaucucuacuaaaaaua

SEQ ID NO: 23186 - RNA, 64 nt, hsa
uugaggccaggaguucgagaccagccuggucaagauggugaaaccccaucucuacuaaaauuac

SEQ ID NO: 23187 - RNA, 64 nt, hsa
uugaggucaggaguuugaaaccagccuggccaacauggugaaaccccaucucuacuaaaaaaac

SEQ ID NO: 23188 - RNA, 64 nt, hsa
uuuauacuuacucaucuggacagcaucuccucagauggugaauuaugugcacggggaaaccucc

SEQ ID NO: 23189 - RNA, 64 nt, hsa
uuggaugaggcugggugacauuucccaggacagcauggugaacauuaccaggcaugcuagcugg

SEQ ID NO: 23190 - RNA, 64 nt, hsa
uugaguccaggaguuugaaaccuaccuaggcaacauggugaaaccuugucucuaccaaaauaaa

SEQ ID NO: 23191 - RNA, 64 nt, hsa
acucagcccaaauuaggaagugcagaagcacaugauggugaaaaaccuaggauuuggcagccuu

SEQ ID NO: 23192 - RNA, 64 nt, hsa
uauucugggagaaguggcuggaagaagggguaauauggugaaagcaaauucccuuucccaggag

SEQ ID NO: 23193 - RNA, 64 nt, hsa
acaaggucaggagaucgagaccauccuggccaacauggugaaaccccgucucuacuaaaauaca

SEQ ID NO: 23194 - RNA, 64 nt, hsa
cugaggucaggaguucacgaccagccuggccaacauggugaaacccuucucuacugaaaauaca

SEQ ID NO: 23195 - RNA, 64 nt, hsa
acaaggucaggaguuccagaccagccuggcuaauauggugaaaccucgucucuacuaaaaauac

SEQ ID NO: 23196 - RNA, 64 nt, hsa
ugcuggauaugcagaaaugauaggaaaaaaaccaauggugaaauuucaaguuucaaaaaccaac

SEQ ID NO: 23197 - RNA, 64 nt, hsa
gccuguauauuaagccuccgcaggaugccggacaauggugaagaaacuccagauaucaaggaau

SEQ ID NO: 23198 - RNA, 64 nt, hsa
gggaagggacaucuguucuuugguguaaucucucauggugaaaucugcucuguacaucagacaa

SEQ ID NO: 23199 - RNA, 64 nt, hsa
gagaucgagaccgcccuggcuaacauggugaaacauggugaaaccccgucucuacuaaaaauac

SEQ ID NO: 23200 - RNA, 64 nt, hsa
acgaggucaggagaucgagaccgcccuggcuaacauggugaaacauggugaaaccccgucucua

SEQ ID NO: 23201 - RNA, 64 nt, hsa
uagaggucaggaguucaagaccagucuggccgacauggugaaacucagucucuauugaaaauac

SEQ ID NO: 23202 - RNA, 64 nt, hsa
cugagaucgggaguucgagaccagccuggccaacauggugaaaccuugucucuacuaaaacuac

SEQ ID NO: 23203 - RNA, 64 nt, hsa
gguggcagcaauagagcaaagguuaccuuuuuguauggugaagggaggccuuccuauggcugua

SEQ ID NO: 23204 - RNA, 64 nt, hsa
augaggucaagagaucaagaccauccuggccaacauggugaaacccugucucuacuaaaaauac

SEQ ID NO: 23205 - RNA, 64 nt, hsa
ccuccagaggacucauagagcugccucccccaggauggugaaguugggagcaaaauggggcuuc

SEQ ID NO: 23206 - RNA, 64 nt, hsa
caaagucagcugaggggcugagggguggggcuccauggugaaugcagguugcugcaggcucugc

SEQ ID NO: 23207 - RNA, 64 nt, hsa
uccuuugaacaagagcaugcuauguguagggcuaauggugaauuuuacagucuuuuuuucaaca

SEQ ID NO: 23208 - RNA, 64 nt, hsa
accaacuauaaacccaguucuaaaguuguguaugauggugaaccuuugggaauaguucuuauca

SEQ ID NO: 23209 - RNA, 64 nt, hsa
guauguguccuuuguggaugaaucccacauuaggauggugaaccagcagcuacuagggagaagu

SEQ ID NO: 23210 - RNA, 64 nt, hsa
uuaaagucaggaguccaagaccagacucgccaacauggugaaaccguaucucuaauaaaaauac

SEQ ID NO: 23211 - RNA, 64 nt, hsa
uugaggucaggagcucaagaccagccuggccaacauggugaaaccccaucucuacuaaaaaaaa

SEQ ID NO: 23212 - RNA, 64 nt, hsa
cugagguuaggaguucaaaaccagccugaccaacauggugaaacccugucucuacuaaauauua

SEQ ID NO: 23213 - RNA, 64 nt, hsa
cuugaggucaggguuugagaucagccugaccaacauggugaaacccuaucucuacuaaaaauau

SEQ ID NO: 23214 - RNA, 64 nt, hsa
cugaggucgggaguuugagaccagccuggccaacauggugaaaccccaucgcuacuaaaaauau

SEQ ID NO: 23215 - RNA, 64 nt, hsa
uugaggccaggaguucaagaccagcccaaccaacauggugaaacccugucuccacugaaaauac

SEQ ID NO: 23216 - RNA, 64 nt, hsa
acaaggucaggaguucgagaccagccuggccaauauggugaaaccccaucucuacuaaaaauau

SEQ ID NO: 23217 - RNA, 64 nt, hsa
uccugcuuaauuggauaauuggugacugaggaagauggugaagauuuuuucuacuuguuauuua

SEQ ID NO: 23218 - RNA, 64 nt, hsa
ucgagaccagccuggccaacccagccuggucaacauggugaaacccugucccuacuaaagauac

SEQ ID NO: 23219 - RNA, 64 nt, hsa
augaggucaaaagauugagaccauccuggccaacauggugaaaccccgucucuacuagaaauac

SEQ ID NO: 23220 - RNA, 64 nt, hsa
acaccaaauacccacuuuauagauaauuacagggauggugaaaaauuaguaaauagcuucacaa

SEQ ID NO: 23221 - RNA, 64 nt, hsa
uaaugcauacuggaaaucaaaagauacugaaagaauggugaacuucucuuagugguauugucau

SEQ ID NO: 23222 - RNA, 64 nt, hsa
uugagguuaggaguucaagaccagcccagccaacauggugaaaacccugucucuacuaaaaaua

SEQ ID NO: 23223 - RNA, 64 nt, hsa
uugaggccaggaguucaagaccagccuggcaaacauggugaaaccccgucucuauuaaaaauac

SEQ ID NO: 23224 - RNA, 64 nt, hsa
cuggggucaggaguucgagaccagccugaccaauauggugaaaccccaucucuacuaaaaauag

SEQ ID NO: 23225 - RNA, 64 nt, hsa
ugaagucaagaguucgagaccagcaauggccaguauggugaaacccugucucuccuaaaaauac

SEQ ID NO: 23226 - RNA, 64 nt, hsa
uuuuugagaacauauagaagaagaaggcuaagagauggugaagagacugcaugauuaaacuaga

SEQ ID NO: 23227 - RNA, 64 nt, hsa
augaggucaggagaucgagaccauccuggccaacauggugaaaccccaucuguacuaaaauaca

SEQ ID NO: 23228 - RNA, 64 nt, hsa
gcugaggagacaagacacauccaaugcugcaaaaauggugaauaaccugauucaggguuagcag

SEQ ID NO: 23229 - RNA, 64 nt, hsa
cucuuuacgccuaaugaacaagcacaguuuuucaauggugaagaaaaaagcaccagacuuuuuu

SEQ ID NO: 23230 - RNA, 64 nt, hsa
gcgacugcuaaucaggaugggguuuccuccugggauggugaaaauguuccggaccuagauagug

SEQ ID NO: 23231 - RNA, 64 nt, hsa
augaggucaggaguuugagaccagccuggccaauauggugaaaccacgucucuauuaaaaauag

SEQ ID NO: 23232 - RNA, 64 nt, hsa
gugcacuaaaugcuauugaauuggacacuuugaaauggugaauuucgugguaugugaauucuac

SEQ ID NO: 23233 - RNA, 64 nt, hsa
gcgacugcuaaucaguaugggguuuccucccgggauggugaaaauguuccggaccuagauacug

SEQ ID NO: 23234 - RNA, 64 nt, hsa
guucagguguaugguaguaaguaaauguauuaacauggugaacaguaguaauauucuaucauag

SEQ ID NO: 23235 - RNA, 64 nt, hsa
acgaggucaggcguuuaagaccagcuugaccaacauggugaaaccccaucucuacaaaaauuag

SEQ ID NO: 23236 - RNA, 64 nt, hsa
uagaaccuuugggccgugcccccauuuuccguacauggugaagaacugcagccgggcuugugug

SEQ ID NO: 23237 - RNA, 64 nt, hsa
acgaggucaagaguucaagagcagccuggccaagauggugaaaccccgucucuacugaaaauac

SEQ ID NO: 23238 - RNA, 64 nt, hsa
auuuuauacugccaacaaagaagacucaacuucucagaucuauaaugggauacauugucauccu

SEQ ID NO: 23239 - RNA, 64 nt, hsa
aauuucuagauguuuguuucaagaccagcuguuucagaucuauuaauguagggaauuuuucccu

SEQ ID NO: 23240 - RNA, 64 nt, hsa
cuaaagcaugucaguggcaugaugcuugccaagccagaucuaggcaucuaggauaauuaaggua

SEQ ID NO: 23241 - RNA, 64 nt, hsa
uccacugaaauuauugugugcuaaauuugggaaacagaucuauucuaacucauuaacccaguug

SEQ ID NO: 23242 - RNA, 64 nt, hsa
gcuuuuuaaauaguuuguccuaagguguuuaaaacaugucaaccuuauguaaggaaaaauuucc

SEQ ID NO: 23243 - RNA, 64 nt, hsa
aucaacacuuuauaguuauucuucugaacuaagacaugucaauauucuuuuuuaaaguuuuuuu

SEQ ID NO: 23244 - RNA, 64 nt, hsa
ccuuacagagaauuguuucacaaaacuuauauuucaugucaauuguauuuauuuuaauaauagc

SEQ ID NO: 23245 - RNA, 64 nt, hsa
cuuuaacaaauugaggagauugauucauaauucacaugucaauuuuuuauaguaauauguacuu

SEQ ID NO: 23246 - RNA, 64 nt, hsa
augaucagaacaaagggcccacucuaguucucuacaugucaaucaaucaagcauguugaauaag

SEQ ID NO: 23247 - RNA, 64 nt, hsa
acuuuucauuacaaggaaaauaaguuauaaauaccaugucaaauugauuauacaggcuaugaaa

SEQ ID NO: 23248 - RNA, 64 nt, hsa
agggcaguaccugaauuaacuguccauuucaguacaugucaagugccuuuguuagguggagaag

SEQ ID NO: 23249 - RNA, 64 nt, hsa
aaacuauuaacauuaaauaauuucacaauuucaacaugucaaaccuaugaagggagauaggaaa

SEQ ID NO: 23250 - RNA, 64 nt, hsa
auauuucauauagaaguauauuguuaacauuuuccaugucaauaaauauucuucuauggcuuaa

SEQ ID NO: 23251 - RNA, 64 nt, hsa
gaugacugaaccuugcaguucugugaauuuuuauaaaacauacaaaaacuuuguauauacacag

SEQ ID NO: 23252 - RNA, 64 nt, hsa
aaaaggugccuauucuuuuuuaaaaaaauaaaauaaaacauaaauauuacucuuccauauuccu

SEQ ID NO: 23253 - RNA, 64 nt, hsa
acugcuaacuguagcaacaaaauuuaaaagaaaaaaaacauacuuuaucuggcuauuauaacau

SEQ ID NO: 23254 - RNA, 64 nt, hsa
guaauaucuauaaguacuuaagagacuugugagcaaaacauacuauuuauaacaguauaugauu

SEQ ID NO: 23255 - RNA, 64 nt, hsa
uaaaaccaaacccugaacccuuuuaaagaacaauaaaacauauuuuacacgcucuuugugcauu

SEQ ID NO: 23256 - RNA, 64 nt, hsa
aaauaaugcuuuucgaaauuguuucuaggacuuuaaaacauaaugguauauccaaaauucuuua

SEQ ID NO: 23257 - RNA, 64 nt, hsa
cuugacagucuaccugugguauaacugucagguaaaaacauacaucuuuacaacuugguggucc

SEQ ID NO: 23258 - RNA, 64 nt, hsa
cuauuauuucuaaccuaaguaaaggccccagugaaaaacauacuggggaaauaaaaccucugag

SEQ ID NO: 23259 - RNA, 64 nt, hsa
aaucaugcuggcauccaugaacacaccgguaaauaaaacauaguccaaguggaagaauucauua

SEQ ID NO: 23260 - RNA, 64 nt, hsa
uauuucucgccaaguuuuuauacuuucugaaaugaaaacauaggauugacuaguuuacugguuu

SEQ ID NO: 23261 - RNA, 64 nt, hsa
uugauucgucugcgauuuuaucuguuaaccaaauaaaacauaauagaauuuccuaaugagauau

SEQ ID NO: 23262 - RNA, 64 nt, hsa
agacaggguuuuuucauuuuugugggggcuagaaaaaacauaaaaugaggcaguuaaauaauaa

SEQ ID NO: 23263 - RNA, 64 nt, hsa
agugacagucaaaaccccaccuggagcaaauaaaaaaacauacaaaacguacuggugcuuuccu

SEQ ID NO: 23264 - RNA, 64 nt, hsa
gcgacacaaaguuaaacaaacaaacaaaaaacacaaaacauaauaaaacaccaagaacaugagg

SEQ ID NO: 23265 - RNA, 64 nt, hsa
uacagacuuauuuucuuuauuacaguauuauaagaaaacauauguauuuguaaaaaugguuucc

SEQ ID NO: 23266 - RNA, 64 nt, hsa
auggaaggggcaaaaugcugccagucucuuugcuaaaacauaacaagagucaccuuuacuccag

SEQ ID NO: 23267 - RNA, 64 nt, hsa
aaaaguccacagaggagaauuugcugguuagcacaaaacauacugcaaaauugcuucuuucugg

SEQ ID NO: 23268 - RNA, 64 nt, hsa
caacuucugugaauauacccaagaagauucuggcaaaacauagauucaaauuacaguugaugcu

SEQ ID NO: 23269 - RNA, 64 nt, hsa
gaucauuacaguuuaaguuuucugaccaauuaaaaaaacauagagaacaaaagcauauuugacc

SEQ ID NO: 23270 - RNA, 64 nt, hsa
uauacuuggaaguguuuaagguugccauugguugaaaacauaagugucucuggccaucaaagug

SEQ ID NO: 23271 - RNA, 64 nt, hsa
auaugggaugaauuuuauauauuaagaaaugccaaaaacauaguuucugcaccaaguuaauuau

SEQ ID NO: 23272 - RNA, 64 nt, hsa
aagugguuuuaaaggggucuaaaaagauuuuggcaaaacauauuugcagauguagauuagcugg

SEQ ID NO: 23273 - RNA, 64 nt, hsa
auaacacuguuugugguaggaaaggaaaacaugcaaaacauacacacacacacacacacacaca

SEQ ID NO: 23274 - RNA, 64 nt, hsa
uuauuuccuauccccgaauuaccuuuucuaugccaaaacauaccuucaggauauuguuaugugu

SEQ ID NO: 23275 - RNA, 64 nt, hsa
ucacccuguugggguaaauguuuuaaagagugagaaaacauaaauugagaaagggugauaaagu

SEQ ID NO: 23276 - RNA, 64 nt, hsa
gguaauauuguguuuuacuauguuuaccuuuuauaaaacauaaccuguuuauuuauauucuuug

SEQ ID NO: 23277 - RNA, 64 nt, hsa
ccaacaaacucucuuaagguucaauauguaauaaaaaacauaacacaaauaauuauucuauaug

SEQ ID NO: 23278 - RNA, 64 nt, hsa
aaaauaaugggaguauaauacccauuuaaugugaaaaacauaagagucuuaaaagaaauuaagc

SEQ ID NO: 23279 - RNA, 64 nt, hsa
ucuuuggugaaugguuuuauauauacauaaaccuaaaacauauaagacaaaaauuuauguuugg

SEQ ID NO: 23280 - RNA, 64 nt, hsa
auauuuuuaccaguauucucagaccacuucuaccaaaacauaaaucugugauugugaucucuga

SEQ ID NO: 23281 - RNA, 64 nt, hsa
aauaaugacaggagagauuauaacacacugaauaaaaacauaauccaugaguucaugcugauac

SEQ ID NO: 23282 - RNA, 64 nt, hsa
ccacugaauuuccagugacuaaguggaaaaauauaaaacauaugaauauaaagaaagaaagaga

SEQ ID NO: 23283 - RNA, 64 nt, hsa
ggcuaaugaagaucauauacgugaaaauuauuugaaaacauauaaagcacuauacagauucgaa

SEQ ID NO: 23284 - RNA, 64 nt, hsa
auacccaugaacuuaaaaugaaaguuaaaaauaaaaaacauauacaaauaaaaaaaucccgacu

SEQ ID NO: 23285 - RNA, 64 nt, hsa
guugaugggacaagaagaauaguauuuauuuaauaaaacauauauuauauugaacuauguguua

SEQ ID NO: 23286 - RNA, 64 nt, hsa
uauaugcaauucuucugguaaauagcaauagaauaaaacauauuucaauguuuguguauagguu

SEQ ID NO: 23287 - RNA, 64 nt, hsa
ugacuaagguguauguuaguuucaucagaaacuuaaaacauagacugaucacucagaaauuaaa

SEQ ID NO: 23288 - RNA, 64 nt, hsa
uuuauuuagugauuguucgacaauuagcugcuucaaaacauaaugugcauugcuuaugaaugcc

SEQ ID NO: 23289 - RNA, 64 nt, hsa
cucuguauucucauauaauuucaauguaaaacagaaaacauauugauguguuggugauaggcuu

SEQ ID NO: 23290 - RNA, 64 nt, hsa
ucuuuuacgcagaagaaauaaaaacuacggguagaaaacauaagaacuaucauaaaauuuacuu

SEQ ID NO: 23291 - RNA, 64 nt, hsa
uugaccaagacacagaagaugaugaaugggaaaaaaaacauagagaucacaccgcaaagaagca

SEQ ID NO: 23292 - RNA, 64 nt, hsa
guaauuaguuuuguauuuucuauacugguguuagaaaacauauguuuacauuugauuaacugug

SEQ ID NO: 23293 - RNA, 64 nt, hsa
gucccaucuuuaauugagaaacauuuaucuguauaaaacauauuuuuggauaaauauauauaua

SEQ ID NO: 23294 - RNA, 64 nt, hsa
gcaucuuagaaaaguuuaaccugcaaacacuuuuaaaacauaaugccuacuugauuuauaucua

SEQ ID NO: 23295 - RNA, 64 nt, hsa
ugguuauuaguauuacauccccauuuuaaaaacaaaaacauaauaaucguuacaacacguggag

SEQ ID NO: 23296 - RNA, 64 nt, hsa
uuacguguuuaaaaaaaagcauaaaaacauuuuaaaaacauagaaaaauucagcaaaccauuuu

SEQ ID NO: 23297 - RNA, 64 nt, hsa
accauuuuuaaaguagaagaggguuuuagguagaaaaacauauucuugugcuuuuccugauaaa

SEQ ID NO: 23298 - RNA, 64 nt, hsa
aaaaccagcaaauuaauuuuaaucucuagccauaaaaacauaaguaauaguaagcuccuaagcu

SEQ ID NO: 23299 - RNA, 64 nt, hsa
uuuaagcucaauuuaauuuugcuagauauuuaacaaaacauacggcucaaccucauaaccuaua

SEQ ID NO: 23300 - RNA, 64 nt, hsa
uuuuuaaaagauaugaugucagaauaaaauguggaaaacauacggaaaacuagucuagacuuua

SEQ ID NO: 23301 - RNA, 64 nt, hsa
auauauucaaagaaaagaaaacacaaauaagcagaaaacauacuuauuuuaaaaaagaaaaaaa

SEQ ID NO: 23302 - RNA, 64 nt, hsa
ccuuuauacaguuguauaaacuguauuuugaaccaaaacauauagguuacuacuuaaugcuuac

SEQ ID NO: 23303 - RNA, 64 nt, hsa
agaaauguuuauggaaauauuaagaacauuuuauaaaacauacgaaaaagugauugugaaggau

SEQ ID NO: 23304 - RNA, 64 nt, hsa
ggcaaaagauccaggagucuuucaacuguuucagaaaacauaauauagcuuaaaacacuucuaa

SEQ ID NO: 23305 - RNA, 64 nt, hsa
ugaauuuacaguaguuaaccuuuuacaagugguuaaaacauagcuuucuucccguaaaaacuau

SEQ ID NO: 23306 - RNA, 64 nt, hsa
ccuuuuugggaaagagacaggaaagauucacuugaaaacauaaaugaacgucaagacugaaggc

SEQ ID NO: 23307 - RNA, 64 nt, hsa
gcccugccaaggcauuguucgacuccaugauacuaaaacauaaugaaagaaacaaacuccagua

SEQ ID NO: 23308 - RNA, 64 nt, hsa
uguauuaaauauguccuuccaauggauaaguucuaaaacauacgcuaucauuggcccauguugc

SEQ ID NO: 23309 - RNA, 64 nt, hsa
guagacauaauaaaauuugugugcuguguacacaaaaacauaauguaucuuaugaaagcauuac

SEQ ID NO: 23310 - RNA, 64 nt, hsa
accccugguaaaccaagccucccacacugaaaccaaaacauaaaaaccaaacccagacaaccaa

SEQ ID NO: 23311 - RNA, 64 nt, hsa
gaaaccaaaacauaaaaaccaaacccagacaaccaaaacauauucaaagcagcagccaccgcca

SEQ ID NO: 23312 - RNA, 64 nt, hsa
ccuaugaauguaugcugugugcuagaaauagacuaaaacauauuccuauagcauguuagugugu

SEQ ID NO: 23313 - RNA, 64 nt, hsa
gguuuagugcaaugugugguagauuacuuaucagaaaacauauaugucaucucuagaacgaaga

SEQ ID NO: 23314 - RNA, 64 nt, hsa
cuccaauuuucagugucaaauucagugaauuuugaaaacauauauacaguugucugucugccac

SEQ ID NO: 23315 - RNA, 64 nt, hsa
aagacggcaagaccaugcuauugaaaaaguucagaaaacauacaccguggaccagaggucuuaa

SEQ ID NO: 23316 - RNA, 64 nt, hsa
cuucaggauuaauuaaauaaacaugcaauuuaugaaaacauauaaacaauuauuuaucacuuuu

SEQ ID NO: 23317 - RNA, 64 nt, hsa
uugaagacuuuacaaggagauuagaaaucuuuggaaaacauaugugaugaaauugagcuauaug

SEQ ID NO: 23318 - RNA, 64 nt, hsa
ugcaaagaaacaguaugaauguaaaaaaugugggaaaacauacauuacucuugcagguuuccag

SEQ ID NO: 23319 - RNA, 64 nt, hsa
gugggaaacccuucaguuaucugcagucuuuuaaaaaacauaaaagaacacacagugcagggau

SEQ ID NO: 23320 - RNA, 64 nt, hsa
acuacagcuuagaaaacaccagagaguucauacuaaaacauauuuuugcagauacaggaaaaau

SEQ ID NO: 23321 - RNA, 64 nt, hsa
aucuuacucaacaucagagaguucauacucaauaaaaacauaagugcaacuacugucaaaauau

SEQ ID NO: 23322 - RNA, 64 nt, hsa
ugugacagugcuuugaaaacaccucaaacuuuucaaaacauaaaucauaguguugagaaauccu

SEQ ID NO: 23323 - RNA, 64 nt, hsa
guggcaaggucuucagucaaguuucauccuaugcaaaacauaggaggauucauacaggagagaa

SEQ ID NO: 23324 - RNA, 64 nt, hsa
cagcuugaaagacaggagaauucauacuggagaaaaaacauacaaauguaagguuuguaacaag

SEQ ID NO: 23325 - RNA, 64 nt, hsa
augacaagauuuuugaauauaauucauaccuggcaaaacauauuagaauucaaacuggagagaa

SEQ ID NO: 23326 - RNA, 64 nt, hsa
gaggcaaggucuucagucaagcuucauccuaugcaaaacauaggaggauucauacaggagagaa

SEQ ID NO: 23327 - RNA, 64 nt, hsa
gugacaagguuuuugcauauaaugcauaucuggcaaaacauacuagaauucacacuggagagaa

SEQ ID NO: 23328 - RNA, 64 nt, hsa
uauucgaaguauaguuccauuuuuugagacuaauaaaacauauguuuaaaaggacacuaaaaac

SEQ ID NO: 23329 - RNA, 64 nt, hsa
aaaaguguugggaaugaagcaagugauugauuggaaaacauacugaauggaagaaauauuuaga

SEQ ID NO: 23330 - RNA, 64 nt, hsa
aggacagccuuagcaucugaaaaagaagcccauuccucuuuauaguggaauuuaguaaguagau

SEQ ID NO: 23331 - RNA, 64 nt, hsa
ugcaaauacugaaaagaaggccugaggggcugguccucuuuagagaaagaugcuuuuugguuuu

SEQ ID NO: 23332 - RNA, 64 nt, hsa
aaaugcuaagccaaaguaucugcacuuagguauaccucuuuaugccaauaaugauuuuaaugaa

SEQ ID NO: 23333 - RNA, 64 nt, hsa
aaauccuauguauuugaaauuguuacagagcuuuccucuuuacuucaaacagcaaaaaaguggg

SEQ ID NO: 23334 - RNA, 64 nt, hsa
gggccaggcauagauuaaguaacugggaacgcccccucuuuauaaagcugggcuucuuucucau

SEQ ID NO: 23335 - RNA, 64 nt, hsa
gcgaaguauuucagaaggccauugaugaauucccccucuuuagcuguguauuugugcacgugug

SEQ ID NO: 23336 - RNA, 64 nt, hsa
ucucucccaacauauuucucuuccuugugccucuccucuuuaucacuuuuaagcauaaaaaaaa

SEQ ID NO: 23337 - RNA, 64 nt, hsa
ucgccaaguucaucuagggucgcuggaagggcacccucuuuaacccaucccucagcaaacgcag

SEQ ID NO: 23338 - RNA, 64 nt, hsa
auaauugaagagucaaagucuucugaagcugcacccucuuuacuucaguacaaugccaccagua

SEQ ID NO: 23339 - RNA, 64 nt, hsa
uugugaugaaaaaucugucauccuuaucuuuguuccucuuuacauaauguuccuuuuaaaaaaa

SEQ ID NO: 23340 - RNA, 64 nt, hsa
cauaaugguuuccaugaauguaguacguucauacaggcuucauucaaccuggcguuccccucca

SEQ ID NO: 23341 - RNA, 64 nt, hsa
gacuauugaaagugguaauaaaaauuuauauuauaggcuucaauguuuucaugaauguuaccca

SEQ ID NO: 23342 - RNA, 64 nt, hsa
gcugcuauuuaacaacccagaguaggccucugugaggcuucaguggccucagaaaccagagggu

SEQ ID NO: 23343 - RNA, 64 nt, hsa
acugaagguauuuuguuucuuaccaacauaauuuaggcuucagcaucucaccagccccucccuc

SEQ ID NO: 23344 - RNA, 64 nt, hsa
agcaugugaaaggaaaaagguaaauacagcauugaggcuucauuuggccuuagucccugggagu

SEQ ID NO: 23345 - RNA, 64 nt, hsa
uggccuuagucccugggaguuacuggcguuggacaggcuucagucauuggacuagaugaaaggu

SEQ ID NO: 23346 - RNA, 64 nt, hsa
caagcugaauguuuaagagagauuuuggucuuaaaggcuucacaucaugaaaguguacaugcau

SEQ ID NO: 23347 - RNA, 64 nt, hsa
cugggucugcuuaugcuaguucaguauuuggucuaggcuucauuuugauaugacugaauugcaa

SEQ ID NO: 23348 - RNA, 64 nt, hsa
gcauaggucaaucaggucccaggaugaauaauccaggcuucagcaacacuccucuuucccagcc

SEQ ID NO: 23349 - RNA, 64 nt, hsa
ccuuuccuagaaagguuauuauaacuuuaaggacaggcuucaagugggaaggccccuacuuuug

SEQ ID NO: 23350 - RNA, 64 nt, hsa
uauucaauggaggcauccugacaucuguucauuuaggcuucaguuccacucccaggaacuuugc

SEQ ID NO: 23351 - RNA, 64 nt, hsa
ggaggugguauggaagacucagcaggaacaagguaggcuucaaagagccuauauuccucuuuuu

SEQ ID NO: 23352 - RNA, 64 nt, hsa
uuuauacauguuuucuauuuccgacaaugccaggaggcuucauugacguuguagucuguguuaa

SEQ ID NO: 23353 - RNA, 64 nt, hsa
cacaaaccuccuuugaagggaaauaauugccguuaggcuucacaguagugcuuuuuccuuucac

SEQ ID NO: 23354 - RNA, 64 nt, hsa
ugaaacguguaaauuaaaaacacaaucaguguucaggcuucaguuauauaauguaagcacaacu

SEQ ID NO: 23355 - RNA, 64 nt, hsa
ucaaguuugaccuuuuaggaguuauuguacauaaaggcuucauccacgaaccauccagcgcaca

SEQ ID NO: 23356 - RNA, 64 nt, hsa
gcuaaagagauuggacaagguuguagcugugcucaggcuucagcuugguuuguuaaauugagag

SEQ ID NO: 23357 - RNA, 64 nt, hsa
uggaacuuucucugccugcaggggcuagcagcagaggcuucaccgcaucaccaccccuuccucc

SEQ ID NO: 23358 - RNA, 64 nt, hsa
acagaugccaggauggcuucucccucucagugcgaggcuucaccccugccaggcaagcccaggg

SEQ ID NO: 23359 - RNA, 64 nt, hsa
acagaggccgggacggccucucccucucagugugaggcuucacccaugcuaggcaagcccaggg

SEQ ID NO: 23360 - RNA, 64 nt, hsa
ugucuuagaccugcaaacagcuaauaggaaauucuauuaauauguuagcuugccauuuuaaaua

SEQ ID NO: 23361 - RNA, 64 nt, hsa
ugcagauguggaucaacauuuguuuaaaauaaaguauuaauacuuuaaagucaaauaagauaua

SEQ ID NO: 23362 - RNA, 64 nt, hsa
aguuauuaaaauguuaaaagauaaguuuguuauauauuaauaugcaugcuucuuuauaaaugca

SEQ ID NO: 23363 - RNA, 64 nt, hsa
ucauugccacauaccauucuuauuccuaggcaacuauuaauaaucuauccugagaauauuaauu

SEQ ID NO: 23364 - RNA, 64 nt, hsa
ugcuuuccuggcucucagagaguauuaauauugauauuaauaauauaguuaauaguaauauugc

SEQ ID NO: 23365 - RNA, 64 nt, hsa
uuuuguauuuagugcuuuccuggcucucagagaguauuaauauugauauuaauaauauaguuaa

SEQ ID NO: 23366 - RNA, 64 nt, hsa
auuauuuuaaauuucuuuuauuaauacuuucuuuuauuaauauaugggggaaaauuauuuugac

SEQ ID NO: 23367 - RNA, 64 nt, hsa
uaaaaauaacugagauauuauuuuaaauuucuuuuauuaauacuuucuuuuauuaauauauggg

SEQ ID NO: 23368 - RNA, 64 nt, hsa
uaugaagaauucuauuucuuacugaagaacaaauuauuaauauuggaugaguauuucaacagug

SEQ ID NO: 23369 - RNA, 64 nt, hsa
gugcuaaaagucacauguuucaguuuguguauaauauuaauaugcaauuuuugguuuaaauuuu

SEQ ID NO: 23370 - RNA, 64 nt, hsa
cauaguaauuaagugaacuaagcauucauuguuuuauuaauacuuuuuuucuaaaauaaaacuu

SEQ ID NO: 23371 - RNA, 64 nt, hsa
auguacccacuaucagguuaagaaauagaacauuuauuaauauguaggaauguuaagaaauaaa

SEQ ID NO: 23372 - RNA, 64 nt, hsa
uaggacaguguuugcugguaacaacuccaauguguauuaauaacuugaaaaggagcauuucacu

SEQ ID NO: 23373 - RNA, 64 nt, hsa
ucgugggaaccuaacacucacauagcauaugguuuauuaauaaugcauauccuuucuaaucacu

SEQ ID NO: 23374 - RNA, 64 nt, hsa
ugaaguucguuaguauaaauuacuuuucuaggauuauuaauaaaagccacauagguggcaaguu

SEQ ID NO: 23375 - RNA, 64 nt, hsa
auuaacacuuacauuuccauaaagaaaacucaaguauuaauaaaagagacuuuacuggcuuaag

SEQ ID NO: 23376 - RNA, 64 nt, hsa
guaagugauuguuauuguuggauguuauacugauuauuaauaagaaauuuggauuuuugccuuu

SEQ ID NO: 23377 - RNA, 64 nt, hsa
uuguggauacugacauauauuaaguguggaagcuuauuaauauuuuugguuuuuuaaaaacuga

SEQ ID NO: 23378 - RNA, 64 nt, hsa
cucagaacuguuuuuggacacauuuaagguguaguauuaauagguuaaaaccaggcuuucuaga

SEQ ID NO: 23379 - RNA, 64 nt, hsa
uacauaggaaguuaaaagcacaaaggaaugaacuuauuaauauuuuugaaaaaugcacugggaa

SEQ ID NO: 23380 - RNA, 64 nt, hsa
ccagcucuuaauugcauccuuuucuaauuaggauuauuaauaaagcgugaauauuuuguuuuuu

SEQ ID NO: 23381 - RNA, 64 nt, hsa
uauauauuauuucuugcagaaacauucauuauuuuauuaauauugcccuaaguacaacuaggca

SEQ ID NO: 23382 - RNA, 64 nt, hsa
uauuuuuccuccugcuauucucucccaaauuaauuauuaauaaguguuguucauuuacugcacu

SEQ ID NO: 23383 - RNA, 64 nt, hsa
uauaucuuuguugugaaugaugcuuuuuuguauuuauuaauaucaaauucacuuaugaauaaac

SEQ ID NO: 23384 - RNA, 64 nt, hsa
guauaauuauacugcuuaaaauacaguuagugccuauuaauagcuuuuuauuuccuaugggaag

SEQ ID NO: 23385 - RNA, 64 nt, hsa
uuaauguaaucauucauauacuuugcuacaaaaauauuaauauauuucauuacugaaugcuaaa

SEQ ID NO: 23386 - RNA, 64 nt, hsa
uauauuuucauauauaugacagaacaagaauauguauuaauagugccuaauguaucuauauuuu

SEQ ID NO: 23387 - RNA, 64 nt, hsa
auaauguauucacauuauucuuuaauaaucuguuuauuaauaagccaugauauguguauguaaa

SEQ ID NO: 23388 - RNA, 64 nt, hsa
uucugcagcaaaggcauuaaaagcgcuaagcauauauuaauaaaugcaaguggcuagaaauagu

SEQ ID NO: 23389 - RNA, 64 nt, hsa
aaaugugucaauugucucugugauuuagaaacacuauuaauaacaucagagcaagguucuaagg

SEQ ID NO: 23390 - RNA, 64 nt, hsa
acuuaugggcagggauaacagugugccugguuaauauuaauauucccauuuuauuaauaauauu

SEQ ID NO: 23391 - RNA, 64 nt, hsa
acagugugccugguuaauauuaauauucccauuuuauuaauaauauuuauguugggucaagugu

SEQ ID NO: 23392 - RNA, 64 nt, hsa
uuaccagaaaauuacuuuggaguuuugaagccuuuauuaauacuacuuuuaaagaagcaguugu

SEQ ID NO: 23393 - RNA, 64 nt, hsa
ucucugguaauguaauaagcaugauggugccuucuauuaauacaucauuccagucuugcuggua

SEQ ID NO: 23394 - RNA, 64 nt, hsa
ucugagguauuuugaaaaauucugugauaguugcuauuaauaaaccaaaauuguauagaaucau

SEQ ID NO: 23395 - RNA, 64 nt, hsa
cuccugacuuucaccugcuuuuaaccugaaaauauauuaauacgccucugacaugaguccaggg

SEQ ID NO: 23396 - RNA, 64 nt, hsa
aacugggacacucuugagaguaaauggagggcauuauuaauaauuaucuuguaaugaacuuaaa

SEQ ID NO: 23397 - RNA, 64 nt, hsa
gucaaaaaaacaacuguuucuuuucuuauuccacuauuaauaaauugaaagcuugcuguacaaa

SEQ ID NO: 23398 - RNA, 64 nt, hsa
auaucacauauguucuucaagaaacacaugaaauuauuaauaaaguaauuaaaaaauuuuuaau

SEQ ID NO: 23399 - RNA, 64 nt, hsa
auuacuguuaaauuucuuagugcagaaauaacauuauuaauagaguauuguuuucaaaacagag

SEQ ID NO: 23400 - RNA, 64 nt, hsa
acuaauugguuugauuuuaaauauuucuggcuuuuauuaauaugucuuaauuuugaguuugaaa

SEQ ID NO: 23401 - RNA, 64 nt, hsa
ccauuuguuuauaaguaugaacuguucuuauaaauauuaauauuuacauauucacuaauuuaac

SEQ ID NO: 23402 - RNA, 64 nt, hsa
gacuuuuuguccuaagugguauguucaaggagccuauuaauauauuuauaguuuuugaaugcug

SEQ ID NO: 23403 - RNA, 64 nt, hsa
uauguuguuacuguaagcuuaggaguuuuccuacuauuaauaaaugugcucuauuuuuacauuu

SEQ ID NO: 23404 - RNA, 64 nt, hsa
uucuaaauguuuuacauuguaagagcauagagaauauuaauaauggcuuauagagagagacuuu

SEQ ID NO: 23405 - RNA, 64 nt, hsa
aauguuuaaaaaguuucuaauauuaaagucagaauauuaauacaauuaauauuaauauuaacua

SEQ ID NO: 23406 - RNA, 64 nt, hsa
ucuaauauuaaagucagaauauuaauacaauuaauauuaauauuaacuacagaaaagacaaaca

SEQ ID NO: 23407 - RNA, 64 nt, hsa
guuaaagauguaaaccuagccaaaauuaccaguuuauuaauaauuaggauccuaauuauuucaa

SEQ ID NO: 23408 - RNA, 64 nt, hsa
cagggggagcaucuuauauucacccuuaaaucguuauuaauacauccuguuuucuucauucccu

SEQ ID NO: 23409 - RNA, 64 nt, hsa
uaaccuguaaccuuguuguuuaaguuuucuuuucuauuaauacucuguccuguggucccgugca

SEQ ID NO: 23410 - RNA, 64 nt, hsa
agguuaaggcccaagauguuugaaaugaaugcaauauuaauagaugcauauauacaugacauau

SEQ ID NO: 23411 - RNA, 64 nt, hsa
ggaaugaaaauacuuaaauacuguaaagcauaucuauuaauaauucccccaauuuuuuaaacua

SEQ ID NO: 23412 - RNA, 64 nt, hsa
cuuuugaguucauaaaucauuuguacccagaauguauuaauauauugcuauuagguuaaucugu

SEQ ID NO: 23413 - RNA, 64 nt, hsa
guccucaucucuuaagcuaaaucuguuuggaucauauuaauaaacuaaaugaaauuacacuuuu

SEQ ID NO: 23414 - RNA, 64 nt, hsa
agaaagaggcuaugggaaacauagaaaugguauguauuaauaacugaucauaggcugaggagaa

SEQ ID NO: 23415 - RNA, 64 nt, hsa
aacaucucaucauugacuaugauugaauuuuauuuauuaauacuucccuaggauauccuguguu

SEQ ID NO: 23416 - RNA, 64 nt, hsa
ucagauucacugaguuaagaaaguuuuauuuaaauauuaauauuaaucaagaauuuaacagaua

SEQ ID NO: 23417 - RNA, 64 nt, hsa
agaaaaauuaaagcuaaaauuagcugcaaagaaguauuaauaaucaccucugcaaaaauucuaa

SEQ ID NO: 23418 - RNA, 64 nt, hsa
cccuugcacauuuuggucuuuuuguuaauauuuuuauuaauaacacauaauuaguaaccacucu

SEQ ID NO: 23419 - RNA, 64 nt, hsa
uagaauuuccuuuagaagauggcagugauuauaauauuaauaugauuucauuuguuccaguguu

SEQ ID NO: 23420 - RNA, 64 nt, hsa
uuuuuuaacagucaauuucaguucagcuaacauauauuaauaccuuuguaacucuuugcuaugg

SEQ ID NO: 23421 - RNA, 64 nt, hsa
cagcagaauugggcagugggggugacuuuucuuauauuaauaauauuuacauccaauacacuga

SEQ ID NO: 23422 - RNA, 64 nt, hsa
aagagauucuguugugauuauuugaauaguuuuauauuaauaaaagaagacaaaauuuuuuaaa

SEQ ID NO: 23423 - RNA, 64 nt, hsa
uaguuuauauuuuagauauaaacaucauauuuuuuauuaauaccuacaucaaauggaaaauauc

SEQ ID NO: 23424 - RNA, 64 nt, hsa
auuauuaaauauucuacaacuuuuuaaaaaugucuauuaauauuccaucguauagaugugauau

SEQ ID NO: 23425 - RNA, 64 nt, hsa
auaaucucuaauccuacuaccuagaauaaaacacuauuaauauuuuggucuguuuccugccaag

SEQ ID NO: 23426 - RNA, 64 nt, hsa
uuguuaguggucugaaauaauuauuuuccuguucuauuaauacauaguguauuuugcacaaaaa

SEQ ID NO: 23427 - RNA, 64 nt, hsa
aauuaaccuggucaauagugauuaccaaaauauauauuaauaaucuuggcaauuuuugacauua

SEQ ID NO: 23428 - RNA, 64 nt, hsa
aaauuuugccuuagacaacauuugucugguuccuuauuaauaacuugcaucugaucugcuuaga

SEQ ID NO: 23429 - RNA, 64 nt, hsa
caagaaguaccaguccaccaacucacauuuucuauauuaauaauucuuaacuaaaagaaguucc

SEQ ID NO: 23430 - RNA, 64 nt, hsa
augaagauauuuuuccauuuuuuucuaauaguuuuauuaauaaacauucuaucuauuccuggua

SEQ ID NO: 23431 - RNA, 64 nt, hsa
uucauccuuuucauugccauguaggguucccuuauauuaauauuccucaguucauccauucuau

SEQ ID NO: 23432 - RNA, 64 nt, hsa
agcuguuuugugguaauugcuuuuuaaaggaaguuauuaauaucauaaguuauuauuaauauuu

SEQ ID NO: 23433 - RNA, 64 nt, hsa
cuuuuuaaaggaaguuauuaauaucauaaguuauuauuaauauuuugaacacagguggauguga

SEQ ID NO: 23434 - RNA, 64 nt, hsa
cuguaggauguacuguauguagucaugcacuuuguauuaauauauuagaaaucuacagaucugu

SEQ ID NO: 23435 - RNA, 64 nt, hsa
ugacuauauauguugcauccugugccucccuucauauuaauauuugauaaagauuuuaauuuau

SEQ ID NO: 23436 - RNA, 64 nt, hsa
uaauagcaacuuuuguguaaugaaaaugaauaucuauuaauauauguauuauuuauaauuccua

SEQ ID NO: 23437 - RNA, 64 nt, hsa
ccugcaauauuugaauuuuaaaucuaaaucuauuuauuaauauuuaacauuauuuauaugggga

SEQ ID NO: 23438 - RNA, 64 nt, hsa
auuuuguauauuugagaaaacagggaauacauuguauuaauaccaaaguguuuggucauuuuaa

SEQ ID NO: 23439 - RNA, 64 nt, hsa
auuuuaucuaaauuacagugcaguuuaguuaaucuauuaauacugacucagugucugccuuuaa

SEQ ID NO: 23440 - RNA, 64 nt, hsa
cuugaaauuauuuccugaucccuuccccuuccacuauuaauaauucauuucugucaaacuguaa

SEQ ID NO: 23441 - RNA, 64 nt, hsa
uguacuguacuuugcagaagugaaguuuuucuguuauuaauauauaauuaugcaaaugaaugcg

SEQ ID NO: 23442 - RNA, 64 nt, hsa
guuuucuacuugagucuaacauauggucccaauuuauuaauacuucuguuaaauuugaugucag

SEQ ID NO: 23443 - RNA, 64 nt, hsa
auacuguuaaaaugugcuuaccaauacuguguuuuauuaauaaucuucauaagaaaagaaacac

SEQ ID NO: 23444 - RNA, 64 nt, hsa
ccccucccugccauucauauuuucugcauaacacuauuaauaauaucaaccuccacagccccuu

SEQ ID NO: 23445 - RNA, 64 nt, hsa
uuuguguugguuuuuuaagaagucuaaaugaaguuauuaauaccugaagcuuuaaguuaagugc

SEQ ID NO: 23446 - RNA, 64 nt, hsa
acugucagcuaacagguuuuuuaaggcuuuuaacuauuaauauuuuauggaauggggcaaagua

SEQ ID NO: 23447 - RNA, 64 nt, hsa
uuuucuacucauuugucucucuggccaauugaauuauuaauaaaaggucuguauuaucaaagag

SEQ ID NO: 23448 - RNA, 64 nt, hsa
uauauuuaacuggaaauaugcuuugauuuuguguuauuaauauaauucuuuugauguagucaug

SEQ ID NO: 23449 - RNA, 64 nt, hsa
uauacuauauuacaaaaugacauuuugccaaaauuauuaauauaagaagcuuucaguauuagug

SEQ ID NO: 23450 - RNA, 64 nt, hsa
uggcuaaauugaaaccuggaauuguggggcaaucuauuaauagcugccuuaaagucaguaacuu

SEQ ID NO: 23451 - RNA, 64 nt, hsa
uucaugcugaauguuugcaaagacuugauauaaguauuaauaguaaugaaucaaugaauaaaua

SEQ ID NO: 23452 - RNA, 64 nt, hsa
acacacgcacgcacacaguggcagaagggauuuauauuaauauucuuuccccucuggccuucuu

SEQ ID NO: 23453 - RNA, 64 nt, hsa; identical to SEQ ID NO: 23340

SEQ ID NO: 23454 - RNA, 64 nt, hsa; identical to SEQ ID NO: 23341

SEQ ID NO: 23455 - RNA, 64 nt, hsa; identical to SEQ ID NO: 23342

SEQ ID NO: 23456 - RNA, 64 nt, hsa; identical to SEQ ID NO: 23343

SEQ ID NO: 23457 - RNA, 64 nt, hsa; identical to SEQ ID NO: 23344

SEQ ID NO: 23458 - RNA, 64 nt, hsa; identical to SEQ ID NO: 23345

SEQ ID NO: 23459 - RNA, 64 nt, hsa; identical to SEQ ID NO: 23346

SEQ ID NO: 23460 - RNA, 64 nt, hsa; identical to SEQ ID NO: 23347

SEQ ID NO: 23461 - RNA, 64 nt, hsa; identical to SEQ ID NO: 23348

SEQ ID NO: 23462 - RNA, 64 nt, hsa; identical to SEQ ID NO: 23349

SEQ ID NO: 23463 - RNA, 64 nt, hsa; identical to SEQ ID NO: 23350

SEQ ID NO: 23464 - RNA, 64 nt, hsa; identical to SEQ ID NO: 23351

SEQ ID NO: 23465 - RNA, 64 nt, hsa; identical to SEQ ID NO: 23352

SEQ ID NO: 23466 - RNA, 64 nt, hsa; identical to SEQ ID NO: 23353

SEQ ID NO: 23467 - RNA, 64 nt, hsa; identical to SEQ ID NO: 23354

SEQ ID NO: 23468 - RNA, 64 nt, hsa; identical to SEQ ID NO: 23355

SEQ ID NO: 23469 - RNA, 64 nt, hsa; identical to SEQ ID NO: 23356

SEQ ID NO: 23470 - RNA, 64 nt, hsa; identical to SEQ ID NO: 23357

SEQ ID NO: 23471 - RNA, 64 nt, hsa; identical to SEQ ID NO: 23358

SEQ ID NO: 23472 - RNA, 64 nt, hsa; identical to SEQ ID NO: 23359

SEQ ID NO: 23473 - RNA, 64 nt, hsa; identical to SEQ ID NO: 23360

SEQ ID NO: 23474 - RNA, 64 nt, hsa; identical to SEQ ID NO: 23361

SEQ ID NO: 23475 - RNA, 64 nt, hsa; identical to SEQ ID NO: 23362

SEQ ID NO: 23476 - RNA, 64 nt, hsa; identical to SEQ ID NO: 23363

SEQ ID NO: 23477 - RNA, 64 nt, hsa; identical to SEQ ID NO: 23364

SEQ ID NO: 23478 - RNA, 64 nt, hsa; identical to SEQ ID NO: 23365

SEQ ID NO: 23479 - RNA, 64 nt, hsa; identical to SEQ ID NO: 23366

SEQ ID NO: 23480 - RNA, 64 nt, hsa; identical to SEQ ID NO: 23367

SEQ ID NO: 23481 - RNA, 64 nt, hsa; identical to SEQ ID NO: 23368

SEQ ID NO: 23482 - RNA, 64 nt, hsa; identical to SEQ ID NO: 23369

SEQ ID NO: 23483 - RNA, 64 nt, hsa; identical to SEQ ID NO: 23370

SEQ ID NO: 23484 - RNA, 64 nt, hsa; identical to SEQ ID NO: 23371

SEQ ID NO: 23485 - RNA, 64 nt, hsa; identical to SEQ ID NO: 23372

SEQ ID NO: 23486 - RNA, 64 nt, hsa; identical to SEQ ID NO: 23373

SEQ ID NO: 23487 - RNA, 64 nt, hsa; identical to SEQ ID NO: 23374

SEQ ID NO: 23488 - RNA, 64 nt, hsa; identical to SEQ ID NO: 23375

SEQ ID NO: 23489 - RNA, 64 nt, hsa; identical to SEQ ID NO: 23376

SEQ ID NO: 23490 - RNA, 64 nt, hsa; identical to SEQ ID NO: 23377

SEQ ID NO: 23491 - RNA, 64 nt, hsa; identical to SEQ ID NO: 23378

SEQ ID NO: 23492 - RNA, 64 nt, hsa; identical to SEQ ID NO: 23379

SEQ ID NO: 23493 - RNA, 64 nt, hsa; identical to SEQ ID NO: 23380

SEQ ID NO: 23494 - RNA, 64 nt, hsa; identical to SEQ ID NO: 23381

SEQ ID NO: 23495 - RNA, 64 nt, hsa; identical to SEQ ID NO: 23382

SEQ ID NO: 23496 - RNA, 64 nt, hsa; identical to SEQ ID NO: 23383

SEQ ID NO: 23497 - RNA, 64 nt, hsa; identical to SEQ ID NO: 23384

SEQ ID NO: 23498 - RNA, 64 nt, hsa; identical to SEQ ID NO: 23385

SEQ ID NO: 23499 - RNA, 64 nt, hsa; identical to SEQ ID NO: 23386

SEQ ID NO: 23500 - RNA, 64 nt, hsa; identical to SEQ ID NO: 23387

SEQ ID NO: 23501 - RNA, 64 nt, hsa; identical to SEQ ID NO: 23388

SEQ ID NO: 23502 - RNA, 64 nt, hsa; identical to SEQ ID NO: 23389

SEQ ID NO: 23503 - RNA, 64 nt, hsa; identical to SEQ ID NO: 23390

SEQ ID NO: 23504 - RNA, 64 nt, hsa; identical to SEQ ID NO: 23391

SEQ ID NO: 23505 - RNA, 64 nt, hsa; identical to SEQ ID NO: 23392

SEQ ID NO: 23506 - RNA, 64 nt, hsa; identical to SEQ ID NO: 23393

SEQ ID NO: 23507 - RNA, 64 nt, hsa; identical to SEQ ID NO: 23394

SEQ ID NO: 23508 - RNA, 64 nt, hsa; identical to SEQ ID NO: 23395

SEQ ID NO: 23509 - RNA, 64 nt, hsa; identical to SEQ ID NO: 23396

SEQ ID NO: 23510 - RNA, 64 nt, hsa; identical to SEQ ID NO: 23397

SEQ ID NO: 23511 - RNA, 64 nt, hsa; identical to SEQ ID NO: 23398

SEQ ID NO: 23512 - RNA, 64 nt, hsa; identical to SEQ ID NO: 23399

SEQ ID NO: 23513 - RNA, 64 nt, hsa; identical to SEQ ID NO: 23400

SEQ ID NO: 23514 - RNA, 64 nt, hsa; identical to SEQ ID NO: 23401

SEQ ID NO: 23515 - RNA, 64 nt, hsa; identical to SEQ ID NO: 23402

SEQ ID NO: 23516 - RNA, 64 nt, hsa; identical to SEQ ID NO: 23403

SEQ ID NO: 23517 - RNA, 64 nt, hsa; identical to SEQ ID NO: 23404

SEQ ID NO: 23518 - RNA, 64 nt, hsa; identical to SEQ ID NO: 23405

SEQ ID NO: 23519 - RNA, 64 nt, hsa; identical to SEQ ID NO: 23406

SEQ ID NO: 23520 - RNA, 64 nt, hsa; identical to SEQ ID NO: 23407

SEQ ID NO: 23521 - RNA, 64 nt, hsa; identical to SEQ ID NO: 23408

SEQ ID NO: 23522 - RNA, 64 nt, hsa; identical to SEQ ID NO: 23409

SEQ ID NO: 23523 - RNA, 64 nt, hsa; identical to SEQ ID NO: 23410

SEQ ID NO: 23524 - RNA, 64 nt, hsa; identical to SEQ ID NO: 23411

SEQ ID NO: 23525 - RNA, 64 nt, hsa; identical to SEQ ID NO: 23412

SEQ ID NO: 23526 - RNA, 64 nt, hsa; identical to SEQ ID NO: 23413

SEQ ID NO: 23527 - RNA, 64 nt, hsa; identical to SEQ ID NO: 23414

SEQ ID NO: 23528 - RNA, 64 nt, hsa; identical to SEQ ID NO: 23415

SEQ ID NO: 23529 - RNA, 64 nt, hsa; identical to SEQ ID NO: 23416

SEQ ID NO: 23530 - RNA, 64 nt, hsa; identical to SEQ ID NO: 23417

SEQ ID NO: 23531 - RNA, 64 nt, hsa; identical to SEQ ID NO: 23418

SEQ ID NO: 23532 - RNA, 64 nt, hsa; identical to SEQ ID NO: 23419

SEQ ID NO: 23533 - RNA, 64 nt, hsa; identical to SEQ ID NO: 23420

SEQ ID NO: 23534 - RNA, 64 nt, hsa; identical to SEQ ID NO: 23421

SEQ ID NO: 23535 - RNA, 64 nt, hsa; identical to SEQ ID NO: 23422

SEQ ID NO: 23536 - RNA, 64 nt, hsa; identical to SEQ ID NO: 23423

SEQ ID NO: 23537 - RNA, 64 nt, hsa; identical to SEQ ID NO: 23424

SEQ ID NO: 23538 - RNA, 64 nt, hsa; identical to SEQ ID NO: 23425

SEQ ID NO: 23539 - RNA, 64 nt, hsa; identical to SEQ ID NO: 23426

SEQ ID NO: 23540 - RNA, 64 nt, hsa; identical to SEQ ID NO: 23427

SEQ ID NO: 23541 - RNA, 64 nt, hsa; identical to SEQ ID NO: 23428

SEQ ID NO: 23542 - RNA, 64 nt, hsa; identical to SEQ ID NO: 23429

SEQ ID NO: 23543 - RNA, 64 nt, hsa; identical to SEQ ID NO: 23430

SEQ ID NO: 23544 - RNA, 64 nt, hsa; identical to SEQ ID NO: 23431

SEQ ID NO: 23545 - RNA, 64 nt, hsa; identical to SEQ ID NO: 23432

SEQ ID NO: 23546 - RNA, 64 nt, hsa; identical to SEQ ID NO: 23433

SEQ ID NO: 23547 - RNA, 64 nt, hsa; identical to SEQ ID NO: 23434

SEQ ID NO: 23548 - RNA, 64 nt, hsa; identical to SEQ ID NO: 23435

SEQ ID NO: 23549 - RNA, 64 nt, hsa; identical to SEQ ID NO: 23436

SEQ ID NO: 23550 - RNA, 64 nt, hsa; identical to SEQ ID NO: 23437

SEQ ID NO: 23551 - RNA, 64 nt, hsa; identical to SEQ ID NO: 23438

SEQ ID NO: 23552 - RNA, 64 nt, hsa; identical to SEQ ID NO: 23439

SEQ ID NO: 23553 - RNA, 64 nt, hsa; identical to SEQ ID NO: 23440

SEQ ID NO: 23554 - RNA, 64 nt, hsa; identical to SEQ ID NO: 23441

SEQ ID NO: 23555 - RNA, 64 nt, hsa; identical to SEQ ID NO: 23442

SEQ ID NO: 23556 - RNA, 64 nt, hsa; identical to SEQ ID NO: 23443

SEQ ID NO: 23557 - RNA, 64 nt, hsa; identical to SEQ ID NO: 23444

SEQ ID NO: 23558 - RNA, 64 nt, hsa; identical to SEQ ID NO: 23445

SEQ ID NO: 23559 - RNA, 64 nt, hsa; identical to SEQ ID NO: 23446

SEQ ID NO: 23560 - RNA, 64 nt, hsa; identical to SEQ ID NO: 23447

SEQ ID NO: 23561 - RNA, 64 nt, hsa; identical to SEQ ID NO: 23448

SEQ ID NO: 23562 - RNA, 64 nt, hsa; identical to SEQ ID NO: 23449

SEQ ID NO: 23563 - RNA, 64 nt, hsa; identical to SEQ ID NO: 23450

SEQ ID NO: 23564 - RNA, 64 nt, hsa; identical to SEQ ID NO: 23451

SEQ ID NO: 23565 - RNA, 64 nt, hsa; identical to SEQ ID NO: 23452

SEQ ID NO: 23566 - RNA, 64 nt, hsa
ugauuaccaccaacuuucugacuaagcuaaaaaugaaugaaaaugguggcuaaagaaaauaggg

SEQ ID NO: 23567 - RNA, 64 nt, hsa
guggaagaauguucaaguugaauccuaaugccgugaaugaaacacagucuguguagggaaugag

SEQ ID NO: 23568 - RNA, 64 nt, hsa
guaauuuggaagcccaguuccuuaggugggauaggaaugaaagccuaaaccucuuccuuuagcu

SEQ ID NO: 23569 - RNA, 64 nt, hsa
auaaaaugauuucuuaguaugauuguacaguaaugaaugaaaguggaacauguuucuuuuugaa

SEQ ID NO: 23570 - RNA, 64 nt, hsa
guugaaaccggcaguuacacuaaguaaguggagggaaugaaaguguuucgaggugaauguggau

SEQ ID NO: 23571 - RNA, 64 nt, hsa
aucuuauaguaauucaggcucuaauuagcugagggaaugaaacacacaaaaaucacugaauucc

SEQ ID NO: 23572 - RNA, 64 nt, hsa
gcaucuuuagagaccauuggcccacugaugaauggaaugaaaaagcgagcagauacuguugguc

SEQ ID NO: 23573 - RNA, 64 nt, hsa
caaugacucgaaguuugcaguauggagaacaggugaaugaaauccugugccguucuucagucug

SEQ ID NO: 23574 - RNA, 64 nt, hsa
acacauuaguauguauaacuggcuuuaccaaauugaaugaaaaggagcuugugcaaaaaaauuu

SEQ ID NO: 23575 - RNA, 64 nt, hsa
uuuuugggguuuaaagaaauggucugcauaaccugaaugaaagaagcaaaugacuauucucuga

SEQ ID NO: 23576 - RNA, 64 nt, hsa
gccuuuuauauuuacccuuuuugucaucacuuuagaaugaaaauucccauuuaaaucugaaagu

SEQ ID NO: 23577 - RNA, 64 nt, hsa
cgugagccacugugccugaccugucauuuuuauagaaugaaaugugcuuauuucuaaacauucu

SEQ ID NO: 23578 - RNA, 64 nt, hsa
ucauugcuucugauuauugaagaggucagauuaugaaugaaaggauaaaauguuuuaauaguag

SEQ ID NO: 23579 - RNA, 64 nt, hsa
caguuuuuauaaaaagaaagcccgggucugcagagaaugaaaacugguuggaaacuaaagguuc

SEQ ID NO: 23580 - RNA, 64 nt, hsa
uuagagcguguugcuguuguaacaucccagagaagaaugaaaaggcacaugcuuuuauccguga

SEQ ID NO: 23581 - RNA, 64 nt, hsa
uuucucuagcuuaucccugcacaauuauuagagugaaugaaaaaccacuuuccugcuuuccauu

SEQ ID NO: 23582 - RNA, 64 nt, hsa
aaccuccacagcucauuucuuuguaauauaaucagaaugaaaaauaauuuaagaggacagaaga

SEQ ID NO: 23583 - RNA, 60 nt, hsa
accuugugacaucuguuuaaaagagaggaagaaugaaacuaagaaaauucuauguuaauu

SEQ ID NO: 23584 - RNA, 64 nt, hsa
acaaguuuacccagccugcuuugcuuuacugcaugaaugaaacugaugguucaauuucagaagu

SEQ ID NO: 23585 - RNA, 64 nt, hsa
aacaaaacaaaaaucuguguaacuguaaaacauugaaugaaacuauuuuaccugaacuagauuu

SEQ ID NO: 23586 - RNA, 64 nt, hsa
auagaaauuuuauuuccauugugaguucugacaagaaugaaauuccacauacaacauaacugua

SEQ ID NO: 23587 - RNA, 64 nt, hsa
acuccauggaucuguguucugacuggcaccuuuggaaugaaagaaaagugugugcuguccaaau

SEQ ID NO: 23588 - RNA, 64 nt, hsa
ucccauaaauaaaaguacaguuuucuugguggcagaaugaaaaucagcaacuucuagcauauag

SEQ ID NO: 23589 - RNA, 64 nt, hsa
augacgacaccuagcucuaagagcaauucugggagaaugaaaggaaguauaaaguaacccauaa

SEQ ID NO: 23590 - RNA, 64 nt, hsa
gauaagaaaaaauauauauugcucuucaacuagugaaugaaagaaacuucagaaagcuagaauu

SEQ ID NO: 23591 - RNA, 64 nt, hsa
aaaacuaaacuaucagucauuuacauccucucaugaaugaaaugcaguguagggagaggagaug

SEQ ID NO: 23592 - RNA, 64 nt, hsa
cuuuacuauaauuaccaaaaacauguauauaaaagaaugaaauugaaaaauaaaauauauaaac

SEQ ID NO: 23593 - RNA, 64 nt, hsa
uguacauucaaguuguacuuguuauaucugacaugaaugaaauaaaaucuuaauuacagaugcu

SEQ ID NO: 23594 - RNA, 64 nt, hsa
auagauuaaauuggagaaacguguuaauuguguggaaugaaaaaauacauauauuuuuggaaaa

SEQ ID NO: 23595 - RNA, 64 nt, hsa
cuuguguugugugacauucaaaugucauuuuuuugaaugaaaaauacuuuccccuuuguguuuu

SEQ ID NO: 23596 - RNA, 64 nt, hsa
cccaaucugguuuucuuuuacccauaaauaacaugaaugaaaaaagauugggacaauagagacu

SEQ ID NO: 23597 - RNA, 64 nt, hsa
aaaacaugaaaugguuuuagcuagagucagaccagaaugaaaaugccaggagcugguacacuac

SEQ ID NO: 23598 - RNA, 64 nt, hsa
acgccuagaauguauuuuaaauacuuacuaagaagaaugaaaauucuuugguuguuuuauauau

SEQ ID NO: 23599 - RNA, 64 nt, hsa
gucagacccuugaagaaacgucacuucaaacucagaaugaaauuuucauuaauauuaaaauugu

SEQ ID NO: 23600 - RNA, 64 nt, hsa
aagaggcgaauuuguugaaaagucccaagggucugaaugaaagcaucuuuaaucaacacucaac

SEQ ID NO: 23601 - RNA, 64 nt, hsa
cauuggaauuuuuguuuuaguggucaguauaggggaaugaaagcgucuguuguuacccacguaa

SEQ ID NO: 23602 - RNA, 64 nt, hsa
auauuagacauaaugauaauuuuuuccauacucagaaugaaaaacuggauauuacguuuuuguu

SEQ ID NO: 23603 - RNA, 64 nt, hsa
auuuccucuuugcuguuuguaguagagacauuuugaaugaaacuuggcacugcuugauucaaaa

SEQ ID NO: 23604 - RNA, 64 nt, hsa
cauauuguguaacauggauaguuaaaacaauguugaaugaaaaaaaucaaaauacaaaugaaac

SEQ ID NO: 23605 - RNA, 64 nt, hsa
augaaacauuguguaauaauauuuauguaaauuggaaugaaaucauuuauaaagaacaacuguu

SEQ ID NO: 23606 - RNA, 64 nt, hsa
uaauaacucuuccugcuauucagaauaaguaggagaaugaaaacugcagcauaucagacagcaa

SEQ ID NO: 23607 - RNA, 64 nt, hsa
auguaauaaacuauucuuugaaacuuguuggguagaaugaaaauuaaagccauaaugguagaag

SEQ ID NO: 23608 - RNA, 64 nt, hsa
aguuuuaaaaacuuucucgcuccccacgaccccagaaugaaacagcuuuaaaaauagccuuaag

SEQ ID NO: 23609 - RNA, 64 nt, hsa
acuccugagggcuagaggacagagaaagagaauagaaugaaaugacuuugauuccugcgccuuu

SEQ ID NO: 23610 - RNA, 64 nt, hsa
accgguauugacuggauugacagcuaaaguaucagaaugaaagcaagguuuuuuugauguuacc

SEQ ID NO: 23611 - RNA, 64 nt, hsa
uaacaacucagugaaaagauggucuccaguuucugaaugaaaaagcuacagcugagaaauaaaa

SEQ ID NO: 23612 - RNA, 64 nt, hsa
ucagaaugucugaggagugagacacaggcaucaacacucucaaaugauucacauguucagccaa

SEQ ID NO: 23613 - RNA, 64 nt, hsa
ggucaugcacuugcacaauguugagaaugaguaccacucucaccauugguauagccaaaaaagc

SEQ ID NO: 23614 - RNA, 64 nt, hsa
aggguguagugguguggcucucuggacuuaacgucacucucagaggucagaaccuuggagauca

SEQ ID NO: 23615 - RNA, 64 nt, hsa
cuguagagccaggauuccuagacccagggcucugcacucucaaggcuggccccaugugcucaag

SEQ ID NO: 23616 - RNA, 64 nt, hsa
augcuuuucccacucucauuuguuaaugcuuucccacucucaggggaaggauuugcauuuugag

SEQ ID NO: 23617 - RNA, 64 nt, hsa
aagaccuguguuaaugcuuuguuaaugcuuuucccacucucauuuguuaaugcuuucccacucu

SEQ ID NO: 23618 - RNA, 64 nt, hsa
ccuuuaugucuggccuucuaggaucuguccaagacacucucaggccuggaggcagggcauagaa

SEQ ID NO: 23619 - RNA, 64 nt, hsa
cuggaguaucuauaugagaagcucugugaggggacacucucaccucaugucguggcugggcucc

SEQ ID NO: 23620 - RNA, 64 nt, hsa
ggccaccuccuaaaaggcccagagagaagagccccacucucagaggccccaauaccccauggac

SEQ ID NO: 23621 - RNA, 64 nt, hsa
ggagcccauuuggagggccugggccuggcucccucacucucaggaaaugcugacccaugggcag

SEQ ID NO: 23622 - RNA, 64 nt, hsa
ggcauaaugaguauuuugaaagaagaaauuucuucacucucauuuuuauagaaaucuuggaauc

SEQ ID NO: 23623 - RNA, 64 nt, hsa
uaacuguuccccauuuuuuuuugaaccacagucucacucucacccaggcuggagugcaguggca

SEQ ID NO: 23624 - RNA, 64 nt, hsa
cccucgugcuuugcuggccccugcccgcuacucccacucucagacacccagggguggugggccc

SEQ ID NO: 23625 - RNA, 64 nt, hsa
cauccauguaaaguagguggcagggcagagaugucacucucauucaacagggaggaugucuguu

SEQ ID NO: 23626 - RNA, 64 nt, hsa
uccaacuucuagaacucccaguuuauaccugugucacucucaauuuuuuccaguaaaguacuug

SEQ ID NO: 23627 - RNA, 64 nt, hsa
uaccugacggaugcuccagacuggcuuccaguuucacucucagcauuccaagaucuuagcccuu

SEQ ID NO: 23628 - RNA, 64 nt, hsa
ucuagucuccccuuuaaaucuuaccuuggcaguaacacauuauuccucauucaauaauuucaau

SEQ ID NO: 23629 - RNA, 64 nt, hsa
cagcaagcuguguaugaacuuguguuuuguggugacacauuaauaaucaaauugcuaaaacccu

SEQ ID NO: 23630 - RNA, 64 nt, hsa
aacaggucucuaagcuagugguuuucaaacugguacacauuagacucacccgaggaauuuuaaa

SEQ ID NO: 23631 - RNA, 64 nt, hsa
ggaagucugucauuaauaagguauuucuaaauaaacacauuauguaaggaagugccaaaauagu

SEQ ID NO: 23632 - RNA, 64 nt, hsa
auguuuaugaacgauucaaauugucuucagugaaacacauuagucacaagaaucccugauugcu

SEQ ID NO: 23633 - RNA, 64 nt, hsa
gaauuuuccuauuauaugguauccaaggauguagacacauuagaauuauaagaagacaugagga

SEQ ID NO: 23634 - RNA, 64 nt, hsa
gucuuaggaauugccucaggcauuuuuuuuuuuuacacauuaacuaaagggcuauucgaaaucu

SEQ ID NO: 23635 - RNA, 64 nt, hsa
cuaaauuaaucucugccuuuucugaccucauauaacacauuauguagguuucuuaucacuuucu

SEQ ID NO: 23636 - RNA, 64 nt, hsa
auuaaaaaagguaguuuuucugucauuguuaaauacacauuaucacugaaaaaauguagcuuuu

SEQ ID NO: 23637 - RNA, 64 nt, hsa
acaccuuuauuuuauuuuuuuucaaaaugaagauacacauuacagccaggugugguagcaggca

SEQ ID NO: 23638 - RNA, 64 nt, hsa
aacugagcgucuuacacacgcaguacagaggagcacacauuaggauagaaacaguagaauaacc

SEQ ID NO: 23639 - RNA, 64 nt, hsa
auucauuaacagugugugcaaaugcaaccccaggacacauuauuguucugauagaugcucacag

SEQ ID NO: 23640 - RNA, 64 nt, hsa
acuucucuaauucuuccuuuguaaaaaaaaaaaaaagcaacacuuuuuauguuauauguuguuc

SEQ ID NO: 23641 - RNA, 64 nt, hsa
auguacucuaaauacugagaaaaccuguucuaccaagcaacaacuccgcaggcaguuaccaagu

SEQ ID NO: 23642 - RNA, 64 nt, hsa
aaaucuguaacagguauuuuguuucuuuuaaagcaagcaacacagaggaauuuauaccucaaac

SEQ ID NO: 23643 - RNA, 64 nt, hsa
uaccugguggauaucuagcuaguaauauauucugaagcaacauuuuagcucuauugauacucuu

SEQ ID NO: 23644 - RNA, 64 nt, hsa
cauuaaaauuucaaaguuuaauuaauauaauuaaaagcaacagcaagcagcagccugugaagau

SEQ ID NO: 23645 - RNA, 64 nt, hsa
caagaaaguuuguuugaauguguagaagaggaaaaagcaacaacagcaacaacacgaagaugau

SEQ ID NO: 23646 - RNA, 64 nt, hsa
aauggaacauuaacccuacacucggaauucccugaagcaacacugccagaaguguguuuuggua

SEQ ID NO: 23647 - RNA, 64 nt, hsa
cccaucucacuuuaauaauaaaaaucaugcuuauaagcaacaugaauuaagaacugacacaaag

SEQ ID NO: 23648 - RNA, 64 nt, hsa
aaaauguugaagcagagaaacauucacacacaaaaagcaacauagucauguggguccagauggc

SEQ ID NO: 23649 - RNA, 64 nt, hsa
aagaaugggggcgugccagccuggcaggagugggaagcaacacgcaggggucccggaccucucc

SEQ ID NO: 23650 - RNA, 64 nt, hsa
auuacauuucgcugaaaugaggacgagggcaagaaagcaacauugcugaucucucuaguaugaa

SEQ ID NO: 23651 - RNA, 64 nt, hsa
uucucuaacacugauuuaauagcuaacgagguagaagcaacauucauucuccuggucuuacaua

SEQ ID NO: 23652 - RNA, 64 nt, hsa
guuucccuuuggaguuccaaaguaaaggacacauaagcaacacuuccaaaaacaagggaacaag

SEQ ID NO: 23653 - RNA, 64 nt, hsa
aaaaagaauaacagaaugcaucguggcaauccuuaagcaacauuaucuauguggacugcuuaaa

SEQ ID NO: 23654 - RNA, 64 nt, hsa
ugcgagcugugguuaggcuugguuagagugcagcaagcaacaugacagaugguggcacgcuguu

SEQ ID NO: 23655 - RNA, 64 nt, hsa
agucagcuccccuuuaaaaaucuaagguaucuccaagcaacacaucuccauucuaguugucuug

SEQ ID NO: 23656 - RNA, 64 nt, hsa
cugcuugcccccccaggucccuccagccucagccaagcaacauggggugaaccucagcacuccc

SEQ ID NO: 23657 - RNA, 64 nt, hsa
cugaaggaauguguuuucaaaauauuauuugguaaagcaacagauugugaugggaaaauguuuu

SEQ ID NO: 23658 - RNA, 64 nt, hsa
aauaacuguauaaaugaugacuuuaaaaaaauguaagcaacaaguccaugucauagucaauaaa

SEQ ID NO: 23659 - RNA, 64 nt, hsa
agcugauugcuugaggcuuuuagugaguuccgaaaagcaacaggaaaaaucaguuaucugaaag

SEQ ID NO: 23660 - RNA, 64 nt, hsa
aucauuugugugcucuggcucuuuugauagaagaaagcaacacaaaagcuccaaagggcccccu

SEQ ID NO: 23661 - RNA, 64 nt, hsa
ugucuuaccuuccucacagacuuuguacagaccaaagcaacaaauauuuauugccauguauagc

SEQ ID NO: 23662 - RNA, 64 nt, hsa
gaauauugucugguucuugguauuuacuguauguaagcaacaacuugaaagguggcaauauggu

SEQ ID NO: 23663 - RNA, 64 nt, hsa
caguccuccugggcggccccagguccuggacaauaagcaacagaugauauugagugucgggugg

SEQ ID NO: 23664 - RNA, 64 nt, hsa
gugcaccaccucgaucucgguguuucaggcacuaaagcaacaaaacaacccauaguaucucauu

SEQ ID NO: 23665 - RNA, 64 nt, hsa
aaggagaggccacaaggaauaugggugggaguaaaagcaacaucgucugcuucauacuuuuucc

SEQ ID NO: 23666 - RNA, 64 nt, hsa
gccuugugggcccccuucuuucggcuuucugcuaaagcaacaccuccagcagagauucccuuaa

SEQ ID NO: 23667 - RNA, 64 nt, hsa
gcauaguuggugcgaaaaucuccugugcuuguggaagcaacauaaguugggucccuuaacuguc

SEQ ID NO: 23668 - RNA, 64 nt, hsa
ucaauuuuuccuuaucuuguuuuccacaauucacaagcaacagcaagcauuuucuauaauuuua

SEQ ID NO: 23669 - RNA, 64 nt, hsa
ugguuuuuuuaagcuuuuuuugcauauguuuuguaagcaacaaauuuuuuuguauaaaaguccc

SEQ ID NO: 23670 - RNA, 64 nt, hsa
uuuuuuuuuuuuccaguaaacaaaaccugaaagcaagcaacaaaacauacacuuugucagagaa

SEQ ID NO: 23671 - RNA, 64 nt, hsa
caguacucaguaaggcagugcaguacucaguaacacaauacaguacucaggcagugcaguacuc

SEQ ID NO: 23672 - RNA, 64 nt, hsa
caguauucaguaaggcagugaaguacucaguaauacaauacaguacucaguuaggcagugcagu

SEQ ID NO: 23673 - RNA, 64 nt, hsa
aauguagcaaguaaagaaugagaauggauucuguacaauacacuagaaaccaacauaauguauu

SEQ ID NO: 23674 - RNA, 64 nt, hsa
guauauaucaacauuauuuuauugugcaauuaaaacaauacaaauucaugguuuuuuaaaguua

SEQ ID NO: 23675 - RNA, 64 nt, hsa
uauauuucagcuagaucuaaaaagcaucugaaggaauuuacaaugaaagauaccuaugcaauaa

SEQ ID NO: 23676 - RNA, 64 nt, hsa
acuuuuucuuuaaaauucaauuaaguuacaccagaauuuacaggcaagauuuuuuuuuucauug

SEQ ID NO: 23677 - RNA, 64 nt, hsa
aggaagauuuuaccucucaaagggugagauuugaaauuuacacuaaaaagacaacuuuacauuu

SEQ ID NO: 23678 - RNA, 64 nt, hsa
cuaaacugacaguccuucgauaauaugaaacauuaauuuacaaggacccguuagggcuucaaug

SEQ ID NO: 23679 - RNA, 64 nt, hsa
uaaaguuuccuuuguauaggaguaugcucacuuaaauuuacagaaagaggugagcuguguuaaa

SEQ ID NO: 23680 - RNA, 64 nt, hsa
gaaagucuauuucuuugaaacgaaggaaguaucgaauuuacauuaguuuuuuucauacccuuuu

SEQ ID NO: 23681 - RNA, 64 nt, hsa
gaauucuguacguuaucacuguaauggaauauccaauuuacagauaguaugauauacauuucau

SEQ ID NO: 23682 - RNA, 64 nt, hsa
guuugacauucaaagugacaauguuuagcaaucaaauuuacauguauagaucgucagggaauag

SEQ ID NO: 23683 - RNA, 64 nt, hsa
auaauauguuugagauuucggauagacuuauuggaauuuacaagacauacaacauaacaaaaag

SEQ ID NO: 23684 - RNA, 64 nt, hsa
augaaguaagauggccucugauuuacacugguucaauuuacaaauuuucaacuuuaugauaggu

SEQ ID NO: 23685 - RNA, 64 nt, hsa
uugacaguuaucaaagauguacuuuccacaguuaaauuuacauuaauggcaauuuuugauaguu

SEQ ID NO: 23686 - RNA, 64 nt, hsa
uucauuggcguaacguaaaguguauucuguacauaauuuacaaauaaaacauuuuauuuuaauu

SEQ ID NO: 23687 - RNA, 64 nt, hsa
uuguaaauuccagguguuacacugaccucaauccaauuuacauaauuuacauaaaugcaucucg

SEQ ID NO: 23688 - RNA, 64 nt, hsa
ccagguguuacacugaccucaauccaauuuacauaauuuacauaaaugcaucucgguggaaaaa

SEQ ID NO: 23689 - RNA, 64 nt, hsa
uucucuuccuauaauucucuaauuauaacauaguaauuuacauguaguuggacauguacacuca

SEQ ID NO: 23690 - RNA, 64 nt, hsa
gggaugcucacuaugcccuguuucucuucuaaacaauuuacauguaaugucucauuccucacaa

SEQ ID NO: 23691 - RNA, 64 nt, hsa
caagagagggugagauuaaccuuuuugcuaaaguaauuuacaagucaaagacaggaagagauca

SEQ ID NO: 23692 - RNA, 64 nt, hsa
uccaauuaaugacccaaaugccaagguaauuuuaaauuuacauuuuuaauaaaagcaacauguu

SEQ ID NO: 23693 - RNA, 64 nt, hsa
uugaagaaauaaaauauuucggauaagguuucauaauuuacaaaugggaauuucauuuauaaua

SEQ ID NO: 23694 - RNA, 64 nt, hsa
gcuuuuuuauauauucaauguuagcccaagucugaauuuacauuugacuaaagcagcacauaag

SEQ ID NO: 23695 - RNA, 64 nt, hsa
aaaaaucauauugcccaacagaaaccuuaggcugaauuuacagguaugauaauuuuuguaauua

SEQ ID NO: 23696 - RNA, 64 nt, hsa
ugugcucucauuggcuaaagcauuauaagcaucaaauuuacaacauugguuucccaauauuuaa

SEQ ID NO: 23697 - RNA, 64 nt, hsa
uucaauaguuaauggaaaguugucuuugaccuugaauuuacagcauugggucacauuuugccuu

SEQ ID NO: 23698 - RNA, 64 nt, hsa
agcugaauauuuguuucacugcuuaauaauccucaauuuacacuauucauaacucuuaaaauua

SEQ ID NO: 23699 - RNA, 64 nt, hsa
gggcagcccauuuaguuuacacgcgcauaagacuaauuuacaaaaucacucuauacagucauua

SEQ ID NO: 23700 - RNA, 64 nt, hsa
aguuaaauuuacaugcucggucacucauugagaaaauuuacacagacucugaauccaguuccug

SEQ ID NO: 23701 - RNA, 64 nt, hsa
uaaagcaauuauuguaguaauuucauuugaguuaaauuuacaugcucggucacucauugagaaa

SEQ ID NO: 23702 - RNA, 64 nt, hsa
aaacaaacaauaaccguaugaagauguccuguuaaauuuacaacacuaacgauguagacucugg

SEQ ID NO: 23703 - RNA, 64 nt, hsa
acuaguuacauuauaaacgguuucaaacauguuuaauuuacauuagguuuuuauguaagagugu

SEQ ID NO: 23704 - RNA, 64 nt, hsa
uuuuagaauuaacuaagaagccaaaaauggcaacaauuuacagaaaucccaccuuuccaugcuu

SEQ ID NO: 23705 - RNA, 64 nt, hsa
uagcacagaguugaccaaacacuggcguaaguucaauuuacacagaauauuugaauugaaacaa

SEQ ID NO: 23706 - RNA, 64 nt, hsa
caaacugcagaggcaaggccaauuuuaacuuuucaauuuacagucgauuuugaagagcuucuac

SEQ ID NO: 23707 - RNA, 64 nt, hsa
ucauuaucucuuuuuuaaaaaugaaaaaguuuauaauuuacauucaguaaaaucacccuuuuua

SEQ ID NO: 23708 - RNA, 64 nt, hsa
aacauugguuucagaaagaaucuuagcuaccuagaauuuacagucucuguuucauggcaacacu

SEQ ID NO: 23709 - RNA, 64 nt, hsa
aauaggcuuuuugugccuuuugcuguuaauguuuaauuuacaaacuguuuugguaaaucucuua

SEQ ID NO: 23710 - RNA, 64 nt, hsa
uuuuuguuacgcauucuuguauuauaugugacuaaauuuacaaacaagauacauguguaauuaa

SEQ ID NO: 23711 - RNA, 64 nt, hsa
auggaaccauuugaugugagaaacaauucuuuuuaauuuacagcaaaauauugaauaaccauug

SEQ ID NO: 23712 - RNA, 64 nt, hsa
uaaauaugcaaguuagaaauuaagucuacugaaaaauuuacauuuugagucagguuuuguguca

SEQ ID NO: 23713 - RNA, 64 nt, hsa
agacuacaaaaucguucaagagcaauucuaauauaauuuacauauguucacgcaaaauaugcuu

SEQ ID NO: 23714 - RNA, 63 nt, hsa
cacgggcuuauaaggauugagugauguccauuccaucauuagggcuacucgcaaaagaccaua

SEQ ID NO: 23715 - RNA, 64 nt, hsa
aacagaaggaguuguuuacagaugaauaguaucacaucauuaucaauuuccacaugaaaaaggu

SEQ ID NO: 23716 - RNA, 64 nt, hsa
ggaucacacagaguuaaauauagaaaaaugaaaccaucauuauauucuuucguguuuuuucuuu

SEQ ID NO: 23717 - RNA, 64 nt, hsa
gauuucuucacacaguauguucaucauauaucaucaucauuauuauggugguaaagauagaauc

SEQ ID NO: 23718 - RNA, 64 nt, hsa
ugcuguugacaugaauagaccauggaaacauuuucaucauuauuauucagccugugcuguaguu

SEQ ID NO: 23719 - RNA, 64 nt, hsa
aaucaguaguguuuacaagauccaacagugcacucaucauuaguuaacaaagcaaauauguuca

SEQ ID NO: 23720 - RNA, 64 nt, hsa
uggacuguuuuugguuuuuuguuuuuaaauaaagcaucauuaaugcacaucugcagggguuugc

SEQ ID NO: 23721 - RNA, 64 nt, hsa
caguuucuuuguuuucgauuuugauuucgccaaucaucauuauuggcauuuuccugccugguuu

SEQ ID NO: 23722 - RNA, 64 nt, hsa
gucugagacacaagagcuauauguuagagguuaucaucauuauuuguauuuugugaauuacgcu

SEQ ID NO: 23723 - RNA, 64 nt, hsa
augaagcuuuuaaaaagcacaaguuaucaggcaacaucauuaaacauacauuaaaugucuguua

SEQ ID NO: 23724 - RNA, 64 nt, hsa
aguagcuucccacccaguccaaaccugcaccauccaucauuauguagaugaaaaagccauaggu

SEQ ID NO: 23725 - RNA, 64 nt, hsa
caagcuucugccugaagauuccucaggucaacaccaucauuaaaugcgaguuuuguugaugauu

SEQ ID NO: 23726 - RNA, 64 nt, hsa
caugcuagaggacaaauauaugaugauauguaugcaucauuauaauauaguauaguuucgcugc

SEQ ID NO: 23727 - RNA, 64 nt, hsa
uacauuuguuacaaucaaugaaccuacucugaaacaucauuaucauccaaaguucaugguuuac

SEQ ID NO: 23728 - RNA, 64 nt, hsa
gauuuuuacagacaccuauuuugggcucaguuuucaucauuaccauuaaaugcauuggauagaa

SEQ ID NO: 23729 - RNA, 64 nt, hsa
agagaaagccaguuuugaguuuuuuacacuugcacaucauuaucugugccguccugacuagaag

SEQ ID NO: 23730 - RNA, 64 nt, hsa
gugaggcagggaguuauuuuagauuaugggaaauaauuuuuaaagguauugguuaaauaacguu

SEQ ID NO: 23731 - RNA, 64 nt, hsa
aauaacguuuaaaaacauguacugagaugaaucuaauuuuuagauugcccuguauuuuguuaac

SEQ ID NO: 23732 - RNA, 64 nt, hsa
acuuuagaaugaaugagucaccuugugauuuuuaaauuuuuauuuuaauaaagcuaaucaauuu

SEQ ID NO: 23733 - RNA, 64 nt, hsa
uuuauauuuucauccugaccagcuuaguucuaauaauuuuuaguugugagugauuaaaaaacuu

SEQ ID NO: 23734 - RNA, 64 nt, hsa
uguacaagcucucaauuuuguucauuuauuaucaaauuuuuaaaauacaaguuugguaugugau

SEQ ID NO: 23735 - RNA, 64 nt, hsa
ucuaguuuuuuuaaaauacaguuuauguuaaaauaauuuuuauuaauuuagagaagacaaucaa

SEQ ID NO: 23736 - RNA, 64 nt, hsa
ugcuguuuaguuuuguacuauugguguguuggugaauuuuuaaacugugugcuaacugcaauaa

SEQ ID NO: 23737 - RNA, 64 nt, hsa
cuuuaggucuuuguaagaacuaaagaagaucuguaauuuuuauuuucacccucuguaccccaug

SEQ ID NO: 23738 - RNA, 64 nt, hsa
ggaggaccacaggugugagccaccacaccuggcuaauuuuuacuuuuuuuuuuuuuugguagag

SEQ ID NO: 23739 - RNA, 64 nt, hsa
cauuuauugauaaacagugaaggaauuuuuaaaaaauuuuuaagaauuguuugucacgucauuu

SEQ ID NO: 23740 - RNA, 64 nt, hsa
uuauucugccacauuuauugauaaacagugaaggaauuuuuaaaaaauuuuuaagaauuguuug

SEQ ID NO: 23741 - RNA, 64 nt, hsa
uuccaugguguacuuugcaagaaauaagcacucuaauuuuuaaaguaaaucucuuauuuuagca

SEQ ID NO: 23742 - RNA, 64 nt, hsa
auuagauuuuuauuuuguauauguagaauauuauaauuuuuaaaaggacuauugaugauagaag

SEQ ID NO: 23743 - RNA, 64 nt, hsa
uacuaguaauuuaacuucaucaugaaugaacuauaauuuuuaaguuaugcccauuuauaacguu

SEQ ID NO: 23744 - RNA, 64 nt, hsa
uaagguuuagcacuggguguacauauuuauuaaaaauuuuuauuauaacaacuuuuauuaaaau

SEQ ID NO: 23745 - RNA, 64 nt, hsa
uuuacauaucaauguuucuacaguauuguuugcuaauuuuuaaauaaagucaugaucagugugc

SEQ ID NO: 23746 - RNA, 64 nt, hsa
uuuuuauucagugagaaccaagcuagccuugaguaauuuuuaucuugucuuccuaaaacacuau

SEQ ID NO: 23747 - RNA, 64 nt, hsa
gacuggugcuucugcuuuugaaggggaaaaugccaauuuuuacuguaauaaguaauguaucaua

SEQ ID NO: 23748 - RNA, 64 nt, hsa
uugauugcaagugaaguuuauaaaguuguuuaauaauuuuuauaauuuuaaaaucaaugucaac

SEQ ID NO: 23749 - RNA, 64 nt, hsa
auguuuguuguagccuuguuaaaggcuauuuuauaauuuuuacuagaaauauuuugacauuuau

SEQ ID NO: 23750 - RNA, 64 nt, hsa
uaaauacgugaaauugcuuaaaaccucuuuuuggaauuuuuaaugaacuugcaacaaauuugua

SEQ ID NO: 23751 - RNA, 64 nt, hsa
ccaagggaauuuaaucuggaagagaacauaugccaauuuuuaaacuaugacagcuuuuuuuuuu

SEQ ID NO: 23752 - RNA, 64 nt, hsa
acacuuagggguugcaugcaagcuguuaccaaaaaauuuuuaaguauuuucuuaauuugaauaa

SEQ ID NO: 23753 - RNA, 64 nt, hsa
cuucacaaaagccuaaugucuguaauuaaccuuuaauuuuuauuucuguaugagacaaaaguug

SEQ ID NO: 23754 - RNA, 64 nt, hsa
uuucuuauccuaagauucaauauuacguuauacaaauuuuuaaaauugaaauuaggaauuugaa

SEQ ID NO: 23755 - RNA, 64 nt, hsa
uauuauggaaguauuuuuuuuaaucaucaguggaaauuuuuauucuucuuuagucucauuccuc

SEQ ID NO: 23756 - RNA, 64 nt, hsa
ucaaggggacagagccuaggcagcagauucuccuaauuuuuaacacuaaaauucaaggaagcag

SEQ ID NO: 23757 - RNA, 64 nt, hsa
ccuuguuuugguaggauguucaguauauucucagaauuuuuaccaccuauuuagcuauacuuca

SEQ ID NO: 23758 - RNA, 64 nt, hsa
uugcaaauacaaaauauaauucuuuacaaaaauaaauuuuuauucuaaucuaaaucugacuucc

SEQ ID NO: 23759 - RNA, 64 nt, hsa
guggauccgguggaaauccaagcucugggcugguaauuuuuaugagcauuuucagcuuuugcaa

SEQ ID NO: 23760 - RNA, 64 nt, hsa
caugucgcugauccauauuaccaaguucaaauaaaauuuuuauaaucggauucagacccauaac

SEQ ID NO: 23761 - RNA, 64 nt, hsa
uggcuguuugggauuuuaguuaaacgugucugugaauuuuuauguaacuaacuccuuuccauuc

SEQ ID NO: 23762 - RNA, 64 nt, hsa
aauuauccauuaaaguuacaucuucauguaucacaauuuuuaaaguugaaaagcaucccaguua

SEQ ID NO: 23763 - RNA, 64 nt, hsa
caggaauugacacugauuuggauuugugcacucuaauuuuuaacuuauugaugcucuauugugc

SEQ ID NO: 23764 - RNA, 64 nt, hsa
aguguguucacgagaaacauaggcuuuucaaaaaaauuuuuauucaaggcaaagcaaggaacau

SEQ ID NO: 23765 - RNA, 64 nt, hsa
ucuccugaauuaugucuuacaaacuaaaagcaaaaauuuuuagcagaaauuuuggaauacauuc

SEQ ID NO: 23766 - RNA, 64 nt, hsa
aaauuuuggaauacauucuaucuagcacaauuugaauuuuuaauuaucaagauuuuuguuaaag

SEQ ID NO: 23767 - RNA, 64 nt, hsa
uucuuucaaaacauuuuugguuuuugguuuuuaaaauuuuuauuaaacaauugcuguuaggauc

SEQ ID NO: 23768 - RNA, 64 nt, hsa
auaauuuuugugauaaauguguccaagauuugaaaauuuuuauauaagaaaauccccagccucu

SEQ ID NO: 23769 - RNA, 64 nt, hsa
uaaagcauuuuuuaagagacaaauuuuaacuuuuaauuuuuauuuuggcaaaacugucaaauga

SEQ ID NO: 23770 - RNA, 64 nt, hsa
ccacauuaaugaauuggugcugucaaaauauaguaauuuuuaaauuuguuaauaaugaaaaccc

SEQ ID NO: 23771 - RNA, 64 nt, hsa
auaguaguaaaauuagaaaaaaacaaacucuacuaauuuuuagauauucauuaauaggaaagau

SEQ ID NO: 23772 - RNA, 64 nt, hsa
cuuuaucauuaaacaugaauuuaaugucuaggauaauuuuuaaaagaggaaauuaaauaauuuu

SEQ ID NO: 23773 - RNA, 64 nt, hsa
uuguguucaucaugacuuuggcgauuuuuaacaaaauuuuuaaagacccagugagagucuguag

SEQ ID NO: 23774 - RNA, 64 nt, hsa
ucuaaguggaaggagaguuacugaagggaaugugaauuuuuaccguuuguacuuaagauacauu

SEQ ID NO: 23775 - RNA, 64 nt, hsa
cagaauugcaggugaaagggagaauuuuagacuuaauuuuuaacucuauugcacuuaaagauuu

SEQ ID NO: 23776 - RNA, 64 nt, hsa
aaaaugcauguuauguagaaaauggucaauggcaaauuuuuauaaauacagcuaccccaucaaa

SEQ ID NO: 23777 - RNA, 64 nt, hsa
aaacuaaaacuacaugaguuucauguuagaaaagaauuuuuaaacaaucuucagauggcuugaa

SEQ ID NO: 23778 - RNA, 64 nt, hsa
caguuaaauuuccucaccuucacuauugaucuguaauuuuuauuuuaaaaacagcuuacuguaa

SEQ ID NO: 23779 - RNA, 64 nt, hsa
ugguauuugcacauuuaagauauguuacuuuaccaauuuuuaaugguaaucaacucugcuacug

SEQ ID NO: 23780 - RNA, 64 nt, hsa
agaaaacuuuaaaaaauauuuauuaaauaaaaucaauuuuuaggaaguuuucuguagucauuua

SEQ ID NO: 23781 - RNA, 64 nt, hsa
acuaauuaggguacauuuauaauugcaucuagguaauuuuuacccuaaugucuucauaaaguac

SEQ ID NO: 23782 - RNA, 64 nt, hsa
gaagcaugggaguggggcaaaguugaauuuagagaauuuuuauaacccauguuacaaggaaguu

SEQ ID NO: 23783 - RNA, 64 nt, hsa
uugaauuuuugcacaaaauauauguuaauaaaauaauuuuuauggcaauacaacugugaaauaa

SEQ ID NO: 23784 - RNA, 64 nt, hsa
aauuuuacagucugccauuuugggugcccaccccaauuuuuaccuuuuaguaaguuggcaugaa

SEQ ID NO: 23785 - RNA, 64 nt, hsa
guaucaaaaauaaaaagcugucacauauuuuguaaauuuuuaccuuguaaagucacaaaaauag

SEQ ID NO: 23786 - RNA, 64 nt, hsa
ugcaaaagguaugaggaauguuuuaauaccuccaaauuuuuaagaaaagcaucaaaggguugau

SEQ ID NO: 23787 - RNA, 64 nt, hsa
gcuucuuuaggaauaacuuuuauauuuauuuaaaaauuuuuaaauuaugggauguuuuguuguu

SEQ ID NO: 23788 - RNA, 64 nt, hsa
uuuaaugaaaacccagaucuuuccuuuuuggcauaauuuuuaugaugaccugaaauuuuacauc

SEQ ID NO: 23789 - RNA, 64 nt, hsa
gggaaaaauaaacaauaagacaugcuuacuuuuuaauuuuuauuuuuuugagacugagucucuc

SEQ ID NO: 23790 - RNA, 64 nt, hsa
auaggcauauuacuaggugacaugucuacuuuuuaauuuuuaagagcauccggccaaaugcaaa

SEQ ID NO: 23791 - RNA, 64 nt, hsa
gugauugguaacuaggauauguauauuuuaauagaauuuuuaacaaaacuucuuagaaaauuaa

SEQ ID NO: 23792 - RNA, 64 nt, hsa
uaauauuuuugguuuuuuaaaaacugaaauuuuuaauuuuuacuuuuuaauuuuuuaggaaaaa

SEQ ID NO: 23793 - RNA, 64 nt, hsa
agcuuauuaauauuuuugguuuuuuaaaaacugaaauuuuuaauuuuuacuuuuuaauuuuuua

SEQ ID NO: 23794 - RNA, 64 nt, hsa
uggauuuccuauuuuaaaaccaugcagcuucaucaauuuuuauacauaucagaaaaguagaauu

SEQ ID NO: 23795 - RNA, 64 nt, hsa
ccaugcugaauuauuuuguugugauuuuguacagaauuuuuaaugacuuuuuauaauguggauu

SEQ ID NO: 23796 - RNA, 64 nt, hsa
uaacaaaaucacaagcaauaauuaggaucuaugcaauuuuuaaacuaguaaugggccaauuaaa

SEQ ID NO: 23797 - RNA, 64 nt, hsa
uaugcaaccaauauauucaauuauauaugugauuaauuuuuaaaaggacaauuguuuucauaaa

SEQ ID NO: 23798 - RNA, 64 nt, hsa
cuuugcuguuuugucauuuaauaugcuuuugucuaauuuuuaauucauuuauuacuguuacucc

SEQ ID NO: 23799 - RNA, 64 nt, hsa
gcuuucccaagcugaauaaaaacaaacauuaacaaauuuuuaccuuguaaugcaggaagaaacc

SEQ ID NO: 23800 - RNA, 64 nt, hsa
ugcugcaacuugaugucaaaucacauuacuggguaauuuuuaagacuauguacccacaccauac

SEQ ID NO: 23801 - RNA, 64 nt, hsa
gaugguacauuuuauguuauguguauuuuaccacaauuuuuauaaaaagaggauuaaaucuaaa

SEQ ID NO: 23802 - RNA, 64 nt, hsa
aggugagccccagcaugcccagcuaauuuuuuuuaauuuuuaguagagacgggguuucaccaug

SEQ ID NO: 23803 - RNA, 64 nt, hsa
cauggguaggaaagauuaguuucaucaagauuucaauuuuuaucaauucauaaauuaaaaacaa

SEQ ID NO: 23804 - RNA, 64 nt, hsa
aguagugugugccaccacgcccagcuaauuuuuuaauuuuuaguagagacaggguuucaccaug

SEQ ID NO: 23805 - RNA, 64 nt, hsa
gccacugcaccuggccuguaacaugauuugcugaaauuuuuaaaaaucuuaaauaauguacugu

SEQ ID NO: 23806 - RNA, 64 nt, hsa
auuuuucagagauuuauauaaauguaaaaauaauaauuuuuauauuuaauuauuaacuacauuu

SEQ ID NO: 23807 - RNA, 64 nt, hsa
agaaagacucuauucucaaaguuuccuaaucagaaauuuuuaucaguuuccagucucaaaaaua

SEQ ID NO: 23808 - RNA, 64 nt, hsa
uucucaguauacacaacugaaugaugauacuuacaauuuuuagcagguagcuuuuuaauguuua

SEQ ID NO: 23809 - RNA, 64 nt, hsa
uuugaggcuuguuuacauugcuuagauaauuuagaauuuuuaacuaaugucaaaacuacagugu

SEQ ID NO: 23810 - RNA, 64 nt, hsa
aaagcauauuugaccaagcaacaagcuuauaauuaauuuuuauuaguugauugauuaaugaugu

SEQ ID NO: 23811 - RNA, 64 nt, hsa
cugauaccuugauguaauuucacaauacaguuccaauuuuuauggcuuuuauaauuacaaugau

SEQ ID NO: 23812 - RNA, 64 nt, hsa
aaaaccuuaagugauacuuuguuuauauguuuauaauuuuuagguguuuccugaaauuuucaca

SEQ ID NO: 23813 - RNA, 64 nt, hsa
gcaaauuauauuuuugcugcugauauauuagaauaauuuuuaaaugucaucuugaaauagaaau

SEQ ID NO: 23814 - RNA, 64 nt, hsa
ugcacuugaugguguugaaauguccaccuucuuaaauuuuuaagaugaacuuaguucuaaagaa

SEQ ID NO: 23815 - RNA, 64 nt, hsa
auuuuaacuccgagacaggagucuuucagugcugaauuuuuagacuguaaaugaguucuucuua

SEQ ID NO: 23816 - RNA, 64 nt, hsa
agcucuaucagaacauauuuauaaaacuuguuggaauuuuuacggcuuuuguguagucauguag

SEQ ID NO: 23817 - RNA, 64 nt, hsa
ugugaaaguaaccauaucugacaaaauucccuugaauuuuuauccuuugcuugcaacauuuaag

SEQ ID NO: 23818 - RNA, 64 nt, hsa
cauauugccacugugcuauccuugaacuaccaauaauuuuuauaaaauaucuaguuuuuacuac

SEQ ID NO: 23819 - RNA, 64 nt, hsa
guaaaugagaacacuacaacuguagucagcucacaauuuuuaaauaaaggauaccacagugcau

SEQ ID NO: 23820 - RNA, 64 nt, hsa
accugguaaaugcacucagacuugcgucuuuaggaauuuuuaacuuucuuucacuacauuggca

SEQ ID NO: 23821 - RNA, 64 nt, hsa
uauuuauguagcuuuuuuuggaaguaacuuuauaaauuuuuauaauucagaagacuacuauaug

SEQ ID NO: 23822 - RNA, 64 nt, hsa
uggaacugcuaaauagauauuucuauaaauagauaauuuuuauuuauguagcuuuuuuuggaag

SEQ ID NO: 23823 - RNA, 64 nt, hsa
uauuguuuauagguuuuaaaaaccaaaccaauaaaauuuuuauuuauucaauaaaauaugcaca

SEQ ID NO: 23824 - RNA, 64 nt, hsa
cuguuuuauucugaaaaaugaaagugcucaauagaauuuuuaacguuggcaacaccauaaggau

SEQ ID NO: 23825 - RNA, 64 nt, hsa
acuaaacaguuuuauuaugacacuagauacaguaaauuuuuagaaaaaaauaccauuuacagua

SEQ ID NO: 23826 - RNA, 64 nt, hsa
uuacaacacacuucucuaacaucuagcccuuuuaaauuuuuaauuaauuucaaagcuuccucug

SEQ ID NO: 23827 - RNA, 64 nt, hsa
guaucugaugucugugggacuaacuguaucacuuaauuuuuaccuuauuuuggcucuaauuuga

SEQ ID NO: 23828 - RNA, 64 nt, hsa
auguuauaacucaucuagugagaccaacuuacuaaauuuuuaguaugcacugaaaguuuuuauc

SEQ ID NO: 23829 - RNA, 64 nt, hsa
ucuccuucuaguggaugcaugcagccuuuuuuucaauuuuuauuuaaauugcaaaauuuuuacu

SEQ ID NO: 23830 - RNA, 64 nt, hsa
gcagccuuuuuuucaauuuuuauuuaaauugcaaaauuuuuacucagauuuuuuuuccucuucc

SEQ ID NO: 23831 - RNA, 64 nt, hsa
caaaaaaagagaaauuuuccuuaauaagaaaaguaauuuuuacucugaugugcaauacauuugu

SEQ ID NO: 23832 - RNA, 64 nt, hsa
auauuucuuccccaaggauuucaagaugaauugaaauuuuuaaucaagauagugugcuuuauuc

SEQ ID NO: 23833 - RNA, 64 nt, hsa
cacuuuuuuuuuuuuuaaagaaaaaaagguagugaauuuuuaaucaucuggacuuuaagaagga

SEQ ID NO: 23834 - RNA, 64 nt, hsa
uacauguauuucuguaauaguauugugucauaucaauuuuuaagaugucuaaauuuuaugguca

SEQ ID NO: 23835 - RNA, 64 nt, hsa
uuccaaaaugauagcuaucuaacaacuaauuacuaauuuuuaaagaacaaaucacacauuuaaa

SEQ ID NO: 23836 - RNA, 64 nt, hsa
aguugaagaugugauguugcucggccuuuggaauaauuuuuaaaucuguaaaugucuauaugag

SEQ ID NO: 23837 - RNA, 64 nt, hsa
auaauucaauacaugaucaucaaguuaauugguaaauuuuuauugaaauuuaaaacuugcauuu

SEQ ID NO: 23838 - RNA, 64 nt, hsa
uaguuuugcauauucuugugcugcacaugggcugaauuuuuaaauuuuuuuuaaaaacuugaag

SEQ ID NO: 23839 - RNA, 64 nt, hsa
uugucaccagauuuuuauuaauguaaaaaaaaucaauuuuuaaaaaauaguuggacuuuggcag

SEQ ID NO: 23840 - RNA, 64 nt, hsa
uuauacacguguauuggaaauaucuaguuuuuuaaauuuuuaauuaauuuauuuauaauuuacu

SEQ ID NO: 23841 - RNA, 64 nt, hsa
aaacuaucaguuacugaagacuuaugaaaaggucaauuuuuaccugucuuuuaauccaguccau

SEQ ID NO: 23842 - RNA, 64 nt, hsa
uucuuuaauuuacuuauauguuauuauaauuuugaauuuuuaaguucuaugauucauguuuuaa

SEQ ID NO: 23843 - RNA, 64 nt, hsa
agggcaaacucuccauuuuacuuauggcuuuucuaauuuuuaauuaauuaauuuauuuuuuuga

SEQ ID NO: 23844 - RNA, 64 nt, hsa
ucauuuaaugucugaauucagaaaaaaaugccgaaauuuuuauucagaugguccauaaauuaaa

SEQ ID NO: 23845 - RNA, 64 nt, hsa
acuaaagagugcuaaugcaggaaauaauacacauaauuuuuagguaaggauaauaauuuaucuc

SEQ ID NO: 23846 - RNA, 64 nt, hsa
agaugacuugaccccaaaccuuuguuuauguaagaauuuuuaaacauaaaaguguuuguuucug

SEQ ID NO: 23847 - RNA, 64 nt, hsa
agcaaguaaccugguacauuugaaauaaaaaccaaauuuuuagauucaaacaaucccuuuaucc

SEQ ID NO: 23848 - RNA, 64 nt, hsa
uuccucucccaauugcaaugagaaaaaaaagcuuaauuuuuacauuauacuuaauuuucuaaaa

SEQ ID NO: 23849 - RNA, 64 nt, hsa
aagggaacaaucuguuucugauugcacaguuucuaauuuuuaaaacugaugugguuugcauuuc

SEQ ID NO: 23850 - RNA, 64 nt, hsa
uuaguuauaacagaguaacauaccauuuaauuacaauuuuuagccagaaaaguccccacuauuu

SEQ ID NO: 23851 - RNA, 64 nt, hsa
aguacuucuuuagggcugguuaauugguucaaauaauuuuuaauuuccuuucuaguaucuucuc

SEQ ID NO: 23852 - RNA, 64 nt, hsa
uaauauguguguuuauuuuaugauauugcuauuaaauuuuuauuaucuaccugaaguauaucaa

SEQ ID NO: 23853 - RNA, 64 nt, hsa
gggcucuguuuacaucuauacauuuugaagaugaaauuuuuagccuuaaaguuuauauucucaa

SEQ ID NO: 23854 - RNA, 64 nt, hsa
agcuacuuaacaaugacaaauauuucacaauaauaauuuuuacuuauauaccaucuuucaacug

SEQ ID NO: 23855 - RNA, 64 nt, hsa
uuuccuucaugcacuuggugauaaacguuuucuaaauuuuuaguuaaguauauggauaaaaagu

SEQ ID NO: 23856 - RNA, 64 nt, hsa
gcaugaggggaguaucuuucagggauucaaauggaauuuuuaccuguuacuuguuuaauuguuu

SEQ ID NO: 23857 - RNA, 64 nt, hsa
cuaaaaaaaucuuaaggauaacauuugguuuacuaauuuuuaaucauuuaucuuucagaacuug

SEQ ID NO: 23858 - RNA, 64 nt, hsa
uaucuggucuuuucuauauagucuuuugaaggauaauuuuuaucaauagccaacuuuggguauu

SEQ ID NO: 23859 - RNA, 64 nt, hsa
uggccaaaguguacaauuuucaucccacaauugaaauuuuuaaaucauuucauguuagucuuac

SEQ ID NO: 23860 - RNA, 64 nt, hsa
guuucaggcaaggcagcucccagguuuagagauuaauuuuuacccccuaaggaauauccaguca

SEQ ID NO: 23861 - RNA, 64 nt, hsa
augauuuaagugucucacuaaagcaugaaaugugaauuuuuauuguuguacauacgauuuaagg

SEQ ID NO: 23862 - RNA, 64 nt, hsa
ucauaguaagauugauaucuauaaaauagauauaaauuuuuaagagaaagaauuuaguauuauc

SEQ ID NO: 23863 - RNA, 64 nt, hsa
uggugauucaguuuuuaauuuuuuagucacaggaaauuuuuaacucuacuguagaugcaugucc

SEQ ID NO: 23864 - RNA, 64 nt, hsa
uuuauaauuagugcuccauuuaaaucuaauuuauaauuuuuauuuuaagcagcaaaugaaacaa

SEQ ID NO: 23865 - RNA, 64 nt, hsa
cuucauuuuuauuuacuaagaaaugcaauuugggaauuuuuaaucuguuaugcuuuguuuauca

SEQ ID NO: 23866 - RNA, 64 nt, hsa
uauuuuuuaaguaaacauugaacauuuuaucauuaauuuuuaauugaaacuaguuauuuuauaa

SEQ ID NO: 23867 - RNA, 64 nt, hsa
uuaucuguguuaaaaugguuuuugccuaaaauauaauuuuuaauuuggcuuuucuuauuuaaaa

SEQ ID NO: 23868 - RNA, 64 nt, hsa
cacauuguaacuuuucuuguugaguuaguaucuuaauuuuuacuccagcacaaguauuuaauca

SEQ ID NO: 23869 - RNA, 64 nt, hsa
gauucauacaugugaaauuggaagguauuuauaaaauuuuuauugcuguauaccaaacucagaa

SEQ ID NO: 23870 - RNA, 64 nt, hsa
cugggauuacaggcaugcaccaccacgcccagcuaauuuuuauauucuuuaguaaagacagggu

SEQ ID NO: 23871 - RNA, 64 nt, hsa
uauuaaauuuuguaaaaauaacuuauuuauaaauaauuuuuaaagagaaaaaucucauauaauu

SEQ ID NO: 23872 - RNA, 64 nt, hsa
uuacuuugcagauauggacagccuuuacaaaaauaauuuuuaaaugcuuaauuauuuuaauuug

SEQ ID NO: 23873 - RNA, 64 nt, hsa
uuuaauuuuuuuaacagcaauggaggaaguuaacaauuuuuaauggaaagagcauguuagagca

SEQ ID NO: 23874 - RNA, 64 nt, hsa
aaguaggcagagcuagguuuauuuucucuuaaacaauuuuuaaaauucagaauguaaaaauugg

SEQ ID NO: 23875 - RNA, 64 nt, hsa
aggauguuuucagaccagaggcaacuuauucaugaauuuuuaugaaaacuaucuacuaggacag

SEQ ID NO: 23876 - RNA, 64 nt, hsa
agcauuaggaaaaaaaauacucacucuuacuaacaauuuuuauacagaaaaugagucauuuugg

SEQ ID NO: 23877 - RNA, 64 nt, hsa
uuaaaauuauaaauuaauguuuucguggcauguaaauuuuuaugguacagauaguuaucaucag

SEQ ID NO: 23878 - RNA, 64 nt, hsa
ugguccuuauaaaugauaguuuuguuuacuuauaaauuuuuaccucaguugcaauauuuacugg

SEQ ID NO: 23879 - RNA, 64 nt, hsa
cagcuccaugcuuugaauacuauguggcugaaugaauuuuuaaaaucucaaagcaguuaaacag

SEQ ID NO: 23880 - RNA, 64 nt, hsa
acaggcgugagccacugagccagccagcauuaguaauuuuuaaaaacacuuuaucaguauuuua

SEQ ID NO: 23881 - RNA, 64 nt, hsa
agugguuaaaauguuaaguuuuauguuuuauuacaauuuuuaaaugugucaaccaacuuuauag

SEQ ID NO: 23882 - RNA, 64 nt, hsa
ugcuuggaacacugccugaaggcacucauuuuuuaauuuuuauuuuauuuuuaauuuuuuauau

SEQ ID NO: 23883 - RNA, 64 nt, hsa
uuacaggugugagccaccaugccuggccuaaacuaauuuuuagauaguuccuggucacucaaau

SEQ ID NO: 23884 - RNA, 64 nt, hsa
auaaaauuaauguuuaaaauguuuuuguaacaauaauuuuuaaaacccacacucuuccauauau

SEQ ID NO: 23885 - RNA, 64 nt, hsa
guauucuacuggaaaugaauguaauaauacauuaaauuuuuaaaaucuauuuuguuuugugugu

SEQ ID NO: 23886 - RNA, 64 nt, hsa
cugauuugagaaaugaaucaaaguaauuuuaaugaauuuuuagcuuguauuagcuugaguuagc

SEQ ID NO: 23887 - RNA, 64 nt, hsa
aucucgauaauuugaggauaacagaugacaauugaauuuuuaauugauuuaguauuuccuccuc

SEQ ID NO: 23888 - RNA, 64 nt, hsa
aacauuagacuuuuugguuaaauaauugagauuuaauuuuuaaaagauauucuuacucauuugc

SEQ ID NO: 23889 - RNA, 64 nt, hsa
aacuuaauuuuuugaaaguacucuguagcaugacaauuuuuagagcugcagguuagcuauuaua

SEQ ID NO: 23890 - RNA, 64 nt, hsa
augaaugugaaaagaguuuuggcuuguucuaaauaauuuuuacaaguuaugguacagacaguug

SEQ ID NO: 23891 - RNA, 64 nt, hsa
uuaauggcucagaaauaguuauucauuaguuuuuaauuuuuaauuucuaagguacagagaucua

SEQ ID NO: 23892 - RNA, 64 nt, hsa
uaauguuccagcaacacugcuauuauacuauccaaauuuuuauuguaacaaaaccucuuuaagc

SEQ ID NO: 23893 - RNA, 64 nt, hsa
auaagagauuguaaaagaagcagauugaaugaagaauuuuuagcugugcagauaggugauguug

SEQ ID NO: 23894 - RNA, 64 nt, hsa
gagcagcacauugcuaaaauaaaaaauacaccuuaauuuuuaagaaauaauuuaaaugaaacaa

SEQ ID NO: 23895 - RNA, 64 nt, hsa
agccuacucaggaauaaucuuccuuaacucuuuaaauuuuuauuucaugugaaguguuuucagu

SEQ ID NO: 23896 - RNA, 64 nt, hsa
cauguuauuuaaccagaaaugucuuaucucuaaaaauuuuuaguaguaauuauuuaccaaacuu

SEQ ID NO: 23897 - RNA, 64 nt, hsa
uugaauguuuuuugacuacuuuuuauaacuuaagaauuuuuauaccaucuacaucuauccuacu

SEQ ID NO: 23898 - RNA, 64 nt, hsa
ugaaaauuaucauuugauauuuggcuuauaaaguaauuuuuaugaaucuguuuuaugaguuagg

SEQ ID NO: 23899 - RNA, 64 nt, hsa
gcauagauuucauaucaagggcauuucaagacagaauuuuuauuuccuguaguaggcuugcugg

SEQ ID NO: 23900 - RNA, 64 nt, hsa
uuauacauaauuuguuuuuguuauaagccauuugaauuuuuaaaaaauuucauacaugcaaugg

SEQ ID NO: 23901 - RNA, 64 nt, hsa
auugauuaaaguuuaauaguuaucaaaaucaccuaauuuuuaaaaauagcuuucguuuugaguu

SEQ ID NO: 23902 - RNA, 64 nt, hsa
gcaugaaucauaauggauucuuuuauaaguuauuaauuuuuaugguuuaaucagucuaauuguu

SEQ ID NO: 23903 - RNA, 64 nt, hsa
auuaaaaauuacuauuuuguuauauggaaugguuaauuuuuaccuaauaaaaacauagaugaaa

SEQ ID NO: 23904 - RNA, 64 nt, hsa
uuuggauuuauuuagccugauguauuuuuaauucaauuuuuauggugaugggcaaaucauucuu

SEQ ID NO: 23905 - RNA, 64 nt, hsa
guuuuuaaauaacuuccucagcaaugcagaccuuaauuuuuauauuuuuuuaaaguagcuaaca

SEQ ID NO: 23906 - RNA, 64 nt, hsa
ccccaugguucucacucuuugcaggcacucuucaaauuuuuauuuuaaaaauuauaaugcaaac

SEQ ID NO: 23907 - RNA, 64 nt, hsa
ggacucaccugaagacucuacuuugccaagagggaauuuuuaacucaaaguugugucagccagc

SEQ ID NO: 23908 - RNA, 64 nt, hsa
uagccaaugagguccaagaaguucucacccauugaauuuuuaaauggcuguucaguucauguug

SEQ ID NO: 23909 - RNA, 64 nt, hsa
cuauaauccugagccauggugugcuacugaaaccaauuuuuauccaccaucuaguccuuauuaa

SEQ ID NO: 23910 - RNA, 64 nt, hsa
uauuuuaucucacagguuuguguaauuguuggaaaauuuuuaaacuucuaagugaaaguagucu

SEQ ID NO: 23911 - RNA, 64 nt, hsa
cauuguaaagcuucaugucuuuuguuuguuggaaaauuuuuacuuauagaaacuuaauuauuag

SEQ ID NO: 23912 - RNA, 64 nt, hsa
gauugguauuagcaucaagucuucauugaugacuaauuuuuaauucccuuccuuuuaucuuuag

SEQ ID NO: 23913 - RNA, 64 nt, hsa
ucaaacuaucgaguuguacaugauaaauauauacaauuuuuauuugucaaauaaagaacaucua

SEQ ID NO: 23914 - RNA, 64 nt, hsa
ucuguuauuucugccccuucuuuacccuucuuccaauuuuuauuaucuucuuauuuauccucua

SEQ ID NO: 23915 - RNA, 64 nt, hsa
gaaauaauuguaaaaucgucuuaaaggaaaauuuaauuuuuacuccuguuuaugggacauucgu

SEQ ID NO: 23916 - RNA, 64 nt, hsa
agggcacucuugaggguguuguuaaugaagauuuaauuuuuaaauacaggugguuccaagcuuu

SEQ ID NO: 23917 - RNA, 64 nt, hsa
agaugauguaauucuucaauuuuuauaaucuuaaaauuuuuaaauuuuauauuuguaaauacag

SEQ ID NO: 23918 - RNA, 64 nt, hsa
ugacacucucaccugacagaugauguaauucuucaauuuuuauaaucuuaaaauuuuuaaauuu

SEQ ID NO: 23919 - RNA, 64 nt, hsa
aaagagugcauuaaaauguuuaguuggguuuuuuaauuuuuaauuuuuauguuauguuuugcuu

SEQ ID NO: 23920 - RNA, 64 nt, hsa
gcauuaaaauguuuaguuggguuuuuuaauuuuuaauuuuuauguuauguuuugcuuuguuuua

SEQ ID NO: 23921 - RNA, 64 nt, hsa
gcuauugguaguuccccuaaauucugacgauagaaauuuuuauuugcuguuuagguuugugacu

SEQ ID NO: 23922 - RNA, 64 nt, hsa
uauguaguaguuccccuaaauucuuguaaaaauaaauuuuuauuugauauuucaucuauguuug

SEQ ID NO: 23923 - RNA, 64 nt, hsa
gguguucagaguaauauucugcauuauagugaaaaauuuuuaauauuaaaauucaauuauauca

SEQ ID NO: 23924 - RNA, 64 nt, hsa
ugaauugugcuuuucauaaugcaguacauuucaaaauuuuuagauuauguaugaacuuagauuu

SEQ ID NO: 23925 - RNA, 64 nt, hsa
uuuuaaacagcuuuauuuauguucauguccuguaaauuuuuaaguacaguaauuaauauuagga

SEQ ID NO: 23926 - RNA, 64 nt, hsa
uaugaaugcauugccucaaaggugaugucaucuuaauuuuuauucacuuuaaauaacuacauuu

SEQ ID NO: 23927 - RNA, 64 nt, hsa
uguguaauuguguuaauaaauccuaauaaauuuaaauuuuuaaaauuuuacaaaccuauuggcu

SEQ ID NO: 23928 - RNA, 64 nt, hsa
ucuaaauaucaccuacuuaugaauaacauguaauaauuuuuaacauuaaugauuccauaaauug

SEQ ID NO: 23929 - RNA, 64 nt, hsa
guuuauauauauagcgaauaaaucuaguuguauaaauuuuuaaaugccgucaguagaaagcaca

SEQ ID NO: 23930 - RNA, 64 nt, hsa
uugaguacucugacacauuucauuuaaauuaggaaauuuuuaauauuaaaaucccaguguucug

SEQ ID NO: 23931 - RNA, 64 nt, hsa
uggaccuguauuauccugaauacacuauuuugaaaauuuuuaaaaaugacuucuuuauuuugcu

SEQ ID NO: 23932 - RNA, 64 nt, hsa
uauauuugaaaaaaauugauuccauguagucuucaauuuuuaauuuuuaagaauuggagaauuu

SEQ ID NO: 23933 - RNA, 64 nt, hsa
gaaaaaaauugauuccauguagucuucaauuuuuaauuuuuaagaauuggagaauuucuaaugu

SEQ ID NO: 23934 - RNA, 64 nt, hsa
auuuaaauaguagucuggaaaguuaccauaugauaauuuuuaauugugugaucuagacaugccu

SEQ ID NO: 23935 - RNA, 64 nt, hsa
auuugauuggauuuguuauucauugguauacaacaauuuuuauucuuaugugugcuuuaagggc

SEQ ID NO: 23936 - RNA, 64 nt, hsa
gaguauacaaucauguuugacaauauagaaauuuaauuuuuagugaaacaauucuaaaccccuu

SEQ ID NO: 23937 - RNA, 64 nt, hsa
uuuuaaagauguaccaaaaaauguaaacuaucucaauuuuuauauuggugaaaucaauaugucu

SEQ ID NO: 23938 - RNA, 64 nt, hsa
cagacuauuucucuacucucaucauccacaguagaauuuuuaaacagauuuuuuuaaagcuuuu

SEQ ID NO: 23939 - RNA, 64 nt, hsa
agguccagaauuccagcaucauuuauucuuuuaaaauuuuuaagaacuugauccauuguaucag

SEQ ID NO: 23940 - RNA, 64 nt, hsa
cuucagccaauuuguuaccucuuuuaugguuuuuaauuuuuaucaggacuaacauuuucagaaa

SEQ ID NO: 23941 - RNA, 64 nt, hsa
uuaaguagauuuaagaucucaaagcuaaagugccaauuuuuacuuucuucagccaauuuguuac

SEQ ID NO: 23942 - RNA, 64 nt, hsa
augccuuucuaaaguuguauaucaaaauuguaucaauuuuuauuuucuaugauuucuagaaaca

SEQ ID NO: 23943 - RNA, 64 nt, hsa
uaaacguguacagcuguuuuauuaguuaaggucuaauuuuuacucuaggugccuuuuauguuca

SEQ ID NO: 23944 - RNA, 64 nt, hsa
ugauggcucuuguuccacuauuaacauuguuuuuaauuuuuaaaauccuaucagcagccuccua

SEQ ID NO: 23945 - RNA, 64 nt, hsa
aaccguguaacaaaaaugccacgugaaaaauaaaaauuuuuauuguauagcaauucucuauaaa

SEQ ID NO: 23946 - RNA, 64 nt, hsa
auuucuguuuuugugaucucugacuuuccuuucaaauuuuuacugagaauaucgaaauuggauu

SEQ ID NO: 23947 - RNA, 64 nt, hsa
uacugacuuucaucugguaguagaugauuuccuuaauuuuuauuagguacguaacuauuuccaa

SEQ ID NO: 23948 - RNA, 64 nt, hsa
auggaaacaccugaaaaagcauucuggagugcugaauuuuuaagauguauauuuuguuaagcau

SEQ ID NO: 23949 - RNA, 64 nt, hsa
auuauuguaugaaguugugucuauaauuauuaccaauuuuuauucuuuauuucucaaauggaaa

SEQ ID NO: 23950 - RNA, 64 nt, hsa
gcagcagcacucauggaaauuguagcaugccaguaauuuuuaccaacaucccauacaucugagu

SEQ ID NO: 23951 - RNA, 64 nt, hsa
caugacugaccuuaauauugggauauuguuaugcaauuuuuauccuguuuagacuguuaaaagc

SEQ ID NO: 23952 - RNA, 64 nt, hsa
auaaacacaguuaacccuuguaaaugaguaaacaaauuuuuacauguaagauucucuaauuguc

SEQ ID NO: 23953 - RNA, 64 nt, hsa
uugauguuugauguugauagauaugcuuauaccuaauuuuuaguuuuuaaacuauuuuaaaaua

SEQ ID NO: 23954 - RNA, 64 nt, hsa
uauuuguuuucuuuuaauuucuaugaauaaaagaaauuuuuaaaaacuuuaaaauuuuaaauau

SEQ ID NO: 23955 - RNA, 64 nt, hsa
ucuaugaguuaucaucuuagcuguguuaaaaaugaauuuuuacuauggcagauaugguauggau

SEQ ID NO: 23956 - RNA, 64 nt, hsa
aaaaaguuauaauuuuagauaaaaauucuagucaaauuuuuacagauauuaucucacuaauuuu

SEQ ID NO: 23957 - RNA, 64 nt, hsa
ugaacauguacagaguuuuauauaaauuuaaaccaauuuuuaaaacaaaacugcggacaccacc

SEQ ID NO: 23958 - RNA, 64 nt, hsa
auuuguuuaacuaaacugucaugguuuaguuuacaauuuuuaaaaaguucuuaaaauacugaaa

SEQ ID NO: 23959 - RNA, 64 nt, hsa
uaccugcuugugaguaucaauuacuuaguuuuuaaauuuuuaagguauugccuacuuuucuuua

SEQ ID NO: 23960 - RNA, 64 nt, hsa
cauccuaaauuuucucccuaucaaaacagcaggaaauuuuuaaacuuuuauauuguacacuauu

SEQ ID NO: 23961 - RNA, 64 nt, hsa
uuuccugggacugccauauuuucuuuuaacuggaaauuuuuaugugaguuuuccuuuuggugca

SEQ ID NO: 23962 - RNA, 64 nt, hsa
uacgccugcauuuaccagccccagcaacacaaagaauuuuuaaucacacggaucucaaauucac

SEQ ID NO: 23963 - RNA, 64 nt, hsa
aaaugucaauuuuuaauguauaaucagaagucugaauuuuuauaaaacauauagcauaaaaacu

SEQ ID NO: 23964 - RNA, 64 nt, hsa
ucagaauuauugauacccuguagugcaaaaugucaauuuuuaauguauaaucagaagucugaau

SEQ ID NO: 23965 - RNA, 64 nt, hsa
cuggccccagccuugucuugauauuaauacaugaaauuuuuauaauugucucauugucucauuu

SEQ ID NO: 23966 - RNA, 64 nt, hsa
cuuuggaugaagaagucuuaauacugaaauacugaauuuuuaauacauuauuauuugguauucu

SEQ ID NO: 23967 - RNA, 64 nt, hsa
uuucuccuucaguccauucccuuaggcaauuuuuaauuuuuaaaaauuauuaucaggggagaaa

SEQ ID NO: 23968 - RNA, 64 nt, hsa
ucauauauuucuccuucaguccauucccuuaggcaauuuuuaauuuuuaaaaauuauuaucagg

SEQ ID NO: 23969 - RNA, 64 nt, hsa
gguuuuuaaaaaaaauauucugucauugguuacaaauuuuuacucaggcuuucuauuggcaugg

SEQ ID NO: 23970 - RNA, 64 nt, hsa
aaccaccuguccccaguuaaugugccaaaaugucaauuuuuaacuuaucuccagccaauuucaa

SEQ ID NO: 23971 - RNA, 64 nt, hsa
aagugacauugcaucaaagcaucuugcauuaugcaauuuuuauauuaaccagauauauauucau

SEQ ID NO: 23972 - RNA, 64 nt, hsa
auauacuggaaagcuuuucuauuuuaauaaaaauaauuuuuauaugaucaugcaugcuucuaag

SEQ ID NO: 23973 - RNA, 64 nt, hsa
ugauguuuaaaauuccauacuucaugcccacacuaauuuuuaauguuauuuucagugguugccg

SEQ ID NO: 23974 - RNA, 64 nt, hsa
guuaucgcuuacagagacuuuaacaauuuuguggaauuuuuacaacuaugagaguaaauggaac

SEQ ID NO: 23975 - RNA, 64 nt, hsa
uuggcagucuuuaaguauauauagcuuaaaauauaauuuuuagcauuuggcaccauauguaugc

SEQ ID NO: 23976 - RNA, 64 nt, hsa
acuacuacuugagcuaaacuucugcaugguucauaauuuuuaaaguguguaguuaauaugcaug

SEQ ID NO: 23977 - RNA, 64 nt, hsa
aguuacauagaggauugaaaaauguauaucacucaauuuuuaucuaagaaggauagguuauaaa

SEQ ID NO: 23978 - RNA, 64 nt, hsa
uaauuccuuucauagacucaaaccugaaagcagaaauuuuuaguaguugaguugcuuuaaguga

SEQ ID NO: 23979 - RNA, 64 nt, hsa
uugaaucuauuugagcuuuaguucagcagaauuaaauuuuuacuugacauuaucauuaaaauug

SEQ ID NO: 23980 - RNA, 64 nt, hsa
cuacuuuuuuuggccucaaaaaaaucaaggguguaauuuuuaauaaauuguuaauccuauguuu

SEQ ID NO: 23981 - RNA, 64 nt, hsa
aguuacuaguaaugcuuuacuaaguagugcaaugaauuuuuauuuuuaaucccugugcccaauu

SEQ ID NO: 23982 - RNA, 64 nt, hsa
aauaucuguaaccaaaucauuugaaggcuugauaaauuuuuaacaaaguuuguacauuuuuuau

SEQ ID NO: 23983 - RNA, 64 nt, hsa
ccaugaaccugguuuuuuuuuauucuguuguggaaauuuuuaaaucuccaacuugcuguuucca

SEQ ID NO: 23984 - RNA, 64 nt, hsa
uuccaaguccauuguugcaagcaauauucuucucaauuuuuauauguuuacuuuaaaucaaagu

SEQ ID NO: 23985 - RNA, 64 nt, hsa
uuuacuuuaaaucaaaguuagucuauuuguauaaaauuuuuaaaaaaucuaaaagaaaaagaaa

SEQ ID NO: 23986 - RNA, 64 nt, hsa
caaccugaaugguuauuuuuguuaauuaaaauuaaauuuuuaagagauauuuucaaaacccuau

SEQ ID NO: 23987 - RNA, 64 nt, hsa
uaucucaauacuggcuggauuagguuaaauaaagaauuuuuauguucucuagguguacuuuguu

SEQ ID NO: 23988 - RNA, 64 nt, hsa
aaccaaaacauuuuauggcuaguaauauuuauguaauuuuuaaaauguauuuuugguacugaug

SEQ ID NO: 23989 - RNA, 64 nt, hsa
aacucauauuugugccuuuucauuuuaaugcuggaauuuuuauuaugucaccucuaaaacacuu

SEQ ID NO: 23990 - RNA, 64 nt, hsa
auuucugacauuuuauaaaccuacauuuaaggggaauuuuuaaaggaaauguuuuuucuuuuuu

SEQ ID NO: 23991 - RNA, 64 nt, hsa
aguaaaaaaagaaaguuauuucuuugucuuaaagaauuuuuaaaaaauuagucaugagacuuau

SEQ ID NO: 23992 - RNA, 64 nt, hsa
gucaagcacuuuguaccaaguuauuaaguaacauaauuuuuaaaauuuaaagaaugugucuuca

SEQ ID NO: 23993 - RNA, 64 nt, hsa
cucuaccaucuuaauguaguaacuuuagaauuuaaauuuuuauauuacuauuuuccuuuuuguu

SEQ ID NO: 23994 - RNA, 64 nt, hsa
cugccuuccagguucaagugauuagagacagugaaauuuuuauggaauacugcaccuauaaaac

SEQ ID NO: 23995 - RNA, 64 nt, hsa
aagagucuauugguuuuuacuucuaggcagucccaauuuuuaaaggcagagaaguaucugcauc

SEQ ID NO: 23996 - RNA, 64 nt, hsa
gaaagcacaaaaauuaaaacauugccauauguugaauuuuuaaaaagcacuuggagugagcgaa

SEQ ID NO: 23997 - RNA, 64 nt, hsa
auauaaucagagaacugaaaaguaauuuaucaguaauuuuuaagaguccauguuuugugacaac

SEQ ID NO: 23998 - RNA, 64 nt, hsa
aggacugcuuauagagcacagaccuuuguauuauaauuuuuaaaaaggcccuuuuaaauaauua

SEQ ID NO: 23999 - RNA, 64 nt, hsa
guaucguauguuagauuuuugauaaaauuuggccaauuuuuacagaagaaauucucugaucauu

SEQ ID NO: 24000 - RNA, 64 nt, hsa
uguauccuuuuuuagguuucccugcuuuccaguuaauuuuuaaaaugguagcgcuuuguaugca

SEQ ID NO: 24001 - RNA, 64 nt, hsa
aaaccagaaauggcuuuauuuucucccuuggacuaauuuuuaagucucgauuggaauucaguga

SEQ ID NO: 24002 - RNA, 64 nt, hsa
aaauguguuuauggucccaaacagucaacucacaaauuuuuauaacaaaauuuccuuguaaaaa

SEQ ID NO: 24003 - RNA, 64 nt, hsa
gaccuuaaaauagcucuucccaguaagauugugcaauuuuuauucacagcucuuccauguagac

SEQ ID NO: 24004 - RNA, 64 nt, hsa
ugucuuuuacacaauggacaaaucaaguuaaaaaaauuuuuagauagcuuagcuuguuuucugg

SEQ ID NO: 24005 - RNA, 64 nt, hsa
aauugaguuucaaacuuugaaagugcaaggauuuaauuuuuaaguugaaucccaugaaaggugu

SEQ ID NO: 24006 - RNA, 64 nt, hsa
uuugagaaauuaauuuuaauuaacuuaaugagcaaauuuuuauuacuacuuuauguucaauacc

SEQ ID NO: 24007 - RNA, 64 nt, hsa
cauacugacucaauucuuaagucugauuugugcaaauuuuuaucguacuuuuuaaauagccuuc

SEQ ID NO: 24008 - RNA, 64 nt, hsa
gauuuuugaccaaaaguaaggugauaacugaagaaauuuuuaguucuuugaucacuucagugac

SEQ ID NO: 24009 - RNA, 64 nt, hsa
uaauguucuuuuguauuuggguauuuuucaucuuaauuuuuacagcauauacucuucuuaccag

SEQ ID NO: 24010 - RNA, 64 nt, hsa
guuuaacaaauuagaauuuguuuacaacuacuugaauuuuuaaauuaugucaaaacuuacauua

SEQ ID NO: 24011 - RNA, 64 nt, hsa
gggagauggaaggaaggcuauuacauuauuuccgaauuuuuaauacugugugaagugguggcuu

SEQ ID NO: 24012 - RNA, 64 nt, hsa
auuuuagaauaaauucuuagaaaguuuugagaggaauuuuuagagaggacauuuccuccuuccu

SEQ ID NO: 24013 - RNA, 64 nt, hsa
uuuaagaacuguagagcugcuuucaauaucuagaaauuuuuaauugaguguaaacacaccuaac

SEQ ID NO: 24014 - RNA, 64 nt, hsa
uaggacugcaggcaccaugucacuaugcccgacuaauuuuuaauuuuuaauuuuuugucaagac

SEQ ID NO: 24015 - RNA, 64 nt, hsa
gcaggcaccaugucacuaugcccgacuaauuuuuaauuuuuaauuuuuugucaagacaaggucu

SEQ ID NO: 24016 - RNA, 64 nt, hsa
ugacuauguauuuuucuauguuuuuuuaauuaaaaauuuuuaaaauacuuguuucagcuucucu

SEQ ID NO: 24017 - RNA, 64 nt, hsa
gcuuguggccaauggaacaguaagaacaucauaaaauuuuuauauauauaguuuauuuuugugg

SEQ ID NO: 24018 - RNA, 64 nt, hsa
acaucuugaugcuguggcucaguuugccuuccugaauuuuuauugggucccuguuuucucuccu

SEQ ID NO: 24019 - RNA, 64 nt, hsa
guguguguguguguguguguguguguguguguuuaauuuuuaaaaaguuuuuauugagauacaa

SEQ ID NO: 24020 - RNA, 64 nt, hsa
auacacuuauuugucaagcucagcacaaucuguaaauuuuuaaccuauguuacaccaucuucag

SEQ ID NO: 24021 - RNA, 64 nt, hsa
gcaaccauuuuggggcuauauuuacaugcuacuaaauuuuuauaauaauugaaaagauuuuaac

SEQ ID NO: 24022 - RNA, 64 nt, hsa
gcucagaauauuaauuuguaaauucugcaaguuuaauuuuuauguagaugguauaacauuugaa

SEQ ID NO: 24023 - RNA, 64 nt, hsa
guauagagagacuaucuuguguugugccuguaugaauuuuuaaaaguuguugacuggauuuugc

SEQ ID NO: 24024 - RNA, 64 nt, hsa
ggaugaucuacaagaaaauaaguuucuuuuugcaaauuuuuaucauacuaaaguuguucuuuua

SEQ ID NO: 24025 - RNA, 64 nt, hsa
aaugcucucccucucgucuuccauccucauucagaauuuuuagaagaccacaaucguggagaua

SEQ ID NO: 24026 - RNA, 64 nt, hsa
uuuuuuaccacaauuuuuaaaaaguuugaauagaaauuuuuaaugucuuugaguggauuuuguu

SEQ ID NO: 24027 - RNA, 64 nt, hsa
gaggauagauuucauguuaugcauuuuuuaccacaauuuuuaaaaaguuugaauagaaauuuuu

SEQ ID NO: 24028 - RNA, 64 nt, hsa
cuggacucaaaaaaugcuuuguuccauguuuuaaaauuuuuaaguagcagucucaaaguugcuu

SEQ ID NO: 24029 - RNA, 64 nt, hsa
gcuuuggcugcugauacugccuuucuuagacuguaauuuuuaucugcaugcccaguuucugacc

SEQ ID NO: 24030 - RNA, 64 nt, hsa
ucugauuauaagaguaauauauguucauuguaaaaauuuuuaaaacacagaaacuauaugcaaa

SEQ ID NO: 24031 - RNA, 64 nt, hsa
auagaucauauuguauauaguuaguaucuuuauuaauuuuuauuaugaaacuuuccuuugucau

SEQ ID NO: 24032 - RNA, 64 nt, hsa
auuuauuauuugaauuuuaggauagcgaaucacuaauuuuuaguugcugagguuggcauuuuag

SEQ ID NO: 24033 - RNA, 64 nt, hsa
agccucacugcaaaauuagugcagaggagaaaacaauuuuuaauguaaucuugauuuuaccuca

SEQ ID NO: 24034 - RNA, 64 nt, hsa
uugguaacuauguucugaaaacacugcauuuaagaauuuuuaaaaauugguuuucuaaaauuaa

SEQ ID NO: 24035 - RNA, 64 nt, hsa
cugaacccugaaauaauauuuuucucuguuaaacaauuuuuaucuguuugccaccucuguuguu

SEQ ID NO: 24036 - RNA, 64 nt, hsa
aauguguaacuauuauggaucuauuuuaaugaacaauuuuuaccauuucccaagcugccuguuu

SEQ ID NO: 24037 - RNA, 64 nt, hsa
uaugacuuacuguuagagucugucauaugguuagaauuuuuacuuccgcuaccccugccauuuc

SEQ ID NO: 24038 - RNA, 64 nt, hsa
uauuuuuguugauaaaauacgaagaaauuccugcaauuuuuaaaaaacaaguuuggaauuuuuu

SEQ ID NO: 24039 - RNA, 64 nt, hsa
ugcuggacauguauaaauuucacuggauuguauaaauuuuuaucuauugccuuaaacauuuaca

SEQ ID NO: 24040 - RNA, 64 nt, hsa
gccacaagcacuguggcaauaacuuuugaauuuuaauuuuuauaauagaaaaaugauuaggaau

SEQ ID NO: 24041 - RNA, 64 nt, hsa
aaaugagcaauuggcagugcucauaauauauuccaauuuuuauuggaauuuucgauggaauguu

SEQ ID NO: 24042 - RNA, 64 nt, hsa
aagugaaugacauuggacuuuuaguaacaaacuuaauuuuuaaaaagguguagacaaugguggu

SEQ ID NO: 24043 - RNA, 64 nt, hsa
uuaaauuuuagauuauuuuuauuaccauguacugaauuuuuacauccugauaccuuuuccuucu

SEQ ID NO: 24044 - RNA, 64 nt, hsa
ccaagagcuuuaacucggucuuaaaauaugcccaaauuuuuacuuuguuuuucuuuuaauaggc

SEQ ID NO: 24045 - RNA, 64 nt, hsa
cguaagaaccucuuagcuuugugcguuccugccuaauuuuuauaucuucuaagcaaagugccuu

SEQ ID NO: 24046 - RNA, 64 nt, hsa
uaggguaagguaguacacauuugguucagaaauuaauuuuuauuucuccuauaucuuguuuuau

SEQ ID NO: 24047 - RNA, 64 nt, hsa
cugggacuacgggcacaugccacugcaccuggcuaauuuuuauauuuuugguagagacaggguu

SEQ ID NO: 24048 - RNA, 64 nt, hsa
uuuauaauucugauugagaauuuaggggcaugguaauuuuuaccaaaacugaagcugguaauuu

SEQ ID NO: 24049 - RNA, 64 nt, hsa
gauguugaacaugggaggcauuuuuaauggaccaaauuuuuagaaaaauuaguuuuuggauuuu

SEQ ID NO: 24050 - RNA, 64 nt, hsa
guauucccuucagggauucccuguccccaacaggaauuuuuaaaccaaaacaccccaacuuggc

SEQ ID NO: 24051 - RNA, 64 nt, hsa
cucuuuauuuuucucuuucucccuuuuuuuuuuaaauuuuuauuuuuacguagaagcucuugga

SEQ ID NO: 24052 - RNA, 64 nt, hsa
uaaauauagaaaauagagaaaaggcuaugccuguaauuuuuaagcccuuaggcuuagaguuucu

SEQ ID NO: 24053 - RNA, 64 nt, hsa
gggugucagugacucauggagaagaaaugggguaaauuuuuagugauguugcuaaucauugaau

SEQ ID NO: 24054 - RNA, 64 nt, hsa
uacaaauuacuucuuuguuuuucuuaaugauggcaauuuuuaaacuuuaauuuuauugugaucu

SEQ ID NO: 24055 - RNA, 64 nt, hsa
ucauauagucagauauauguugucugcuuuaaacaauuuuuaaauuuuaaaaaugcauuaacgu

SEQ ID NO: 24056 - RNA, 64 nt, hsa
aaauuguggaaugcaugauugacaauauauuuuuaauuuuuauuuuuucaaguaauaccaguac

SEQ ID NO: 24057 - RNA, 64 nt, hsa
ccaguacuguuuaacuauagccagaacuggcuaaaauuuuuauauuuucagaguugaaguuggu

SEQ ID NO: 24058 - RNA, 64 nt, hsa
aaaaaugaaauuguuaggugaaaguguuuuugagaauuuuuauauauauuacucacugcagaga

SEQ ID NO: 24059 - RNA, 64 nt, hsa
uaacuaaaucaguacaaguuuggggugaaaaggaaauuuuuaauccaucucaaauguauuuggu

SEQ ID NO: 24060 - RNA, 64 nt, hsa
uugacugcugaugugaugcuacuguaaugcaauaaauuuuuaaauuguugcaaagugcuguuuu

SEQ ID NO: 24061 - RNA, 64 nt, hsa
auaaacaccaccaucaucaaagagcugcucaagaaauuuuuaaaaacgaaacaaaguuaugggg

SEQ ID NO: 24062 - RNA, 64 nt, hsa
uuuucacauugaaaacagcaaauguugacuuaguaauuuuuauaucgauaucuauauguauaug

SEQ ID NO: 24063 - RNA, 64 nt, hsa
uugauuuuuuucucauaaaauagucugauaagcuaauuuuuaaaaagaaaugccauuaacugug

SEQ ID NO: 24064 - RNA, 64 nt, hsa
guggcuggaggccaugccuuuuaagcauguguaaaauuuuuaaagaaaugaacauacacauagu

SEQ ID NO: 24065 - RNA, 64 nt, hsa
uugguuuauuucaugcacugugccuucaaaaugaaauuuuuaaaagggacuuuaaaugaaguug

SEQ ID NO: 24066 - RNA, 64 nt, hsa
cuggcacuguaggcauguaccaccaugcccagcuaauuuuuauauuuuuaguagagaugggguu

SEQ ID NO: 24067 - RNA, 64 nt, hsa
ugacauugaaagacuguugggguggggggaggaaaauuuuuacuuuccaucuuaauguaaccuu

SEQ ID NO: 24068 - RNA, 64 nt, hsa
gaguuucauaaccuguuauggugcuuuugguggaaauuuuuauuauuuagcauuuuaggagacc

SEQ ID NO: 24069 - RNA, 64 nt, hsa
ggcuuugugggaaaaugaucuaaauuauuguuuuaauuuuuaaaccuaauuuauucacucagug

SEQ ID NO: 24070 - RNA, 64 nt, hsa
uuaaaacaugaaugauuugaaaguuuaaauuuuuaauuuuuauauguggaaauucuuccuguug

SEQ ID NO: 24071 - RNA, 64 nt, hsa
auuauguuuaaaacaugaaugauuugaaaguuuaaauuuuuaauuuuuauauguggaaauucuu

SEQ ID NO: 24072 - RNA, 64 nt, hsa
ugugcuggggugggauuaugggucaauguugaagaauuuuuaagucuguauuauguuuaaaaca

SEQ ID NO: 24073 - RNA, 64 nt, hsa
gucuacaagaauuauagcuuuaaaaaauacaaccaauuuuuauauuucaaaaauauuugaacuc

SEQ ID NO: 24074 - RNA, 64 nt, hsa
aaacauagaugaccauuuuuaauaagcacaaucaaauuuuuaaccacagaaugucuacaagaau

SEQ ID NO: 24075 - RNA, 64 nt, hsa
uucugauaguuuuauuaagcauggagaaauugccaauuuuuaaaaacugcaguuuuccaaacuu

SEQ ID NO: 24076 - RNA, 64 nt, hsa
guucuuuuuuaaauagaaacuuuaguuuuuuguaaauuuuuaaaaaaauauuucauugauaugc

SEQ ID NO: 24077 - RNA, 64 nt, hsa
ucacaaaucuguucauuuaauuuuuuaauuugagaauuuuuauuucuuuugacugaaaacacau

SEQ ID NO: 24078 - RNA, 64 nt, hsa
gauucuuaaucagagggcaaauucauuagagaagaauuuuuaguagauacacagacuaauauuu

SEQ ID NO: 24079 - RNA, 64 nt, hsa
uuucccccuuguaacccaugugccagauguguggaauuuuuagcucagcauugagagaauaaaa

SEQ ID NO: 24080 - RNA, 64 nt, hsa
uuaugugacuugugguguaaaaugucuugaugauaauuuuuaaaacuuggguaacacuuccaaa

SEQ ID NO: 24081 - RNA, 64 nt, hsa
ggugauacuggcuuuacagaaauuucagagaacuaauuuuuaaaaucuuuagcauuuaaaacuu

SEQ ID NO: 24082 - RNA, 64 nt, hsa
gaacuaguagaugucaauaauuauuauuuuuaaaaauuuuuauuuguuggccgggcaugguggc

SEQ ID NO: 24083 - RNA, 64 nt, hsa
ccagccugggugucaauaauuauuuuuuaaaaaaaauuuuuaaaaagguuuuuugagacagauu

SEQ ID NO: 24084 - RNA, 64 nt, hsa
uauaaccagggauaauaaaaagaaaaaagaaguuaauuuuuaauugauguuuuugaaacuuagu

SEQ ID NO: 24085 - RNA, 64 nt, hsa
cauuuuugaguuacaagagucuuauaacuacuugaauuuuuaguuaaaaugucuuaauguaggu

SEQ ID NO: 24086 - RNA, 64 nt, hsa
uagcaagauugaccaaaacaggugguagguguguaauuuuuaacugucaugaaauacuguaaug

SEQ ID NO: 24087 - RNA, 64 nt, hsa
aaaggaugucagaaauugacauacaaauauuuacaauuuuuaugaaugguggucuuugcaaaga

SEQ ID NO: 24088 - RNA, 64 nt, hsa
acacuauuaauauaugagagaaaugcuauuuuuuaauuuuuauuuuaauagagacagggucuca

SEQ ID NO: 24089 - RNA, 64 nt, hsa
gagauuauaggcgugagccacuguucccagccacaauuuuuaucuugaccauaauuugucauuc

SEQ ID NO: 24090 - RNA, 64 nt, hsa
aaaaugugcauguuaaguauucaaaucagucuuaaauuuuuaaaaauauguaauuuuagaaaau

SEQ ID NO: 24091 - RNA, 64 nt, hsa
ugaaguuucuuucuuucauagagcaaacguuuuaaauuuuuaugaaguaagacuucucaguuuu

SEQ ID NO: 24092 - RNA, 64 nt, hsa
uuuacaaacaauccaauucuacacuuuaaaaaaaaauuuuuaaauguacaauuaaauuuuuauu

SEQ ID NO: 24093 - RNA, 64 nt, hsa
acacuuuaaaaaaaaauuuuuaaauguacaauuaaauuuuuauuuaccacaguguuauuuuuau

SEQ ID NO: 24094 - RNA, 64 nt, hsa
uuuugguuuacgucaucauuguagccauaugguaaauuuuuauuuguuaaauuuuuaaaaauua

SEQ ID NO: 24095 - RNA, 64 nt, hsa
ucauuguagccauaugguaaauuuuuauuuguuaaauuuuuaaaaauuacuuagcucaaaaugu

SEQ ID NO: 24096 - RNA, 64 nt, hsa
uuuaaaaauuacuuagcucaaaaugucagugguaaauuuuuaaauugaguaaagugauucuucu

SEQ ID NO: 24097 - RNA, 64 nt, hsa
cgacagcauuucuaguuccuuugacauuccauauaauuuuuaggauuaguuuguacuuauuuac

SEQ ID NO: 24098 - RNA, 64 nt, hsa
caggugugagccacugcacccggccacaagauguaauuuuuacuuuaucucucacacguauuuu

SEQ ID NO: 24099 - RNA, 64 nt, hsa
uuccagucuauuuucugucuuguuaauauugauuaauuuuuauugaccuuccaugguccucacu

SEQ ID NO: 24100 - RNA, 64 nt, hsa
cuggcauuacaggcacaugccaccacgcccaacuaauuuuuauauuuuuaguagagacgggguu

SEQ ID NO: 24101 - RNA, 64 nt, hsa
cugggauuacaagugcccaccaccaugcccagcuaauuuuuauauuuuuaguagagacaguguu

SEQ ID NO: 24102 - RNA, 64 nt, hsa
caaacauaaaauuugcaagaaaauguagaaauuaaauuuuuaagaguuaaugguaagugaacaa

SEQ ID NO: 24103 - RNA, 64 nt, hsa
uaagaauaauuuuuacaaaauuuagugcauacaaaauuuuuaaauguaauuccacaauuagugu

SEQ ID NO: 24104 - RNA, 64 nt, hsa
uucauuaugugagcuggucugugauuauaagaauaauuuuuacaaaauuuagugcauacaaaau

SEQ ID NO: 24105 - RNA, 64 nt, hsa
aauaacuaaaaguauguaaagguaaaagguuugaaauuuuuaagcgcauuuuuuaaaacuuaaa

SEQ ID NO: 24106 - RNA, 64 nt, hsa
uuuccagucacuagaguucuuucaguagaaaaagaauuuuuaaaaauuaaaauguaauguugcu

SEQ ID NO: 24107 - RNA, 64 nt, hsa
gguuuuuauaaauuuuauauaaauaaguuauaugaauuuuuauugauagagaguauguaagcuu

SEQ ID NO: 24108 - RNA, 64 nt, hsa
acuauaaaguacuaaucuuauuuuggauuugacgaauuuuuacauguuuuuuucuuuuuuaguu

SEQ ID NO: 24109 - RNA, 64 nt, hsa
cugggcugacaggcacccaccaccacacccagcuaauuuuuauguuuuuaguagagaugggguu

SEQ ID NO: 24110 - RNA, 64 nt, hsa
guguccucucucucuuucuugcuagugguuuaucaauuuuuaaaaccuuuucuuguuuauuugu

SEQ ID NO: 24111 - RNA, 64 nt, hsa
uuaaguuucauucuuccuagaauauuuuucuaacaauuuuuauuucagcuuuaaagauggguca

SEQ ID NO: 24112 - RNA, 64 nt, hsa
agguaucugacuuuacaaguuuguuauccuuucuaauuuuuacugaacugaaagcacaaagaag

SEQ ID NO: 24113 - RNA, 64 nt, hsa
aaccucaaggaaaccauaaagcuuggagugccuuaauuuuuaaccaguuuccaauaaaacgguu

SEQ ID NO: 24114 - RNA, 64 nt, hsa
aaccuucauauaaaaauucaggcccuuuuuggacaauuuuuaaaauuuguaucuuuacuagaac

SEQ ID NO: 24115 - RNA, 64 nt, hsa
ggauaauuuucauuuuuaauuccucuuggugucaaauuuuuaaguaauuucaugcacacaggag

SEQ ID NO: 24116 - RNA, 64 nt, hsa
uuggaguuaaaauguguuuuucaguuauaauuucaauuuuuaaauuucuuggugcuuugucuaa

SEQ ID NO: 24117 - RNA, 64 nt, hsa
gacaaaacuuguuauguugaucgcgguaugucaaaauuuuuacagguuugcucaucugccagag

SEQ ID NO: 24118 - RNA, 64 nt, hsa
aucguuaaguuaaacaaguuuucaaaaacaaaacaauuuuuaaaguaccuuaaaauugaggaug

SEQ ID NO: 24119 - RNA, 64 nt, hsa
auuuuuuauaaguauguauuacuuuuguaaucagaauuuuuagaaaguauuuugcugauuuaaa

SEQ ID NO: 24120 - RNA, 64 nt, hsa
uuuaaaguuuucuacaaggggagaaaaguguuaaaauuuuuaaaauauguuuuccaggacacuu

SEQ ID NO: 24121 - RNA, 64 nt, hsa
aagcuuugucuuguauccuugugugaaauugcauaauuuuuacccuauuugauuucuuaaauaa

SEQ ID NO: 24122 - RNA, 64 nt, hsa
uguugauacucguacuuguaaaaaauuguaaggcaauuuuuaguauuguugucaaagaaaagcu

SEQ ID NO: 24123 - RNA, 64 nt, hsa
uuugaugcuuauuaagaguaaacccaugaauuugaauuuuuauauuaugcuugguacuuggaau

SEQ ID NO: 24124 - RNA, 64 nt, hsa
aaggucuucuaccgacuucaugguauuuaggaaaaauuuuuaagugauaauaccaugccgaguu

SEQ ID NO: 24125 - RNA, 64 nt, hsa
cagaucucaucaggguagcagcagaggcaggaccagaaggcaaucaagagcuuccagaaaugcc

SEQ ID NO: 24126 - RNA, 64 nt, hsa
gcaggcagccuugcccauucucuaagccuggcuuagaaggcacugggaauguccuguagagaga

SEQ ID NO: 24127 - RNA, 64 nt, hsa
gggucuugugagggcugggggcauccaggcacucagaaggcaaaggaaccacccuacccauuug

SEQ ID NO: 24128 - RNA, 64 nt, hsa
cacugaguccacucggagugcccuguguuccuggagaaggcauuccaggguugaaucuuguccc

SEQ ID NO: 24129 - RNA, 64 nt, hsa
uucccuaaucauucccuuuucuccccacuccuccagaaggcauaacccuucucuccacaccccc

SEQ ID NO: 24130 - RNA, 64 nt, hsa
cacuuuuauuuuuuaaaauuaaguaauuuuuuaaagaaggcacuuuuaaaauuaacacacacau

SEQ ID NO: 24131 - RNA, 64 nt, hsa
auaggggaggagcucaggucugcgccaggcaggaagaaggcaggcuucuggcuuccagaggugc

SEQ ID NO: 24132 - RNA, 64 nt, hsa
agcugugccacuuggaauugcaacccaugaguucagaaggcacacucugccaugcugagcucca

SEQ ID NO: 24133 - RNA, 64 nt, hsa
guacgacugucuggcccugaauuugcauggcuugagaaggcacaccguaagacuaaguaggaaa

SEQ ID NO: 24134 - RNA, 64 nt, hsa
cuucuggggacaccucaggagcuuuacucauggcagaaggcaaagcaaaggcaggcacuucaca

SEQ ID NO: 24135 - RNA, 64 nt, hsa
uacacacacaaauacacaaucucuaggguaagccagaaggcaagaucagauuaaaaacaccaug

SEQ ID NO: 24136 - RNA, 64 nt, hsa
cugugccauggcugguguauauaugugcaauguuagaaggcaaaagagugaugguaggcagagg

SEQ ID NO: 24137 - RNA, 64 nt, hsa
gaaggaaagaaaggauauaggaagagagggaagcagaaggcaggcauuuuucuauuuuccccac

SEQ ID NO: 24138 - RNA, 64 nt, hsa
auuacucuuagagaagaagaaauggaaaaaugaaagaaggcaggaaggaaagaaaggauauagg

SEQ ID NO: 24139 - RNA, 64 nt, hsa
gaaguuucacacaaucgaagacugcacaacuccuagaaggcagcacuaugcugcaaacccagac

SEQ ID NO: 24140 - RNA, 64 nt, hsa
agagaagcaagagcaaacacauucaaaagcuagcagaaggcaagaaauaacuaagauccgagca

SEQ ID NO: 24141 - RNA, 64 nt, hsa
uguguuuggaaaauagcgaauuaaccuaagacacagaaggcagacugggugaggagaccuagca

SEQ ID NO: 24142 - RNA, 64 nt, hsa
ucucaagguuguugauggggaacuugccacuaagagaaggcagagaggucccuaguggguauau

SEQ ID NO: 24143 - RNA, 64 nt, hsa
aaggagauggccacaugaacacagacacgcagggagaaggcagccgugugaaggagucggagau

SEQ ID NO: 24144 - RNA, 64 nt, hsa
gagcacugugaggccccagguggaaacgugcaagagaaggcagagccuuugacaguucucaaaa

SEQ ID NO: 24145 - RNA, 64 nt, hsa
ugcagggggcucgggcugccuggccuggcugcacagaaggcaagugcuggggcucauggugcuc

SEQ ID NO: 24146 - RNA, 64 nt, hsa
aauuccuuuugggacuggaggcagaaaagcggccagaaggcagcagcccuggcuccuuuccuuu

SEQ ID NO: 24147 - RNA, 64 nt, hsa
aaaaauccgauacugcaacguuuuccaaaaucccagaaggcaaacugugcauguucuacccuga

SEQ ID NO: 24148 - RNA, 64 nt, hsa
cauuguacuaggccauuccagcugaaucucaaacagaaggcaguaaugagagccuacaaauggg

SEQ ID NO: 24149 - RNA, 64 nt, hsa
auuuuaucuaaaucacuggaaaggcuggaggagcagaaggcagaggccaccacuggacuauugg

SEQ ID NO: 24150 - RNA, 64 nt, hsa
uuggugguaaaagaggguugcauuucuugcagccagaaggcagagaaagugaagaccaagucca

SEQ ID NO: 24151 - RNA, 64 nt, hsa
caugguggauaggcauuaugguuuccacuuuggcagaaggcagacuauucacagcccuauuuac

SEQ ID NO: 24152 - RNA, 64 nt, hsa
uaauauugaacuauuuuuauaucugcugucuuucagaaggcaaauaggaaacuauauauuugcu

SEQ ID NO: 24153 - RNA, 64 nt, hsa
acaaaccaccaggacugaaagaagaaaacaguacagaaggcaaaguuuacagauguuuuuaauu

SEQ ID NO: 24154 - RNA, 64 nt, hsa
aaucugaccguucuauuguguggaugaccacauaagaaggcaauuuuaguguauuaaucauaga

SEQ ID NO: 24155 - RNA, 64 nt, hsa
gggagagggggagguugguuccuuggggggccaaagaaggcagggaaugccuggaggguaacug

SEQ ID NO: 24156 - RNA, 64 nt, hsa
caguccccagcccugggcuuggcucuuggcuuccagaaggcagcaaagaggggcgcuguccugc

SEQ ID NO: 24157 - RNA, 64 nt, hsa
gauugugacaauucagagcauaacucagauggcgagaaggcagcauuaucucugugcgaugcug

SEQ ID NO: 24158 - RNA, 64 nt, hsa
gccagccuuuauuucccuggcaggcagccuugccagaaggcagagaggcaguucugaaucauuc

SEQ ID NO: 24159 - RNA, 64 nt, hsa
cucuucuaugacccugacgagugcgggcugaugaagaaggcagccuuguacuucagugacuucu

SEQ ID NO: 24160 - RNA, 64 nt, hsa
aucccacucuaugcgaaccacaagacccuccuccagaaggcagccgcugaguucggggcucacu

SEQ ID NO: 24161 - RNA, 64 nt, hsa
uuuuaauaaugugaggaguacaguguuuucuaauucauucaaguauauaugauuuaaaccuggg

SEQ ID NO: 24162 - RNA, 64 nt, hsa
agguugagcaagaaaugucuuccuuuagaaaaucucauucaagucagguucuucucuacaguuc

SEQ ID NO: 24163 - RNA, 64 nt, hsa
cucuucccaugaccuaaaacacugugaggaaaaaucauucaaguggcaugccaagucccuauga

SEQ ID NO: 24164 - RNA, 64 nt, hsa
augccagauuaaaauaacugaauaguuuacuauuucauucaagcauguuuaaaacaaauaauuu

SEQ ID NO: 24165 - RNA, 64 nt, hsa
uauguagaaaagugggguccuuuugaauaaaagaucauucaacuaaaaauauuaaaauuuauuu

SEQ ID NO: 24166 - RNA, 64 nt, hsa
uuaacagaauaucaugggcauuucucuaugauggucauucaagguaguaggucucuuucaacug

SEQ ID NO: 24167 - RNA, 64 nt, hsa
acccuacagaugcccagguucuuuaguuuuuuauucauucaacucacacacacauaaacauaua

SEQ ID NO: 24168 - RNA, 64 nt, hsa
cacuagacaauggaucugcaacuuuggacuaaggucauucaauguacccaaacuugaacagggg

SEQ ID NO: 24169 - RNA, 64 nt, hsa
aaaaugaggcauaaacuugaugcagcugccucccucauucaacuggggaguucuugaguuccuc

SEQ ID NO: 24170 - RNA, 64 nt, hsa
auggcuucaggacauggguucucuucuccugugaucauucaagugcucacugcaugaagacugg

SEQ ID NO: 24171 - RNA, 64 nt, hsa
ucaagcuguacugugagcagacgcauugguauuaucauucaaagcagucucccucuuauuugua

SEQ ID NO: 24172 - RNA, 64 nt, hsa
ucucuccugaggaagaauuuuaaacauguacagcucauucaauauagauaugagccauggugga

SEQ ID NO: 24173 - RNA, 64 nt, hsa
aucauauauugauuauacaauuguauuauaaaguucauucaaaucaaauuaagaaaaccugagu

SEQ ID NO: 24174 - RNA, 64 nt, hsa
gauugugugaaauccuuuagccagcguuucaaccucauucaacaccagaaaguucacaguggaa

SEQ ID NO: 24175 - RNA, 64 nt, hsa
aacagauggaaauccguuagccacaccuccagucucauucaacacuggacaguuuacaaugugg

SEQ ID NO: 24176 - RNA, 64 nt, hsa
guucauuacuuuguucacuccuucuuccauuuauucauucaauaaacauuuauugggaaccugu

SEQ ID NO: 24177 - RNA, 64 nt, hsa
ggagaugcguuguaugggacuggaagcaagagguucauucaaagagaaacucaugggauuugua

SEQ ID NO: 24178 - RNA, 64 nt, hsa
uguauauuucuuauguagaaaauacuguuucuacucauucaaagcacauuguagauauucagag

SEQ ID NO: 24179 - RNA, 64 nt, hsa
cucaacccauuauaucaauccuaaguccaaaauuucauucaaauaucaucgguucaaaaguucc

SEQ ID NO: 24180 - RNA, 64 nt, hsa
acaauauuucacaagcaauggaaaagcaguuaccucauucaaagaagacauaugacucuuucca

SEQ ID NO: 24181 - RNA, 64 nt, hsa
cuggaugccucauagccauuucaaauccaccuagucauucaaaguagaaacccacagguaacua

SEQ ID NO: 24182 - RNA, 64 nt, hsa
gucacauuugacaguuuugcuaaaauccaaaguaagcucauaaaaauaauugaugauaacacuu

SEQ ID NO: 24183 - RNA, 64 nt, hsa
auuuuugguacugugcuguuuacuuauuauauguagcucauacuucauagaagcuguuauuuug

SEQ ID NO: 24184 - RNA, 64 nt, hsa
ugaggggccaaaagaauaaaggaccaaauuucuuagcucauaucauugcuuuaaacauagaagu

SEQ ID NO: 24185 - RNA, 64 nt, hsa
ccugguuacccagcacauaguaguacuggauuccagcucauaauaaguacucuauaucauuuuu

SEQ ID NO: 24186 - RNA, 64 nt, hsa
uaacuccagauuguagucauuuugagagguacaaagcucauaauuaccaugacaacaugguaau

SEQ ID NO: 24187 - RNA, 64 nt, hsa
guggcucaaaggacaaugcaaaaucgccgaucagagcucauacccaaagcauuacagagaacag

SEQ ID NO: 24188 - RNA, 64 nt, hsa
aaacugcaaaaagcuagguaagcuauuuuguugcagcucauaagguggugaaaaggacucuccu

SEQ ID NO: 24189 - RNA, 64 nt, hsa
aauuguggauaaauguuagacaucuguugaaauaagcucauaugguggaaacgacaacuauauu

SEQ ID NO: 24190 - RNA, 64 nt, hsa
ggucauuuacaagacacaucuugugcccucuggaagcucauaggguugugaggcaaacuuccag

SEQ ID NO: 24191 - RNA, 64 nt, hsa
gaugccauuugaucagaugccaauuuguauucagagcucauaaaaacaaguccauucuuauagu

SEQ ID NO: 24192 - RNA, 64 nt, hsa
ggccaagagaagccucauugguucacagucaugcagcucauacuguccacccuuguauucucag

SEQ ID NO: 24193 - RNA, 64 nt, hsa
agaugggaagaauggaaacagggaccgauuuuguagcucauacaauuaggacaccuuaggaaua

SEQ ID NO: 24194 - RNA, 64 nt, hsa
agaaauauugaaaacugaggcaguuaaccaaaguagcucauauaaauaauaaaaccaaucugag

SEQ ID NO: 24195 - RNA, 64 nt, hsa
aaagugauguuccucuuccuuuuuuacacuuuucagcucauauuuaaccucuguuuggaaaaug

SEQ ID NO: 24196 - RNA, 64 nt, hsa
gaaggucacauuccuagcauucuugggaaguauuagcucauacucucauucacauaugggaggu

SEQ ID NO: 24197 - RNA, 64 nt, hsa
uuguguuuuuuaauuuugauucagaaguagucccagcucauagguguucauacuguuacaucca

SEQ ID NO: 24198 - RNA, 64 nt, hsa
aauugagaaguucuaaauuaagacauuucaguuaagcucauaaaauuucauuguuuucauuuaa

SEQ ID NO: 24199 - RNA, 64 nt, hsa
ggaugacuaaaaagaguaaaauaauuuaauuaauagcucauauuuuaugugugaaaacauguua

SEQ ID NO: 24200 - RNA, 64 nt, hsa
gcugcugauauguugaguuuguucuuuaaaaaauagcucauauaucucaucuuuccuccugucu

SEQ ID NO: 24201 - RNA, 64 nt, hsa
aaacagguauaagacucagucuccacaugaagggagcucauauccaaggacacaaaaccacuuu

SEQ ID NO: 24202 - RNA, 64 nt, hsa
cagugcucugauuuugaaggaggauauucacugaagcucauaguuauaaacaaggaaaucacug

SEQ ID NO: 24203 - RNA, 64 nt, hsa
ugguguguucugcagggacaggccuggaugaucuagcucauaccaaaggaccuuguucugagag

SEQ ID NO: 24204 - RNA, 64 nt, hsa
uauguaauuacaaaucacugucaauuuuaugggaagcucauaguauuuuaauauuuuauuaaca

SEQ ID NO: 24205 - RNA, 64 nt, hsa
cagugagaguaugccuucacuauguuaaaaaauaagcucauaaaacaggguacuuuuuauucaa

SEQ ID NO: 24206 - RNA, 64 nt, hsa
uauuaggacguccagcaggagcagauccaggagcagcucauaugauccccacagucgauccagg

SEQ ID NO: 24207 - RNA, 64 nt, hsa
agcuggggcugcaagacugccucuccugcaaggcagcucauacuuguacuguauguucagaaau

SEQ ID NO: 24208 - RNA, 64 nt, hsa
ccaaagcccccuggcucugggcauuugacagacuagcucauacagaucauaauugccucuacuc

SEQ ID NO: 24209 - RNA, 64 nt, hsa
aaggaaacauaggcagcacugaaaaaaaaaaaaaagcucauauuaauuagacugacaauauggc

SEQ ID NO: 24210 - RNA, 64 nt, hsa
caaaucccucauccugacaggaagaaaauagaacagcucauagcucgagccgguccaauuuaug

SEQ ID NO: 24211 - RNA, 64 nt, hsa
gaagaggaaacucugucacuccucaugccugucuagcucauacacccauuucucuuugcuucac

SEQ ID NO: 24212 - RNA, 64 nt, hsa
uuugcaugguaaggaaaaggcuuacuugcccuucagcucauaaaagcagaaggugugcuauuca

SEQ ID NO: 24213 - RNA, 64 nt, hsa
cugaaucgaguucuuugcccuccuuugugccugcagcucauauggaggucuuugccaccaaugg

SEQ ID NO: 24214 - RNA, 64 nt, hsa
uuauuauuuuagagcaucucauuuauaauguagcagcucauaaaugaaauugaaaaugguauua

SEQ ID NO: 24215 - RNA, 64 nt, hsa
cugugugauugucauuuauaucugauccccaaauagcucauacaauaauccauucaauagaaug

SEQ ID NO: 24216 - RNA, 64 nt, hsa
ugaagaaccuaagacacagagaccaaggcccaugagcucauagggcugaggcaggauuuggaau

SEQ ID NO: 24217 - RNA, 64 nt, hsa
aaugaaaacauguuugaugacuggucaaaaaauaagcucauaaucuauuuuuuucauguaguau

SEQ ID NO: 24218 - RNA, 64 nt, hsa
aaacauuuaugccucccuuuuguguugacacuguagcucauacuggaaaagucgaucaauguuu

SEQ ID NO: 24219 - RNA, 64 nt, hsa
caguccugagagggauggaccagacugccacagcagcucauagcacaaaaaaagguuaagaagu

SEQ ID NO: 24220 - RNA, 64 nt, hsa
acuaagccuuuugagacauccuuuauucuuaaaaagcucauaaauaauuggcuuauuacauaua

SEQ ID NO: 24221 - RNA, 64 nt, hsa
ugcuuuccucuggccccggccccacccugaacacagcucauacacagaaucaggaccagcaugu

SEQ ID NO: 24222 - RNA, 64 nt, hsa
aucuguuuuuuuaaaaauaucuuuuucuccucucagcucauacauaacacaaggcagaaaucug

SEQ ID NO: 24223 - RNA, 64 nt, hsa
aaugcuuugaaauucuaaugguaucugaaauaucagcucauagaaaguaacaaaauuugcuguc

SEQ ID NO: 24224 - RNA, 64 nt, hsa
auguaucagggguuuugcuucuguguuucgccaaagcucauaagggcugugacccacccauaug

SEQ ID NO: 24225 - RNA, 64 nt, hsa
auuugcaaauaauggaucaauuaauuuuuuuugaagcucauauuguaucuuuuuaaaaaccaug

SEQ ID NO: 24226 - RNA, 64 nt, hsa
gcuuggugcuugaccugguuaaauacugucuuaaagcucauacaaaacaaauaggcuuuuccau

SEQ ID NO: 24227 - RNA, 64 nt, hsa
caagaguuucaugugaucacugcaguguugucacagcucauaaauagcaacagugucucaugau

SEQ ID NO: 24228 - RNA, 64 nt, hsa
ucuccaguauucuugucaaaaaaaaaaaaaaaaaagcucauauuuuguauauaucugcuucagu

SEQ ID NO: 24229 - RNA, 64 nt, hsa
uuuagucccuccaugucaaagugggccugagaaaagcucauacaugccucaugugaagugucca

SEQ ID NO: 24230 - RNA, 64 nt, hsa
cugcucccagacagucucacaaguaaacaccagcagcucauagauuacaaccaagaaagugacu

SEQ ID NO: 24231 - RNA, 64 nt, hsa
auaaugccugaauggaacucauuuauugguuaacagcucauaucaggagcugugauaaguaagu

SEQ ID NO: 24232 - RNA, 64 nt, hsa
aaaaauaaaaucaagauaaccucuugaauguaauagcucauagcacuuuaauuuggcaagccau

SEQ ID NO: 24233 - RNA, 64 nt, hsa
gagugcuaagcauuagcuuuaauuaagcucucauagcucauaagaguaacagucaucauuuauc

SEQ ID NO: 24234 - RNA, 64 nt, hsa
caagaagacagcacaaaguauggguuuggccauaagcucauaugcugcccccaaagacugggga

SEQ ID NO: 24235 - RNA, 64 nt, hsa
ugguugauuucaagccaccagugguuuaauaaccagcucauaaaucuccuaaauauuuuacagu

SEQ ID NO: 24236 - RNA, 64 nt, hsa
uggggaccaaaucaaaugaaugauuaaauuaugaagcucauauccuuuugaagguaguugcaaa

SEQ ID NO: 24237 - RNA, 64 nt, hsa
acauuuuacuaaaagguucauugguuccaaucacagcucauagguagagcaaagaaagggugga

SEQ ID NO: 24238 - RNA, 64 nt, hsa
uaaaaguuaauaacagcuccuuuauuauaaucaaagcucauaauggaaaaaaagacugaugaag

SEQ ID NO: 24239 - RNA, 64 nt, hsa
gaacaguuugccauaagucagaauuuugcaguuuagcucauagaucuuaauugguuuuucucua

SEQ ID NO: 24240 - RNA, 64 nt, hsa
aaaagggcauauugccccaagguuacacugaagcagcucauagcaaguuaaaauauugugacag

SEQ ID NO: 24241 - RNA, 64 nt, hsa
cagcguccacuggcuccaggcuccucacaacagcagcucauagacacggggcgucuccaggugg

SEQ ID NO: 24242 - RNA, 64 nt, hsa
caucuauggguaucacacccaagacuacccaccaagcucauacagggaaccacacccaacacuu

SEQ ID NO: 24243 - RNA, 64 nt, hsa
uucccaugaaggugagcacagcugugagugagugagcucauaucuccauuugucagugcuggac

SEQ ID NO: 24244 - RNA, 64 nt, hsa
auuauuauuucuguucuuacaaaugugaaacggaagcucauagaggugagaaaacucaaccaga

SEQ ID NO: 24245 - RNA, 64 nt, hsa
uucugcagcugagcuugcagaauagagaaaaaugagcucauaauuugcuuugagagcuacagga

SEQ ID NO: 24246 - RNA, 64 nt, hsa
acauuagaaauggacaaaaguggccaggagcgguagcucauacuuguaacccagcacuuuggga

SEQ ID NO: 24247 - RNA, 64 nt, hsa
uuauaguuuacuuugaauauuuauauuaauaauuagcucauaauuuuuauugcaaggcucaaug

SEQ ID NO: 24248 - RNA, 64 nt, hsa
uccacagagaagccccaagaaggagguuggggccagcucauaaaaagccugaaugccaagccaa

SEQ ID NO: 24249 - RNA, 64 nt, hsa
auuaccauacaugacauaaaaaggaacaguggauagcucauacuuuauggugguucuucuccuc

SEQ ID NO: 24250 - RNA, 64 nt, hsa
gaaucacagcacugaguauuuuguaggccaacagagcucauaguacuugggaaaaauuaaaaag

SEQ ID NO: 24251 - RNA, 64 nt, hsa; identical to SEQ ID NO: 24247

SEQ ID NO: 24252 - RNA, 64 nt, hsa
augcuccuaauguacauggacauuuuuguaacucagcucauauucugacuguauuugagaagcu

SEQ ID NO: 24253 - RNA, 64 nt, hsa
guugcucugggauugcacuucugaaugaaguagcagcucauaagcuuuugccacaggcucuguc

SEQ ID NO: 24254 - RNA, 64 nt, hsa
gaaguuggguguuuccagaauugguaaaaacagcagcucauagaauuuugaguauuccaugagc

SEQ ID NO: 24255 - RNA, 64 nt, hsa
auaaugcaguaucuuccccugacuccagccacaaagcucauacccagcccuaccaaucaugaac

SEQ ID NO: 24256 - RNA, 64 nt, hsa
auggaucaauuccuugcaagaugcauucucucaaagcucauaaaagguagaucucaguaggcau

SEQ ID NO: 24257 - RNA, 64 nt, hsa
uacuagggaaauuuuaaaauuaggaaaugcugauagcucauauuauaaauuucuaaauccuagg

SEQ ID NO: 24258 - RNA, 64 nt, hsa
ucguuuguugcagcugucagcuaacauuugguugagcucauauaauccaaaccuaauuguccaa

SEQ ID NO: 24259 - RNA, 64 nt, hsa
ccagcccuggggcugggccccccagcucaggggcagcucauagaguccccccucccaccuccag

SEQ ID NO: 24260 - RNA, 64 nt, hsa
ggugcucucuugaaaucuuaaauaugauuauuugagcucauauaagguggauuggagcagauaa

SEQ ID NO: 24261 - RNA, 64 nt, hsa
auagagagauuaaguaacuugccugaggucacucagcucauaaauugcacuuuagggauugugc

SEQ ID NO: 24262 - RNA, 64 nt, hsa
uggagaggcaucaggagaggucucguucgucuccagcucauaaaauguagcagcaucauccuug

SEQ ID NO: 24263 - RNA, 64 nt, hsa
cugacuaccaaauggagugacgguugaagaaucaagcucauaauaugauacacccagacagacc

SEQ ID NO: 24264 - RNA, 64 nt, hsa
cccuaagggcgcagcuucggagcaggaucuguccagcucauacuuuccuucgcugucccucccg

SEQ ID NO: 24265 - RNA, 64 nt, hsa
cuugaacuugggaggcggagguugcagugagcugagcucauaccacugcacuccagccugaaca

SEQ ID NO: 24266 - RNA, 64 nt, hsa
ucuuuggaugggccuuuuagaaaccucauuggccagcucauaaaauggaagcaauugcucaugu

SEQ ID NO: 24267 - RNA, 64 nt, hsa
guaggaugcucacuacaaccauaggugggguuucagcucauaucuuaaagauaaaagguacuau

SEQ ID NO: 24268 - RNA, 64 nt, hsa
agacuugagaacuacgaggaacauggcagccucuagcucauacuugucguuguacaauugagau

SEQ ID NO: 24269 - RNA, 64 nt, hsa
auuuguuuaauuaaauuuaacucugguuucuaccagcucauacaaaauaaaugguuucugaaaa

SEQ ID NO: 24270 - RNA, 64 nt, hsa
gcugccccagcugacuuggaggcccuggcucaggagcucauagauggaggaggugugggcugac

SEQ ID NO: 24271 - RNA, 64 nt, hsa
aucucucacuugucuuccacuuugaaccgguuaaagcucauagcugucagcucugaaugaggag

SEQ ID NO: 24272 - RNA, 64 nt, hsa
cuccaggaaggccaucugacccugugacaggcauagcucauaaacuaccccucccugggauccc

SEQ ID NO: 24273 - RNA, 64 nt, hsa
agaucuuuguugagaaccacuacuaucauucacuagcucauaucugccggcagcaauugaagag

SEQ ID NO: 24274 - RNA, 64 nt, hsa
ugccuaauuuacacccacauuuuuuccaagauucagcucauauggcaucuguccucgacuaacc

SEQ ID NO: 24275 - RNA, 64 nt, hsa
uaccuaauuuacucuuauacuuuugucgacauucagcucauauggcaucuguucuugauuaacc

SEQ ID NO: 24276 - RNA, 64 nt, hsa
cucucuucuauccccagaaacuuucagaggaagcagcucauagaaacauacaaaagcacacaag

SEQ ID NO: 24277 - RNA, 64 nt, hsa
cagauguuucuauuuugggcaccauaacuauuugagcucauauuuuuauaauucugauugagaa

SEQ ID NO: 24278 - RNA, 64 nt, hsa
ucugcaggccuaggugcagcuccucagcggcuccagcucauaugcugacagcucuucacagucc

SEQ ID NO: 24279 - RNA, 64 nt, hsa
auaauaaggcuaagugggagaguaccuguucaauagcucauauaucgaguacccugucauacag

SEQ ID NO: 24280 - RNA, 64 nt, hsa
cuuuugagucuugaggggauagcggaaaaagcugagcucauaggugcccagccagccucccagc

SEQ ID NO: 24281 - RNA, 64 nt, hsa
augagcaacacaaauuuuacucugaagucagaagagcucauauauaauaauucuaaugucccac

SEQ ID NO: 24282 - RNA, 64 nt, hsa
uuacugaugagaaugacauacauccuuuccauuuagcucauaagcacggcuaucuuuuuaagag

SEQ ID NO: 24283 - RNA, 64 nt, hsa
ugaccauucugggucuaagacuguuucaaagaagagcucauagacugacugguccagaagacag

SEQ ID NO: 24284 - RNA, 64 nt, hsa
aagggcugugcuacacuucccaguuacauucugaagcucauaaauguaugagaagguuugugau

SEQ ID NO: 24285 - RNA, 64 nt, hsa
ugcaguuuguagcagaaugguauuuuccucaaguagcucauaauacugccaaaucucaaaaguu

SEQ ID NO: 24286 - RNA, 64 nt, hsa
gcccggcuuuccccauauccacaugcagagggcgagcucauaaaacuacagggaagcgugaaau

SEQ ID NO: 24287 - RNA, 64 nt, hsa
cugcccagggcacuguccccauuuucccacacacagcucauaugcugcauucgugcagggggug

SEQ ID NO: 24288 - RNA, 64 nt, hsa
ccuccaucaccccaaguccuugggcccaguugggagcucauaucuaacacagagacacauugca

SEQ ID NO: 24289 - RNA, 64 nt, hsa
uuccucaaauauaaggaggaagauaccaauuaaaagcucauaguaucaacugcccuucuugugu

SEQ ID NO: 24290 - RNA, 64 nt, hsa
augaggcuaaaugguacugauucucaaaacaaggagcucauagucuaaaaccauuuuucuuucu

SEQ ID NO: 24291 - RNA, 64 nt, hsa
cuuguuauuggccuaugaacuaaaagcaaaucaaagcucauaaaucaaagcucaucaguuccca

SEQ ID NO: 24292 - RNA, 64 nt, hsa
acugaacucuauaaacguaaaugcugcuuuuuguagcucauauaaaaaagguuccauauuugua

SEQ ID NO: 24293 - RNA, 64 nt, hsa
uucaucugcuguccacguauuucacuugacugaaagcucauaugaguuaaaaugucccuucuuc

SEQ ID NO: 24294 - RNA, 64 nt, hsa
auguucuaagaauuccauuugccucuaugaucuuagcucauaaaaauauaauaugacuugauaa

SEQ ID NO: 24295 - RNA, 64 nt, hsa
ccacuuucuucuuaugucagauugugcugguucuagcucauaauaaugaaaaaaauagaauuau

SEQ ID NO: 24296 - RNA, 64 nt, hsa
cuaucuuuuuauuaucugagccuuuuccuaaugcagcucauaggugcuagcuagagcugcugcu

SEQ ID NO: 24297 - RNA, 64 nt, hsa
aacaaugaagacugaauuaaauuaaaaauguugcagcucauaaagaauugggacucaccccuac

SEQ ID NO: 24298 - RNA, 64 nt, hsa
uucuaggguucuuggaaagauaaggaccagaacaagcucauagcaaauugaggggcagagauuu

SEQ ID NO: 24299 - RNA, 64 nt, hsa
uaaaauauuggggggauagaaaaauaaugcuguuagcucauacuuccaugaaaauguauauauu

SEQ ID NO: 24300 - RNA, 64 nt, hsa
gaccccagcagagaugccagaaugggggaggcacagcucauagccacacacccagggccugacu

SEQ ID NO: 24301 - RNA, 64 nt, hsa
cuuuuaacucggacaucacccuccugaggcccucagcucauacgggcagacugcucaggcguga

SEQ ID NO: 24302 - RNA, 64 nt, hsa
uuuuuaugugaauucuaccuaaacaugcuauuacagcucauauauacuuuuuccaucuggauuc

SEQ ID NO: 24303 - RNA, 64 nt, hsa
uguuauuuauugguauugacuucuuauuagacagagcucauaguauuuguuuucugcuccgaac

SEQ ID NO: 24304 - RNA, 64 nt, hsa
acuuuuauuucgccucucuccuuggcugccaggaagcucauagcuauuuauacucagaaaguuu

SEQ ID NO: 24305 - RNA, 64 nt, hsa
gauggcuccccaaggucauucauaucucgguuugagcucauaucuuauaauaacacaaaguagc

SEQ ID NO: 24306 - RNA, 64 nt, hsa
aacuuuccagggauccagggacacuuuuuuuuaaagcucauaaacugccaagagcuccauauau

SEQ ID NO: 24307 - RNA, 64 nt, hsa
auuaggugaauauuacucauuuucccucaagagaagcucauaagugugugugggugugagagca

SEQ ID NO: 24308 - RNA, 64 nt, hsa
uucaucaaauggagugguuuaaaacugaucaagcagcucauaauaaugaauuccugcucugucu

SEQ ID NO: 24309 - RNA, 64 nt, hsa
ugaucucaauguguaaaaugacagagauguaacaagcucauaggguaucaauaucucuuauugu

SEQ ID NO: 24310 - RNA, 64 nt, hsa
ucacuugcucaacaccagacuuuaaucugacuguagcucauaagacccucauuccagagagggu

SEQ ID NO: 24311 - RNA, 64 nt, hsa
acugagaggugaggugacuugccuggggccacauagcucauaagcuguagaacucugcaggcag

SEQ ID NO: 24312 - RNA, 64 nt, hsa
aagccuguaaagaauaccccugcuauuuaaauaaagcucauaccaagagguaacauuuugcccc

SEQ ID NO: 24313 - RNA, 64 nt, hsa
uuggaaucaauucugcacaauagcccaugcuguaagcucauagaagucacuguaacuguagugu

SEQ ID NO: 24314 - RNA, 64 nt, hsa
cucucccuuguggacccugguaaagaaaagccucagcucauagugaacacagcagaccuagaaa

SEQ ID NO: 24315 - RNA, 64 nt, hsa
gagaggauaaacaaagaaaaaagaaaaaaaaauaagcucauacccaaauucacaaagccuauuu

SEQ ID NO: 24316 - RNA, 64 nt, hsa
ccuucacacuccuaguuuaggauugauguguccaagcucauagggaagaaagagcugcagcugg

SEQ ID NO: 24317 - RNA, 64 nt, hsa
ccgaaaggaugaagaguuagaccccauggacccuagcucauacucagacgccccccgguaagug

SEQ ID NO: 24318 - RNA, 64 nt, hsa
cuaauguuuuaaaaggcacuaguuuuaagugcacagcucauaaauucugcugacauuuuggauu

SEQ ID NO: 24319 - RNA, 64 nt, hsa
cccagcugguguaauaaugaauuguuuaaaaaacagcucauaauugaugccaaauuaaagcacu

SEQ ID NO: 24320 - RNA, 64 nt, hsa
acuggaaacaucugauuucugaacuaucagggcaagcucauagcacauguuuuacaaagaaaca

SEQ ID NO: 24321 - RNA, 64 nt, hsa
gaaacugaaacuacugcaccauuuaaaaacaggcagcucauaagagccacaggucuuuauguug

SEQ ID NO: 24322 - RNA, 64 nt, hsa
auuuuuuugaaacuugaacuuagcagcaaaauagagcucauaaagaaauagugaaaugaaaaug

SEQ ID NO: 24323 - RNA, 64 nt, hsa
gacugagaaaauguaagcagacagugccacaguuagcucauacagugccuuugagcaaguuagg

SEQ ID NO: 24324 - RNA, 64 nt, hsa
uauaagcaagcaauaucauaguaauuggcagauuagcucauauucuauacagcaucguuuaaau

SEQ ID NO: 24325 - RNA, 64 nt, hsa
aaaacaaaaaaaaacaaaugacaaagaaugugauagcucauauuuuagaaauggcuuuauaaau

SEQ ID NO: 24326 - RNA, 64 nt, hsa
ugggaaucccuuccuuguguccuuaccaaaugauagcucauaaaacucugauaauguaacaaau

SEQ ID NO: 24327 - RNA, 64 nt, hsa
uuugugcccuucugcuucccccauucccuuccacagcucauagcucgucaucucggcccuuguc

SEQ ID NO: 24328 - RNA, 64 nt, hsa
uucugucacaaugcuaagugguauccgagguucuuaauaugagauuuaaaaucuuaaaauguuu

SEQ ID NO: 24329 - RNA, 64 nt, hsa
uguuggcaacauugaguuuuggaguugauugagauaauaugacuuaacuaguuuugucauucca

SEQ ID NO: 24330 - RNA, 64 nt, hsa
aauugcccucauacuuaauaauauggucugcauuuaauaugaaagguguuuuauugauaaaucu

SEQ ID NO: 24331 - RNA, 64 nt, hsa
agagcacacaguagaaaaacuuuagcuucauuaguaauaugacacauguauauagugagauguc

SEQ ID NO: 24332 - RNA, 64 nt, hsa
cuuuggaaacucugcaaugcacugaagacaucuguaauaugauguuaccaaagcaguuuacaua

SEQ ID NO: 24333 - RNA, 64 nt, hsa
uccuauuucaacaaauaguugcugcaagaauuuuuaauaugacucuauaaaagcucuuuaguac

SEQ ID NO: 24334 - RNA, 64 nt, hsa
uuaauuuccuuaaaucuuuuuguauucagauagauaauaugaaucauuauggguugauucagaa

SEQ ID NO: 24335 - RNA, 64 nt, hsa
aucauuuuaguuacacuaaacacuuuuggcagcuuaauaugaccuuuuuaaauuuuuuuuauuu

SEQ ID NO: 24336 - RNA, 64 nt, hsa
guggauggggaaaauguuuuaaaauccaguuauuuaauaugaguuugagagagaaaauuguuuu

SEQ ID NO: 24337 - RNA, 64 nt, hsa
auauguguauaagucugucaugugcuaaacaaaauaauaugaaagaccuaguuaaaaauucuaa

SEQ ID NO: 24338 - RNA, 64 nt, hsa
uucaggccaguuugauacuggcuguccuuaauucuaauaugagaguaggacaucauacuaaaug

SEQ ID NO: 24339 - RNA, 64 nt, hsa
aagugauuuuauuuuugcaaaauaaguuuuucuuuaauaugauucuaguacauaauugauuaaa

SEQ ID NO: 24340 - RNA, 64 nt, hsa
caauuuuagaaauaaauuaaaaauuaaauaaaacuaauaugaacauaaagaggaaauaaaaggu

SEQ ID NO: 24341 - RNA, 64 nt, hsa
auaauuauggcaaaguagacauuuauguucuaauuaauaugauuacagagaaggcuuuuucuca

SEQ ID NO: 24342 - RNA, 64 nt, hsa
uaugugugauguacuuaaaggaauaauaaaugcauaauaugaggucaguggacgccauuuucug

SEQ ID NO: 24343 - RNA, 64 nt, hsa
ccugugauucuccuuguaagaauuaaaugcucucuaauaugauaucccuuuaauuugaccauug

SEQ ID NO: 24344 - RNA, 64 nt, hsa
gucacuuaaaaugugcaguaauagcacugccaggaucaagcaugaaaggcuuuuaaauuagauc

SEQ ID NO: 24345 - RNA, 64 nt, hsa
guauaccggaauuacuuuuuuccaauuuuagaaaaucaagcagguuagagaaaauagagaugaa

SEQ ID NO: 24346 - RNA, 64 nt, hsa
cuauuguuuaaagagaaggugcauuuguuccucaaucaagcaagagcaccuguguuguacugcu

SEQ ID NO: 24347 - RNA, 64 nt, hsa
aaagggcccacucuaguucucuacaugucaaucaaucaagcauguugaauaagggacauagagg

SEQ ID NO: 24348 - RNA, 64 nt, hsa
acaguuguuucaaaugccauuaguauagcaagccaucaagcauuaauugacauuacaguuaaau

SEQ ID NO: 24349 - RNA, 64 nt, hsa
aaagccuuuagugggcagucaccacuuauucaccaucaagcaauccauaguauagggaaacuug

SEQ ID NO: 24350 - RNA, 64 nt, hsa
acaguuguuucaaaugcagugaguauagcaaaccaucaagcauuaauugacauuagagucaaau

SEQ ID NO: 24351 - RNA, 64 nt, hsa
aaacccuuuagugggcagucaccacuuauucaccaucaagcaauccaugguauagggaaacuug

SEQ ID NO: 24352 - RNA, 64 nt, hsa
aagcagagacuuacaugagugaaaggguugccucaucaagcagcucaguguaaauggggaggcu

SEQ ID NO: 24353 - RNA, 64 nt, hsa
cacuuguuucaucaaauggagugguuuaaaacugaucaagcagcucauaauaaugaauuccugc

SEQ ID NO: 24354 - RNA, 64 nt, hsa
ggggccagggguauuugcauucauacauugugucaucaagcauuccuugagcgccuacugggca

SEQ ID NO: 24355 - RNA, 64 nt, hsa
cagcuggacccugcaggguggcucccuccuccccaucaagcacaagagagggcccaggaaaaaa

SEQ ID NO: 24356 - RNA, 64 nt, hsa
uugugugcuuuaaacaaaauaccuuggguugaugaaacaucaacccagugcuaggaauacugug

SEQ ID NO: 24357 - RNA, 64 nt, hsa
ggaugcaauuuauguugugugccagucuggucccaaacaucaauuucuuaacaugagcuccagu

SEQ ID NO: 24358 - RNA, 64 nt, hsa
auuuagaaaucauuuugcaaucccuuaauauccuaaacaucauucauuuuuguuguuguuguug

SEQ ID NO: 24359 - RNA, 64 nt, hsa
gggauuacagguguaagccaccgugcccagcccuaaacaucauucuugagagcauugggauauc

SEQ ID NO: 24360 - RNA, 64 nt, hsa
cuggacagagaggguaacaggaggagucggggauaaacaucaaacaucaaucguguguccugau

SEQ ID NO: 24361 - RNA, 64 nt, hsa
gagaggguaacaggaggagucggggauaaacaucaaacaucaaucguguguccugauuugggag

SEQ ID NO: 24362 - RNA, 64 nt, hsa
uauggaaaagccauuuauaucugcucacauguaaaaacaucaguucauacuuaauaaaaugcaa

SEQ ID NO: 24363 - RNA, 64 nt, hsa
uggaaaaacauuuuuucaaaaacuacagcuuggaaaacaucagagaguucauacuaaaauauau

SEQ ID NO: 24364 - RNA, 64 nt, hsa
accugcuuaguuaauuggcucagaauuuuaauauaaacaucacacuuuaauuuggagcauagua

SEQ ID NO: 24365 - RNA, 64 nt, hsa
gugcuaaaugcucuguaugucacuacauaugaaaaaacaucaaaaaacaauuagcauuggacau

SEQ ID NO: 24366 - RNA, 64 nt, hsa
acauugucaagcuguuuguuuacucuuucuuugaaaacaucaccuucugaaauuugucuuuuag

SEQ ID NO: 24367 - RNA, 64 nt, hsa
aggaaguugacuguaugucugcuaguuagauucaaaacaucauaaagaugauagcaugucaaua

SEQ ID NO: 24368 - RNA, 64 nt, hsa
uggaacguuuauaugcaauuaacaugcauaugaaaaacaucacuuacguucucccacccauaga

SEQ ID NO: 24369 - RNA, 64 nt, hsa
cagguuuguguuuuaacauuccacuuaugccuugaaacaucauuucuugauaacuuuuugauac

SEQ ID NO: 24370 - RNA, 64 nt, hsa
uauuugagugcuuuuucuuaauaaguauaaccuuaaacaucagcuaauacaccuggugugcauu

SEQ ID NO: 24371 - RNA, 64 nt, hsa
uggaaaugccuuuuguggcaacucagacuucauuaaacaucaguguguuucuagccaauuggaa

SEQ ID NO: 24372 - RNA, 64 nt, hsa
ugcagaggacaaggcuggaggcauuugucaucacuacagauaugcaacuaaaauagacguggag

SEQ ID NO: 24373 - RNA, 64 nt, hsa
ugugcuuguggaucaccugaggauccugugaaaauacagauacugauucagugggucugcguag

SEQ ID NO: 24374 - RNA, 64 nt, hsa
caaaagaacaaauaguaaaauccaaaguauuaauuacagauaacuuuucaaaaauucaucauuc

SEQ ID NO: 24375 - RNA, 64 nt, hsa
ggagaaacagagugaggccuuuuuaaccugagauuacagauacuuauaaaacccucuauaaaua

SEQ ID NO: 24376 - RNA, 64 nt, hsa
uccgaccaagcccacuggaauuauccuuuaauuuuacagauaccacuugcuguaggcuguggac

SEQ ID NO: 24377 - RNA, 64 nt, hsa
gcacuuggauuauggaucugaauagagaaaugcuuacagauaaucauuagcccacauaccagua

SEQ ID NO: 24378 - RNA, 64 nt, hsa
caauguugcaaggcuuuuaucccugaaaaucauuuacagauaaccacaauuugcugugguauau

SEQ ID NO: 24379 - RNA, 64 nt, hsa
aaugauaaaauuuaagauuuuucuaauaaaagaguacagauaaugggacaguugagagagaugg

SEQ ID NO: 24380 - RNA, 64 nt, hsa
gguuguuccauuccugaauaugcaggcuaauuuguacagauagggauuaaggaauacagacuau

SEQ ID NO: 24381 - RNA, 64 nt, hsa
uucucaauuuuacugaguaggcacagaagaaaaguacagauaggcugaugguuauugccuuauu

SEQ ID NO: 24382 - RNA, 64 nt, hsa
agaucauuugaaauuucuggcugccuuacuuguuuacagauaguuuaagacuauuuaaauuucu

SEQ ID NO: 24383 - RNA, 64 nt, hsa
caaaacugaaguaucugugugcuuccagaaagcuuacagauaaauggguuucaagcacaagaau

SEQ ID NO: 24384 - RNA, 64 nt, hsa
aguggacuuguuuuaauuuuagagaaacuuugaguacagauacugugagcuuacauugaaaaca

SEQ ID NO: 24385 - RNA, 64 nt, hsa
auaguuuucuagaugacauaaaauuuacauuuaauacagauaaguguucuucaguguaauguga

SEQ ID NO: 24386 - RNA, 64 nt, hsa
uuaguuauauuuaaaaauauuuuuuuaaauucuuuacagauaauauuauacuuguuacccuuca

SEQ ID NO: 24387 - RNA, 64 nt, hsa
cagucggcaauuucuuggccauggauguagaaccuacagauaaggugagccaacugcauuagga

SEQ ID NO: 24388 - RNA, 64 nt, hsa
uacuuuccauacaacgaaucuauuauucccaucuuacagauaaaacaacugaggcucagggaga

SEQ ID NO: 24389 - RNA, 64 nt, hsa
uguuuuauauuugaccaaaauauucugguuuagauacagauauuuacagaaaguagggaggaag

SEQ ID NO: 24390 - RNA, 64 nt, hsa; identical to SEQ ID NO: 24377

SEQ ID NO: 24391 - RNA, 64 nt, hsa
uucuaccaagcccauuggaauuauccuuuaauuuuacagauaccacuugcuguaggcuacggac

SEQ ID NO: 24392 - RNA, 64 nt, hsa
uaucaguuauguaggaccuuuggacccaggguccuacagauagauauggugugcccagauuuua

SEQ ID NO: 24393 - RNA, 64 nt, hsa
ccaaccagauguuacuggucugugaggaaauaaguacagauacugacaggaagcuuuuauaaac

SEQ ID NO: 24394 - RNA, 64 nt, hsa
uuuaguuuuacuccugauagguagaugcagcucuuacagauauuuacuugguaaagugcagugg

SEQ ID NO: 24395 - RNA, 64 nt, hsa
auuuuuuuacucacguaccuguuacacuuuagcauacagauagaucauagaucacguuacaagc

SEQ ID NO: 24396 - RNA, 64 nt, hsa
ucuauauacagauaucuauaucuauauauauauauacagauauauauauaugacgcgucacaga

SEQ ID NO: 24397 - RNA, 64 nt, hsa
ccccaaaaacacaaaaaaagaaaaucuaucuauauacagauaucuauaucuauauauauauaua

SEQ ID NO: 24398 - RNA, 64 nt, hsa
uggauguggguaaacuaagguaaaggggaugauauuccacaaacuaauuaugcacacagaaaau

SEQ ID NO: 24399 - RNA, 64 nt, hsa
gucucuuuucuuacucuggcaaaccugugagugauuccacaaagauacaguauuacuuagcuau

SEQ ID NO: 24400 - RNA, 64 nt, hsa
cugaaucuuguaaaauuauaacuucauuaaauguuuccacaaguauuucugagauacaauauuu

SEQ ID NO: 24401 - RNA, 64 nt, hsa
accauguagccugaaguuuuucuuagauccuuauuuccacaaauauuuugcauuuuuaggaggu

SEQ ID NO: 24402 - RNA, 64 nt, hsa
gagguugggugaaagagugcaucuccucccaggauuccacaacaaaauucuuaucuuccaugga

SEQ ID NO: 24403 - RNA, 64 nt, hsa
uuucgcuuuccuucuucuuggcuuccucuuauucuuccacaaaccauucucaauaaagccaaaa

SEQ ID NO: 24404 - RNA, 64 nt, hsa
gggugacgagcaaaacuccaucucaaaacaaaaguuccacaaccagccuggaguguguagcccc

SEQ ID NO: 24405 - RNA, 64 nt, hsa
caacauuguaaugacaaaauaaauucccgugaaguuccacaaccaggccgggcaugguggcuca

SEQ ID NO: 24406 - RNA, 64 nt, hsa
gccaaugauugccucugauucuuguaaguuugaguuccacaagggcuaauuuauuccccuuuua

SEQ ID NO: 24407 - RNA, 64 nt, hsa
ucauaaaaaguuaugugauuuccuccucugucuuuuccacaacauaggacuuugaauagcaaug

SEQ ID NO: 24408 - RNA, 64 nt, hsa
gcucuucugcuucucacucuuguauuaagaaggauuccacaaagggagaguggcaucccugcug

SEQ ID NO: 24409 - RNA, 64 nt, hsa
ugaccagccugcuuacagggagcgugaagcgcuuuuccacaauggcaagguccggacaagacaa

SEQ ID NO: 24410 - RNA, 64 nt, hsa
cuuuagcuagccaaauuguccuugaauuuggguuuuccacaaccucaaaggguuauuugaaauc

SEQ ID NO: 24411 - RNA, 64 nt, hsa
ugaauuuagcaccaauugcauuaacgcacaucucuuccacaacuaacagacuuaaaauaacagu

SEQ ID NO: 24412 - RNA, 64 nt, hsa
gccagauauucaguacucgaucucaauuccccucuuccacaagaguugggugaccagcuguccu

SEQ ID NO: 24413 - RNA, 64 nt, hsa
uugucuccgauagcuccccacaucucuaauugacuuccacaaaaucgaugcguugcuuugguau

SEQ ID NO: 24414 - RNA, 64 nt, hsa
aaggaaauaguaccuucaauacuuaaaaauagucuuccacaaaaaauacuuuauuucugaucua

SEQ ID NO: 24415 - RNA, 64 nt, hsa
cuugcuuuaguuuuuaagauuuguguuuuucuuuuuccacaaggaauaaaugagagggaaucga

SEQ ID NO: 24416 - RNA, 64 nt, hsa
cccuggcaugcaugcuggcggcggcaugccucccuuccacaagcccaugcugcugcagagggag

SEQ ID NO: 24417 - RNA, 64 nt, hsa
aaugaaguuuccauugcuuuguuugcuuuaaaaauuccacaauuaaaauaucugucauugaaag

SEQ ID NO: 24418 - RNA, 64 nt, hsa
uccugugcccugugguaguuggaaacaaaucauaauguauuauuuaaauguuuaacaucauugc

SEQ ID NO: 24419 - RNA, 64 nt, hsa
gauuucaguucaucaaaucaucauuaaugacuuuauguauuauuugcacagggagaauugaaac

SEQ ID NO: 24420 - RNA, 64 nt, hsa
uuguaccaaauguuuuccuuugguuuauucuuuaauguauuaauauuuuacugcuggucacuca

SEQ ID NO: 24421 - RNA, 64 nt, hsa
uguacuauuuuguaaugucuuuuuucauuuuacaauguauuaucaaccuuuucccucucaaaaa

SEQ ID NO: 24422 - RNA, 64 nt, hsa
aaaauuuaacaaauaguauuuucuuauagaagcaauguauuaaaugauuagauacacaggacag

SEQ ID NO: 24423 - RNA, 64 nt, hsa
caguaaaauuuuuuuagugguauucuguuuacagauguauuaggaccauugaugcauuacauuu

SEQ ID NO: 24424 - RNA, 64 nt, hsa
auucuuuucugaaaguauucaugaucugcauaugauguauuagguuaggucacaaagguuuuau

SEQ ID NO: 24425 - RNA, 64 nt, hsa
ggaacaucuugagauaugucucaagaauauaaagauguauuauuuuaagccaaggagcugaaau

SEQ ID NO: 24426 - RNA, 64 nt, hsa
gagggaggacaucauaaggaaguuauuaacgggcauguauuaucacaucaagcaugcaauaaug

SEQ ID NO: 24427 - RNA, 64 nt, hsa
aaaggggagauacucucccugacauuucuaacauauguauuaagccaaacaugagugaauagcu

SEQ ID NO: 24428 - RNA, 64 nt, hsa
guauuuuaacauucaccucuuauuuuauauugaaauguauuacaguauuaaaacucaguguuca

SEQ ID NO: 24429 - RNA, 64 nt, hsa
cuaaacauuguaucaugguuucaguauguuauucauguauuacugggagaugcuaccaagaaac

SEQ ID NO: 24430 - RNA, 64 nt, hsa
gguauuacuuaaaccaauauuauaaguagauaacauguauuaguauuuuugucuguauguccua

SEQ ID NO: 24431 - RNA, 64 nt, hsa
uuuuuggguaauaagaaugguugagugcaacaucauguauuaauaucaaaugaaagacaagggu

SEQ ID NO: 24432 - RNA, 64 nt, hsa
caauaaugguuugguucacuuuaugaaaaauaaaauguauuaaaauauaguuuaaaugcuguuc

SEQ ID NO: 24433 - RNA, 64 nt, hsa
uaggaaagaguaagacuguuaagaagaccgaagcauguauuaaugcuguggcuaugagaggccu

SEQ ID NO: 24434 - RNA, 64 nt, hsa
gauaucugugauacugaaacuugaggauguugaaauguauuacauuuuggcuucuuucuacaug

SEQ ID NO: 24435 - RNA, 64 nt, hsa
uagucauuuguaaauucuaaauggucaccauaaaauguauuagguaggagaagauacguuuuau

SEQ ID NO: 24436 - RNA, 64 nt, hsa
auagcaaaguaguacuucuucuguaauauuuacaauguauuaagcccacaguauauuuuauuuc

SEQ ID NO: 24437 - RNA, 64 nt, hsa
uuuacaaguuauaguacuagagauauuuuguaaaauguauuauguccugugagauguguaucag

SEQ ID NO: 24438 - RNA, 64 nt, hsa
aaucauccaauuaaauguggguagauuaaugaaaauguauuacaucaauauuaacucaucuaua

SEQ ID NO: 24439 - RNA, 64 nt, hsa
accuggauuugugcaauauguaaaaauguaucaaauguauuauagauaagguguuaggugcaaa

SEQ ID NO: 24440 - RNA, 64 nt, hsa
cccuguacagcuguaucucuauaaauauaauuccauguauuaauagucacagaaagacuguaag

SEQ ID NO: 24441 - RNA, 64 nt, hsa
cguccugguacuguauccucugacuuuauuuuccauguauuacaaaaggaaaaaaaaauugaga

SEQ ID NO: 24442 - RNA, 64 nt, hsa
ucauaauuucuaaaccauguauauguacguuuauauguauuauaauugcauacacaugccucca

SEQ ID NO: 24443 - RNA, 64 nt, hsa
gcauugugcccaaguaauaauaaaacuauuucagauguauuauaugauugagcaaaugagaaaa

SEQ ID NO: 24444 - RNA, 64 nt, hsa
gaaaaacauuuuagauauguauuacuauacaugaauguauuauacacacacacuuuagagauug

SEQ ID NO: 24445 - RNA, 64 nt, hsa
uuucaccgguuagugggagaaaaacauuuuagauauguauuacuauacaugaauguauuauaca

SEQ ID NO: 24446 - RNA, 64 nt, hsa
cuaacucaaaucauauguuuauuuguguaauaaaauguauuauucucccaaauuucaaggaaua

SEQ ID NO: 24447 - RNA, 64 nt, hsa
acauguugaauuuauuauuguuuauuuccaaggcauguauuauucaauuucuaauuaaaauaua

SEQ ID NO: 24448 - RNA, 64 nt, hsa
aacauguauuacucaaaguaauauauuuagaauuauguauuaguauaagaucagaauugaauuu

SEQ ID NO: 24449 - RNA, 64 nt, hsa
aaaccuauacuuaauauaguaaaucuaaguaaacauguauuacucaaaguaauauauuuagaau

SEQ ID NO: 24450 - RNA, 64 nt, hsa
uagcaugaaaaugguuuaaauaggcugguccuacauguauuagguucuuucaaguuugacuggg

SEQ ID NO: 24451 - RNA, 64 nt, hsa
aauuaaaucccaagggaaagugagaagaaaauuaauguauuagcaaccaguguuagccaacucu

SEQ ID NO: 24452 - RNA, 64 nt, hsa
cuaaagugucuaguuuuuugaaaugcaaagcuuuauguauuaacuugcugaugugguuuacaau

SEQ ID NO: 24453 - RNA, 64 nt, hsa
gaagcaaaacuuuuugaagaagcaccccucuuucauguauuaaaauaacacugagauuuuuuua

SEQ ID NO: 24454 - RNA, 64 nt, hsa
ccccucauuucaaggccagaguuauuuucuauuuauguauuagucuaggcugaucuuuuagggc

SEQ ID NO: 24455 - RNA, 64 nt, hsa
gcaccaucaaccagucagccauuauuauuuauauauguauuaccaaaagcagucuaucugccug

SEQ ID NO: 24456 - RNA, 64 nt, hsa
gacaacuucuaccguaugaauauauauuauauuuauguauuauauuuuguacaauaguugaucu

SEQ ID NO: 24457 - RNA, 64 nt, hsa
auuauuaucuagauuacuuuaagccuuuuaucugauguauuaucagugaaaaccaugcugcuua

SEQ ID NO: 24458 - RNA, 64 nt, hsa
aaaagucuggaaacuuucauaucaauaauugauuauguauuaacugaaacaaaagacuagagaa

SEQ ID NO: 24459 - RNA, 64 nt, hsa
aaaagacuagagaaagacacagugggaauugauuauguauuaacugaggaauaaaagacugaag

SEQ ID NO: 24460 - RNA, 64 nt, hsa
ggggcaaugugucuccacagcgaccguggcagccauguauuacagcuacuacaugcuaccggac

SEQ ID NO: 24461 - RNA, 64 nt, hsa
uguauauuuguaaauauaucauguuucugugaaaauguauuaugaaauaaaaugggaggaaaca

SEQ ID NO: 24462 - RNA, 64 nt, hsa
auaauauuacauaguaguaugcuuaggcuuuacuauguauuagccuuuuguuggacuguguaug

SEQ ID NO: 24463 - RNA, 64 nt, hsa
gauaacauaguacucuaacuaaagucuccaaguuauguauuauaauauuacauaguaguaugcu

SEQ ID NO: 24464 - RNA, 64 nt, hsa
ugaggggacccuguuaggagagcauagcaucaugauguauuagcuguucaucugcuacugguug

SEQ ID NO: 24465 - RNA, 64 nt, hsa
gacauuccucaagauauuuaauaucaacugcauuauguauuaugucugcuuaaaucauuuaaaa

SEQ ID NO: 24466 - RNA, 64 nt, hsa
augaguuauauccuggcucaguggagugauauuuauguauuauuuuuacuuuucucucaguguc

SEQ ID NO: 24467 - RNA, 64 nt, hsa
gauggccaucugcuggaaacuccugaagagcauuauguauuacagugagcaguuguauugccug

SEQ ID NO: 24468 - RNA, 64 nt, hsa
aauuucaucauuucugaaaauguacuguuuuagaauguauuacaauaucaaugugaauaucuug

SEQ ID NO: 24469 - RNA, 64 nt, hsa
caugcuuuuuaugacuaugccuaauguaaagaaaauguauuacauucuguauguacaaagauua

SEQ ID NO: 24470 - RNA, 64 nt, hsa
cauguacuuauuuaaagcugcugucauuuaaacaauguauuaccaagugaauaaaucaagcagu

SEQ ID NO: 24471 - RNA, 64 nt, hsa
cagcauaacaacacaacacuugagcuccuagccaauguauuaaguaaggaaaacaaguaucaac

SEQ ID NO: 24472 - RNA, 64 nt, hsa
cacuguuggaaacauuuauucagauauggcucuaauguauuaggaagcacuaaauggccuaaaa

SEQ ID NO: 24473 - RNA, 64 nt, hsa
aguuucuuuaauaaauuaaauuuuauuguguaaaauguauuauuacauaaaauguguuuuugaa

SEQ ID NO: 24474 - RNA, 64 nt, hsa
aucuuugauaacagggauugauuuuaaaauguacauguauuaaauuacauuuguaauuuaaggu

SEQ ID NO: 24475 - RNA, 64 nt, hsa
uucagaaguuuaaauauuaagcaugacagaaaauauguauuaacacuacucaaagcaaaagugc

SEQ ID NO: 24476 - RNA, 64 nt, hsa
uauuuaauuuugugaaacuuaaucaucuuuuaaaauguauuauuugaagaguauuuuauuucug

SEQ ID NO: 24477 - RNA, 64 nt, hsa
uuacauagucuuaagcauuuuugcaauuuuuuaaauguauuaauagagucaauggaacuuuaaa

SEQ ID NO: 24478 - RNA, 64 nt, hsa
gccucagggaagacaguaaucaugccuuuucuuuaaaagacacaauaggacucgcaacagcauu

SEQ ID NO: 24479 - RNA, 64 nt, hsa
ccacuuuagguuccuuggcuggggccccuauaacaaaagacagauugacaagagaaaaacaaac

SEQ ID NO: 24480 - RNA, 64 nt, hsa
cuuagagcaauaaccacuuuuuaaauguaaaauaaaaagacaaaugaaaaggcacauccuuguc

SEQ ID NO: 24481 - RNA, 64 nt, hsa
uugagugaggcugaaggcuggguuugaaaaggcaaaaagacaagacauccaggcagggcuucuc

SEQ ID NO: 24482 - RNA, 64 nt, hsa
ugagccauggcacccggucuugguuuauauuuuaaaaagacaacuguguagcugggcguggugg

SEQ ID NO: 24483 - RNA, 64 nt, hsa
agacacaggcugugcucucagucuagugagggagaaaagacacacaguagcagaagagaacagg

SEQ ID NO: 24484 - RNA, 64 nt, hsa
ucuccucaaaugaaaauucuuuaucugaaauuuuaaaagacauugauuccacauguaaggauuu

SEQ ID NO: 24485 - RNA, 64 nt, hsa
aauacuaaggacaauuauuuuuauagacaaaguaaaaagacagauauuuaagaggcauaaccaa

SEQ ID NO: 24486 - RNA, 64 nt, hsa
accuuaaacauguggacccauaggugcaguuagaaaaagacaaccuauuuuuauuuauguuaga

SEQ ID NO: 24487 - RNA, 64 nt, hsa
aauccaaauaaacccugaauauuuaguaaguuuaaaaagacaaauugagaacaaguagacacac

SEQ ID NO: 24488 - RNA, 64 nt, hsa
guggugacacccauggguucucaacuguaaggaaaaaagacaccagacuuuuguucccuagugg

SEQ ID NO: 24489 - RNA, 64 nt, hsa
uauauuccugacagcccugacugccagguagagcaaaagacauugguggggguaugugaagcaa

SEQ ID NO: 24490 - RNA, 64 nt, hsa
aaaaauaauaagucgcugucaggugugcaugaagaaaagacacugaagcuaaaaaagacagcag

SEQ ID NO: 24491 - RNA, 64 nt, hsa
ucaggugugcaugaagaaaagacacugaagcuaaaaaagacagcagaacugcuauuuuucaucc

SEQ ID NO: 24492 - RNA, 64 nt, hsa
uuauuuuaaagucaaguugugagcaaauagaaauaaaagacaaaaggacaucacucuuaucaaa

SEQ ID NO: 24493 - RNA, 64 nt, hsa
uucuuuuuuauaaaaaaagagagaugggggagaaaaaagacaagagggaaaguauuucucuuga

SEQ ID NO: 24494 - RNA, 64 nt, hsa
agcguuucacauaaaaagcauagcagcagcucugaaaagacacuucacaguaaauaugucaaag

SEQ ID NO: 24495 - RNA, 64 nt, hsa
acaccaaaaaagugaaagagaaauugaaagggaaaaaagacaaaaagcauaaggcuccaaaacg

SEQ ID NO: 24496 - RNA, 64 nt, hsa
uguuuaaaacaggucuuugucuugcuauggggagaaaagacaugaauaugauuaguaaagaaau

SEQ ID NO: 24497 - RNA, 64 nt, hsa
ucccuagucuucaagcagauuggagaaacccuugaaaagacaucaagcacagaaggaggaggag

SEQ ID NO: 24498 - RNA, 64 nt, hsa
acaagacauccacauauugcauguuaaccagaagaaaagacaacauuuuccggaaauccacugc

SEQ ID NO: 24499 - RNA, 64 nt, hsa
ccuaguuaguuuccuauauauucaugccaucuugaaaagacagacuaugguguaaccaugauuc

SEQ ID NO: 24500 - RNA, 64 nt, hsa
ugaguggaauacuugguuucuuuucuuacuuaucaaaagacagcacuacagauaucauauugag

SEQ ID NO: 24501 - RNA, 64 nt, hsa
acuuacugcuuauauauauuugauuguaaaaacaaaaagacagugugugugucuguugagugca

SEQ ID NO: 24502 - RNA, 64 nt, hsa
acaacccagaaagguuuaaaaaacauaaggaaaaaaaagacaaauuaaaggaggggcuagggga

SEQ ID NO: 24503 - RNA, 64 nt, hsa
gggccucaaccaacuuagugacuuguuuagaaaaaaaagacaaaaaaguaaaaauaaaaacaaa

SEQ ID NO: 24504 - RNA, 64 nt, hsa
cccuucuaauguuugcauaauucugagaacugauaaaagacagcaauaaaagaccagugucauc

SEQ ID NO: 24505 - RNA, 64 nt, hsa
gguuauggaauggucucuuuuauccuaucacaaaaaaagacauagauauuuaggcugauuaauu

SEQ ID NO: 24506 - RNA, 64 nt, hsa
augacaggucaugcauuauccaaaaacaauaccaaaaagacauauuuuauaaaaugacaaaaaa

SEQ ID NO: 24507 - RNA, 64 nt, hsa
uauuuaauuuccaaccacacuucuuauuuuuuugaaaagacaauuuuccauuucaguauuacau

SEQ ID NO: 24508 - RNA, 64 nt, hsa
gaaaagacuaaugagaagauaacaugacaauauaaaaagacagaaacucaaaaaguauauucac

SEQ ID NO: 24509 - RNA, 64 nt, hsa
cguguugcugguuacuaaacuuuauggugucacaaaaagacaaaugauuguaggauccauggaa

SEQ ID NO: 24510 - RNA, 64 nt, hsa
ucagccuaagcguacgagugaaaacaaugaugucaaaagacaauagcaaguauaggcuacuauu

SEQ ID NO: 24511 - RNA, 64 nt, hsa
gaagcuagucucccaaaacacaaucuuuagagagaaaagacaugaacgaacuccaaaauaucca

SEQ ID NO: 24512 - RNA, 64 nt, hsa
ucacauagcauguacaauauauuuaugcuggcugaaaagacagaaucugggaauaauaaaauug

SEQ ID NO: 24513 - RNA, 64 nt, hsa
gauuauucagaacaaaauaaguagacaaaauaacaaaagacaggaaaauaagucucuuuguauc

SEQ ID NO: 24514 - RNA, 64 nt, hsa
ugugauugaaguggagagguacucuaggaauuuaaaaagacacaaaauuauuuuuuuccagacu

SEQ ID NO: 24515 - RNA, 64 nt, hsa
uaggaagcuuuuaaaagacacuaaauuguacucuaaaagacacuaaauuguacuaauuguacaa

SEQ ID NO: 24516 - RNA, 64 nt, hsa
ccuugaaaauguuuuaaauauuuaggaagcuuuuaaaagacacuaaauuguacucuaaaagaca

SEQ ID NO: 24517 - RNA, 64 nt, hsa
ugguccuaaaagcaaaauaaaaacuauucgaaugaaaagacaagaaaaucagguauuaaucuug

SEQ ID NO: 24518 - RNA, 64 nt, hsa
uguagauuguaugaguaagaaguauuaauuuuuuaaaagacaaaucaacuuugaagacacaaaa

SEQ ID NO: 24519 - RNA, 64 nt, hsa
gcaaggcauguuacuacuuuuaucaucuaaggaaaaaagacaagggaauuccagucaggcauua

SEQ ID NO: 24520 - RNA, 64 nt, hsa
ggagaccccaguugugccuuugcuacagaucuggaaaagacaaggucaugggggccuccagugu

SEQ ID NO: 24521 - RNA, 64 nt, hsa
cacaaagacauggaagguuagagguuugucaacaaaaagacauggaagguuagguuugucaaca

SEQ ID NO: 24522 - RNA, 64 nt, hsa
agacacugggagaagagaaccucaaacuaggaggaaaagacagagccuccacuuaguuuuggga

SEQ ID NO: 24523 - RNA, 64 nt, hsa
uagaacuauuagagggggaugugauggaugggacaaaagacagcaguagccauuuguauugacu

SEQ ID NO: 24524 - RNA, 64 nt, hsa
uuuauugauuacaagggcuguauacgggguuacaaaaagacaugagcuggauuggacacuccua

SEQ ID NO: 24525 - RNA, 64 nt, hsa
gaagaaugauacuguuuaugaugaauccauagugaaaagacagugaccucucuuucauccaguc

SEQ ID NO: 24526 - RNA, 64 nt, hsa
uccucuguucugaaucuggggaaguaguaaaccaaaaagacagggaaaaccagauauuuagagu

SEQ ID NO: 24527 - RNA, 64 nt, hsa
aaggcaaauugaaaauuagaaugguugugguuuaaaaagacauuaagugaauucuagguagcuu

SEQ ID NO: 24528 - RNA, 64 nt, hsa
aaagugacacuucaaaagugugcuuacauuuuuaaaaagacaaauaaaaacaguguuuuauagu

SEQ ID NO: 24529 - RNA, 64 nt, hsa
uggaucugugacugauugaaaugcaugcaaauaaaaaagacaauauuaaagucuguuaucaaac

SEQ ID NO: 24530 - RNA, 64 nt, hsa
uguguuaagaguuuaauuuuuuuguuaucauuaaaaaagacaggauuauaaagagauaucaaag

SEQ ID NO: 24531 - RNA, 64 nt, hsa
agacuuuuccugcacuggacaguaaaaaaauaauaaaagacaaaaacaaauuuaaaaaaaaauu

SEQ ID NO: 24532 - RNA, 64 nt, hsa
uugaaugucccuuccaacuuuuauauuaaaaauaaaaagacaagaaaauugaagaucauuuuuc

SEQ ID NO: 24533 - RNA, 64 nt, hsa
uugucagccccuuccuuucccccgaccuaaacauaaaagacaaggcaaagcccgcauaauuuua

SEQ ID NO: 24534 - RNA, 64 nt, hsa
ccaagucuccccuuugaagacuuugaggccacagaaaagacaguuaaagcaaagaagagaagug

SEQ ID NO: 24535 - RNA, 64 nt, hsa
agagcgaaacucugucucaaaauaaauaaaaaauaaaagacagaaagcaaggggugccuaaauc

SEQ ID NO: 24536 - RNA, 64 nt, hsa
guuuuguuuggggggauauuuuucauaauuauuuaaaagacaggccgggcgcgguggcucacgu

SEQ ID NO: 24537 - RNA, 64 nt, hsa
acuguaaaaaaaaaaaaaaaaaaaaagacaaaacaaaagacaaaaaaaaaaaaaaaacccaaca

SEQ ID NO: 24538 - RNA, 64 nt, hsa
aggugauaaaaaacuguaaaaaaaaaaaaaaaaaaaaagacaaaacaaaagacaaaaaaaaaaa

SEQ ID NO: 24539 - RNA, 64 nt, hsa
cagaagagauuuaaaaaaaaaaaaggaaaaaaaaaaaagacauaaacuggcaccaguuaacuuu

SEQ ID NO: 24540 - RNA, 64 nt, hsa
ggggauucuugaacuugaaaaaaaaaaacacaaaaaaagacaaaaaaaaaaaaagaaaauauuu

SEQ ID NO: 24541 - RNA, 64 nt, hsa
guauuuaaaaauagaaacauaucaaaaacaagagaaaagacacgagagagacuguggcccauca

SEQ ID NO: 24542 - RNA, 64 nt, hsa
gaauauggacauaucaucuguggacugaccuuguaaaagacaguguauguagaagcaugaaguc

SEQ ID NO: 24543 - RNA, 64 nt, hsa
cauggggguggguuuccuggcaccuacaugaaaaaaaagacaaguuauaugggugaugaagaaa

SEQ ID NO: 24544 - RNA, 64 nt, hsa
agaaaaaaaaagacguauuuuugcuuacucagauaaaagacaaccuguaaaaauauaauaauua

SEQ ID NO: 24545 - RNA, 64 nt, hsa
ucacugucuuguuggacgagaaaacaauaacgauaaaagacagugaaagaaaauaacgauaaaa

SEQ ID NO: 24546 - RNA, 64 nt, hsa
auaacgauaaaagacagugaaagaaaauaacgauaaaagacagugaaagaaaauaacaauaaaa

SEQ ID NO: 24547 - RNA, 64 nt, hsa
auaacgauaaaagacagugaaagaaaauaacaauaaaagacaaggaaaaaauaacaaugaaagu

SEQ ID NO: 24548 - RNA, 64 nt, hsa
aaguucuuggacuuugccccgaaagcacauccauaaaagacaaaaucugauauauuggacuucu

SEQ ID NO: 24549 - RNA, 64 nt, hsa
caauaaaaacaaacaguccaauuagaaaaugggcaaaagacaugaauagauguuucacugaaga

SEQ ID NO: 24550 - RNA, 64 nt, hsa
acaagaacuuaagagaaaaagaaaccuacucaagaaaagacagaagagacagugauuugggaug

SEQ ID NO: 24551 - RNA, 64 nt, hsa
aggagaacauaagagaaaaggaaaccuguuacagaaaagacaagaaucuguguuuuggaaugag

SEQ ID NO: 24552 - RNA, 64 nt, hsa
ggugggguaauuaaauugccaccuucgugguuguaaaagacaaacaaaacauggcaaauuucau

SEQ ID NO: 24553 - RNA, 64 nt, hsa
gagggcuuuaaacaagugaauaauugcacaacuaaaaagacauuagaacugugugggcuauaag

SEQ ID NO: 24554 - RNA, 64 nt, hsa
ccauccaaaacaaauuccuccuucaaccuuauuuuuacuugaaauuugcuagaagaaauagcaa

SEQ ID NO: 24555 - RNA, 64 nt, hsa
ccacagucagaacaugcaaacuuuuuugaagaaauuacuugaauaaguaguuuucauguuuuca

SEQ ID NO: 24556 - RNA, 64 nt, hsa
ucucuuuuccuguuguauugacuauuuucguucauuacuugauuaagauuuuacaaaagaggag

SEQ ID NO: 24557 - RNA, 64 nt, hsa
uagugcaacuaugaauguacugcauguuaccaucuuacuugagccuuuaauggacuuauuucuu

SEQ ID NO: 24558 - RNA, 64 nt, hsa
ugugcauauacuggcaauaaaacuguacauaacauuacuugaaaaaguuaauaauguauaucag

SEQ ID NO: 24559 - RNA, 64 nt, hsa
guggaaccugguuuccuuuuaccaugaaauugucuuacuugaaaauauugauccugaugagaga

SEQ ID NO: 24560 - RNA, 64 nt, hsa
ccacagccucucguuucuccuccaucugugcuuauuacuugaggacugugucugcuccgugaga

SEQ ID NO: 24561 - RNA, 64 nt, hsa
uacaagccuuuucuaaguauuuggugguuuauguuuacuugaacggcuccauguugccggugcc

SEQ ID NO: 24562 - RNA, 64 nt, hsa
ggucacauauauacaguagcagcuguaaauaagcuuacuugaacuaauuacuugaaaacuggug

SEQ ID NO: 24563 - RNA, 64 nt, hsa
caguagcagcuguaaauaagcuuacuugaacuaauuacuugaaaacugguggaaaaaagagacc

SEQ ID NO: 24564 - RNA, 64 nt, hsa
auaggguagcaacuggccaaaugaggccuacugauuacuugaggugugccuuguauaacugaau

SEQ ID NO: 24565 - RNA, 64 nt, hsa
uaagaaaauacauuagcaagcuuaaugguuauccuuacuugaguccauauggguuggacagucc

SEQ ID NO: 24566 - RNA, 64 nt, hsa
cuuuuucaaaaugcucaccuacuggaagugugaauuacuugacaauguauggcuuaguuguguu

SEQ ID NO: 24567 - RNA, 64 nt, hsa
cugugucauuguuuaacuuggauauuuuaugauuuuacuugaaugugccuaauggaaccauuug

SEQ ID NO: 24568 - RNA, 64 nt, hsa
acccagccauauagcacagaggcauauuuuccuguuacuugagugguucuuuuagcucauuugc

SEQ ID NO: 24569 - RNA, 64 nt, hsa
ugacugugaaaugucagagaaaaauaaaagucacuuacuugaaaccuauuuggccuuuuugcuu

SEQ ID NO: 24570 - RNA, 64 nt, hsa
ugaacugucuuaaggauuuguuuaaacagcuaaguuacuugauuaaaauaaugauaaaauugua

SEQ ID NO: 24571 - RNA, 64 nt, hsa
cuugucugugaacugagcaucugccucaguuuuauuacuugaaaucuuggcaggugcuuaauag

SEQ ID NO: 24572 - RNA, 64 nt, hsa
aaacucuaacagcaaagguuaucuugaccugauguuacuugaaucugagagaaagucauuacuu

SEQ ID NO: 24573 - RNA, 64 nt, hsa
guguucuuuuuuccaggaaaggcuccagugguucuuacuugauccaaaaaaugucaagaauuaa

SEQ ID NO: 24574 - RNA, 64 nt, hsa
cucugauaaaauaaaggcagggaaacaagcugaauuacuugaaauuacuugaauuuucuugucu

SEQ ID NO: 24575 - RNA, 64 nt, hsa
auaaaggcagggaaacaagcugaauuacuugaaauuacuugaauuuucuugucuuaaaacugaa

SEQ ID NO: 24576 - RNA, 64 nt, hsa
aaaaaaaaaauuacacugugguaguggcauuuaaacaauauaauauauucuaaacacaaugaaa

SEQ ID NO: 24577 - RNA, 64 nt, hsa
uuuaaaaauugcucuuaauuuuuaaacucucaauacaauauauuuugaccuuaccauuauucca

SEQ ID NO: 24578 - RNA, 64 nt, hsa
ugauaaauaauugcuuuauaacaaauguauauauacaauauaucauuuuuguuaaaauaaucac

SEQ ID NO: 24579 - RNA, 64 nt, hsa
aaagguuguguaacauacuuccaccagcaguccaacaauauauguuuaaaaauuuaaaacauau

SEQ ID NO: 24580 - RNA, 64 nt, hsa
auggaagucuggggggcacagacaaccuuaucaaacaauauaaaagccaauauaaauucucaua

SEQ ID NO: 24581 - RNA, 64 nt, hsa
aaggaaguguuaagcagauuuuuugaauacacuuacaauauacuggcuuauaaucauuuuuauu

SEQ ID NO: 24582 - RNA, 64 nt, hsa
aaagaugguuugcaccgucauuucaaauguuugcacaauauaccacuuagaggcuuaaaaucag

SEQ ID NO: 24583 - RNA, 64 nt, hsa
agucacucuaggacucugcacugaauggcugaccugaccugauguccauucaucccacccucuc

SEQ ID NO: 24584 - RNA, 64 nt, hsa
aucucagucacucuaggacucugcacugaauggcugaccugaccugauguccauucaucccacc

SEQ ID NO: 24585 - RNA, 64 nt, hsa
caugcaaacaaaacucuaacagcaaagguuaucuugaccugauguuacuugaaucugagagaaa

SEQ ID NO: 24586 - RNA, 64 nt, hsa
uuuaguggcuuugugaaggaaagaaaccauuaaaugaccugacaaaaacugacucaugucuuua

SEQ ID NO: 24587 - RNA, 64 nt, hsa
aguggcaucuuucccuuuucuuuuguucaugaccugaccugaagcagcagauuugauagacugg

SEQ ID NO: 24588 - RNA, 64 nt, hsa
ucuccaguggcaucuuucccuuuucuuuuguucaugaccugaccugaagcagcagauuugauag

SEQ ID NO: 24589 - RNA, 64 nt, hsa; identical to SEQ ID NO: 21350

SEQ ID NO: 24590 - RNA, 64 nt, hsa; identical to SEQ ID NO: 21351

SEQ ID NO: 24591 - RNA, 64 nt, hsa; identical to SEQ ID NO: 21352

SEQ ID NO: 24592 - RNA, 64 nt, hsa; identical to SEQ ID NO: 21353

SEQ ID NO: 24593 - RNA, 64 nt, hsa; identical to SEQ ID NO: 21354

SEQ ID NO: 24594 - RNA, 64 nt, hsa; identical to SEQ ID NO: 21355

SEQ ID NO: 24595 - RNA, 64 nt, hsa; identical to SEQ ID NO: 21356

SEQ ID NO: 24596 - RNA, 64 nt, hsa; identical to SEQ ID NO: 21357

SEQ ID NO: 24597 - RNA, 64 nt, hsa; identical to SEQ ID NO: 21358

SEQ ID NO: 24598 - RNA, 64 nt, hsa; identical to SEQ ID NO: 21359

SEQ ID NO: 24599 - RNA, 64 nt, hsa; identical to SEQ ID NO: 21360

SEQ ID NO: 24600 - RNA, 64 nt, hsa; identical to SEQ ID NO: 21361

SEQ ID NO: 24601 - RNA, 64 nt, hsa; identical to SEQ ID NO: 21362

SEQ ID NO: 24602 - RNA, 64 nt, hsa; identical to SEQ ID NO: 21363

SEQ ID NO: 24603 - RNA, 64 nt, hsa; identical to SEQ ID NO: 21364

SEQ ID NO: 24604 - RNA, 64 nt, hsa; identical to SEQ ID NO: 21365

SEQ ID NO: 24605 - RNA, 64 nt, hsa; identical to SEQ ID NO: 21366

SEQ ID NO: 24606 - RNA, 64 nt, hsa; identical to SEQ ID NO: 21367

SEQ ID NO: 24607 - RNA, 64 nt, hsa; identical to SEQ ID NO: 21368

SEQ ID NO: 24608 - RNA, 64 nt, hsa; identical to SEQ ID NO: 21369

SEQ ID NO: 24609 - RNA, 64 nt, hsa; identical to SEQ ID NO: 21370

SEQ ID NO: 24610 - RNA, 64 nt, hsa; identical to SEQ ID NO: 21371

SEQ ID NO: 24611 - RNA, 64 nt, hsa
uuuaaaauaaucuggaaguaaugggaacuuaguuuuuccugaacuccaaccagaauccaaauug

SEQ ID NO: 24612 - RNA, 64 nt, hsa
acccuuaaugugccaagcuugaaacaggauuugauuuccugagcuacuuguucgccuucugugc

SEQ ID NO: 24613 - RNA, 64 nt, hsa
aagguuacuguuuuuauccucuauccuuuuuuccuuuccugaucaaggugcucuucucauuuuu

SEQ ID NO: 24614 - RNA, 64 nt, hsa
uuuuccuuuccugaucaaggugcucuucucauuuuuuccugagaaccuuagccaucagaugagg

SEQ ID NO: 24615 - RNA, 64 nt, hsa
ccugugccauuugccuucugcugcaacgaaaauauuuccugauucaagauucuauaaaaaggaa

SEQ ID NO: 24616 - RNA, 64 nt, hsa
acuaggauccacggauaugagaccauuuuugucauuuccugaagucacacuggcguuuccagaa

SEQ ID NO: 24617 - RNA, 64 nt, hsa
uuuuuuacacaaaaauguauugaagcaacaaauauuuccugaagauccacccugggugaggcuu

SEQ ID NO: 24618 - RNA, 64 nt, hsa
aaaaaguuaguucauaaguaaaggcacuaaauccuuuccugacaauggcagagucucuagaggu

SEQ ID NO: 24619 - RNA, 64 nt, hsa
cccaaaaaauguguuuuuguaauuacuauuucuuuuuccugaaauucgugauugcaacaaaggc

SEQ ID NO: 24620 - RNA, 64 nt, hsa
uuugccuguccacacccccucgcuccccaccauuuuuccugaccggccuguguccccgagcccu

SEQ ID NO: 24621 - RNA, 64 nt, hsa
ugugaaauggaauucaugguauuuucuguaacguuuuccugaagcuguuucuggagagccacac

SEQ ID NO: 24622 - RNA, 64 nt, hsa
uuucuggagagccacacauuuaaauacagacagcuuuccugaucauuugauuuauugugcaccu

SEQ ID NO: 24623 - RNA, 64 nt, hsa
ucaaaggaagagcagaacaccugaaaaucagcaauuuccugacaacgaaagugaagaguaucac

SEQ ID NO: 24624 - RNA, 64 nt, hsa
uccaaggaagagcagaacaccugaaagccagcaauuuccugacacugagaaugaagaguaucac

SEQ ID NO: 24625 - RNA, 64 nt, hsa
ucuuccauccccaagaugugaccccauaaaaauuuuuccugaguuggccaggcaugguggcuca

SEQ ID NO: 24626 - RNA, 64 nt, hsa
aacagagcaagacccaucucaaaaaaaaaauuuuuuuccugagaggaagccugagguugaccag

SEQ ID NO: 24627 - RNA, 64 nt, hsa
guucccagacccaggaaguauaagucauugacaguuuccugaguggcucugccaauccauacca

SEQ ID NO: 24628 - RNA, 64 nt, hsa
caucacaucccagaaucccacucccaaugcauuauuuccugaggcaagaacuuaagguccucac

SEQ ID NO: 24629 - RNA, 64 nt, hsa
aucuuuauugaauuagaaaacaagugggacauauuuuccugagagcagcacaggaaucuucuuc

SEQ ID NO: 24630 - RNA, 64 nt, hsa
uaggcagauacuauuuuguuuauguuuuuguuuuuuuccugaugaaggcagaagagaugguggu

SEQ ID NO: 24631 - RNA, 64 nt, hsa
gguaagacaccugcuuacauucucuaagccuugguuuccugaaccuuaaaacaggauaacauag

SEQ ID NO: 24632 - RNA, 64 nt, hsa
cuucccuccaggugcccaguguagguccagcguguuuccugagccuccugugaguuuccacuug

SEQ ID NO: 24633 - RNA, 64 nt, hsa
cuuuaaagaaaugcuuuaguaagaauaugaacaauuuccugaugucuccuauaaauugugauug

SEQ ID NO: 24634 - RNA, 64 nt, hsa
cauuuguuacuuuaacauuuuaaaauuaugguguuuuccugauuuuaaaagcaauauuuuccuu

SEQ ID NO: 24635 - RNA, 64 nt, hsa
uaucaaaagaaaauugauauuuuuauacaaguaauuuccugagcuaaaugcuucauugaaagcu

SEQ ID NO: 24636 - RNA, 64 nt, hsa
uccuguggaggcugagaugaaaacuagggcucauuuuccugacauuuguuuauuuuuuggaaga

SEQ ID NO: 24637 - RNA, 64 nt, hsa
agauguuuugccacaaauaugaauguguuuguuguuuccugacuuuaagcaaugaagauugaga

SEQ ID NO: 24638 - RNA, 64 nt, hsa
uaacacucagcagugcuauuuugagucaucccaguuuccugaaaguaaugcccagucuuccuga

SEQ ID NO: 24639 - RNA, 64 nt, hsa
augacuuuuccugaaggcuugcuuuucccucgccuuuccugaaggucgcauuagagcgagucac

SEQ ID NO: 24640 - RNA, 64 nt, hsa
cgcaucuccagauuccagacccugccgcaugacuuuuccugaaggcuugcuuuucccucgccuu

SEQ ID NO: 24641 - RNA, 64 nt, hsa
ucaccacuuuuuaaguuuuuuuuccacagguauuuuuccugagcucuauaccaugcauuuagcu

SEQ ID NO: 24642 - RNA, 64 nt, hsa
guggagagcuuccaaaaagagauugcucucagauuuuccugaaaauccugaaaaccaggauuuu

SEQ ID NO: 24643 - RNA, 64 nt, hsa
uuuuucucaguaacuuacuauccagcagacuggcuuuccugagacuugagguuguggcuuauac

SEQ ID NO: 24644 - RNA, 64 nt, hsa
gacaaguggacacacagaugcacugcugugcugcuuuccugaggugguuuucuaugccuguuuu

SEQ ID NO: 24645 - RNA, 63 nt, hsa
aaugcuguauauaaaauuugcacuggaaauucuguuuccugauauuuggacuuguacauuuau

SEQ ID NO: 24646 - RNA, 64 nt, hsa
agcaaaucuccuuggauuuccuccagaguucggauuuccugagaagauaacagugaaacagcgu

SEQ ID NO: 24647 - RNA, 64 nt, hsa
uaguauaaauaugauuaauaaaaaugugcauggcuuuccugaaggagauuuuuuaauugccuuu

SEQ ID NO: 24648 - RNA, 64 nt, hsa
auagaauauuauguaauuuguuuugaagguuuuuuuuccugacugucuuaaagauuaugcuagc

SEQ ID NO: 24649 - RNA, 64 nt, hsa
gacccuuaggcgcuaauaugauuacagcgaagacuuuccugauaaguucucaaacucgaugugu

SEQ ID NO: 24650 - RNA, 64 nt, hsa
guaauuaagaugagaucaguuucuuagaaaaagcuuuccugaaucccucugacguugccuggga

SEQ ID NO: 24651 - RNA, 64 nt, hsa
ccuguaaucugagcuccaguuacuacuuaagguguuuccugaacguacuacugcauuuccuguu

SEQ ID NO: 24652 - RNA, 64 nt, hsa
uugccucuauguuauuucuagaaugcugaaaagcuuuccugacccaagcaaagacacacaucau

SEQ ID NO: 24653 - RNA, 64 nt, hsa
gugcugucauaaugaagagauuuccaagauuuuuuuuccugauuagaacugguagccaguauau

SEQ ID NO: 24654 - RNA, 64 nt, hsa
uuuaaucucguaggaggaaucucauuaagacauuuuuccugauauguagagcagucuguuggca

SEQ ID NO: 24655 - RNA, 64 nt, hsa
cugugcacacacccccucagcacucccuaugcacuuuccugacacgcaaagacacagcccucuu

SEQ ID NO: 24656 - RNA, 64 nt, hsa
guuucacaugggacccaacauccuucaucaauacuuuccugaguuugaucauccauuuagccuu

SEQ ID NO: 24657 - RNA, 64 nt, hsa
cacacacauauauauauauauauauuuuuuuuuuuuuccugaggauggugaagguaccugacug

SEQ ID NO: 24658 - RNA, 64 nt, hsa
auaauggagacaacagcauuaccuauaucaggguuuuccugaggucucaauauaagggacucag

SEQ ID NO: 24659 - RNA, 64 nt, hsa
uuuucuguucagcaguuuccuuuuagcuuccguauuuccugaugagaaaucugcagucauucaa

SEQ ID NO: 24660 - RNA, 64 nt, hsa
guguuuaugaaggauggggccuggaaaggcaacuuuuccugauuaaugugaaaaauaauuccua

SEQ ID NO: 24661 - RNA, 64 nt, hsa
aaucuguagaauaaaguguauuccuccacuuuuuuuuccugaacagucaaggugaggcaauuga

SEQ ID NO: 24662 - RNA, 64 nt, hsa
guauuuuuaauuuuaaacugaacaauaaucaucuuuuccugacaauaaauaucaaucucuauca

SEQ ID NO: 24663 - RNA, 64 nt, hsa
uaaaucagguaugagugaaacucuggguauggucuuuccugaggccaaauuccucuuccucuga

SEQ ID NO: 24664 - RNA, 64 nt, hsa
uucacacauucagaaaagaggguccucacagauuuuuccugaacaaccccaucucuauucuugg

SEQ ID NO: 24665 - RNA, 64 nt, hsa
gugggauuuuuguugauaauuuuuagaagcaaauuuuccugaaaguuuugaguagaggugagac

SEQ ID NO: 24666 - RNA, 64 nt, hsa
aaaagaggcaaaaauuaaaagcuuggagagauaguuuccugaauagaauuugaagcagucugaa

SEQ ID NO: 24667 - RNA, 64 nt, hsa
uugacaaugguacuugcuucuuguuguuuuauuguuuccugaauucaugcagaugccuggccau

SEQ ID NO: 24668 - RNA, 64 nt, hsa
gccuuuuaauauuugauccuauuaugugagagauuuuccugauauguuaucuuauuuauauuuu

SEQ ID NO: 24669 - RNA, 64 nt, hsa
gaauugcuuuccuuccccgccuuugacaugaggccuucaguaaagagcuacagaacaugaguac

SEQ ID NO: 24670 - RNA, 64 nt, hsa
agcccuguauucucaacagggaugcaaauugguucuucaguaaggauaaaaaaaaaucacaagc

SEQ ID NO: 24671 - RNA, 64 nt, hsa
uaaauugaauguucgccuuuuacauauauuugcucuucaguauggaucccaauuugaauguuac

SEQ ID NO: 24672 - RNA, 64 nt, hsa
gagcccacaauggccaguuuacuaccagaaagggcuucaguaagauauucuuggacuugauacu

SEQ ID NO: 24673 - RNA, 64 nt, hsa
uauuaugaacaaaauuuuuccuguuaaauagcgacuucaguauuguguuauguuuuacagcguu

SEQ ID NO: 24674 - RNA, 64 nt, hsa
uuauugcaaagcuuuaaauauaaauuucagagugcuucaguaaaaagcuacuauauauuguugu

SEQ ID NO: 24675 - RNA, 64 nt, hsa
auuuaauugugguuuaccaucuuuuugguucccucuucaguaauuaaccuaucgaaaaucuguc

SEQ ID NO: 24676 - RNA, 64 nt, hsa
gcccuggaggggcugcugcuccucaguugcauuucuucaguagauucauuuccuugaugcaaag

SEQ ID NO: 24677 - RNA, 64 nt, hsa
aauagaucauuggauacgaagggcucuuuugaagcuucaguauaccauguuugcauaguuuauc

SEQ ID NO: 24678 - RNA, 64 nt, hsa
gggagagagguaccuagaccaugucaucuacaagcuucaguaacuaaagaaaaaggaacuuccc

SEQ ID NO: 24679 - RNA, 64 nt, hsa
cauguaaucucuaaccugugggcaagucuuuacccuucaguagucaagauuacguuagagacuu

SEQ ID NO: 24680 - RNA, 64 nt, hsa
auauaaauagacuugcaguuauuacuaagcuccucuucaguaauagaaagacuuaugaagucuu

SEQ ID NO: 24681 - RNA, 64 nt, hsa
gacuuugugacugucacuugcugcuuuuucugcgcuucaguaacaaguguuggcaaacgagacu

SEQ ID NO: 24682 - RNA, 64 nt, hsa
agaaacaugucuugacuguuaguuguccacaaaucuucaguauuuucuccacuucauuuuuaag

SEQ ID NO: 24683 - RNA, 64 nt, hsa
cucguaucugaguguaacuuugccaauauuuuaaaagccaaaauauucucuggacaacaaauuu

SEQ ID NO: 24684 - RNA, 64 nt, hsa
cauuugcucaaagucacagagaaaauuaguggcaaagccaaaaagauucagaucuucugacucg

SEQ ID NO: 24685 - RNA, 64 nt, hsa
aagaaggaaagagcuggagucagcacuguccagaaagccaaaaagaaacagaagaagagagacu

SEQ ID NO: 24686 - RNA, 64 nt, hsa
cuccuagauggcuacauugacuucagguggagagaagccaaacaaagacuuggagagcugcagu

SEQ ID NO: 24687 - RNA, 64 nt, hsa
gcagauggccagaugcacugcccaguaaggcaggaagccaaagaggcagugcccagccccacaa

SEQ ID NO: 24688 - RNA, 64 nt, hsa
aagggacaauuuggcugaagucuuucucugaaaaaagccaaaggguuauagggguacacuuagg

SEQ ID NO: 24689 - RNA, 64 nt, hsa
auuucuuaaaauguuucauuuucauuaaaaaugaaagccaaauuuauaugccaccgauugcagg

SEQ ID NO: 24690 - RNA, 64 nt, hsa
uuuuuuuuaaccuguuuauauaauuuugcagcagaagccaaauuuuuuguauauuaaagcacca

SEQ ID NO: 24691 - RNA, 64 nt, hsa
aagcuuggcaccuauaccuugaauaucugcuaucaagccaaauaccugguuuuccuuaucaugc

SEQ ID NO: 24692 - RNA, 64 nt, hsa
gugccuucaugcccuacuucuuaaugccucucuaaagccaaaaaaaaaaaaaaagacaaagccu

SEQ ID NO: 24693 - RNA, 64 nt, hsa
cgggagugguauguggcccugaauaaaagaggaaaagccaaacgagggugcagcccccggguua

SEQ ID NO: 24694 - RNA, 64 nt, hsa
uguuccugaaaagaaaaagccaccuagcccuaucaagccaaagauuccccuuucugcaccucgg

SEQ ID NO: 24695 - RNA, 64 nt, hsa
ccacaaaacucaagauugggagcucuuugugaucaagccaaagaauucucauguacucuaccuu

SEQ ID NO: 24696 - RNA, 64 nt, hsa
cugaaaguguucaugugcuuuuaauguagucuaaaagccaaaguauagugacucagaauccuca

SEQ ID NO: 24697 - RNA, 64 nt, hsa
ucagcuuauaugaaagucaaguggggaacugggaaagccaaagucagucuugagcagagggagc

SEQ ID NO: 24698 - RNA, 64 nt, hsa
aagagaggggcagaagcaagaagagauuguuuugaagccaaaaugguacaccgauauuuaagaa

SEQ ID NO: 24699 - RNA, 64 nt, hsa
gcuucuuccaaaauaucucuagguaguacaacugaagccaaaccugccugacuuccugcuccug

SEQ ID NO: 24700 - RNA, 64 nt, hsa
gucacauaaguucuccauauugccuuaugucccaaagccaaauauaaaaauauaaaugaugcuu

SEQ ID NO: 24701 - RNA, 64 nt, hsa
gaagaggagugcaaggagaaggucuguacuaacaaagccaaauuccucaagcucuuacuggacu

SEQ ID NO: 24702 - RNA, 64 nt, hsa
aaagaacaauauagucugggaaucccagaaugucaagccaaaggucuaagaagucaucuccuuc

SEQ ID NO: 24703 - RNA, 64 nt, hsa
acucuuuucagacacagcgguuuuuguuuccaagaagccaaaauuguuuagaauuugcuuccca

SEQ ID NO: 24704 - RNA, 64 nt, hsa
augagugcuuguaacaaaauaaacaacaaaaacaaagccaaaaacuaccuuuauccauauguga

SEQ ID NO: 24705 - RNA, 64 nt, hsa
aauuugaacauuccuuuacauuguuggagaaaugaagccaaaguuauucagaugguuuucccag

SEQ ID NO: 24706 - RNA, 64 nt, hsa
agacucaggaaaggauuucuacaguguucuauaaaagccaaaagagagaguggguuugggaaga

SEQ ID NO: 24707 - RNA, 64 nt, hsa
ggccauuuacagcugaaccacgucuucaagaaagaagccaaaaauauuuccgugagguuuuuaa

SEQ ID NO: 24708 - RNA, 64 nt, hsa
uugguuauacaguuucaaaaaaggagaucagagaaagccaaagaaugucagaaauuuguagaaa

SEQ ID NO: 24709 - RNA, 64 nt, hsa
ucaagguauagacuuuuuugguuaugauacaguuaagccaaaaacagcuaaucuuugcaucuaa

SEQ ID NO: 24710 - RNA, 64 nt, hsa
uaccuagaauaguuacacacaagagggaaacuggaagccaaacacuguacaguauuguguagaa

SEQ ID NO: 24711 - RNA, 64 nt, hsa
auucagaaacugcaggagacaagaugaauuugagaagccaaauggaauuuuuaauggaaaccau

SEQ ID NO: 24712 - RNA, 64 nt, hsa
acugugcuuguccauuauuuuacacaugcccuagaagccaaaacugaaagccacuggauccugg

SEQ ID NO: 24713 - RNA, 64 nt, hsa
ccugugaucuccacaccaaagucagggagccuggaagccaaacaaaggcccagcagccuucuga

SEQ ID NO: 24714 - RNA, 64 nt, hsa
ccugccugcuccaagaaaagggcuugcgaaaggaaagccaaacacuguuucuaacucaggggug

SEQ ID NO: 24715 - RNA, 64 nt, hsa
ucuccauagaauuuccccccaaaguagagaugcuaagccaaauccagaagaacccauagaugaa

SEQ ID NO: 24716 - RNA, 64 nt, hsa
ucuacauagaaaacaugcaguaccuucuuauuacaagccaaauuguguuugcuuugguaaguaa

SEQ ID NO: 24717 - RNA, 64 nt, hsa
accaaaaaagagcccacauugccaagucaauccuaagccaaaugaauaaagccggaggcaucac

SEQ ID NO: 24718 - RNA, 64 nt, hsa
uucaugucuaaaacaccaaaagcaauggcaacaaaagccaaaauugacaaaugggaucuaauua

SEQ ID NO: 24719 - RNA, 64 nt, hsa
uggagggcuggcuauaaagggcaccacaaggaagaagccaaacagauccagaaugugugaaauu

SEQ ID NO: 24720 - RNA, 64 nt, hsa
caucaacauggcugcuugcuucaucaaggcaugcaagccaaaagggaggacagucugcuagcaa

SEQ ID NO: 24721 - RNA, 50 nt, hsa
ugcacaccucccccuccuagaagccaaagacccgcgggcgcccucugcca

SEQ ID NO: 24722 - RNA, 64 nt, hsa
cccuuggggauggguugaugcgagggucccacucaagccaaaaagccgggaccuuugcgcagcu

SEQ ID NO: 24723 - RNA, 64 nt, hsa
gcugcauccguccacccccaggcgugggggacaaaagccaaaggugccaggccuuagagcagac

SEQ ID NO: 24724 - RNA, 64 nt, hsa
uaaauugcaguaucagaaugaauguugauguuugaagccaaaaagccaaaugcuuaaacugauc

SEQ ID NO: 24725 - RNA, 64 nt, hsa
aguaucagaaugaauguugauguuugaagccaaaaagccaaaugcuuaaacugaucaaugacug

SEQ ID NO: 24726 - RNA, 64 nt, hsa
uuuuucauguugacagauuuguagacaauuacaaaagccaaaaaaggauaaaauaagcauuagg

SEQ ID NO: 24727 - RNA, 64 nt, hsa
gucuuuuugggguuggacuaaauaugaaauccgaaagccaaaccagacucaccagaaauugcug

SEQ ID NO: 24728 - RNA, 60 nt, hsa
uuccacaugaaaaagguggagcuuucuagaaaaaccaaccucuaaggcauuaggaauuua

SEQ ID NO: 24729 - RNA, 60 nt, hsa
ucuuccuuuguuaggcugugcuuuacugauaaaaccaaguauugaauaaagagaguuaau

SEQ ID NO: 24730 - RNA, 60 nt, hsa
ugggagcugagugggggaucacagccucugaaaaccaauguucucucuucuccaccuccc

SEQ ID NO: 24731 - RNA, 60 nt, hsa
ugggggaagcaccauaacuuuguuuagcccaaaaccaagucaagugaaaaaggaggaaga

SEQ ID NO: 24732 - RNA, 60 nt, hsa
agcugguagccuaccuacacagcugcuacaaaaaccaaaauacagaauggcuucugugau

SEQ ID NO: 24733 - RNA, 60 nt, hsa
caugacaucugagcacagaaauuaaggcaaaaaaccaaagcaaaacaaauacauggugcu

SEQ ID NO: 24734 - RNA, 60 nt, hsa
gauugauuugaaaggugugcagccugauuuaaaaccaaacccugaacccuuuuaaagaac

SEQ ID NO: 24735 - RNA, 60 nt, hsa
uugagauuaaaaaaaaaaaaucccugguuuaaaaccaacaaugaugccuagugaguaugu

SEQ ID NO: 24736 - RNA, 60 nt, hsa
ucaacuuaaaaaaaaauaggcccuuucauaaaaaccaaacuguagcaagaugcaaaugca

SEQ ID NO: 24737 - RNA, 60 nt, hsa
aggcaacauuccuuucuugugcccugggccaaaaccaaugcugaugaccuuaucagcuuc

SEQ ID NO: 24738 - RNA, 60 nt, hsa
cguacuguaccguacagagaaaaggagcaaaaaaccaagucuucuguuuauccugaggcu

SEQ ID NO: 24739 - RNA, 60 nt, hsa
acuucccuguggauuuguggauuaauuaggaaaaccaauaguaaucacgucugagccaag

SEQ ID NO: 24740 - RNA, 60 nt, hsa
ucuaauuaaugcccuuucuuauuuaaaaacaaaaccaaaugauaucuaaguaguucucag

SEQ ID NO: 24741 - RNA, 60 nt, hsa
cuaccuuuaaaauaagcaauaacaaagaagaaaaccaaauuauuguucaaauuuagguuu

SEQ ID NO: 24742 - RNA, 60 nt, hsa
auuaaggucacagaaaucauuagguaaaggaaaaccaaugaggaguucugcaguuuucuu

SEQ ID NO: 24743 - RNA, 60 nt, hsa
uuuugugacuuuaauugguaaauauguuacaaaaccaaguacuuaaucuuuuacaucaug

SEQ ID NO: 24744 - RNA, 60 nt, hsa
gaagaaaauggagacaaacagaaggagggaaaaaccaaccuacucugaaagccuucagac

SEQ ID NO: 24745 - RNA, 60 nt, hsa
ccaugaucgaugaugucccaugcuucgaggaaaaccaaacacuuuccgccucucuugcaa

SEQ ID NO: 24746 - RNA, 60 nt, hsa
agcaacaaucggaaaccaaauacuggagagaaaaccaacguuuccacccacagacccuuu

SEQ ID NO: 24747 - RNA, 60 nt, hsa
agugguagaugaugaaauuuacuacuucagaaaaccaauuguuccucagaaggagccauc

SEQ ID NO: 24748 - RNA, 60 nt, hsa
guuuuugucugugaaucacgguauucugccaaaaccaaaucuuuuaagaaaauuaaacug

SEQ ID NO: 24749 - RNA, 60 nt, hsa
agcuccaguguuuuuaagagaauguuucuuaaaaccaauaggaaacuuaagcgagguuuc

SEQ ID NO: 24750 - RNA, 60 nt, hsa
aacuaagauuauaaauuagcaucuaguuccaaaaccaaaaaaagugccuguggauguaua

SEQ ID NO: 24751 - RNA, 60 nt, hsa
guggcccugaaggaauaaauuccagcuuuaaaaaccaagucugaggaaauauuuggcuuc

SEQ ID NO: 24752 - RNA, 60 nt, hsa
guauuuuaugcccauaaaauaagcuuuauaaaaaccaauuuccugauggacuauuaaauu

SEQ ID NO: 24753 - RNA, 60 nt, hsa
gauuuccacagagacuguuugaauguuuucaaaaccaaguaucacacuuuaauguacaug

SEQ ID NO: 24754 - RNA, 60 nt, hsa
gugacagagccaugguguguuuguaauaauaaaaccaaagaaacauacguccugugugca

SEQ ID NO: 24755 - RNA, 60 nt, hsa
acaguacacuuguagccaaaacuggaagacaaaaccaauauauaauuuggcugcugauug

SEQ ID NO: 24756 - RNA, 60 nt, hsa
gcuaccuaacaguaccaucuuggauccuucaaaaccaaagacuugccccagcacugcugu

SEQ ID NO: 24757 - RNA, 60 nt, hsa
gccauuauuuuuauaucaauagcacaaaggaaaaccaaaaguccuuaaccacugaccauu

SEQ ID NO: 24758 - RNA, 60 nt, hsa
ucccacugccuuuuuauuauugacauaucuaaaaccaaacugaaaucgcuuuggaaauca

SEQ ID NO: 24759 - RNA, 60 nt, hsa
ugucauaaaauauaacauuacagcuuauuuaaaaccaaauauaguugaacauauuuaaaa

SEQ ID NO: 24760 - RNA, 60 nt, hsa
uaccuuucuguccuugauaaaauaguaaagaaaaccaaacaaacccaggccugaugggaa

SEQ ID NO: 24761 - RNA, 60 nt, hsa
uucaaacgaaacguaagagaagucaacaauaaaaccaagaaaagugaguauuuuuauacc

SEQ ID NO: 24762 - RNA, 60 nt, hsa
augucaagaagcuuuuaaaggucaacacaaaaaaccaaggccaggagugaggggcucuuu

SEQ ID NO: 24763 - RNA, 60 nt, hsa
uuucaguuaguccuaacuuuuaaaagaaggaaaaccaagagacauaucugguguacgugu

SEQ ID NO: 24764 - RNA, 60 nt, hsa
cgcacaagucaaacgcuaggaaguuugaauaaaaccaauuuuucuaacuuguugcucauu

SEQ ID NO: 24765 - RNA, 60 nt, hsa
acaagcauaggaagauacuucaaaaccaaaaaaaccaaggugcaucauuaauauucauuu

SEQ ID NO: 24766 - RNA, 60 nt, hsa
acagucaucacaagcauaggaagauacuucaaaaccaaaaaaaccaaggugcaucauuaa

SEQ ID NO: 24767 - RNA, 60 nt, hsa
cuguguugaguucucuuuaaaaacaaggacaaaaccaaccagcguucaaaggaaccuccc

SEQ ID NO: 24768 - RNA, 60 nt, hsa
caauguauguuuguuaaaaauaauaauaauaaaaccaaaagccuuuguggaaacccacuc

SEQ ID NO: 24769 - RNA, 60 nt, hsa
uuuugcuggauaugcagaaaugauaggaaaaaaaccaauggugaaauuucaaguuucaaa

SEQ ID NO: 24770 - RNA, 60 nt, hsa
aaaaaaccaauggugaaauuucaaguuucaaaaaccaaccuuucauuaccaaucccaggc

SEQ ID NO: 24771 - RNA, 60 nt, hsa
uguguuuauuguaacuccucauacacuuuuaaaaccaacaucuuuuuucauaaauguugg

SEQ ID NO: 24772 - RNA, 60 nt, hsa
auuuacuuaacaaguaaccaguaguucaucaaaaccaacuuguacagacuaauaaaucuu

SEQ ID NO: 24773 - RNA, 60 nt, hsa
auuuuauggugguuucaguaggucauuuuaaaaaccaaugugcauuaguuuucaaguaua

SEQ ID NO: 24774 - RNA, 60 nt, hsa
gcaccuccaaaucucauguccucacauuucaaaaccaaucaugccuucccaacagucccc

SEQ ID NO: 24775 - RNA, 60 nt, hsa
aucuguuagcaguccugacuugauuuaauaaaaaccaaggagagccaccccugcuuucug

SEQ ID NO: 24776 - RNA, 60 nt, hsa
gaugcuuuucauaauuuucacuauaccucuaaaaccaauuguaccgacaucacguagaca

SEQ ID NO: 24777 - RNA, 60 nt, hsa
caucugcuauaacucuuucaacagaaaaccaaaaccaaacgaaaugucuaaggaaaaugu

SEQ ID NO: 24778 - RNA, 60 nt, hsa
aauagccaucugcuauaacucuuucaacagaaaaccaaaaccaaacgaaaugucuaagga

SEQ ID NO: 24779 - RNA, 60 nt, hsa
cucuuguuugucuaguaugcucuuggaaagaaaaccaagcaagcaaguugcugccuauuc

SEQ ID NO: 24780 - RNA, 60 nt, hsa
ucaggagaaauauuggaaaauuauauguauaaaaccaaagugcuauuuuuaaaagcauca

SEQ ID NO: 24781 - RNA, 60 nt, hsa
acuaucggaaauucauuuugauucagaauaaaaaccaaauguauagagcuuuggguguag

SEQ ID NO: 24782 - RNA, 60 nt, hsa
acuuucuguaucucuuaggaggaacaaguaaaaaccaaaugguuacauugugcugcuaga

SEQ ID NO: 24783 - RNA, 60 nt, hsa
cuauaguuacugauuuuuuauuauguaagcaaaaccaauaaaaauuuaaguuuuuuuaac

SEQ ID NO: 24784 - RNA, 60 nt, hsa
aagaaacaauuauaauuucuuuacauacucaaaaccaagauagaaaaaggugcuaucguu

SEQ ID NO: 24785 - RNA, 60 nt, hsa
ucacuucuaaaccaaaaauuauguguugccaaaaccaaacccagguucaugaauauggug

SEQ ID NO: 24786 - RNA, 60 nt, hsa
cacugaugugugaagugagaacuccaucagaaaaccaaagggugcuaggaggugugggug

SEQ ID NO: 24787 - RNA, 60 nt, hsa
cugaaaacuguauauuuagcaguagcacccaaaaccaagccuuuaaccccaacaaugugu

SEQ ID NO: 24788 - RNA, 60 nt, hsa
uucuuuguuaacaugagagucccaugucugaaaaccaaaguccaauuucugucuggccuu

SEQ ID NO: 24789 - RNA, 60 nt, hsa
uggaaugauauaauuauacaaguaaugccaaaaaccaagucaaagccuaauuaaccaaag

SEQ ID NO: 24790 - RNA, 60 nt, hsa
gaugagaaugguuguuauaaacuuuauuuuaaaaccaaauuuagguguucuuacauauuu

SEQ ID NO: 24791 - RNA, 60 nt, hsa
aauuuuaacaguucucugucaucguuuaacaaaaccaacaacugacacaacuccuuaagc

SEQ ID NO: 24792 - RNA, 60 nt, hsa
ggaagaauguaguaaucuucuagaccgcuuaaaaccaaugcucccaagcugaauauucuu

SEQ ID NO: 24793 - RNA, 60 nt, hsa
ugaacuugugauuuuguguuuuacuugaccaaaaccaaguguauauguuuacauguuuuu

SEQ ID NO: 24794 - RNA, 60 nt, hsa
uuauaaaagggaaaauagaacaaaaauauuaaaaccaaugagaauaaaagaauggaaaga

SEQ ID NO: 24795 - RNA, 60 nt, hsa
cuacaguuuugcaccacggcaagaaaaccaaaaaccaaaacaaacaaacaaaaaaaaccc

SEQ ID NO: 24796 - RNA, 60 nt, hsa
caacuuucuacaguuuugcaccacggcaagaaaaccaaaaaccaaaacaaacaaacaaaa

SEQ ID NO: 24797 - RNA, 60 nt, hsa
aaauaaucuauuuguagcuucucuucuaucaaaaccaacacauccucuucuuucugccaa

SEQ ID NO: 24798 - RNA, 60 nt, hsa
uaaaaagaaaaacagaaaaagguuaaucacaaaaccaacccucacuucacagggucugua

SEQ ID NO: 24799 - RNA, 60 nt, hsa
ugguguuugcauguaaauugcagagaaaacaaaaccaaagcugauuggaaacaauuaauu

SEQ ID NO: 24800 - RNA, 60 nt, hsa
gcgcaaacuucaagagacagggcuuugcugaaaaccaaacaugggccagcugggcuuuuu

SEQ ID NO: 24801 - RNA, 60 nt, hsa
uuuccgucaagaaaaaggaaacaacaaaauaaaaccaacccaaguaaagaacagccaagu

SEQ ID NO: 24802 - RNA, 60 nt, hsa
ugaaauuucaauaauaaaauguuuaaaaucaaaaccaaaauuauagacuauguagaaaug

SEQ ID NO: 24803 - RNA, 60 nt, hsa
aaggaaccagaggugaaaaacaaacaaaaaaaaaccaaaaacaaaccaaaaaaaaaaaaa

SEQ ID NO: 24804 - RNA, 60 nt, hsa
aaaaaggaaagaaacuaaccaacaaaagagaaaaccaaaaauaaucacaacagaaaccag

SEQ ID NO: 24805 - RNA, 60 nt, hsa
acaaugacccaaaucucuuccacaagacuuaaaaccaaauucagggacaaauggauagag

SEQ ID NO: 24806 - RNA, 60 nt, hsa
cuguagcuuugugaaauaucuuaaaacgcaaaaaccaauuguguccugaaaauuguuuca

SEQ ID NO: 24807 - RNA, 60 nt, hsa
gcggcccugacggugguauccaguuaacucaaaaccaacacacagagugcaggaaaagac

SEQ ID NO: 24808 - RNA, 60 nt, hsa
acagcgcccucaucuuuuuagcaagguaaaaaaaccaaaauggguguuaucucugauauc

SEQ ID NO: 24809 - RNA, 60 nt, hsa
uuuuuuucuuuuuuaguaaaaaccuguauaaaaaccaaaauuauaggauuuuuuuuucuu

SEQ ID NO: 24810 - RNA, 60 nt, hsa
auuuuuucuuuuuuaguaaaaaccuauaugaaaaccaaaauuauaggauuuuuuucuuuu

SEQ ID NO: 24811 - RNA, 60 nt, hsa
uuuuuuucuuuuuuaguaaaaaccuauauaaaaaccaaaauuauaggauuuuuucuuuuu

SEQ ID NO: 24812 - RNA, 60 nt, hsa
auuuuuucuuuuuuaguaaaaaccgguaucaaaaccaaaauuauaggauuuuuuucuuuu

SEQ ID NO: 24813 - RNA, 60 nt, hsa
uagagccacuggugaguaaaaaccuauauaaaaaccaaaauuauaggauuuuuucuuuuu

SEQ ID NO: 24814 - RNA, 60 nt, hsa
cuuucaagggaaauuuuaaucuaaaaggaaaaaaccaaaauauugaugagaaggaguccu

SEQ ID NO: 24815 - RNA, 60 nt, hsa
ggcuugucucaccuccaccggcauccacacaaaaccaaacaggagcaggcgucaucccca

SEQ ID NO: 24816 - RNA, 60 nt, hsa
aauuuaaguuugcacuuuaauaccaaacuuaaaaccaaacacucauuuaaaaguagguua

SEQ ID NO: 24817 - RNA, 60 nt, hsa
auuugaacaugcuucuaaauaaaauaaaacaaaaccaaaacuauacuuuugaucuauaau

SEQ ID NO: 24818 - RNA, 64 nt, hsa
uggccuuucugccaauaaaguugcaugguaaauauuucauuacagaauuuauguuagagcuuuc

SEQ ID NO: 24819 - RNA, 64 nt, hsa
cucaacuuaaagcagaacuguuuucuacuggauuuuucauuaacagcaagcuuuuucuuuuaug

SEQ ID NO: 24820 - RNA, 64 nt, hsa
aaaaucacaacuuaacuagcauguuaacugcacuuuucauuacgugaauggaacuuaccuaacc

SEQ ID NO: 24821 - RNA, 64 nt, hsa
auguuagaugcccaucgugugccacaagugguuuuuucauuauguaaagcacccguugaauuaa

SEQ ID NO: 24822 - RNA, 64 nt, hsa
uauuuucuugaggaaaauauugcugugucuucauuuucauuaccagguuucauuuugggccuug

SEQ ID NO: 24823 - RNA, 64 nt, hsa
uuauuagaagccaaguaaagugcuuaagguuuguuuucauuaaauuagcuauuucugcuccccu

SEQ ID NO: 24824 - RNA, 64 nt, hsa
uguuuuaugcuaauucugcuuauuuuagaguauuuuucauuaaaaggugagcaaagugaaagau

SEQ ID NO: 24825 - RNA, 64 nt, hsa
ugauggucuguaucaaucagcagauuuuauugcuuuucauuauuuuacuguaaaggcaaagaau

SEQ ID NO: 24826 - RNA, 64 nt, hsa
ucuuagucuuaauaauuuacuaaaauggucaacuuuucauuaucuuuauuauaauaaaccugau

SEQ ID NO: 24827 - RNA, 64 nt, hsa
ucaaauacauaguggauagcucaucccuaggaauuuucauuaaaauuuggaaacagaguaauga

SEQ ID NO: 24828 - RNA, 64 nt, hsa
gcaugaguguaucacagcuuucauuaggaaaacuuuucauuacauacuuguuuaaacucugucu

SEQ ID NO: 24829 - RNA, 64 nt, hsa
gauaaaguaccuuugagcaugaguguaucacagcuuucauuaggaaaacuuuucauuacauacu

SEQ ID NO: 24830 - RNA, 64 nt, hsa
gacagcaucugauaaucuguugguuuauuucacuuuucauuaaaugaacauugaugagagaaga

SEQ ID NO: 24831 - RNA, 53 nt, hsa
agagcugcacugugaugugaaucuuucauuaucuuuaaugaagacaaaggaau

SEQ ID NO: 24832 - RNA, 64 nt, hsa
gcuacuguacugggcaacauacauuauagaacauuuucauuauaggaaguuuuauugggcagug

SEQ ID NO: 24833 - RNA, 64 nt, hsa
uuuuacaacuuuuaacaccccacaccaauuuuaguuucauuacuuuuacacacaccauuuuauc

SEQ ID NO: 24834 - RNA, 64 nt, hsa
cagaauaaguaauauauuuuaaaaaccuagcuccuuucauuauuuaaaacagcaaaauuauuuu

SEQ ID NO: 24835 - RNA, 64 nt, hsa
uauuuaaaacagcaaaauuauuuuuguagcucaguuucauuauugucauuguagaagcggucac

SEQ ID NO: 24836 - RNA, 64 nt, hsa
auguguaaacucauuguccuugauaguuuuuauuuuucauuauaaaauuauaccaggagauuuc

SEQ ID NO: 24837 - RNA, 64 nt, hsa
guauaaacaugguguuuuucagaaauaaaaauuauuucauuaaccuuuacuauuacugugauaa

SEQ ID NO: 24838 - RNA, 64 nt, hsa
auuuggaaaacuauaggcuggaaacuccuaucuguuucauuaacuauguauggagcuuuguauc

SEQ ID NO: 24839 - RNA, 64 nt, hsa
ggcuuuuaauuuuauuuguaugaauuuuccaggauuucauuaaaaauuauuauuguauuuuuua

SEQ ID NO: 24840 - RNA, 64 nt, hsa
gaguagaaagcuugaaaagauucugaaaccacaguuucauuauucucauaauccuucugcaacu

SEQ ID NO: 24841 - RNA, 64 nt, hsa
ccaauguaccguuuccuuauuccacagauaucuuuuucauuauugugaagugauguucagauuu

SEQ ID NO: 24842 - RNA, 64 nt, hsa
cacuuuguaggggaacuuuaguaaguucuucucauuucauuauguuucuuccaaggaaacagga

SEQ ID NO: 24843 - RNA, 64 nt, hsa
ccccgugcccugaggugacuuccuaacuaugugguuucauuagcgaauuuauuuuuugugcugg

SEQ ID NO: 24844 - RNA, 64 nt, hsa
uuguucucagggcuauuugugcuaaaagcugaaauuucauuauuuuaaagcuaauugccugaaa

SEQ ID NO: 24845 - RNA, 64 nt, hsa
aaaugauuaggcuguaaaauuuggagacacaauuuuucauuacaaugcaauuugcaugugcaca

SEQ ID NO: 24846 - RNA, 64 nt, hsa
uacuauuuuaacuacuggcaaagccacuugcauuuuucauuaguagcaacaauagcaauuuagu

SEQ ID NO: 24847 - RNA, 64 nt, hsa
gaccaugagaaaauaauaugucuugaugaagucuuuucauuagucacucuuagaauucuaaagu

SEQ ID NO: 24848 - RNA, 64 nt, hsa
uacaugauaacugguaccuuaucuacuguaaauauuucauuaaaaaugaugcacacauagauau

SEQ ID NO: 24849 - RNA, 64 nt, hsa
aauuuuaauguuuuauuggcaacguaugcugcuuuuucauuaaaauaugcuauuaaaauuaaau

SEQ ID NO: 24850 - RNA, 64 nt, hsa
aaggcuaaauucacagcgcuaugcaauucuuaauuuucauuaaguuguuauuucaguuuuaaau

SEQ ID NO: 24851 - RNA, 64 nt, hsa
uuauuucuaaaauauaagaucugagauugaauauuuucauuaaaagcuacaguuuugugaaucu

SEQ ID NO: 24852 - RNA, 64 nt, hsa
ugcaaacgcagauuacaauggaguggggaaguacuuucauuacccaagccucagaaaaacacac

SEQ ID NO: 24853 - RNA, 64 nt, hsa
cauucccaggacaugcaugaucaccagcauuuauuuucauuauuugaggauaucuuauaacuca

SEQ ID NO: 24854 - RNA, 64 nt, hsa
cuuauaacuguaauauauagauucagaaauacauuuucauuauccaaaaucagcuucaacaaau

SEQ ID NO: 24855 - RNA, 64 nt, hsa
uucaacaaaugguuucuggagacaaauaauuuguuuucauuaucauuguauaaucagguuaaug

SEQ ID NO: 24856 - RNA, 64 nt, hsa
uugugguuguccagugguauacaacugacaggcauuucauuaagcacauagaccagacuuugug

SEQ ID NO: 24857 - RNA, 64 nt, hsa
cauagaccagacuuugugaaugguucagauauuuuuucauuaaaaaacaagguauggcagaugg

SEQ ID NO: 24858 - RNA, 64 nt, hsa
gccccauuuuaggucuuucuuuuagguuuuugguuuucauuacuccaaguaauccuugacccaa

SEQ ID NO: 24859 - RNA, 64 nt, hsa
ucucugcaugucccccucacccgccaacccuccguuucauuauauaggagcugggaagugccac

SEQ ID NO: 24860 - RNA, 64 nt, hsa
uauucuuauaguuaucuuuuuaacaucuuauuuuuuucauuaauuacauaucaacauuaauuuu

SEQ ID NO: 24861 - RNA, 64 nt, hsa
aaaaauaaguuuaagaaauuuaagagaauuguguuuucauuaaguuuugcauaucuuuuguuau

SEQ ID NO: 24862 - RNA, 64 nt, hsa
uuugcauagaauaaugaagaucuuuguuuuuuguuuucauuaaagagccauucuggcacuuuaa

SEQ ID NO: 24863 - RNA, 64 nt, hsa
agugucagacuauccauuuuacacuugcuuuauuuuucauuaccuguagcuuugggcagauuug

SEQ ID NO: 24864 - RNA, 64 nt, hsa
uuuuuaauuugcuagguuuguauauagaagauccuuucauuaucaagaaugaguaugguugcuu

SEQ ID NO: 24865 - RNA, 64 nt, hsa
gaaaguuacuugacauuacaugaauugaacugccuuucauuaucuucagacacuuuguuuuagu

SEQ ID NO: 24866 - RNA, 64 nt, hsa
cuuuauuauugauaauuuuauuuucauuuuuugcuuucauuauuauacauauuuugguggagaa

SEQ ID NO: 24867 - RNA, 64 nt, hsa
uacaagcuacuggaugcacugucagauuaacuuauuucauuaaagaaguugggagaacaaauag

SEQ ID NO: 24868 - RNA, 64 nt, hsa
ccaauggugaaauuucaaguuucaaaaaccaaccuuucauuaccaaucccaggcaacaaacaug

SEQ ID NO: 24869 - RNA, 64 nt, hsa
acuaauauuuuuguuuguugcuuuugggaguuauuuucauuagugauuucagcaaaucucauga

SEQ ID NO: 24870 - RNA, 64 nt, hsa
aaaaguuucacaacagauuucuaaguuaaaucauuuucauuaaaaggaaaaaagaaaaaaaauu

SEQ ID NO: 24871 - RNA, 64 nt, hsa
uuguuaaaaaacaaccaaaccucacacuacuguauuucauuaucuguacugaaagcaaaugcuu

SEQ ID NO: 24872 - RNA, 64 nt, hsa
guguuuucugacuuuuacaaaauuacuuguuuguuuucauuaaaaaaaaagcauaaacuauguu

SEQ ID NO: 24873 - RNA, 64 nt, hsa
uguucacggugugauaauacucuuuagauugugcuuucauuauuauagaugcaucaugucuucu

SEQ ID NO: 24874 - RNA, 64 nt, hsa
uugaccaaaaaaccacauuaauuuaaauggagccuuucauuauuuucagauagcggggucuuuu

SEQ ID NO: 24875 - RNA, 64 nt, hsa
uuccuaguaagaguugaugucugcuagugguauuuuucauuaaaugucauauucuuacaacagu

SEQ ID NO: 24876 - RNA, 64 nt, hsa
ggaccuaacauaugucucuaccuagaacggaugguuucauuaaagaauguggauuuauugaugu

SEQ ID NO: 24877 - RNA, 64 nt, hsa
uauaauuuaaacagugagguaguuuugaauggcauuucauuaaggcaucuaugggcauuaugag

SEQ ID NO: 24878 - RNA, 64 nt, hsa
aacccagucugcugugucuucaacauacugguauuuucauuacaaaguaugguaaauuuuugag

SEQ ID NO: 24879 - RNA, 64 nt, hsa
acaggccauaauugaaaugggaauaccuuuuaaguuucauuagggguggggugggagugggaca

SEQ ID NO: 24880 - RNA, 64 nt, hsa
uugcuacuguugagcaugaauagcaguagguuguuuucauuaaugcaguuuucauaauguaucc

SEQ ID NO: 24881 - RNA, 64 nt, hsa
uacagcugcaguagcuuuuaaguauguaucaacauuucauuauaaauuauagcuuccugguucu

SEQ ID NO: 24882 - RNA, 64 nt, hsa
cuggcuaauuuuuuguauuuuuaguacagauggguuucauuauguuagccaggauggucucgau

SEQ ID NO: 24883 - RNA, 64 nt, hsa
ucugugagaacaaugguugaaauuucaaaguauguuucauuauucuuucuaaauuugauaauug

SEQ ID NO: 24884 - RNA, 64 nt, hsa
guagccaggaaggaaacaagagaaaguacguccauuucauuauggauuuuggaguugugaguga

SEQ ID NO: 24885 - RNA, 64 nt, hsa
cugagcuuccgaaaagauacauauauguuucccuuuucauuagcugaaugaggauauuuuaaga

SEQ ID NO: 24886 - RNA, 64 nt, hsa
cgauggcuuuuauuuggacaaauagcuuuuauauuuucauuaaaccaugcaaaaaauacuacau

SEQ ID NO: 24887 - RNA, 64 nt, hsa
ucauguggcagagucuucuauguuuucacagcuuuuucauuacagaaaagaacacuugcucuuc

SEQ ID NO: 24888 - RNA, 64 nt, hsa
ggacagaaaauagcaauguauuuuuuuaauauaauuucauuauucacaaaugaagaaugcaauu

SEQ ID NO: 24889 - RNA, 64 nt, hsa
cucuucuauuuuugugagacuugggcuuaucaucuuucauuacuuuuuucccauuuagccccug

SEQ ID NO: 24890 - RNA, 64 nt, hsa
uguauucuaaauuaaugcagaaccauauggaaaauuucauuaaaaucuauccccaaaugugcuu

SEQ ID NO: 24891 - RNA, 64 nt, hsa
guugcuaaguaauucccaauagaaagcugcuuauuuucauuaaugaaaaauaaccaugguuugu

SEQ ID NO: 24892 - RNA, 64 nt, hsa
ucaguuugauaguagacuaguuaaggaagaacucuuucauuacuugcaucguguaaaucaucuc

SEQ ID NO: 24893 - RNA, 64 nt, hsa
uucuucacaauccuauucagaaacagauuuuuuuuuucauuagagauaugacugucaguugcag

SEQ ID NO: 24894 - RNA, 64 nt, hsa
uuuccacugguaaccaaagaguaccuaaguaguuuuucauuauuuuaaguugaauuugaauaaa

SEQ ID NO: 24895 - RNA, 64 nt, hsa
acugugcccggccaagaucuaacucacgcuuacuuuucauuaaaauauuucuugucgcuuuuag

SEQ ID NO: 24896 - RNA, 64 nt, hsa
gaauuaucuguaacagaaaagccaagacuuuaacuuucauuacauaucuaauaguugauaucac

SEQ ID NO: 24897 - RNA, 64 nt, hsa
augcaaugcacugcauccaugcauucugauagcauuucauuaauuuugauuucaaauggaagau

SEQ ID NO: 24898 - RNA, 64 nt, hsa
cuucuguaagucacagugcuuaaaucucaggauuuuucauuaggagagaccugucguuaaggau

SEQ ID NO: 24899 - RNA, 64 nt, hsa
uaacaagcaaguuuuaaaauuuuaauguuuuggcuuucauuacuucaucuuaauuauagcuuug

SEQ ID NO: 24900 - RNA, 64 nt, hsa
cacaucccaugugggauggagcagaacugcauuauuucauuacauuacucagaacaggcauaua

SEQ ID NO: 24901 - RNA, 64 nt, hsa
uauauaaaauccuacuuuggccaaguuuguuucuuuucauuauaguuuauaugaaaagaucacc

SEQ ID NO: 24902 - RNA, 64 nt, hsa
agucuaaaaauuauuagcuguuacaaauggaacauuucauuauaacgugaucacuuugacuuga

SEQ ID NO: 24903 - RNA, 64 nt, hsa
gaugaagagcaagaccuucucuagguuuucuagcuuucauuaaauguauuuuuuuccccagagc

SEQ ID NO: 24904 - RNA, 64 nt, hsa
uaucuguaaugaaaaugcugcacuucaacugguauuucauuagagaaccgugugugugcgugug

SEQ ID NO: 24905 - RNA, 64 nt, hsa
uaccaaaaagauggcugcaaauguaauuuggaccuuucauuaauuuuguuuucaaaacuagaau

SEQ ID NO: 24906 - RNA, 64 nt, hsa
ggcaggauagagcuaagagaauugggcauuaguauuucauuaugugcaauaagucauuguaagu

SEQ ID NO: 24907 - RNA, 64 nt, hsa
ucucacccaguucagguguauagggaauuuucauuuucauuauuucaaggaauagaguuuuccu

SEQ ID NO: 24908 - RNA, 64 nt, hsa
auauaauuuuuccuuuaaucggagacccuauuuguuucauuaaagaggauuggguagcauaucc

SEQ ID NO: 24909 - RNA, 64 nt, hsa
cucugaaauguacucagugaaaauuuguuuugaguuucauuaaugcuauuucaccaguuagaca

SEQ ID NO: 24910 - RNA, 64 nt, hsa
uacaaucuucccugucaugacuuuaaguucuacuuuucauuaaccauggccugauauuaguucu

SEQ ID NO: 24911 - RNA, 64 nt, hsa
uuacugcccuucucuucuuuauuccucucuccucuuucauuauucuguucuguauuccuuuccc

SEQ ID NO: 24912 - RNA, 64 nt, hsa
cgaaagaacucuaaauccugcagggaggcucuguuuucauuauuuuucuacuuugugucauguc

SEQ ID NO: 24913 - RNA, 64 nt, hsa
auugcucccccuucauucugaugccucccuggggaacaaggauaaugacuuugcaucugcaccu

SEQ ID NO: 24914 - RNA, 64 nt, hsa
cccccauccagcacccuucagcuguguguggacaaacaaggacagaaaaacccaguguccaagg

SEQ ID NO: 24915 - RNA, 64 nt, hsa
cgaggaagguucuguuuugaguauagccagagaaaacaaggauggagaaaaaucuaggacaggu

SEQ ID NO: 24916 - RNA, 64 nt, hsa
cgaggaagauucuguuuuggguauagccagagaaaacaaggauggagaaaaaucuaggacaggu

SEQ ID NO: 24917 - RNA, 64 nt, hsa
gagcugcccgcauacugagagacagcuucuuauaaacaaggagaguuuuugugugugcgagauc

SEQ ID NO: 24918 - RNA, 64 nt, hsa
guuuucuuuuugacaauucuuggacuugagguaaaacaaggaggauuguggccggauuucagau

SEQ ID NO: 24919 - RNA, 64 nt, hsa
ggcauuccacacaggcacugccccaggacaacacaacaaggacagucacaacaaggacaacaag

SEQ ID NO: 24920 - RNA, 64 nt, hsa
cacugccccaggacaacacaacaaggacagucacaacaaggacaacaaggacacaacacaacac

SEQ ID NO: 24921 - RNA, 64 nt, hsa
aggacaacacaacaaggacagucacaacaaggacaacaaggacacaacacaacacacaacaagg

SEQ ID NO: 24922 - RNA, 64 nt, hsa
acaacaaggacaacaaggacacaacacaacacacaacaaggacagucacaacaagccuagagcc

SEQ ID NO: 24923 - RNA, 64 nt, hsa
uaaaaacaagguauauacuuuauuauuuuuugaaaacaaggauauugugaucaauuuuacccug

SEQ ID NO: 24924 - RNA, 64 nt, hsa
aggccuacucauuauuuuagagaaugaaugaagcaacaaggaagagagaccaugacucuaucga

SEQ ID NO: 24925 - RNA, 64 nt, hsa
uuaggcaaaaauaauuuauuuugcucuuguuucuaacaaggacuuggagacuugguggucugag

SEQ ID NO: 24926 - RNA, 64 nt, hsa
ugggguuuccugcauggacaguuguuuggagaacaacaaggacaacuuuauguagagaaaagga

SEQ ID NO: 24927 - RNA, 64 nt, hsa
cagagaugggccuuagaaauguguuuuaagaauuaacaaggagucucaaaaagaaaugagaggg

SEQ ID NO: 24928 - RNA, 64 nt, hsa
uggguugcugucagccccaguuggcuuccuggucaacaaggaccucaagaacugccuguggacc

SEQ ID NO: 24929 - RNA, 64 nt, hsa
aguaggcacaaaguaaaaaauggaaccaucuacuaacaaggauccuuuaaaacugccaagggag

SEQ ID NO: 24930 - RNA, 64 nt, hsa
uauauacacacacacauauauauauauaaaguguaacaaggaacacuaaaacaguguugauucu

SEQ ID NO: 24931 - RNA, 64 nt, hsa
acacguggagagcuucuuccagaagauggacagaaacaaggaugguguggugaccauugaggaa

SEQ ID NO: 24932 - RNA, 64 nt, hsa
caggcuuaauugggccuucaaccuguaugaccuuaacaaggacggcugcaucaccaaggaggug

SEQ ID NO: 24933 - RNA, 64 nt, hsa
uuucuggcugcugaaaccacuuugggccaggaagaacaaggaugaagagguuccugucauuucu

SEQ ID NO: 24934 - RNA, 64 nt, hsa
gugucuuugcuuauagcauuuuucucuaaccuauaacaaggagacauuacauuuuacuuuagaa

SEQ ID NO: 24935 - RNA, 64 nt, hsa
uacacuguuguacuuccgugggcccuccuuccagaacaaggacaacaaggacaagguugaaggg

SEQ ID NO: 24936 - RNA, 64 nt, hsa
guacuuccgugggcccuccuuccagaacaaggacaacaaggacaagguugaagggucuucucau

SEQ ID NO: 24937 - RNA, 64 nt, hsa
ucuauaugguacuugaucuacauuuaaguggaaaaauuagcaguauuugaaagcucaguuuaug

SEQ ID NO: 24938 - RNA, 64 nt, hsa
ugucacuuuugcucucacuguuauguugaauaauaauuagcauauaauugucuacagaagcaag

SEQ ID NO: 24939 - RNA, 64 nt, hsa
uuuugcugaguguucccacuggagucucugguagaauuagcaggucaugcugucaaaaucaugg

SEQ ID NO: 24940 - RNA, 64 nt, hsa
cuucauguuguuaauaauauaaacaaaccuuugaaauuagcauugcaaaagaaucccauuuuug

SEQ ID NO: 24941 - RNA, 64 nt, hsa
aagaugggggaaaauuaagguuugagguuuuagaaauuagcaaguagugcauacccuucuagcc

SEQ ID NO: 24942 - RNA, 64 nt, hsa
ggugucucucaucauuugcucuguuaagggaacaaauuagcacuuuuuagaagucugacaauug

SEQ ID NO: 24943 - RNA, 64 nt, hsa
cagggcagggauaaauacagugcaugucugcuucaauuagcagaugccgcaacuccacacagug

SEQ ID NO: 24944 - RNA, 64 nt, hsa
auugcauguuugcuuuugauguaucccuuugugaaauuagcacuuuuggggccaauggagaaau

SEQ ID NO: 24945 - RNA, 64 nt, hsa
cuuaagcuauaagucucugucauuuuugcuugaaaauuagcaugccucugucuuaaaagagacc

SEQ ID NO: 24946 - RNA, 64 nt, hsa
ccuggaacaggaugaaauagacaaguagagauuuaauuagcaaaaauuuuguagggaaguaaaa

SEQ ID NO: 24947 - RNA, 64 nt, hsa
uaaucaagauuuuauguaacauuuguaaagggaaaauuagcacuuuugugguucuuaagggaaa

SEQ ID NO: 24948 - RNA, 64 nt, hsa
augccccuaggauuuugcuuccuccccggugcuaaauuagcaagcuccuagagaagccauguga

SEQ ID NO: 24949 - RNA, 64 nt, hsa
uuuuuauaccaguauuuuauguagugaagaugucaauuagcaggaaacuaaaaugaauggaaau

SEQ ID NO: 24950 - RNA, 64 nt, hsa
cuaguuuccgacagucaucuccuucugcugggagaauuagcagcaguucagggggcuuauguua

SEQ ID NO: 24951 - RNA, 64 nt, hsa
gcuaauauaaaugggagguuuuacugucaaguccaauuagcaaaacgugguaauaauuuuuuug

SEQ ID NO: 24952 - RNA, 64 nt, hsa
augguaccauguaacagaaugagagcuaauuccaaauuagcaacuucauccugcuuucuauuuu

SEQ ID NO: 24953 - RNA, 64 nt, hsa
cuacuagggccaaaaagagaaaagaaaagaaaauuucuacuaauuucagaccucuagagcaauu

SEQ ID NO: 24954 - RNA, 64 nt, hsa
uugcccauuucuaucacuguggaagcuaaaacacuucuacuagggccaaaaagagaaaagaaaa

SEQ ID NO: 24955 - RNA, 64 nt, hsa
aaaaugggcaauaaucaucucuguuuugcccccauucuacuacccaccacugcccaccccaccc

SEQ ID NO: 24956 - RNA, 64 nt, hsa
gguaauaauguauuacuuugaauucagauuaauguucuacuacuugugacugagaaaaguuuaa

SEQ ID NO: 24957 - RNA, 64 nt, hsa
auuacaguauuuuaauauuuaguuauuuaauuuguucuacuaguuggauacagaacacacaaau

SEQ ID NO: 24958 - RNA, 64 nt, hsa
acauaauaaguaugugucuuuggugacacuaauguucuacuauagcuuauuuucaaacaagggg

SEQ ID NO: 24959 - RNA, 64 nt, hsa
uguuagugugcaugacuaauguaagaaauuguuauucuacuaauauuuacuugugauuguguga

SEQ ID NO: 24960 - RNA, 64 nt, hsa
gguguuucuaaagaaaagaaucagaaaucaaucuuucuacuaauguaaauuugagauuauuuuu

SEQ ID NO: 24961 - RNA, 64 nt, hsa
cuuuggaaaaauggauuugacaguacauaaucaguucuacuaaccaaagcuuguauuuggaaau

SEQ ID NO: 24962 - RNA, 64 nt, hsa
aauuaaaguuuuauuugcuguaguucugauauaauucuacuauuuuguggcacagaaauuugau

SEQ ID NO: 24963 - RNA, 64 nt, hsa
accauaugguguuguauauuauaaacuggugacauucuacuauugaauuauguacaacauuuuc

SEQ ID NO: 24964 - RNA, 64 nt, hsa
agauuauugggggaaaaggaaaauuagugaucucuucuacuauguucuuuaccaaauuguugca

SEQ ID NO: 24965 - RNA, 64 nt, hsa
acuuuuguaaaugugguauacaggacaaacuagacggccguagaaaagauuuauauucaaaugu

SEQ ID NO: 24966 - RNA, 64 nt, hsa
ggacaguuuggcuucacuucucugaccccagccucggccguaaagugaaagagaccggaccagc

SEQ ID NO: 24967 - RNA, 64 nt, hsa
ccauggaauuccacugccagugacccacugccuccggccguacacgacagugccuugacccaac

SEQ ID NO: 24968 - RNA, 64 nt, hsa
aagugcugggauuacaggcgugagccaccguguccggccguaguuuauuuuaaaauauauuuuu

SEQ ID NO: 24969 - RNA, 64 nt, hsa
gcguccaggcucuuugagagccaugggcugcacccggccguaggcuaguguaacucgcauccca

SEQ ID NO: 24970 - RNA, 64 nt, hsa
gguugggaagggaaggccaggccaaaagcuccaccggccguauagauaauguacucgcaguuuu

SEQ ID NO: 24971 - RNA, 64 nt, hsa
ggcauaccuguccuagcaggaucugcccacaccucggccguacaucucugugagagacccccuc

SEQ ID NO: 24972 - RNA, 64 nt, hsa
ccugguggcuggacccccgggauugacuagagaccggccguacaccuucugcaucucacuggag

SEQ ID NO: 24973 - RNA, 64 nt, hsa
gcccccaacugaggccccagcucccagcccugggcggccguaucaucaggugcuccugugcauc

SEQ ID NO: 24974 - RNA, 64 nt, hsa
ugacaccacagcagcugggccccucuuccagcagcggccguauccauccccaggggcugugcuc

SEQ ID NO: 24975 - RNA, 64 nt, hsa
aaaauauuaaagauaucaauacuaagugacaguaucacucuaauauaauauggaucagagcauu

SEQ ID NO: 24976 - RNA, 64 nt, hsa
gauagcuuuauaaagcaguuaguuaguuaguuacucacucuagugauaaaucgggaaauuuaca

SEQ ID NO: 24977 - RNA, 64 nt, hsa
ugaggaaaagugccuaauacaauuagaaucucccucacucuauaguugcccaguugaaaggaua

SEQ ID NO: 24978 - RNA, 64 nt, hsa
gggaugcacugaaaaucugagaacuauuuaccuaucacucuaguuuugaagcaaagauggacuu

SEQ ID NO: 24979 - RNA, 64 nt, hsa
acagucucuuaggcuuccuucucauuuccacuacucacucuagcuucaguugacuucuugacuc

SEQ ID NO: 24980 - RNA, 64 nt, hsa
auaaggaacaagcauuauuccuuugccaacagccucacucuaagaggcuuuuuugcugagucaa

SEQ ID NO: 24981 - RNA, 64 nt, hsa
cugccauucucugggcuggaaugugaagccucagucacucuaaaugaagaauuuucuuuugaau

SEQ ID NO: 24982 - RNA, 64 nt, hsa
uaucuugauuuucaaacaugcauagcuauuuuuaucacucuaaucaguaaggcuacuaucuaga

SEQ ID NO: 24983 - RNA, 64 nt, hsa
caaaacaauaaacuagcagaagaacuaguaaaaauacaagcagauuccucuacugauuucuguu

SEQ ID NO: 24984 - RNA, 64 nt, hsa
ucuggcugugagucaucauggcaaggguaaucuuuacaagcauagcugccugcacucugucucu

SEQ ID NO: 24985 - RNA, 64 nt, hsa
aggaaaugucauuacaguaugaauuauaauuauuuacaagcaauggcuuuuguggccaucauuu

SEQ ID NO: 24986 - RNA, 64 nt, hsa
gaaaagccuagucuucucaagcaaugaggaugacuacaagcagccucuaacuggaucuuaagga

SEQ ID NO: 24987 - RNA, 64 nt, hsa
cccccagcagggcccuccgagguggagcagcagcuacaagcagaggcugaacaccugcggaagg

SEQ ID NO: 24988 - RNA, 64 nt, hsa
cccccagcagggcccuccgagguggaacagcagcuacaagcagaggcugaacaccugcggaagg

SEQ ID NO: 24989 - RNA, 64 nt, hsa
uguggaacugcugcuucuaucagaagaccuaggauacaagcagccacuguuuccuccguuaaca

SEQ ID NO: 24990 - RNA, 64 nt, hsa
uccugagaagagauggaaguggagcugugacuaguacaagcagcccaagaaacucugaacgggg

SEQ ID NO: 24991 - RNA, 64 nt, hsa
uucacaccuuguaauucauaguggagagaaaccuuacaagcacaaugaaugugacaugguuuuu

SEQ ID NO: 24992 - RNA, 64 nt, hsa
aagucauaaggcaauucauacuggagagaaaccuuacaagcauaaugaauguggcaagguuuuu

SEQ ID NO: 24993 - RNA, 64 nt, hsa
ugggccagaacuaagaaugccaagguuuuauauauguguguauauauauauauauauauauaua

SEQ ID NO: 24994 - RNA, 64 nt, hsa
uauauauauauauauauauauauauauauguuuguguguguauauauauauauauauauauaug

SEQ ID NO: 24995 - RNA, 64 nt, hsa
uguguguauauauauauauauauauauauguuuguguguguauauauauguuuguguauauaua

SEQ ID NO: 24996 - RNA, 64 nt, hsa
gugaagacaggcugugacacucuggaugucuugguguguguagacacacauugcagacucuuaa

SEQ ID NO: 24997 - RNA, 64 nt, hsa
gguuuucucuuggugggauaugcagaacuugggauguguguauauauaaauauauaauauauau

SEQ ID NO: 24998 - RNA, 64 nt, hsa
uagggccuagagcucggggugugugugugcgugcuguguguauggugugcacauacgugagugu

SEQ ID NO: 24999 - RNA, 64 nt, hsa
cuguguguauggugugcacauacgugaguguggguguguguagcgugcugaucugugacuccca

SEQ ID NO: 25000 - RNA, 64 nt, hsa
uauucaguaaaaaacaacuucuuuguaaucguuauguguguauauguauguguguaugggugug

SEQ ID NO: 25001 - RNA, 64 nt, hsa
caacuucuuuguaaucguuauguguguauauguauguguguauggguguguguuugugugagag

SEQ ID NO: 25002 - RNA, 64 nt, hsa
uuuacuucuagagauaguacauaaaggugguauguguguguaugcuacuacaaaaaaguuguua

SEQ ID NO: 25003 - RNA, 64 nt, hsa
auggcguuugggagcucguguguguaugugugcguguguguaugugugcaugugugugugugug

SEQ ID NO: 25004 - RNA, 64 nt, hsa
cuauugagagcguguaauggcguuugggagcucguguguguaugugugcguguguguaugugug

SEQ ID NO: 25005 - RNA, 64 nt, hsa
acuagcaccuuguguguaugugugugcgcgcacguguguguagguggguauguguuguuuaaaa

SEQ ID NO: 25006 - RNA, 64 nt, hsa
cacaagcagaagcacagaggggucacuagcaccuuguguguaugugugugcgcgcacgugugug

SEQ ID NO: 25007 - RNA, 64 nt, hsa
cugacauucggcuugauccauguccaggugcaacuguguguacaccagggaucuguuuggaaac

SEQ ID NO: 25008 - RNA, 64 nt, hsa
uaugugcauuaggacuuuuaucaugcccuuguucuguguguaguuacuugacagcaucaaaugc

SEQ ID NO: 25009 - RNA, 64 nt, hsa
cugggcccuacagacaggggcacacgcuuauggauguguguaccauugagaugagaauggguag

SEQ ID NO: 25010 - RNA, 64 nt, hsa
auguguguuguguauaugcaugugugugugugcguguguguauaguuuuagcuccaagccaagc

SEQ ID NO: 25011 - RNA, 64 nt, hsa
ucugguguuacacauacacacucauacguguguguguguguauguguguguguguauguguaau

SEQ ID NO: 25012 - RNA, 64 nt, hsa
uacacacucauacguguguguguguguauguguguguguguauguguaaugauuuguguccauu

SEQ ID NO: 25013 - RNA, 64 nt, hsa
ggugggcguggagaguguaucuuuuuuugggguguguguguauauguguguguguaugugugug

SEQ ID NO: 25014 - RNA, 64 nt, hsa
guguaucuuuuuuugggguguguguguauauguguguguguauguguguguguguuuaauaguu

SEQ ID NO: 25015 - RNA, 64 nt, hsa
ucggaggaggagcuccugccugcgguuuuguguauguguguaugugugugcguguuugugugcg

SEQ ID NO: 25016 - RNA, 64 nt, hsa
agaucagagguucgacuguggcugggacaggaguuguguguagaaauucaccagguggccugag

SEQ ID NO: 25017 - RNA, 64 nt, hsa
guguguacacgugcauguacacacagcuguacaguguguguauauauguauacauauauguaug

SEQ ID NO: 25018 - RNA, 64 nt, hsa
uuauucagguaguguccagcuauauguguauguguguguguacacgugcauguacacacagcug

SEQ ID NO: 25019 - RNA, 64 nt, hsa
agcagccucauuugaauugcuuucauagcuuucauguguguaugguuuagaaguacacuuaccu

SEQ ID NO: 25020 - RNA, 64 nt, hsa
uuaggaauacauguuguaaauauauaucuguguauguguguauacacacacacagacacacaca

SEQ ID NO: 25021 - RNA, 64 nt, hsa
agugugucuguaugcgugccugucugugugcggguguguguaugugcguagccucaugcuuagg

SEQ ID NO: 25022 - RNA, 64 nt, hsa
cuuagacuaaauaugagcugacuaucucuuuugauguguguacauaggugugagugugucugua

SEQ ID NO: 25023 - RNA, 64 nt, hsa
ucuugucuuuuuuuucaacccacauggagugcccuguguguacauacugaccuuuuuuuuuuuu

SEQ ID NO: 25024 - RNA, 64 nt, hsa
agcagaaucauuuuuucuauguaagguguuaauguguguguaugugcuuugguuguaggaaaac

SEQ ID NO: 25025 - RNA, 64 nt, hsa
cugguucagcaggguguguguguguguguguguguguguguaugaaugguauauuuauuacauu

SEQ ID NO: 25026 - RNA, 64 nt, hsa
gagcagacgcaaugguaggagccugcacaggauguguguguauggacauucugaagguuugcug

SEQ ID NO: 25027 - RNA, 64 nt, hsa
gucgugagauauuguauguguaugcacaugaucauguguguaugugcgugcgugcgugcgugug

SEQ ID NO: 25028 - RNA, 64 nt, hsa
gcgagaagaccccugacuaccacauccuuguguuuguguguagagacgggggauagugagaacc

SEQ ID NO: 25029 - RNA, 64 nt, hsa
uauacacauguauacguauguacgugucuguagguguguguauauauauauauauuuaugcauc

SEQ ID NO: 25030 - RNA, 64 nt, hsa
uccucucucgacauucucucuacauacguauauguguguguauaucgaugugugcauauauaca

SEQ ID NO: 25031 - RNA, 64 nt, hsa
uauacauaucuacacauacauauauacacauauauguguguauguagauauguagacuauccua

SEQ ID NO: 25032 - RNA, 64 nt, hsa
guuugugugugacuuguaugcuuguguguguaaauguguguacauauacauauauacauaucua

SEQ ID NO: 25033 - RNA, 64 nt, hsa
guguguguguguuugugugugacuuguaugcuuguguguguaaauguguguacauauacauaua

SEQ ID NO: 25034 - RNA, 64 nt, hsa
caggcacagaaacagacagaaaugauacuguauguguguguauuuaugucugaagaaagucccc

SEQ ID NO: 25035 - RNA, 64 nt, hsa
gagggguuggguuauuuuaaccuuggugaauuguuguguguacucagaguguauuuucuuugug

SEQ ID NO: 25036 - RNA, 64 nt, hsa
agaaauauauaugucuaaugugcagaaauauauauguguguauguguguauauauaugcacaca

SEQ ID NO: 25037 - RNA, 64 nt, hsa
auaugucuaaugugcagaaauauauauguguguauguguguauauauaugcacacacacacaga

SEQ ID NO: 25038 - RNA, 64 nt, hsa
accuaucuucuaugaaagccuaugugcauguguguguguguaugaguuucuaugugagcaugca

SEQ ID NO: 25039 - RNA, 64 nt, hsa
uauuuauacaucuucugaaauauauuucaaaauauguguguacguguguauauguguauauaua

SEQ ID NO: 25040 - RNA, 64 nt, hsa
uauauauauauauauguguguguguguguguguguguguguauauauauauauauauauauaua

SEQ ID NO: 25041 - RNA, 64 nt, hsa
uauauauauauauauauauauauauauauauauguguguguauauauauauauauguguauaua

SEQ ID NO: 25042 - RNA, 64 nt, hsa
acugcuuuucccaggaggcuccaggauuaggaaauguguguauuuagugaaaaauagguuugua

SEQ ID NO: 25043 - RNA, 64 nt, hsa
uuugucacaucuaagcugugguguguuccccauguguguguacaacacuggugacuccaggaac

SEQ ID NO: 25044 - RNA, 64 nt, hsa
uguuagcuuguguaagaauguguuuucaaaacaguguguguauugggagugauggguauguguu

SEQ ID NO: 25045 - RNA, 64 nt, hsa
agauggaaucaggaagucgagacaccaucccagguguguguaagagagagagagagaacaggga

SEQ ID NO: 25046 - RNA, 64 nt, hsa
auguacacacaaaaauguguguauacauuuggguuguguguauacaucuugccauauacaauau

SEQ ID NO: 25047 - RNA, 64 nt, hsa
gguauaccaaauagcauacauguacacacaaaaauguguguauacauuuggguuguguguauac

SEQ ID NO: 25048 - RNA, 64 nt, hsa
aaaucuaagaaguauuuuacccacuggugguuuguguguguaugaagguaaauauuuauauauu

SEQ ID NO: 25049 - RNA, 64 nt, hsa
uuaaauauucgaaugcauguagauuuguuaaauguguguguauaguaacacugaagaacuaaaa

SEQ ID NO: 25050 - RNA, 64 nt, hsa
agcauguguguguagcuguguguguguguguguguguguguauggauauguagaauuguauuug

SEQ ID NO: 25051 - RNA, 64 nt, hsa
ccauccuguacuacccaagcaccugcuuagcauguguguguagcugugugugugugugugugug

SEQ ID NO: 25052 - RNA, 64 nt, hsa
aucauuggacaccuuugcguuuugcugcuaacaguguguguaugucacccucuuuauaucuggu

SEQ ID NO: 25053 - RNA, 64 nt, hsa
auauaagaccauuugcuguuuuuauuaaaguauguguguguaucagugucucaaugugaagauu

SEQ ID NO: 25054 - RNA, 64 nt, hsa
ccaaauuguggcaggacuucuuucugcggaaauguguguguauacuuauguguguguaugugug

SEQ ID NO: 25055 - RNA, 64 nt, hsa
cuucuuucugcggaaauguguguguauacuuauguguguguaugugugagugugaauauaugua

SEQ ID NO: 25056 - RNA, 64 nt, hsa
acgcaguuuaauugaggaccguguuguguguguauguguguacacacgcucugucuuuaaugac

SEQ ID NO: 25057 - RNA, 64 nt, hsa
uuuuucugacgcaguuuaauugaggaccguguuguguguguauguguguacacacgcucugucu

SEQ ID NO: 25058 - RNA, 64 nt, hsa
ugaauagcccccaaacagugggaguguguauguauguguguauguauguaucuauguauaugcu

SEQ ID NO: 25059 - RNA, 64 nt, hsa
cauauguuuguaugaguguauauauauaucuguguguguguaucucuaacgucaguguauaagu

SEQ ID NO: 25060 - RNA, 64 nt, hsa
gggaaauuuuguguguguaguauguguguguuuguguguguaugugugugugugcccauagcac

SEQ ID NO: 25061 - RNA, 64 nt, hsa
caccuggugcaucuggguugaaugggaaauuuuguguguguaguauguguguguuugugugugu

SEQ ID NO: 25062 - RNA, 64 nt, hsa
cauauauacacauauacacaucuauguauggauauguguguauacacauauacacaucucuguc

SEQ ID NO: 25063 - RNA, 64 nt, hsa
cggggaugcgcgcgagugugugcgugcucgcguguguguguaugugugugugugagugugugug

SEQ ID NO: 25064 - RNA, 64 nt, hsa
uggacuuucuuuugaaagaaaacuugauguauucuguguguaugguuuuuccccagauuaguca

SEQ ID NO: 25065 - RNA, 64 nt, hsa
uugguuucucuugguuugugcuuacauguauggauguguguauauguacagugaaaauguuguc

SEQ ID NO: 25066 - RNA, 64 nt, hsa
uuacuucugcccuuucuauccaucgucuucauuuuguguguacagugcuguguguaagcuuauc

SEQ ID NO: 25067 - RNA, 64 nt, hsa
ucuauccaucgucuucauuuuguguguacagugcuguguguaagcuuaucaguguguuuuuuua

SEQ ID NO: 25068 - RNA, 64 nt, hsa
cuaaagaugggguguguguggauguguguguguguguguguacaccauuguguguuuguaaaau

SEQ ID NO: 25069 - RNA, 64 nt, hsa
aaaauguguauguucaugaguaaggguguguguguguguguauuaaaauuccagagugaccgug

SEQ ID NO: 25070 - RNA, 64 nt, hsa
uuuuccaugugaugauuuacuaguuguauuuccuuguguguaaaauguucauucauuucuuaug

SEQ ID NO: 25071 - RNA, 64 nt, hsa
agaugggaaaacgggauuccuuuucagaaguaccuguguguaucuguuaauaaccacagggguu

SEQ ID NO: 25072 - RNA, 64 nt, hsa
ugggccugugugugugcccguguguguguauguguguguguauguuucuuagccccuuggauuc

SEQ ID NO: 25073 - RNA, 64 nt, hsa
cucugggcacagugggccugugugugugcccguguguguguauguguguguguauguuucuuag

SEQ ID NO: 25074 - RNA, 64 nt, hsa
gucuuuaaaguauuuuucuuccugauuaaaaauguguguguauguguguguguguguguauaua

SEQ ID NO: 25075 - RNA, 64 nt, hsa
uuccugauuaaaaauguguguguauguguguguguguguguauauauauauauauuuuuaaauc

SEQ ID NO: 25076 - RNA, 64 nt, hsa
cauauacguauauauaaauauauauauacauauguguguguauauauauauauauuuuuuuuuu

SEQ ID NO: 25077 - RNA, 64 nt, hsa
uuuuccaguuggaaacaguaaagguuguaagcuuuguguguacaaaagaaaacagggaaugcag

SEQ ID NO: 25078 - RNA, 64 nt, hsa
uucuauuguuguacacagaaauacaguuaaguuuuguguguagucuuacgauguuuaguaaacu

SEQ ID NO: 25079 - RNA, 64 nt, hsa
ucuguuuauaaacauuguauaguuggaaucauauuguguguaauguuguaugucuuguuuacuc

SEQ ID NO: 25080 - RNA, 64 nt, hsa
uauauuuauuugcaguacagugcgcgcguguguguguguguacgcgcacgugugggugagugcg

SEQ ID NO: 25081 - RNA, 64 nt, hsa
cacaaggaugcuuuagggagagaucacuucaguguguguguauauuuauuugcaguacagugcg

SEQ ID NO: 25082 - RNA, 64 nt, hsa
guguuugcagggagauuucugaugccucuguggguguguguaaguuaaaguggccacauuuaag

SEQ ID NO: 25083 - RNA, 64 nt, hsa
acucagggccccacuuuuuguugcuuucuagacuuguguguagaaagaagauuaaugaucacuu

SEQ ID NO: 25084 - RNA, 64 nt, hsa
aaggaagcugugcguguguguguguguauguguguguguguauguguaucucacacucaugcau

SEQ ID NO: 25085 - RNA, 64 nt, hsa
aguucuuuggcugaaaggaagcugugcguguguguguguguauguguguguguguauguguauc

SEQ ID NO: 25086 - RNA, 64 nt, hsa
guguguguguguguguguguguguguguacucuguguguguaugagagagagaaaugcuaaccu

SEQ ID NO: 25087 - RNA, 64 nt, hsa
agagagagacuguguguguguguguguguguguguguguguacucuguguguguaugagagaga

SEQ ID NO: 25088 - RNA, 64 nt, hsa
ggugugugugucugucuguguguaugcauacauauguguguauauaugguuuugucaggugugu

SEQ ID NO: 25089 - RNA, 64 nt, hsa
ggccuggcuagagcuucgggugugugugucugucuguguguaugcauacauauguguguauaua

SEQ ID NO: 25090 - RNA, 64 nt, hsa
cuuuuuuauuuuguuugauucauucgagacaacauguguguauguguguguguguguguguaga

SEQ ID NO: 25091 - RNA, 64 nt, hsa
cauucgagacaacauguguguauguguguguguguguguguagauaaugugguuuuuguauggu

SEQ ID NO: 25092 - RNA, 64 nt, hsa
aaauggcuauugcauuuugggauucuucgcauuuuguguguauauuuuuacagugagguacauu

SEQ ID NO: 25093 - RNA, 64 nt, hsa
ucuaaggauuuuuuaaggagggaauauauauguguguguguauauaagcucccacauagauaca

SEQ ID NO: 25094 - RNA, 64 nt, hsa
auggcauguauagggaagagugagagaguguguguguguguauguguguguaauauuuauauau

SEQ ID NO: 25095 - RNA, 64 nt, hsa
uagggaagagugagagaguguguguguguguauguguguguaauauuuauauauauucacagua

SEQ ID NO: 25096 - RNA, 64 nt, hsa
aaaauaagcuuuccauuuuauucauaaucuaauguguguguauauauguauguguguaugugug

SEQ ID NO: 25097 - RNA, 64 nt, hsa
uuuauucauaaucuaauguguguguauauauguauguguguauguguguguauauauagaugua

SEQ ID NO: 25098 - RNA, 64 nt, hsa
aucuaauguguguguauauauguauguguguauguguguguauauauagauguauauauauaca

SEQ ID NO: 25099 - RNA, 64 nt, hsa
ugucucucucucucucuccauauauauauguguguguguguauauauauauauaugugugugug

SEQ ID NO: 25100 - RNA, 64 nt, hsa
uguguguguauauauauauauauguguguguguguguguguauacauauauacacauauauaca

SEQ ID NO: 25101 - RNA, 64 nt, hsa
ggauguuuuccuaguguguguguguguguguguguguguguaugagagagagagagagagacaa

SEQ ID NO: 25102 - RNA, 64 nt, hsa
cuggcauagcugcucagggagaauuacgugccucuguguguaaaauugccuuuguguucuccug

SEQ ID NO: 25103 - RNA, 64 nt, hsa
gaagaggagagagagagagacugagcgcuaggaguguguguaugugugugugugugugugugug

SEQ ID NO: 25104 - RNA, 64 nt, hsa
aguguguguauguguguguguguguguguguguguguguguauguguguagcgggagauguggg

SEQ ID NO: 25105 - RNA, 64 nt, hsa
uauguguguguguguguguguguguguguguguauguguguagcgggagaugugggcggagcga

SEQ ID NO: 25106 - RNA, 64 nt, hsa
uguguguguguguguguguguguguguguguguguguguguaagggaguacuuuaaccuugcca

SEQ ID NO: 25107 - RNA, 64 nt, hsa
ucaucucucgcuguguccuguguauguguggguguguguguauuuggguguguaaauguugguu

SEQ ID NO: 25108 - RNA, 64 nt, hsa
cauuuuggguuuuugccuccucccacuguguguauguguguauauguauguuuugaauauguuu

SEQ ID NO: 25109 - RNA, 64 nt, hsa
aucagcuucauuuuggguuuuugccuccucccacuguguguauguguguauauguauguuuuga

SEQ ID NO: 25110 - RNA, 64 nt, hsa
gggguaugaaaacacugagaaggagaugaaggaguguguguagcauggggguguguacaacuua

SEQ ID NO: 25111 - RNA, 64 nt, hsa
cugauaagcucugugaaagagaagaugugccugguguguguaaugcggcugggguaugaaaaca

SEQ ID NO: 25112 - RNA, 64 nt, hsa
auguguuuauguucuucacaugcauauguguguauguguguauaucuuuccccccaucaauugg

SEQ ID NO: 25113 - RNA, 64 nt, hsa
uuggcuuuauguguuuauguucuucacaugcauauguguguauguguguauaucuuucccccca

SEQ ID NO: 25114 - RNA, 64 nt, hsa
aguuaugaguauaauacauuacauguaaauuaaguguguguauacuguaaucgugcuauuuuuu

SEQ ID NO: 25115 - RNA, 64 nt, hsa
cuaguucaaaacaaccacuuucucaggcuucucauguguguagcuaagcuaccuugucauaugu

SEQ ID NO: 25116 - RNA, 64 nt, hsa
cacuuuugcuccaggccacuuguguguguauguguguguguaccacugccaucugaacaaacua

SEQ ID NO: 25117 - RNA, 64 nt, hsa
cuacggauuuugcacuuuugcuccaggccacuuguguguguauguguguguguaccacugccau

SEQ ID NO: 25118 - RNA, 64 nt, hsa
aaccucuggagcaauguugcuuaggaugugugcauguguguaagugugugugugugugugugug

SEQ ID NO: 25119 - RNA, 64 nt, hsa
ugugugcauguguguaaguguguguguguguguguguguguauacaugccagugacacuuccag

SEQ ID NO: 25120 - RNA, 64 nt, hsa
agcaguauuagccguguguguaugcaugugaguguguguguaugugugugugugcaugcauaug

SEQ ID NO: 25121 - RNA, 64 nt, hsa
ugcccaggagccaugccuugagcaguauuagccguguguguaugcaugugaguguguguguaug

SEQ ID NO: 25122 - RNA, 64 nt, hsa
cauacgugaacacaugccuguguguguguguguguguguguacuuguaugcacguaggcaccag

SEQ ID NO: 25123 - RNA, 64 nt, hsa
uugccccuccuccagcacacuagagcucuggccuuguguguauauguauacauacgugaacaca

SEQ ID NO: 25124 - RNA, 64 nt, hsa
agaagaauucagaguaugugucucagaaaaucuguguguguacaugugcauguguagauaugug

SEQ ID NO: 25125 - RNA, 64 nt, hsa
aaaaucuguguguguacaugugcauguguagauauguguguauauguaucaggaaaggcauucu

SEQ ID NO: 25126 - RNA, 64 nt, hsa
guuuacgugauagauuaggcucuuacuacauauguguguguauauauauguauuugauucuacc

SEQ ID NO: 25127 - RNA, 64 nt, hsa
aggggugggagggauggggagacuccccucuugcuguguguacuggacacgcaggaagcaugcu

SEQ ID NO: 25128 - RNA, 64 nt, hsa
uggcugugugucugcuuguaugcuuuuauaggccuguguguauagcuguguguguguucaagug

SEQ ID NO: 25129 - RNA, 64 nt, hsa
gaccugcucaggcgucgcuggauuuauucacuuguguguguaccuguggcugugugucugcuug

SEQ ID NO: 25130 - RNA, 64 nt, hsa
aagggcauguguggggugugugugggauguggguuguguguauaucuggcaugugucccaguca

SEQ ID NO: 25131 - RNA, 64 nt, hsa
gggggugugugugggaugcguguguauaaggggguguguguaguguguguuggguguggggugu

SEQ ID NO: 25132 - RNA, 64 nt, hsa
guguauguguguagggguguggugggguguggcguguguguaugauguaugugggcuguguauc

SEQ ID NO: 25133 - RNA, 64 nt, hsa
uguaagggugaggugggggugugugugccguguauguguguagggguguggugggguguggcgu

SEQ ID NO: 25134 - RNA, 64 nt, hsa
uucaaagcuaaagauguauauauacauauacuuuuguguguauauauacacauauguguguaug

SEQ ID NO: 25135 - RNA, 64 nt, hsa
uauacauauacuuuuguguguauauauacacauauguguguaugcaguuugucagguuauauau

SEQ ID NO: 25136 - RNA, 64 nt, hsa
agcuuugaacccuggagugaggacggugaugcccuguguguauuaauaugcuauguaaggcugg

SEQ ID NO: 25137 - RNA, 64 nt, hsa
aaaaaauacauauacacauaaauauauauauguguguguguauauauauauauauauauauaua

SEQ ID NO: 25138 - RNA, 64 nt, hsa
uguauuccauauauauauuccauauguauauguguguguguauaaaauauauauuugccuuaaa

SEQ ID NO: 25139 - RNA, 64 nt, hsa
auuccacauguguguauguggaauauauuccacauguguguauguggaauauauuccacaugug

SEQ ID NO: 25140 - RNA, 64 nt, hsa
caagguaguuccauauauauacauauauuccacauguguguauguggaauauauacauauauuc

SEQ ID NO: 25141 - RNA, 64 nt, hsa
cccgcccguguguguguuuguguguguguguguguguguguauucccccugggcuccuucuugg

SEQ ID NO: 25142 - RNA, 64 nt, hsa
aucuguguguguugguucagaguguguguguguguguguguauucccgcccguguguguguuug

SEQ ID NO: 25143 - RNA, 64 nt, hsa
gucuaaaaauaaaccaaaggacauuaugugugcauguguguauaagugcacacagaaauauaua

SEQ ID NO: 25144 - RNA, 64 nt, hsa
acagaaauauauauacauauguagacuauauacauguguguauauauguguauauauacauaca

SEQ ID NO: 25145 - RNA, 64 nt, hsa
acuuguauaaauguauauacacauauaccuauaauguguguauguguauuuauugaagaaacag

SEQ ID NO: 25146 - RNA, 64 nt, hsa
aauagcauauauuuuuacauguacuauaucuagguguguguacaaguguguguaaaaauauaua

SEQ ID NO: 25147 - RNA, 64 nt, hsa
uuuuacauguacuauaucuagguguguguacaaguguguguaaaaauauauaccuuguguguaa

SEQ ID NO: 25148 - RNA, 64 nt, hsa
guguguguacaaguguguguaaaaauauauaccuuguguguaagcagcccuuuuuuuuuuuggu

SEQ ID NO: 25149 - RNA, 64 nt, hsa
guccgaaauaauagcaauucaugggcuguguguguguguguauguguguguguguguguguaug

SEQ ID NO: 25150 - RNA, 64 nt, hsa
augggcuguguguguguguguauguguguguguguguguguauguuuaauuauguuaccuuuuc

SEQ ID NO: 25151 - RNA, 64 nt, hsa
gaacuggugggcaguguccagcucuccagagggguguguguaugcgugugcguguguguguaua

SEQ ID NO: 25152 - RNA, 64 nt, hsa
gcucuccagagggguguguguaugcgugugcguguguguguauauaugugggaggucaccugac

SEQ ID NO: 25153 - RNA, 64 nt, hsa
uuucauaguuuacauggguguguguagggguguguguguguauguguguggguuagggcuuuuu

SEQ ID NO: 25154 - RNA, 64 nt, hsa
cuucaacuuccuugauuuucauaguuuacauggguguguguagggguguguguguguaugugug

SEQ ID NO: 25155 - RNA, 64 nt, hsa
ccucaaauacaguauuguggucauuuugaugauauguguguaaaaugugaauaauccaauuggu

SEQ ID NO: 25156 - RNA, 64 nt, hsa
cuguggcuuguauccuucaguccaccacagcaaauguguguagauuucaugcucgacacuuacc

SEQ ID NO: 25157 - RNA, 64 nt, hsa
uuggauauauuauguguguguguguguguguguguguguguaugguguguauuccauaucuauu

SEQ ID NO: 25158 - RNA, 64 nt, hsa
uguugccuaaaaagcaaaccuacaaguauguugguguguguauguguauggaccaguuuguuug

SEQ ID NO: 25159 - RNA, 64 nt, hsa
uauauauauauauauauauauguguguguguguguguguguauauguguuuauagagauacaca

SEQ ID NO: 25160 - RNA, 64 nt, hsa
uauauguguuuauagagauacacacacauauauauguguguauauauauacacauacauauaua

SEQ ID NO: 25161 - RNA, 64 nt, hsa
uaaaauauauaauauacaauauaaauauauaguguguguguaugcguguguguagacacacacg

SEQ ID NO: 25162 - RNA, 64 nt, hsa
uauacaauauaaauauauaguguguguguaugcguguguguagacacacacgcauacacacaua

SEQ ID NO: 25163 - RNA, 64 nt, hsa
uguguguguguguguguguguguguguguaugccuguguguauauauagaagucauuauggcag

SEQ ID NO: 25164 - RNA, 64 nt, hsa
aaauuguguguguguguguguguguguguguguguguguguaugccuguguguauauauagaag

SEQ ID NO: 25165 - RNA, 64 nt, hsa
acggcauaaggacaucuccacuuuucucuguaccuguguguauagaaauagauuagagcacagu

SEQ ID NO: 25166 - RNA, 64 nt, hsa
uguguguauguguguauguguguguguguguguguguguguauguguacaaacauguauuuucu

SEQ ID NO: 25167 - RNA, 64 nt, hsa
agcaaagauuuauaauuuaauguguauguguguauguguguaugugugugugugugugugugug

SEQ ID NO: 25168 - RNA, 64 nt, hsa
aaaucaagagcaaagauuuauaauuuaauguguauguguguauguguguaugugugugugugug

SEQ ID NO: 25169 - RNA, 64 nt, hsa
cuuccaaaggaauuauuuugugugugugccuguguguguguagagacauaaaggagggugaugu

SEQ ID NO: 25170 - RNA, 64 nt, hsa
uugcauggggugcuauaugcagacuuccaugguuuguguguagccaugaacacagcuugcuugc

SEQ ID NO: 25171 - RNA, 64 nt, hsa
cagggcuguagcugugaggucuugucuccaaggguguguguaugucuccguggaucagccacag

SEQ ID NO: 25172 - RNA, 64 nt, hsa
uacuacccuauaugugaauaucccuguauguacuuguguguacuuguuggucuguaucuuaguu

SEQ ID NO: 25173 - RNA, 64 nt, hsa
acggccugaggacauuuccaguuuucucuguaccuguguguauagaaauagaucagagcacagu

SEQ ID NO: 25174 - RNA, 64 nt, hsa
auuugauuauaaccacaaauuguguguguguguguguguguauauauagaagucauuauggcag

SEQ ID NO: 25175 - RNA, 64 nt, hsa
agaaaaaaugaugauagagucccaaaaagaagagaaaaaaaaugcccaaguugcccuuuaaaaa

SEQ ID NO: 25176 - RNA, 64 nt, hsa
aaagaagagaaaaaaaaugcccaaguugcccuuuaaaaaaaaagagcguaaauacaaacaggag

SEQ ID NO: 25177 - RNA, 64 nt, hsa
aagaagagaaaaaaaaugcccaaguugcccuuuaaaaaaaaagagcguaaauacaaacaggagu

SEQ ID NO: 25178 - RNA, 64 nt, hsa
aauaaccagcgcuccaaaguguuuuucugcuuugaaaaaaaaaaauuccacaagcuuuuaaagg

SEQ ID NO: 25179 - RNA, 64 nt, hsa
auaaccagcgcuccaaaguguuuuucugcuuugaaaaaaaaaaauuccacaagcuuuuaaaggu

SEQ ID NO: 25180 - RNA, 64 nt, hsa
uaaccagcgcuccaaaguguuuuucugcuuugaaaaaaaaaaauuccacaagcuuuuaaaggug

SEQ ID NO: 25181 - RNA, 64 nt, hsa
aaccagcgcuccaaaguguuuuucugcuuugaaaaaaaaaaauuccacaagcuuuuaaaggugc

SEQ ID NO: 25182 - RNA, 64 nt, hsa
aggagaacauuuugcuaaagcaugacuaaacugcaaaaaaaaaaaaagagcuacuguauuuaga

SEQ ID NO: 25183 - RNA, 64 nt, hsa
ggagaacauuuugcuaaagcaugacuaaacugcaaaaaaaaaaaaagagcuacuguauuuagac

SEQ ID NO: 25184 - RNA, 64 nt, hsa
gagaacauuuugcuaaagcaugacuaaacugcaaaaaaaaaaaaagagcuacuguauuuagacu

SEQ ID NO: 25185 - RNA, 64 nt, hsa
agaacauuuugcuaaagcaugacuaaacugcaaaaaaaaaaaaagagcuacuguauuuagacuu

SEQ ID NO: 25186 - RNA, 64 nt, hsa
gaacauuuugcuaaagcaugacuaaacugcaaaaaaaaaaaaagagcuacuguauuuagacuua

SEQ ID NO: 25187 - RNA, 64 nt, hsa
aacauuuugcuaaagcaugacuaaacugcaaaaaaaaaaaaagagcuacuguauuuagacuuag

SEQ ID NO: 25188 - RNA, 64 nt, hsa
uagacuuaggaaaaaaggcagaguaacauuacuuaaaaaaaaaaggauauguuuacauuuaauu

SEQ ID NO: 25189 - RNA, 64 nt, hsa
agacuuaggaaaaaaggcagaguaacauuacuuaaaaaaaaaaggauauguuuacauuuaauuu

SEQ ID NO: 25190 - RNA, 64 nt, hsa
gacuuaggaaaaaaggcagaguaacauuacuuaaaaaaaaaaggauauguuuacauuuaauuuu

SEQ ID NO: 25191 - RNA, 64 nt, hsa
uccacucacuccaacaaagaacacuuagaaugauaaaaaaaaaaaaaaaaaaccugacaaaaga

SEQ ID NO: 25192 - RNA, 64 nt, hsa
ccacucacuccaacaaagaacacuuagaaugauaaaaaaaaaaaaaaaaaaccugacaaaagaa

SEQ ID NO: 25193 - RNA, 64 nt, hsa
cacucacuccaacaaagaacacuuagaaugauaaaaaaaaaaaaaaaaaaccugacaaaagaaa

SEQ ID NO: 25194 - RNA, 64 nt, hsa
acucacuccaacaaagaacacuuagaaugauaaaaaaaaaaaaaaaaaaccugacaaaagaaau

SEQ ID NO: 25195 - RNA, 64 nt, hsa
cucacuccaacaaagaacacuuagaaugauaaaaaaaaaaaaaaaaaaccugacaaaagaaaua

SEQ ID NO: 25196 - RNA, 64 nt, hsa
ucacuccaacaaagaacacuuagaaugauaaaaaaaaaaaaaaaaaaccugacaaaagaaauag

SEQ ID NO: 25197 - RNA, 64 nt, hsa
cacuccaacaaagaacacuuagaaugauaaaaaaaaaaaaaaaaaaccugacaaaagaaauagu

SEQ ID NO: 25198 - RNA, 64 nt, hsa
acuccaacaaagaacacuuagaaugauaaaaaaaaaaaaaaaaaaccugacaaaagaaauagua

SEQ ID NO: 25199 - RNA, 64 nt, hsa
cuccaacaaagaacacuuagaaugauaaaaaaaaaaaaaaaaaaccugacaaaagaaauaguau

SEQ ID NO: 25200 - RNA, 64 nt, hsa
uccaacaaagaacacuuagaaugauaaaaaaaaaaaaaaaaaaccugacaaaagaaauaguaug

SEQ ID NO: 25201 - RNA, 64 nt, hsa
ccaacaaagaacacuuagaaugauaaaaaaaaaaaaaaaaaaccugacaaaagaaauaguauga

SEQ ID NO: 25202 - RNA, 64 nt, hsa
cugcuggaaaucagaaaauauaauaaaauugcacaaaaaaaaaaaugaaaaagaugcagacugg

SEQ ID NO: 25203 - RNA, 64 nt, hsa
ugcuggaaaucagaaaauauaauaaaauugcacaaaaaaaaaaaugaaaaagaugcagacuggu

SEQ ID NO: 25204 - RNA, 64 nt, hsa
gcuggaaaucagaaaauauaauaaaauugcacaaaaaaaaaaaugaaaaagaugcagacugguc

SEQ ID NO: 25205 - RNA, 64 nt, hsa
cuggaaaucagaaaauauaauaaaauugcacaaaaaaaaaaaugaaaaagaugcagacuggucu

SEQ ID NO: 25206 - RNA, 64 nt, hsa
acuccagccuggcgacagagcaagacucugucucaaaaaaaaaaaaaaauuuaguaaaaaucaa

SEQ ID NO: 25207 - RNA, 64 nt, hsa
cuccagccuggcgacagagcaagacucugucucaaaaaaaaaaaaaaauuuaguaaaaaucaau

SEQ ID NO: 25208 - RNA, 64 nt, hsa
uccagccuggcgacagagcaagacucugucucaaaaaaaaaaaaaaauuuaguaaaaaucaaug

SEQ ID NO: 25209 - RNA, 64 nt, hsa
ccagccuggcgacagagcaagacucugucucaaaaaaaaaaaaaaauuuaguaaaaaucaaugg

SEQ ID NO: 25210 - RNA, 64 nt, hsa
cagccuggcgacagagcaagacucugucucaaaaaaaaaaaaaaauuuaguaaaaaucaauggu

SEQ ID NO: 25211 - RNA, 64 nt, hsa
agccuggcgacagagcaagacucugucucaaaaaaaaaaaaaaauuuaguaaaaaucaauggua

SEQ ID NO: 25212 - RNA, 64 nt, hsa
gccuggcgacagagcaagacucugucucaaaaaaaaaaaaaaauuuaguaaaaaucaaugguaa

SEQ ID NO: 25213 - RNA, 64 nt, hsa
ccuggcgacagagcaagacucugucucaaaaaaaaaaaaaaauuuaguaaaaaucaaugguaag

SEQ ID NO: 25214 - RNA, 64 nt, hsa
ccugggcaaaaaagcaaaacuccaucucaaagagaaaaaaaaaaaagaccgggugugguggcuc

SEQ ID NO: 25215 - RNA, 64 nt, hsa
cugggcaaaaaagcaaaacuccaucucaaagagaaaaaaaaaaaagaccgggugugguggcuca

SEQ ID NO: 25216 - RNA, 64 nt, hsa
ugggcaaaaaagcaaaacuccaucucaaagagaaaaaaaaaaaagaccgggugugguggcucac

SEQ ID NO: 25217 - RNA, 64 nt, hsa
gggcaaaaaagcaaaacuccaucucaaagagaaaaaaaaaaaagaccgggugugguggcucaca

SEQ ID NO: 25218 - RNA, 64 nt, hsa
ggcaaaaaagcaaaacuccaucucaaagagaaaaaaaaaaaagaccgggugugguggcucacac

SEQ ID NO: 25219 - RNA, 64 nt, hsa
uaacauacuugaauucucaaauuuccuuugggguaaaaaaaaaaaaaggauuugaaaccauaaa

SEQ ID NO: 25220 - RNA, 64 nt, hsa
aacauacuugaauucucaaauuuccuuugggguaaaaaaaaaaaaaggauuugaaaccauaaag

SEQ ID NO: 25221 - RNA, 64 nt, hsa
acauacuugaauucucaaauuuccuuugggguaaaaaaaaaaaaaggauuugaaaccauaaagu

SEQ ID NO: 25222 - RNA, 64 nt, hsa
cauacuugaauucucaaauuuccuuugggguaaaaaaaaaaaaaggauuugaaaccauaaagug

SEQ ID NO: 25223 - RNA, 64 nt, hsa
auacuugaauucucaaauuuccuuugggguaaaaaaaaaaaaaggauuugaaaccauaaagugu

SEQ ID NO: 25224 - RNA, 64 nt, hsa
uacuugaauucucaaauuuccuuugggguaaaaaaaaaaaaaggauuugaaaccauaaaguguu

SEQ ID NO: 25225 - RNA, 64 nt, hsa
ccagccugggugacagagcaagacucugccucagaaaaaaaaaaaaauaauaaugcuggguagu

SEQ ID NO: 25226 - RNA, 64 nt, hsa
cagccugggugacagagcaagacucugccucagaaaaaaaaaaaaauaauaaugcuggguagug

SEQ ID NO: 25227 - RNA, 64 nt, hsa
agccugggugacagagcaagacucugccucagaaaaaaaaaaaaauaauaaugcuggguaguga

SEQ ID NO: 25228 - RNA, 64 nt, hsa
gccugggugacagagcaagacucugccucagaaaaaaaaaaaaauaauaaugcuggguagugac

SEQ ID NO: 25229 - RNA, 64 nt, hsa
ccugggugacagagcaagacucugccucagaaaaaaaaaaaaauaauaaugcuggguagugacc

SEQ ID NO: 25230 - RNA, 64 nt, hsa
cugggugacagagcaagacucugccucagaaaaaaaaaaaaauaauaaugcuggguagugaccu

SEQ ID NO: 25231 - RNA, 64 nt, hsa
ucacacaauuccaauggauuuugugcucuuuuugaaaaaaaaaaauucuuuagcguaaacauga

SEQ ID NO: 25232 - RNA, 64 nt, hsa
cacacaauuccaauggauuuugugcucuuuuugaaaaaaaaaaauucuuuagcguaaacaugaa

SEQ ID NO: 25233 - RNA, 64 nt, hsa
acacaauuccaauggauuuugugcucuuuuugaaaaaaaaaaauucuuuagcguaaacaugaau

SEQ ID NO: 25234 - RNA, 64 nt, hsa
cacaauuccaauggauuuugugcucuuuuugaaaaaaaaaaauucuuuagcguaaacaugaauu

SEQ ID NO: 25235 - RNA, 64 nt, hsa
gccugggcgacagagcgagagucugucucaaaagaaaaaaaaaagcaccgccuccaaaugccaa

SEQ ID NO: 25236 - RNA, 64 nt, hsa
ccugggcgacagagcgagagucugucucaaaagaaaaaaaaaagcaccgccuccaaaugccaac

SEQ ID NO: 25237 - RNA, 64 nt, hsa
cugggcgacagagcgagagucugucucaaaagaaaaaaaaaagcaccgccuccaaaugccaacu

SEQ ID NO: 25238 - RNA, 64 nt, hsa
ccugagcaacagagugagacccugucucuuaaagaaaaaaaaagucagacugcugggacuggcc

SEQ ID NO: 25239 - RNA, 64 nt, hsa
cugagcaacagagugagacccugucucuuaaagaaaaaaaaagucagacugcugggacuggcca

SEQ ID NO: 25240 - RNA, 64 nt, hsa
uggaaacauugguaaacucuguugauugagaaggaaaaaaaaagucccauugaacuguugcaac

SEQ ID NO: 25241 - RNA, 64 nt, hsa
ggaaacauugguaaacucuguugauugagaaggaaaaaaaaagucccauugaacuguugcaaca

SEQ ID NO: 25242 - RNA, 64 nt, hsa
uagcugcaauaggaaaaaaacaaauugggaaaugaaaaaaaaaugggaagauuaaaaagcacag

SEQ ID NO: 25243 - RNA, 64 nt, hsa
agcugcaauaggaaaaaaacaaauugggaaaugaaaaaaaaaugggaagauuaaaaagcacagg

SEQ ID NO: 25244 - RNA, 64 nt, hsa
uccagccugggcaacaagagggaaacuccgucucaaaaaaaaaaaagugccuuuuaggccggau

SEQ ID NO: 25245 - RNA, 64 nt, hsa
ccagccugggcaacaagagggaaacuccgucucaaaaaaaaaaaagugccuuuuaggccggaug

SEQ ID NO: 25246 - RNA, 64 nt, hsa
cagccugggcaacaagagggaaacuccgucucaaaaaaaaaaaagugccuuuuaggccggaugu

SEQ ID NO: 25247 - RNA, 64 nt, hsa
agccugggcaacaagagggaaacuccgucucaaaaaaaaaaaagugccuuuuaggccggaugug

SEQ ID NO: 25248 - RNA, 64 nt, hsa
gccugggcaacaagagggaaacuccgucucaaaaaaaaaaaagugccuuuuaggccggaugugg

SEQ ID NO: 25249 - RNA, 64 nt, hsa
uaacacggugaaaccccgucucuacuaaaaauagaaaaaaaaacuaguugggcauaguggcaug

SEQ ID NO: 25250 - RNA, 64 nt, hsa
aacacggugaaaccccgucucuacuaaaaauagaaaaaaaaacuaguugggcauaguggcaugu

SEQ ID NO: 25251 - RNA, 64 nt, hsa
acugugccuuuguuuuugcuaguguguguuguugaaaaaaaaacauucucugccugaguuuuaa

SEQ ID NO: 25252 - RNA, 64 nt, hsa
cugugccuuuguuuuugcuaguguguguuguugaaaaaaaaacauucucugccugaguuuuaau

SEQ ID NO: 25253 - RNA, 64 nt, hsa
uccucucugaagcgacucuccuguuuggaacggcaaaaaaaaauuuuuuuuucucuuuuuggug

SEQ ID NO: 25254 - RNA, 64 nt, hsa
ccucucugaagcgacucuccuguuuggaacggcaaaaaaaaauuuuuuuuucucuuuuuggugg

SEQ ID NO: 25255 - RNA, 64 nt, hsa
aaaagugauuaguacuauuuuuuuuuguuguuucaaaaaaaaaauuuuuguguguguguguuuu

SEQ ID NO: 25256 - RNA, 64 nt, hsa
aaagugauuaguacuauuuuuuuuuguuguuucaaaaaaaaaauuuuuguguguguguguuuuu

SEQ ID NO: 25257 - RNA, 64 nt, hsa
aagugauuaguacuauuuuuuuuuguuguuucaaaaaaaaaauuuuuguguguguguguuuuuu

SEQ ID NO: 25258 - RNA, 64 nt, hsa
acgucaccaagaaaacaugcaacucaaacgacggaaaaaaaaagggaaugggaaaaaagaaaac

SEQ ID NO: 25259 - RNA, 64 nt, hsa
cgucaccaagaaaacaugcaacucaaacgacggaaaaaaaaagggaaugggaaaaaagaaaaca

SEQ ID NO: 25260 - RNA, 64 nt, hsa
cugacauaauucauugagugaaauauuuuaagccaaaaaaaaauucccuuuuuaaaaaaggggg

SEQ ID NO: 25261 - RNA, 64 nt, hsa
ugacauaauucauugagugaaauauuuuaagccaaaaaaaaauucccuuuuuaaaaaagggggu

SEQ ID NO: 25262 - RNA, 64 nt, hsa
auguguucagaggaaauagaauguaaaacaucacaaaaaaaauugcaguacauaaaauuucugg

SEQ ID NO: 25263 - RNA, 64 nt, hsa
augacuuuuuuuuuuaaauaaagugaguuucaacaaaaaaaaaacugaaaauucuacauugcug

SEQ ID NO: 25264 - RNA, 64 nt, hsa
ugacuuuuuuuuuuaaauaaagugaguuucaacaaaaaaaaaacugaaaauucuacauugcugc

SEQ ID NO: 25265 - RNA, 63 nt, hsa
gacuuuuuuuuuuaaauaaagugaguuucaacaaaaaaaaaacugaaaauucuacauugcugc

SEQ ID NO: 25266 - RNA, 64 nt, hsa
accaaaguuacuguuguuuacagugaguuuggggaaaaaaaauaaaauaaaaauggcuuuccca

SEQ ID NO: 25267 - RNA, 64 nt, hsa
cgggaugccacauuucauaacuguuuuuaaugguaaaaaaaaaaaaaaaaaauacaaaaaaaaa

SEQ ID NO: 25268 - RNA, 64 nt, hsa
gggaugccacauuucauaacuguuuuuaaugguaaaaaaaaaaaaaaaaaauacaaaaaaaaau

SEQ ID NO: 25269 - RNA, 64 nt, hsa
ggaugccacauuucauaacuguuuuuaaugguaaaaaaaaaaaaaaaaaauacaaaaaaaaauu

SEQ ID NO: 25270 - RNA, 64 nt, hsa
gaugccacauuucauaacuguuuuuaaugguaaaaaaaaaaaaaaaaaauacaaaaaaaaauuc

SEQ ID NO: 25271 - RNA, 64 nt, hsa
augccacauuucauaacuguuuuuaaugguaaaaaaaaaaaaaaaaaauacaaaaaaaaauucu

SEQ ID NO: 25272 - RNA, 64 nt, hsa
ugccacauuucauaacuguuuuuaaugguaaaaaaaaaaaaaaaaaauacaaaaaaaaauucug

SEQ ID NO: 25273 - RNA, 64 nt, hsa
gccacauuucauaacuguuuuuaaugguaaaaaaaaaaaaaaaaaauacaaaaaaaaauucuga

SEQ ID NO: 25274 - RNA, 64 nt, hsa
ccacauuucauaacuguuuuuaaugguaaaaaaaaaaaaaaaaaauacaaaaaaaaauucugaa

SEQ ID NO: 25275 - RNA, 64 nt, hsa
cacauuucauaacuguuuuuaaugguaaaaaaaaaaaaaaaaaauacaaaaaaaaauucugaag

SEQ ID NO: 25276 - RNA, 64 nt, hsa
acauuucauaacuguuuuuaaugguaaaaaaaaaaaaaaaaaauacaaaaaaaaauucugaagg

SEQ ID NO: 25277 - RNA, 64 nt, hsa
cauuucauaacuguuuuuaaugguaaaaaaaaaaaaaaaaaauacaaaaaaaaauucugaagga

SEQ ID NO: 25278 - RNA, 64 nt, hsa
uguuuuuaaugguaaaaaaaaaaaaaaaaaauacaaaaaaaaauucugaaggacaaaaaaggug

SEQ ID NO: 25279 - RNA, 64 nt, hsa
guuuuuaaugguaaaaaaaaaaaaaaaaaauacaaaaaaaaauucugaaggacaaaaaagguga

SEQ ID NO: 25280 - RNA, 64 nt, hsa
uuuuuaaaaauguuuuuaguuaaacguugaggagaaaaaaaaaaaaggcuuuucccccaaagua

SEQ ID NO: 25281 - RNA, 64 nt, hsa
uuuuaaaaauguuuuuaguuaaacguugaggagaaaaaaaaaaaaggcuuuucccccaaaguau

SEQ ID NO: 25282 - RNA, 64 nt, hsa
uuuaaaaauguuuuuaguuaaacguugaggagaaaaaaaaaaaaggcuuuucccccaaaguauc

SEQ ID NO: 25283 - RNA, 64 nt, hsa
uuaaaaauguuuuuaguuaaacguugaggagaaaaaaaaaaaaggcuuuucccccaaaguauca

SEQ ID NO: 25284 - RNA, 64 nt, hsa
uaaaaauguuuuuaguuaaacguugaggagaaaaaaaaaaaaggcuuuucccccaaaguaucau

SEQ ID NO: 25285 - RNA, 64 nt, hsa
uggugugaggcgucaggagagaggccaaguacauaaaaaaaaaaaaagcagauuaucucuagag

SEQ ID NO: 25286 - RNA, 64 nt, hsa
ggugugaggcgucaggagagaggccaaguacauaaaaaaaaaaaaagcagauuaucucuagaga

SEQ ID NO: 25287 - RNA, 64 nt, hsa
gugugaggcgucaggagagaggccaaguacauaaaaaaaaaaaaagcagauuaucucuagagag

SEQ ID NO: 25288 - RNA, 64 nt, hsa
ugugaggcgucaggagagaggccaaguacauaaaaaaaaaaaaagcagauuaucucuagagagu

SEQ ID NO: 25289 - RNA, 64 nt, hsa
gugaggcgucaggagagaggccaaguacauaaaaaaaaaaaaagcagauuaucucuagagaguu

SEQ ID NO: 25290 - RNA, 64 nt, hsa
ugaggcgucaggagagaggccaaguacauaaaaaaaaaaaaagcagauuaucucuagagaguuu

SEQ ID NO: 25291 - RNA, 64 nt, hsa
uccagccugggugagaagagcgaaacuccgucucaaaaaaaaauaaaaaugaagaggggaaacc

SEQ ID NO: 25292 - RNA, 64 nt, hsa
ccagccugggugagaagagcgaaacuccgucucaaaaaaaaauaaaaaugaagaggggaaacca

SEQ ID NO: 25293 - RNA, 64 nt, hsa
uuucacaaaagacauaggacuuaacuggaaaaugaaaaaaaaaagaaaaagaaaaaacuaaaca

SEQ ID NO: 25294 - RNA, 64 nt, hsa
uucacaaaagacauaggacuuaacuggaaaaugaaaaaaaaaagaaaaagaaaaaacuaaacaa

SEQ ID NO: 25295 - RNA, 64 nt, hsa
ucacaaaagacauaggacuuaacuggaaaaugaaaaaaaaaagaaaaagaaaaaacuaaacaaa

SEQ ID NO: 25296 - RNA, 64 nt, hsa
guuuaaauauaaacagaaguguaccuuuuauaauaaaaaaaagaaguugaguaaaaaaaaaaaa

SEQ ID NO: 25297 - RNA, 64 nt, hsa
guguaccuuuuauaauaaaaaaaagaaguugaguaaaaaaaaaaaacacacaaaccuguuaguu

SEQ ID NO: 25298 - RNA, 64 nt, hsa
uguaccuuuuauaauaaaaaaaagaaguugaguaaaaaaaaaaaacacacaaaccuguuaguuu

SEQ ID NO: 25299 - RNA, 64 nt, hsa
guaccuuuuauaauaaaaaaaagaaguugaguaaaaaaaaaaaacacacaaaccuguuaguuuc

SEQ ID NO: 25300 - RNA, 64 nt, hsa
uaccuuuuauaauaaaaaaaagaaguugaguaaaaaaaaaaaacacacaaaccuguuaguuuca

SEQ ID NO: 25301 - RNA, 64 nt, hsa
accuuuuauaauaaaaaaaagaaguugaguaaaaaaaaaaaacacacaaaccuguuaguuucaa

SEQ ID NO: 25302 - RNA, 64 nt, hsa
aauaguugaugcaauuuuuaacguuaauugauauaaaaaaaaaaacaacaaaauuaggcuugua

SEQ ID NO: 25303 - RNA, 64 nt, hsa
auaguugaugcaauuuuuaacguuaauugauauaaaaaaaaaaacaacaaaauuaggcuuguaa

SEQ ID NO: 25304 - RNA, 64 nt, hsa
uaguugaugcaauuuuuaacguuaauugauauaaaaaaaaaaacaacaaaauuaggcuuguaaa

SEQ ID NO: 25305 - RNA, 64 nt, hsa
aguugaugcaauuuuuaacguuaauugauauaaaaaaaaaaacaacaaaauuaggcuuguaaaa

SEQ ID NO: 25306 - RNA, 64 nt, hsa
uccauccugagccacaagagcaaaacuccgucucaaaaaaaaaaaagaagaagguggaucucca

SEQ ID NO: 25307 - RNA, 64 nt, hsa
ccauccugagccacaagagcaaaacuccgucucaaaaaaaaaaaagaagaagguggaucuccaa

SEQ ID NO: 25308 - RNA, 64 nt, hsa
cauccugagccacaagagcaaaacuccgucucaaaaaaaaaaaagaagaagguggaucuccaac

SEQ ID NO: 25309 - RNA, 64 nt, hsa
auccugagccacaagagcaaaacuccgucucaaaaaaaaaaaagaagaagguggaucuccaacc

SEQ ID NO: 25310 - RNA, 64 nt, hsa
uccugagccacaagagcaaaacuccgucucaaaaaaaaaaaagaagaagguggaucuccaacca

SEQ ID NO: 25311 - RNA, 64 nt, hsa
uuagcauaguagauaaauuguuaugaaauaccagaaaaaaaaaucuguaucuuuuacugagaac

SEQ ID NO: 25312 - RNA, 64 nt, hsa
uagcauaguagauaaauuguuaugaaauaccagaaaaaaaaaucuguaucuuuuacugagaaca

SEQ ID NO: 25313 - RNA, 64 nt, hsa
ccaugauaaaaguacucauguuuccccuauuuggaaaaaaaaauugcuuuuaguauuuuuccaa

SEQ ID NO: 25314 - RNA, 64 nt, hsa
caugauaaaaguacucauguuuccccuauuuggaaaaaaaaauugcuuuuaguauuuuuccaag

SEQ ID NO: 25315 - RNA, 64 nt, hsa
aacaagugaaaaggucaagauacaaauguguauuaaaaaaaaaaaagccuauuaauaggguuuc

SEQ ID NO: 25316 - RNA, 64 nt, hsa
acaagugaaaaggucaagauacaaauguguauuaaaaaaaaaaaagccuauuaauaggguuucu

SEQ ID NO: 25317 - RNA, 64 nt, hsa
caagugaaaaggucaagauacaaauguguauuaaaaaaaaaaaagccuauuaauaggguuucug

SEQ ID NO: 25318 - RNA, 64 nt, hsa
aagugaaaaggucaagauacaaauguguauuaaaaaaaaaaaagccuauuaauaggguuucugc

SEQ ID NO: 25319 - RNA, 64 nt, hsa
agugaaaaggucaagauacaaauguguauuaaaaaaaaaaaagccuauuaauaggguuucugcg

SEQ ID NO: 25320 - RNA, 64 nt, hsa
cccagcaccuuccuauagagaugacuuuaaaaggaaaaaaaaaaaaaaaaaaacccacaugauu

SEQ ID NO: 25321 - RNA, 64 nt, hsa
ccagcaccuuccuauagagaugacuuuaaaaggaaaaaaaaaaaaaaaaaaacccacaugauuu

SEQ ID NO: 25322 - RNA, 64 nt, hsa
cagcaccuuccuauagagaugacuuuaaaaggaaaaaaaaaaaaaaaaaaacccacaugauuuc

SEQ ID NO: 25323 - RNA, 64 nt, hsa
agcaccuuccuauagagaugacuuuaaaaggaaaaaaaaaaaaaaaaaaacccacaugauuuca

SEQ ID NO: 25324 - RNA, 64 nt, hsa
gcaccuuccuauagagaugacuuuaaaaggaaaaaaaaaaaaaaaaaaacccacaugauuucaa

SEQ ID NO: 25325 - RNA, 64 nt, hsa
caccuuccuauagagaugacuuuaaaaggaaaaaaaaaaaaaaaaaaacccacaugauuucaag

SEQ ID NO: 25326 - RNA, 64 nt, hsa
accuuccuauagagaugacuuuaaaaggaaaaaaaaaaaaaaaaaaacccacaugauuucaagg

SEQ ID NO: 25327 - RNA, 64 nt, hsa
ccuuccuauagagaugacuuuaaaaggaaaaaaaaaaaaaaaaaaacccacaugauuucaagga

SEQ ID NO: 25328 - RNA, 64 nt, hsa
cuuccuauagagaugacuuuaaaaggaaaaaaaaaaaaaaaaaaacccacaugauuucaaggag

SEQ ID NO: 25329 - RNA, 64 nt, hsa
uuccuauagagaugacuuuaaaaggaaaaaaaaaaaaaaaaaaacccacaugauuucaaggagu

SEQ ID NO: 25330 - RNA, 64 nt, hsa
uccuauagagaugacuuuaaaaggaaaaaaaaaaaaaaaaaaacccacaugauuucaaggaguc

SEQ ID NO: 25331 - RNA, 64 nt, hsa
ccuauagagaugacuuuaaaaggaaaaaaaaaaaaaaaaaaacccacaugauuucaaggagucu

SEQ ID NO: 25332 - RNA, 64 nt, hsa
aaaacaaaaacaaaaaaccacaaaaauaaaaaacaaaaaaaacaaaaaacccaagaaaaaaaaa

SEQ ID NO: 25333 - RNA, 64 nt, hsa
aaaaauaaaaaacaaaaaaaacaaaaaacccaagaaaaaaaaaaagagucagcccuuggcuucu

SEQ ID NO: 25334 - RNA, 64 nt, hsa
aaaauaaaaaacaaaaaaaacaaaaaacccaagaaaaaaaaaaagagucagcccuuggcuucug

SEQ ID NO: 25335 - RNA, 64 nt, hsa
aaauaaaaaacaaaaaaaacaaaaaacccaagaaaaaaaaaaagagucagcccuuggcuucugc

SEQ ID NO: 25336 - RNA, 64 nt, hsa
aauaaaaaacaaaaaaaacaaaaaacccaagaaaaaaaaaaagagucagcccuuggcuucugcu

SEQ ID NO: 25337 - RNA, 64 nt, hsa
agcuuggacaauguagugagaccuggucuuuaccaaaaaaaaaaaaaaaaaaauuagcugggug

SEQ ID NO: 25338 - RNA, 64 nt, hsa
gcuuggacaauguagugagaccuggucuuuaccaaaaaaaaaaaaaaaaaaauuagcugggugc

SEQ ID NO: 25339 - RNA, 64 nt, hsa
cuuggacaauguagugagaccuggucuuuaccaaaaaaaaaaaaaaaaaaauuagcugggugcg

SEQ ID NO: 25340 - RNA, 64 nt, hsa
uuggacaauguagugagaccuggucuuuaccaaaaaaaaaaaaaaaaaaauuagcugggugcgc

SEQ ID NO: 25341 - RNA, 64 nt, hsa
uggacaauguagugagaccuggucuuuaccaaaaaaaaaaaaaaaaaaauuagcugggugcgcu

SEQ ID NO: 25342 - RNA, 64 nt, hsa
ggacaauguagugagaccuggucuuuaccaaaaaaaaaaaaaaaaaaauuagcugggugcgcug

SEQ ID NO: 25343 - RNA, 64 nt, hsa
gacaauguagugagaccuggucuuuaccaaaaaaaaaaaaaaaaaaauuagcugggugcgcugg

SEQ ID NO: 25344 - RNA, 64 nt, hsa
acaauguagugagaccuggucuuuaccaaaaaaaaaaaaaaaaaaauuagcugggugcgcuggc

SEQ ID NO: 25345 - RNA, 64 nt, hsa
caauguagugagaccuggucuuuaccaaaaaaaaaaaaaaaaaaauuagcugggugcgcuggca

SEQ ID NO: 25346 - RNA, 64 nt, hsa
aauguagugagaccuggucuuuaccaaaaaaaaaaaaaaaaaaauuagcugggugcgcuggcau

SEQ ID NO: 25347 - RNA, 64 nt, hsa
auguagugagaccuggucuuuaccaaaaaaaaaaaaaaaaaaauuagcugggugcgcuggcaug

SEQ ID NO: 25348 - RNA, 64 nt, hsa
uguagugagaccuggucuuuaccaaaaaaaaaaaaaaaaaaauuagcugggugcgcuggcaugu

SEQ ID NO: 25349 - RNA, 64 nt, hsa
cuccagccagggugacagagugagacucugucucaaaaaaaaaaaaaaaaaaaaaggcauuggg

SEQ ID NO: 25350 - RNA, 64 nt, hsa
uccagccagggugacagagugagacucugucucaaaaaaaaaaaaaaaaaaaaaggcauuggga

SEQ ID NO: 25351 - RNA, 64 nt, hsa
ccagccagggugacagagugagacucugucucaaaaaaaaaaaaaaaaaaaaaggcauugggau

SEQ ID NO: 25352 - RNA, 64 nt, hsa
cagccagggugacagagugagacucugucucaaaaaaaaaaaaaaaaaaaaaggcauugggauu

SEQ ID NO: 25353 - RNA, 64 nt, hsa
agccagggugacagagugagacucugucucaaaaaaaaaaaaaaaaaaaaaggcauugggauuu

SEQ ID NO: 25354 - RNA, 64 nt, hsa
gccagggugacagagugagacucugucucaaaaaaaaaaaaaaaaaaaaaggcauugggauuua

SEQ ID NO: 25355 - RNA, 64 nt, hsa
ccagggugacagagugagacucugucucaaaaaaaaaaaaaaaaaaaaaggcauugggauuuau

SEQ ID NO: 25356 - RNA, 64 nt, hsa
cagggugacagagugagacucugucucaaaaaaaaaaaaaaaaaaaaaggcauugggauuuaua

SEQ ID NO: 25357 - RNA, 64 nt, hsa
agggugacagagugagacucugucucaaaaaaaaaaaaaaaaaaaaaggcauugggauuuauaa

SEQ ID NO: 25358 - RNA, 64 nt, hsa
gggugacagagugagacucugucucaaaaaaaaaaaaaaaaaaaaaggcauugggauuuauaau

SEQ ID NO: 25359 - RNA, 64 nt, hsa
ggugacagagugagacucugucucaaaaaaaaaaaaaaaaaaaaaggcauugggauuuauaaug

SEQ ID NO: 25360 - RNA, 64 nt, hsa
gugacagagugagacucugucucaaaaaaaaaaaaaaaaaaaaaggcauugggauuuauaaugu

SEQ ID NO: 25361 - RNA, 64 nt, hsa
ugacagagugagacucugucucaaaaaaaaaaaaaaaaaaaaaggcauugggauuuauaaugug

SEQ ID NO: 25362 - RNA, 64 nt, hsa
gacagagugagacucugucucaaaaaaaaaaaaaaaaaaaaaggcauugggauuuauaaugugc

SEQ ID NO: 25363 - RNA, 64 nt, hsa
gacagagcgagacugucucaaaaaaacaaaaaagaaaaaaaaacuggggccuguguagccagug

SEQ ID NO: 25364 - RNA, 64 nt, hsa
acagagcgagacugucucaaaaaaacaaaaaagaaaaaaaaacuggggccuguguagccagugg

SEQ ID NO: 25365 - RNA, 64 nt, hsa
uuauggauugacacuguuccuuucuuuuauugugaaaaaaaaaaaaaacccugaaagucuuggg

SEQ ID NO: 25366 - RNA, 64 nt, hsa
uauggauugacacuguuccuuucuuuuauugugaaaaaaaaaaaaaacccugaaagucuuggga

SEQ ID NO: 25367 - RNA, 64 nt, hsa
auggauugacacuguuccuuucuuuuauugugaaaaaaaaaaaaaacccugaaagucuugggaa

SEQ ID NO: 25368 - RNA, 64 nt, hsa
uggauugacacuguuccuuucuuuuauugugaaaaaaaaaaaaaacccugaaagucuugggaac

SEQ ID NO: 25369 - RNA, 64 nt, hsa
ggauugacacuguuccuuucuuuuauugugaaaaaaaaaaaaaacccugaaagucuugggaacc

SEQ ID NO: 25370 - RNA, 64 nt, hsa
gauugacacuguuccuuucuuuuauugugaaaaaaaaaaaaaacccugaaagucuugggaaccc

SEQ ID NO: 25371 - RNA, 64 nt, hsa
auugacacuguuccuuucuuuuauugugaaaaaaaaaaaaaacccugaaagucuugggaacccc

SEQ ID NO: 25372 - RNA, 64 nt, hsa
agauuuuuacauuuugaagaaggggagcaaaucuaaaaaaaauucaguugaacuucugagaguu

SEQ ID NO: 25373 - RNA, 64 nt, hsa
ugaagaaauguauaaaaccauagauuucuuucagaaaaaaaaaacaggcauaggaacaguuuuc

SEQ ID NO: 25374 - RNA, 64 nt, hsa
gaagaaauguauaaaaccauagauuucuuucagaaaaaaaaaacaggcauaggaacaguuuucu

SEQ ID NO: 25375 - RNA, 64 nt, hsa
aagaaauguauaaaaccauagauuucuuucagaaaaaaaaaacaggcauaggaacaguuuucuc

SEQ ID NO: 25376 - RNA, 64 nt, hsa
uguauaugaagaauuguuuuuaauuuuguaaauuaaaaaaaaauuuagaucguuacuuggaaau

SEQ ID NO: 25377 - RNA, 64 nt, hsa
guauaugaagaauuguuuuuaauuuuguaaauuaaaaaaaaauuuagaucguuacuuggaaaug

SEQ ID NO: 25378 - RNA, 64 nt, hsa
augauguuaacccaagaaguagacaucaaaaauuaaaaaaaaaaaaaggaauguguuuucauug

SEQ ID NO: 25379 - RNA, 64 nt, hsa
ugauguuaacccaagaaguagacaucaaaaauuaaaaaaaaaaaaaggaauguguuuucauugu

SEQ ID NO: 25380 - RNA, 64 nt, hsa
gauguuaacccaagaaguagacaucaaaaauuaaaaaaaaaaaaaggaauguguuuucauuguu

SEQ ID NO: 25381 - RNA, 64 nt, hsa
auguuaacccaagaaguagacaucaaaaauuaaaaaaaaaaaaaggaauguguuuucauuguuu

SEQ ID NO: 25382 - RNA, 64 nt, hsa
uguuaacccaagaaguagacaucaaaaauuaaaaaaaaaaaaaggaauguguuuucauuguuuu

SEQ ID NO: 25383 - RNA, 64 nt, hsa
guuaacccaagaaguagacaucaaaaauuaaaaaaaaaaaaaggaauguguuuucauuguuuua

SEQ ID NO: 25384 - RNA, 64 nt, hsa
cuguaccacacccuggugaaaccuuugaagacauaaaaaaaaccugucugagauguucuuucua

SEQ ID NO: 25385 - RNA, 64 nt, hsa
gcccauuggccugaaaauacucauuguaagccugaaaaaaaaaaucuuucccacuguuuuuucu

SEQ ID NO: 25386 - RNA, 64 nt, hsa
cccauuggccugaaaauacucauuguaagccugaaaaaaaaaaucuuucccacuguuuuuucug

SEQ ID NO: 25387 - RNA, 64 nt, hsa
ccauuggccugaaaauacucauuguaagccugaaaaaaaaaaucuuucccacuguuuuuucugc

SEQ ID NO: 25388 - RNA, 64 nt, hsa
uuuuuguccuaauguugcuacucccauggcaaagaaaaaaaaaagaaugaaaaaaagaaaaaaa

SEQ ID NO: 25389 - RNA, 64 nt, hsa
uuuuguccuaauguugcuacucccauggcaaagaaaaaaaaaagaaugaaaaaaagaaaaaaau

SEQ ID NO: 25390 - RNA, 64 nt, hsa
uuuguccuaauguugcuacucccauggcaaagaaaaaaaaaagaaugaaaaaaagaaaaaaauu

SEQ ID NO: 25391 - RNA, 64 nt, hsa
aaaaaaaaagaaugaaaaaaagaaaaaaauuuggaaaaaaaaaucaggcucauagcagcuacug

SEQ ID NO: 25392 - RNA, 64 nt, hsa
aaaaaaaagaaugaaaaaaagaaaaaaauuuggaaaaaaaaaucaggcucauagcagcuacugu

SEQ ID NO: 25393 - RNA, 64 nt, hsa
aaaauucccccuacuucuaauuugcugaaugaagaaaaaaaaaaaucuuuuauuugugauauuu

SEQ ID NO: 25394 - RNA, 64 nt, hsa
aaauucccccuacuucuaauuugcugaaugaagaaaaaaaaaaaucuuuuauuugugauauuuu

SEQ ID NO: 25395 - RNA, 64 nt, hsa
aauucccccuacuucuaauuugcugaaugaagaaaaaaaaaaaucuuuuauuugugauauuuuc

SEQ ID NO: 25396 - RNA, 64 nt, hsa
auucccccuacuucuaauuugcugaaugaagaaaaaaaaaaaucuuuuauuugugauauuuuca

SEQ ID NO: 25397 - RNA, 64 nt, hsa
gcccuaaaggagucuggcuuuuacuaucuuucuuaaaaaaaaaaaaaagucaaaaaaauucaaa

SEQ ID NO: 25398 - RNA, 64 nt, hsa
cccuaaaggagucuggcuuuuacuaucuuucuuaaaaaaaaaaaaaagucaaaaaaauucaaaa

SEQ ID NO: 25399 - RNA, 64 nt, hsa
ccuaaaggagucuggcuuuuacuaucuuucuuaaaaaaaaaaaaaagucaaaaaaauucaaaaa

SEQ ID NO: 25400 - RNA, 64 nt, hsa
cuaaaggagucuggcuuuuacuaucuuucuuaaaaaaaaaaaaaagucaaaaaaauucaaaaaa

SEQ ID NO: 25401 - RNA, 64 nt, hsa
uaaaggagucuggcuuuuacuaucuuucuuaaaaaaaaaaaaaagucaaaaaaauucaaaaaag

SEQ ID NO: 25402 - RNA, 64 nt, hsa
aaaggagucuggcuuuuacuaucuuucuuaaaaaaaaaaaaaagucaaaaaaauucaaaaaagg

SEQ ID NO: 25403 - RNA, 64 nt, hsa
aaggagucuggcuuuuacuaucuuucuuaaaaaaaaaaaaaagucaaaaaaauucaaaaaaggg

SEQ ID NO: 25404 - RNA, 64 nt, hsa
acauuguaaaauaaaguugagcuuaguuuuuuuuaaaaaaaaaaacaaagcaacaaauuaacua

SEQ ID NO: 25405 - RNA, 64 nt, hsa
cauuguaaaauaaaguugagcuuaguuuuuuuuaaaaaaaaaaacaaagcaacaaauuaacuag

SEQ ID NO: 25406 - RNA, 64 nt, hsa
auuguaaaauaaaguugagcuuaguuuuuuuuaaaaaaaaaaacaaagcaacaaauuaacuaga

SEQ ID NO: 25407 - RNA, 64 nt, hsa
uuguaaaauaaaguugagcuuaguuuuuuuuaaaaaaaaaaacaaagcaacaaauuaacuagau

SEQ ID NO: 25408 - RNA, 64 nt, hsa
uagcgaacuuguauacuuauuuucuguucagauuaaaaaaaaaaaaaaaaaacucagauauccu

SEQ ID NO: 25409 - RNA, 64 nt, hsa
agcgaacuuguauacuuauuuucuguucagauuaaaaaaaaaaaaaaaaaacucagauauccua

SEQ ID NO: 25410 - RNA, 64 nt, hsa
gcgaacuuguauacuuauuuucuguucagauuaaaaaaaaaaaaaaaaaacucagauauccuau

SEQ ID NO: 25411 - RNA, 64 nt, hsa
cgaacuuguauacuuauuuucuguucagauuaaaaaaaaaaaaaaaaaacucagauauccuaua

SEQ ID NO: 25412 - RNA, 64 nt, hsa
gaacuuguauacuuauuuucuguucagauuaaaaaaaaaaaaaaaaaacucagauauccuauac

SEQ ID NO: 25413 - RNA, 64 nt, hsa
aacuuguauacuuauuuucuguucagauuaaaaaaaaaaaaaaaaaacucagauauccuauaca

SEQ ID NO: 25414 - RNA, 64 nt, hsa
acuuguauacuuauuuucuguucagauuaaaaaaaaaaaaaaaaaacucagauauccuauacaa

SEQ ID NO: 25415 - RNA, 64 nt, hsa
cuuguauacuuauuuucuguucagauuaaaaaaaaaaaaaaaaaacucagauauccuauacaac

SEQ ID NO: 25416 - RNA, 64 nt, hsa
uuguauacuuauuuucuguucagauuaaaaaaaaaaaaaaaaaacucagauauccuauacaacc

SEQ ID NO: 25417 - RNA, 64 nt, hsa
uguauacuuauuuucuguucagauuaaaaaaaaaaaaaaaaaacucagauauccuauacaaccu

SEQ ID NO: 25418 - RNA, 64 nt, hsa
guauacuuauuuucuguucagauuaaaaaaaaaaaaaaaaaacucagauauccuauacaaccuu

SEQ ID NO: 25419 - RNA, 64 nt, hsa
uuuuuguuaauuggacaccaagaggaagaaucugaaaaaaaaaugcauguugguaaguaaaagu

SEQ ID NO: 25420 - RNA, 64 nt, hsa
uuuuguuaauuggacaccaagaggaagaaucugaaaaaaaaaugcauguugguaaguaaaagua

SEQ ID NO: 25421 - RNA, 64 nt, hsa
aaacaaagaaaugguaaaugaauuguuugcauuuaaaaaaaaaaacucuuaagaaaacuguacu

SEQ ID NO: 25422 - RNA, 64 nt, hsa
aacaaagaaaugguaaaugaauuguuugcauuuaaaaaaaaaaacucuuaagaaaacuguacua

SEQ ID NO: 25423 - RNA, 64 nt, hsa
acaaagaaaugguaaaugaauuguuugcauuuaaaaaaaaaaacucuuaagaaaacuguacuaa

SEQ ID NO: 25424 - RNA, 64 nt, hsa
caaagaaaugguaaaugaauuguuugcauuuaaaaaaaaaaacucuuaagaaaacuguacuaaa

SEQ ID NO: 25425 - RNA, 64 nt, hsa
guuugccagaaacagggaaggagggcguuaagggaaaaaaaaaauccucaaauuuauuuaccag

SEQ ID NO: 25426 - RNA, 64 nt, hsa
uuugccagaaacagggaaggagggcguuaagggaaaaaaaaaauccucaaauuuauuuaccagu

SEQ ID NO: 25427 - RNA, 64 nt, hsa
uugccagaaacagggaaggagggcguuaagggaaaaaaaaaauccucaaauuuauuuaccaguc

SEQ ID NO: 25428 - RNA, 64 nt, hsa
auccguuuaaaaguucuauauuuguggcuuuauuaaaaaaaaaagaaaaauauauagagagaua

SEQ ID NO: 25429 - RNA, 64 nt, hsa
uccguuuaaaaguucuauauuuguggcuuuauuaaaaaaaaaagaaaaauauauagagagauau

SEQ ID NO: 25430 - RNA, 64 nt, hsa
ccguuuaaaaguucuauauuuguggcuuuauuaaaaaaaaaagaaaaauauauagagagauaua

SEQ ID NO: 25431 - RNA, 64 nt, hsa
cuauccugaggaauugcgagauauugcugaggggaaaaaaaaaugaccuuuucuugaaauguaa

SEQ ID NO: 25432 - RNA, 64 nt, hsa
uauccugaggaauugcgagauauugcugaggggaaaaaaaaaugaccuuuucuugaaauguaac

SEQ ID NO: 25433 - RNA, 64 nt, hsa
uuaaaaucaguguuuccccuuugugcacuuguagaaaaaaaagaaaaaccuucuagagcugauu

SEQ ID NO: 25434 - RNA, 64 nt, hsa
ggucuacugugucucuaggguuaagccaaaagacaaaaaaaauuuuacuacuuuugagauugcc

SEQ ID NO: 25435 - RNA, 64 nt, hsa
gcugauauaaaguccuuuugucuuaauuguauuuaaaaaaaaaaaaaaacuacucuugaucaca

SEQ ID NO: 25436 - RNA, 64 nt, hsa
cugauauaaaguccuuuugucuuaauuguauuuaaaaaaaaaaaaaaacuacucuugaucacau

SEQ ID NO: 25437 - RNA, 64 nt, hsa
ugauauaaaguccuuuugucuuaauuguauuuaaaaaaaaaaaaaaacuacucuugaucacauu

SEQ ID NO: 25438 - RNA, 64 nt, hsa
gauauaaaguccuuuugucuuaauuguauuuaaaaaaaaaaaaaaacuacucuugaucacauua

SEQ ID NO: 25439 - RNA, 64 nt, hsa
auauaaaguccuuuugucuuaauuguauuuaaaaaaaaaaaaaaacuacucuugaucacauuag

SEQ ID NO: 25440 - RNA, 64 nt, hsa
uauaaaguccuuuugucuuaauuguauuuaaaaaaaaaaaaaaacuacucuugaucacauuagc

SEQ ID NO: 25441 - RNA, 64 nt, hsa
auaaaguccuuuugucuuaauuguauuuaaaaaaaaaaaaaaacuacucuugaucacauuagcu

SEQ ID NO: 25442 - RNA, 64 nt, hsa
uaaaguccuuuugucuuaauuguauuuaaaaaaaaaaaaaaacuacucuugaucacauuagcua

SEQ ID NO: 25443 - RNA, 64 nt, hsa
accuaagacagggaggggucagagugauggugauaaaaaaaaaaaaucaucagcaauaagcuga

SEQ ID NO: 25444 - RNA, 64 nt, hsa
ccuaagacagggaggggucagagugauggugauaaaaaaaaaaaaucaucagcaauaagcugau

SEQ ID NO: 25445 - RNA, 64 nt, hsa
cuaagacagggaggggucagagugauggugauaaaaaaaaaaaaucaucagcaauaagcugaua

SEQ ID NO: 25446 - RNA, 64 nt, hsa
uaagacagggaggggucagagugauggugauaaaaaaaaaaaaucaucagcaauaagcugauag

SEQ ID NO: 25447 - RNA, 64 nt, hsa
aagacagggaggggucagagugauggugauaaaaaaaaaaaaucaucagcaauaagcugauaga

SEQ ID NO: 25448 - RNA, 64 nt, hsa
uacagugguuuuauacugaaggaaaaacacaagcaaaaaaaaaaaaaagcaucuaucucaucua

SEQ ID NO: 25449 - RNA, 64 nt, hsa
acagugguuuuauacugaaggaaaaacacaagcaaaaaaaaaaaaaagcaucuaucucaucuau

SEQ ID NO: 25450 - RNA, 64 nt, hsa
cagugguuuuauacugaaggaaaaacacaagcaaaaaaaaaaaaaagcaucuaucucaucuauc

SEQ ID NO: 25451 - RNA, 64 nt, hsa
agugguuuuauacugaaggaaaaacacaagcaaaaaaaaaaaaaagcaucuaucucaucuaucu

SEQ ID NO: 25452 - RNA, 64 nt, hsa
gugguuuuauacugaaggaaaaacacaagcaaaaaaaaaaaaaagcaucuaucucaucuaucuc

SEQ ID NO: 25453 - RNA, 64 nt, hsa
ugguuuuauacugaaggaaaaacacaagcaaaaaaaaaaaaaagcaucuaucucaucuaucuca

SEQ ID NO: 25454 - RNA, 64 nt, hsa
gguuuuauacugaaggaaaaacacaagcaaaaaaaaaaaaaagcaucuaucucaucuaucucaa

SEQ ID NO: 25455 - RNA, 64 nt, hsa
cuccagccugggcgaaagggugagacuccaucucaaaaaaaaaaaaaaugauuugcuuuugacg

SEQ ID NO: 25456 - RNA, 64 nt, hsa
uccagccugggcgaaagggugagacuccaucucaaaaaaaaaaaaaaugauuugcuuuugacgu

SEQ ID NO: 25457 - RNA, 64 nt, hsa
ccagccugggcgaaagggugagacuccaucucaaaaaaaaaaaaaaugauuugcuuuugacguc

SEQ ID NO: 25458 - RNA, 64 nt, hsa
cagccugggcgaaagggugagacuccaucucaaaaaaaaaaaaaaugauuugcuuuugacgucu

SEQ ID NO: 25459 - RNA, 64 nt, hsa
agccugggcgaaagggugagacuccaucucaaaaaaaaaaaaaaugauuugcuuuugacgucuu

SEQ ID NO: 25460 - RNA, 64 nt, hsa
gccugggcgaaagggugagacuccaucucaaaaaaaaaaaaaaugauuugcuuuugacgucuua

SEQ ID NO: 25461 - RNA, 64 nt, hsa
ccugggcgaaagggugagacuccaucucaaaaaaaaaaaaaaugauuugcuuuugacgucuuag

SEQ ID NO: 25462 - RNA, 64 nt, hsa
ucccaauuuucucccucccugugugucacuagagaaaaaaaaaaacaaaaaccuagauuccgga

SEQ ID NO: 25463 - RNA, 64 nt, hsa
cccaauuuucucccucccugugugucacuagagaaaaaaaaaaacaaaaaccuagauuccggau

SEQ ID NO: 25464 - RNA, 64 nt, hsa
ccaauuuucucccucccugugugucacuagagaaaaaaaaaaacaaaaaccuagauuccggauu

SEQ ID NO: 25465 - RNA, 64 nt, hsa
caauuuucucccucccugugugucacuagagaaaaaaaaaaacaaaaaccuagauuccggauua

SEQ ID NO: 25466 - RNA, 64 nt, hsa
cuagacagcagugcacuccccuaagucucugcucaaaaaaaaaacaauucucggcccaaagaaa

SEQ ID NO: 25467 - RNA, 64 nt, hsa
uagacagcagugcacuccccuaagucucugcucaaaaaaaaaacaauucucggcccaaagaaaa

SEQ ID NO: 25468 - RNA, 64 nt, hsa
agacagcagugcacuccccuaagucucugcucaaaaaaaaaacaauucucggcccaaagaaaac

SEQ ID NO: 25469 - RNA, 64 nt, hsa
uaggcucugagacuaaaugagaggaaaagaaaagaaaaaaaaaaugauugucuaaccaauugug

SEQ ID NO: 25470 - RNA, 64 nt, hsa
aggcucugagacuaaaugagaggaaaagaaaagaaaaaaaaaaugauugucuaaccaauuguga

SEQ ID NO: 25471 - RNA, 64 nt, hsa
ggcucugagacuaaaugagaggaaaagaaaagaaaaaaaaaaugauugucuaaccaauugugag

SEQ ID NO: 25472 - RNA, 64 nt, hsa
ucgccguguugugagggcaaaggagagaagggagaaaaaaaaaaaaaaaccacacacacccaua

SEQ ID NO: 25473 - RNA, 64 nt, hsa
cgccguguugugagggcaaaggagagaagggagaaaaaaaaaaaaaaaccacacacacccauac

SEQ ID NO: 25474 - RNA, 64 nt, hsa
gccguguugugagggcaaaggagagaagggagaaaaaaaaaaaaaaaccacacacacccauaca

SEQ ID NO: 25475 - RNA, 64 nt, hsa
ccguguugugagggcaaaggagagaagggagaaaaaaaaaaaaaaaccacacacacccauacac

SEQ ID NO: 25476 - RNA, 64 nt, hsa
cguguugugagggcaaaggagagaagggagaaaaaaaaaaaaaaaccacacacacccauacaca

SEQ ID NO: 25477 - RNA, 64 nt, hsa
guguugugagggcaaaggagagaagggagaaaaaaaaaaaaaaaccacacacacccauacacac

SEQ ID NO: 25478 - RNA, 64 nt, hsa
uguugugagggcaaaggagagaagggagaaaaaaaaaaaaaaaccacacacacccauacacaca

SEQ ID NO: 25479 - RNA, 64 nt, hsa
guugugagggcaaaggagagaagggagaaaaaaaaaaaaaaaccacacacacccauacacacau

SEQ ID NO: 25480 - RNA, 64 nt, hsa
cacuggacuagaagagauaaugauugaaacauuuaaaaaaaaaaagugcuccauucgcaggagc

SEQ ID NO: 25481 - RNA, 64 nt, hsa
acuggacuagaagagauaaugauugaaacauuuaaaaaaaaaaagugcuccauucgcaggagcu

SEQ ID NO: 25482 - RNA, 64 nt, hsa
cuggacuagaagagauaaugauugaaacauuuaaaaaaaaaaagugcuccauucgcaggagcuu

SEQ ID NO: 25483 - RNA, 64 nt, hsa
uggacuagaagagauaaugauugaaacauuuaaaaaaaaaaagugcuccauucgcaggagcuuu

SEQ ID NO: 25484 - RNA, 64 nt, hsa
uuguuuauguacagauuuucuguagccuuaaaggaaaaaaaaauaaagaucguuacaggcaggu

SEQ ID NO: 25485 - RNA, 64 nt, hsa
uguuuauguacagauuuucuguagccuuaaaggaaaaaaaaauaaagaucguuacaggcagguu

SEQ ID NO: 25486 - RNA, 64 nt, hsa
auuuccccccaguuuuaaauugccuuugaaauuuaaaaaaaaaaaauuuagacuuaguaccaga

SEQ ID NO: 25487 - RNA, 64 nt, hsa
uuuccccccaguuuuaaauugccuuugaaauuuaaaaaaaaaaaauuuagacuuaguaccagaa

SEQ ID NO: 25488 - RNA, 64 nt, hsa
uuccccccaguuuuaaauugccuuugaaauuuaaaaaaaaaaaauuuagacuuaguaccagaac

SEQ ID NO: 25489 - RNA, 64 nt, hsa
uccccccaguuuuaaauugccuuugaaauuuaaaaaaaaaaaauuuagacuuaguaccagaacc

SEQ ID NO: 25490 - RNA, 64 nt, hsa
ccccccaguuuuaaauugccuuugaaauuuaaaaaaaaaaaauuuagacuuaguaccagaacca

SEQ ID NO: 25491 - RNA, 64 nt, hsa
uuuuucagaauaaacaacuaaauaacuguauuagaaaaaaaagaaacuuacuaaauaucauaau

SEQ ID NO: 25492 - RNA, 64 nt, hsa
cagccugagcaacauggugagaccccaucucuacaaaaaaaauauaaaaauuagccaggugugg

SEQ ID NO: 25493 - RNA, 64 nt, hsa
uacagaggaaccaggugccaacagucaacugaggaaaaaaaauaauuaaacaggccuaagaaga

SEQ ID NO: 25494 - RNA, 64 nt, hsa
cagcccacccacccccaugauuguaugaaguuuuaaaaaaaacuacagcagccaaagaaacuau

SEQ ID NO: 25495 - RNA, 64 nt, hsa
gcuuuauuaucuugucagucacuaccuccuaaagaaaaaaaaaaaggcuagaagaaaaaacauu

SEQ ID NO: 25496 - RNA, 64 nt, hsa
cuuuauuaucuugucagucacuaccuccuaaagaaaaaaaaaaaggcuagaagaaaaaacauua

SEQ ID NO: 25497 - RNA, 64 nt, hsa
uuuauuaucuugucagucacuaccuccuaaagaaaaaaaaaaaggcuagaagaaaaaacauuac

SEQ ID NO: 25498 - RNA, 64 nt, hsa
uuauuaucuugucagucacuaccuccuaaagaaaaaaaaaaaggcuagaagaaaaaacauuaca

SEQ ID NO: 25499 - RNA, 64 nt, hsa
cuaacuccaguuuuacuauuauuauuuugguuggaaaaaaaauucacucuuuacgugcuaauuu

SEQ ID NO: 25500 - RNA, 64 nt, hsa
acugguguguucuuagaucagcacaaaccaugucaaaaaaaauuggagauuuuuuuccaauuuu

SEQ ID NO: 25501 - RNA, 64 nt, hsa
auauacauagucauuuuuccucuaugguagaaguaaaaaaaaaaaaaaaggacauagcaacauu

SEQ ID NO: 25502 - RNA, 64 nt, hsa
uauacauagucauuuuuccucuaugguagaaguaaaaaaaaaaaaaaaggacauagcaacauua

SEQ ID NO: 25503 - RNA, 64 nt, hsa
auacauagucauuuuuccucuaugguagaaguaaaaaaaaaaaaaaaggacauagcaacauuaa

SEQ ID NO: 25504 - RNA, 64 nt, hsa
uacauagucauuuuuccucuaugguagaaguaaaaaaaaaaaaaaaggacauagcaacauuaaa

SEQ ID NO: 25505 - RNA, 64 nt, hsa
acauagucauuuuuccucuaugguagaaguaaaaaaaaaaaaaaaggacauagcaacauuaaag

SEQ ID NO: 25506 - RNA, 64 nt, hsa
cauagucauuuuuccucuaugguagaaguaaaaaaaaaaaaaaaggacauagcaacauuaaagu

SEQ ID NO: 25507 - RNA, 64 nt, hsa
auagucauuuuuccucuaugguagaaguaaaaaaaaaaaaaaaggacauagcaacauuaaagua

SEQ ID NO: 25508 - RNA, 64 nt, hsa
uagucauuuuuccucuaugguagaaguaaaaaaaaaaaaaaaggacauagcaacauuaaaguag

SEQ ID NO: 25509 - RNA, 64 nt, hsa
ucucgcacuaaccaccagaagacuugaaaaucuuaaaaaaaaaaaacaaaaaaacaagaaaagg

SEQ ID NO: 25510 - RNA, 64 nt, hsa
cucgcacuaaccaccagaagacuugaaaaucuuaaaaaaaaaaaacaaaaaaacaagaaaaggc

SEQ ID NO: 25511 - RNA, 64 nt, hsa
ucgcacuaaccaccagaagacuugaaaaucuuaaaaaaaaaaaacaaaaaaacaagaaaaggca

SEQ ID NO: 25512 - RNA, 64 nt, hsa
cgcacuaaccaccagaagacuugaaaaucuuaaaaaaaaaaaacaaaaaaacaagaaaaggcaa

SEQ ID NO: 25513 - RNA, 64 nt, hsa
gcacuaaccaccagaagacuugaaaaucuuaaaaaaaaaaaacaaaaaaacaagaaaaggcaac

SEQ ID NO: 25514 - RNA, 64 nt, hsa
uggaaggaaaaauaaaaaucacaaagguauauugaaaaaaaaaaaaaaaaaagggauacaugug

SEQ ID NO: 25515 - RNA, 64 nt, hsa
ggaaggaaaaauaaaaaucacaaagguauauugaaaaaaaaaaaaaaaaaagggauacaugugc

SEQ ID NO: 25516 - RNA, 64 nt, hsa
gaaggaaaaauaaaaaucacaaagguauauugaaaaaaaaaaaaaaaaaagggauacaugugca

SEQ ID NO: 25517 - RNA, 64 nt, hsa
aaggaaaaauaaaaaucacaaagguauauugaaaaaaaaaaaaaaaaaagggauacaugugcag

SEQ ID NO: 25518 - RNA, 64 nt, hsa
aggaaaaauaaaaaucacaaagguauauugaaaaaaaaaaaaaaaaaagggauacaugugcaga

SEQ ID NO: 25519 - RNA, 64 nt, hsa
ggaaaaauaaaaaucacaaagguauauugaaaaaaaaaaaaaaaaaagggauacaugugcagaa

SEQ ID NO: 25520 - RNA, 64 nt, hsa
gaaaaauaaaaaucacaaagguauauugaaaaaaaaaaaaaaaaaagggauacaugugcagaag

SEQ ID NO: 25521 - RNA, 64 nt, hsa
aaaaauaaaaaucacaaagguauauugaaaaaaaaaaaaaaaaaagggauacaugugcagaagg

SEQ ID NO: 25522 - RNA, 64 nt, hsa
aaaauaaaaaucacaaagguauauugaaaaaaaaaaaaaaaaaagggauacaugugcagaaggu

SEQ ID NO: 25523 - RNA, 64 nt, hsa
aaauaaaaaucacaaagguauauugaaaaaaaaaaaaaaaaaagggauacaugugcagaaggug

SEQ ID NO: 25524 - RNA, 64 nt, hsa
aauaaaaaucacaaagguauauugaaaaaaaaaaaaaaaaaagggauacaugugcagaaggugc

SEQ ID NO: 25525 - RNA, 64 nt, hsa
cagcuuggguaacagauugagaaccugucucauuaaaaaaaaaaaaaaaaaaaaagccguuaga

SEQ ID NO: 25526 - RNA, 64 nt, hsa
agcuuggguaacagauugagaaccugucucauuaaaaaaaaaaaaaaaaaaaaagccguuagac

SEQ ID NO: 25527 - RNA, 64 nt, hsa
gcuuggguaacagauugagaaccugucucauuaaaaaaaaaaaaaaaaaaaaagccguuagaca

SEQ ID NO: 25528 - RNA, 64 nt, hsa
cuuggguaacagauugagaaccugucucauuaaaaaaaaaaaaaaaaaaaaagccguuagacac

SEQ ID NO: 25529 - RNA, 64 nt, hsa
uuggguaacagauugagaaccugucucauuaaaaaaaaaaaaaaaaaaaaagccguuagacaca

SEQ ID NO: 25530 - RNA, 64 nt, hsa
uggguaacagauugagaaccugucucauuaaaaaaaaaaaaaaaaaaaaagccguuagacacac

SEQ ID NO: 25531 - RNA, 64 nt, hsa
ggguaacagauugagaaccugucucauuaaaaaaaaaaaaaaaaaaaaagccguuagacacaca

SEQ ID NO: 25532 - RNA, 64 nt, hsa
gguaacagauugagaaccugucucauuaaaaaaaaaaaaaaaaaaaaagccguuagacacacag

SEQ ID NO: 25533 - RNA, 64 nt, hsa
guaacagauugagaaccugucucauuaaaaaaaaaaaaaaaaaaaaagccguuagacacacagg

SEQ ID NO: 25534 - RNA, 64 nt, hsa
uaacagauugagaaccugucucauuaaaaaaaaaaaaaaaaaaaaagccguuagacacacagga

SEQ ID NO: 25535 - RNA, 64 nt, hsa
aacagauugagaaccugucucauuaaaaaaaaaaaaaaaaaaaaagccguuagacacacaggaa

SEQ ID NO: 25536 - RNA, 64 nt, hsa
acagauugagaaccugucucauuaaaaaaaaaaaaaaaaaaaaagccguuagacacacaggaaa

SEQ ID NO: 25537 - RNA, 64 nt, hsa
cagauugagaaccugucucauuaaaaaaaaaaaaaaaaaaaaagccguuagacacacaggaaaa

SEQ ID NO: 25538 - RNA, 64 nt, hsa
agauugagaaccugucucauuaaaaaaaaaaaaaaaaaaaaagccguuagacacacaggaaaaa

SEQ ID NO: 25539 - RNA, 64 nt, hsa
gccaacauggugaaacccugucucuacugaaaauaaaaaaaacuagcugggcaugguggcagau

SEQ ID NO: 25540 - RNA, 64 nt, hsa
agagagagacaauguguaggaaauguucuuuuuuaaaaaaaaauaacaaaaacaaaacaaaacu

SEQ ID NO: 25541 - RNA, 64 nt, hsa
gagagagacaauguguaggaaauguucuuuuuuaaaaaaaaauaacaaaaacaaaacaaaacua

SEQ ID NO: 25542 - RNA, 64 nt, hsa
uccagucugggcaacaaaaaugaaacuccgucucaaaaaaaaaaaaguaggucaauucguaaca

SEQ ID NO: 25543 - RNA, 64 nt, hsa
ccagucugggcaacaaaaaugaaacuccgucucaaaaaaaaaaaaguaggucaauucguaacag

SEQ ID NO: 25544 - RNA, 64 nt, hsa
cagucugggcaacaaaaaugaaacuccgucucaaaaaaaaaaaaguaggucaauucguaacagu

SEQ ID NO: 25545 - RNA, 64 nt, hsa
agucugggcaacaaaaaugaaacuccgucucaaaaaaaaaaaaguaggucaauucguaacaguu

SEQ ID NO: 25546 - RNA, 64 nt, hsa
gucugggcaacaaaaaugaaacuccgucucaaaaaaaaaaaaguaggucaauucguaacaguuu

SEQ ID NO: 25547 - RNA, 64 nt, hsa
cuccagccugggcgacagagcgagacuccgucucaaaaaaaaaaaaaaaaaaaaaaagaugacu

SEQ ID NO: 25548 - RNA, 64 nt, hsa
uccagccugggcgacagagcgagacuccgucucaaaaaaaaaaaaaaaaaaaaaaagaugacuu

SEQ ID NO: 25549 - RNA, 64 nt, hsa
ccagccugggcgacagagcgagacuccgucucaaaaaaaaaaaaaaaaaaaaaaagaugacuuu

SEQ ID NO: 25550 - RNA, 64 nt, hsa
cagccugggcgacagagcgagacuccgucucaaaaaaaaaaaaaaaaaaaaaaagaugacuuug

SEQ ID NO: 25551 - RNA, 64 nt, hsa
agccugggcgacagagcgagacuccgucucaaaaaaaaaaaaaaaaaaaaaaagaugacuuuga

SEQ ID NO: 25552 - RNA, 64 nt, hsa
gccugggcgacagagcgagacuccgucucaaaaaaaaaaaaaaaaaaaaaaagaugacuuugaa

SEQ ID NO: 25553 - RNA, 64 nt, hsa
ccugggcgacagagcgagacuccgucucaaaaaaaaaaaaaaaaaaaaaaagaugacuuugaaa

SEQ ID NO: 25554 - RNA, 64 nt, hsa
cugggcgacagagcgagacuccgucucaaaaaaaaaaaaaaaaaaaaaaagaugacuuugaaaa

SEQ ID NO: 25555 - RNA, 64 nt, hsa
ugggcgacagagcgagacuccgucucaaaaaaaaaaaaaaaaaaaaaaagaugacuuugaaaaa

SEQ ID NO: 25556 - RNA, 64 nt, hsa
gggcgacagagcgagacuccgucucaaaaaaaaaaaaaaaaaaaaaaagaugacuuugaaaaag

SEQ ID NO: 25557 - RNA, 64 nt, hsa
ggcgacagagcgagacuccgucucaaaaaaaaaaaaaaaaaaaaaaagaugacuuugaaaaagu

SEQ ID NO: 25558 - RNA, 64 nt, hsa
gcgacagagcgagacuccgucucaaaaaaaaaaaaaaaaaaaaaaagaugacuuugaaaaaguc

SEQ ID NO: 25559 - RNA, 64 nt, hsa
cgacagagcgagacuccgucucaaaaaaaaaaaaaaaaaaaaaaagaugacuuugaaaaaguca

SEQ ID NO: 25560 - RNA, 64 nt, hsa
gacagagcgagacuccgucucaaaaaaaaaaaaaaaaaaaaaaagaugacuuugaaaaagucac

SEQ ID NO: 25561 - RNA, 63 nt, hsa
acagagcgagacuccgucucaaaaaaaaaaaaaaaaaaaaaaagaugacuuugaaaaagucac

SEQ ID NO: 25562 - RNA, 62 nt, hsa
cagagcgagacuccgucucaaaaaaaaaaaaaaaaaaaaaaagaugacuuugaaaaagucac

SEQ ID NO: 25563 - RNA, 64 nt, hsa
uguagccucagccugauauucuuggugcgaagguaaaaaaaaaaaaauaaauaaaaccauuggc

SEQ ID NO: 25564 - RNA, 64 nt, hsa
guagccucagccugauauucuuggugcgaagguaaaaaaaaaaaaauaaauaaaaccauuggcc

SEQ ID NO: 25565 - RNA, 64 nt, hsa
uagccucagccugauauucuuggugcgaagguaaaaaaaaaaaaauaaauaaaaccauuggccu

SEQ ID NO: 25566 - RNA, 64 nt, hsa
agccucagccugauauucuuggugcgaagguaaaaaaaaaaaaauaaauaaaaccauuggccug

SEQ ID NO: 25567 - RNA, 64 nt, hsa
gccucagccugauauucuuggugcgaagguaaaaaaaaaaaaauaaauaaaaccauuggccugg

SEQ ID NO: 25568 - RNA, 64 nt, hsa
ccucagccugauauucuuggugcgaagguaaaaaaaaaaaaauaaauaaaaccauuggccuggu

SEQ ID NO: 25569 - RNA, 64 nt, hsa
augaacuugcaaaggaauauugcuaaaaacaaacaaaaaaaacuguuaucgaacuuucuuuguu

SEQ ID NO: 25570 - RNA, 64 nt, hsa
gagauuggacuuuuucuuguuuaaaaccccaaccaaaaaaaauaauaaggcaugauuggugggg

SEQ ID NO: 25571 - RNA, 64 nt, hsa
ccuggaugacauaaugagauucugucucuacuggaaaaaaaaaaaauuagcuggacaugguggc

SEQ ID NO: 25572 - RNA, 64 nt, hsa
cuggaugacauaaugagauucugucucuacuggaaaaaaaaaaaauuagcuggacaugguggca

SEQ ID NO: 25573 - RNA, 64 nt, hsa
uggaugacauaaugagauucugucucuacuggaaaaaaaaaaaauuagcuggacaugguggcaa

SEQ ID NO: 25574 - RNA, 64 nt, hsa
ggaugacauaaugagauucugucucuacuggaaaaaaaaaaaauuagcuggacaugguggcaau

SEQ ID NO: 25575 - RNA, 64 nt, hsa
gaugacauaaugagauucugucucuacuggaaaaaaaaaaaauuagcuggacaugguggcaauc

SEQ ID NO: 25576 - RNA, 64 nt, hsa
ugagacauugucucuaaaauacauaaguaaauuuaaaaaaaaaagaauaauaauuugaacagug

SEQ ID NO: 25577 - RNA, 64 nt, hsa
gagacauugucucuaaaauacauaaguaaauuuaaaaaaaaaagaauaauaauuugaacaguga

SEQ ID NO: 25578 - RNA, 64 nt, hsa
agacauugucucuaaaauacauaaguaaauuuaaaaaaaaaagaauaauaauuugaacagugaa

SEQ ID NO: 25579 - RNA, 64 nt, hsa
uauaguaugugcauaauggaaaguuaccuuacugaaaaaaaaaaaagaaggaaaaauaagaugg

SEQ ID NO: 25580 - RNA, 64 nt, hsa
auaguaugugcauaauggaaaguuaccuuacugaaaaaaaaaaaagaaggaaaaauaagauggg

SEQ ID NO: 25581 - RNA, 64 nt, hsa
uaguaugugcauaauggaaaguuaccuuacugaaaaaaaaaaaagaaggaaaaauaagaugggc

SEQ ID NO: 25582 - RNA, 64 nt, hsa
aguaugugcauaauggaaaguuaccuuacugaaaaaaaaaaaagaaggaaaaauaagaugggcc

SEQ ID NO: 25583 - RNA, 64 nt, hsa
guaugugcauaauggaaaguuaccuuacugaaaaaaaaaaaagaaggaaaaauaagaugggccc

SEQ ID NO: 25584 - RNA, 64 nt, hsa
gaaacucaucuguaaacuuuuauaccaaggggguaaaaaaaaaaacuaaggcauuugauuaaau

SEQ ID NO: 25585 - RNA, 64 nt, hsa
aaacucaucuguaaacuuuuauaccaaggggguaaaaaaaaaaacuaaggcauuugauuaaauu

SEQ ID NO: 25586 - RNA, 64 nt, hsa
aacucaucuguaaacuuuuauaccaaggggguaaaaaaaaaaacuaaggcauuugauuaaauua

SEQ ID NO: 25587 - RNA, 64 nt, hsa
acucaucuguaaacuuuuauaccaaggggguaaaaaaaaaaacuaaggcauuugauuaaauuau

SEQ ID NO: 25588 - RNA, 64 nt, hsa
agauuauuaacauacauuugaacauucccaaaugaaaaaaaaagccauugaauuucaagaaaug

SEQ ID NO: 25589 - RNA, 64 nt, hsa
gauuauuaacauacauuugaacauucccaaaugaaaaaaaaagccauugaauuucaagaaaugc

SEQ ID NO: 25590 - RNA, 64 nt, hsa
uugggcgacagagugagacuccgucucaaaaaagaaaaaaaaaagaugcuccucugaggucccu

SEQ ID NO: 25591 - RNA, 64 nt, hsa
ugggcgacagagugagacuccgucucaaaaaagaaaaaaaaaagaugcuccucugaggucccuc

SEQ ID NO: 25592 - RNA, 64 nt, hsa
gggcgacagagugagacuccgucucaaaaaagaaaaaaaaaagaugcuccucugaggucccucc

SEQ ID NO: 25593 - RNA, 64 nt, hsa
acuccagccuaggagacaaaacgagacuucauuuaaaaaaaauaaaaauaaaaauaaaaauaaa

SEQ ID NO: 25594 - RNA, 64 nt, hsa
acuccagccuggugacagagcgagacucccucucaaaaaaaaaaacaaacaaaaaagaagugug

SEQ ID NO: 25595 - RNA, 64 nt, hsa
cuccagccuggugacagagcgagacucccucucaaaaaaaaaaacaaacaaaaaagaagugugg

SEQ ID NO: 25596 - RNA, 64 nt, hsa
uccagccuggugacagagcgagacucccucucaaaaaaaaaaacaaacaaaaaagaaguguggg

SEQ ID NO: 25597 - RNA, 64 nt, hsa
ccagccuggugacagagcgagacucccucucaaaaaaaaaaacaaacaaaaaagaagugugggc

SEQ ID NO: 25598 - RNA, 64 nt, hsa
cucuauggggauggcuauuuuauuuuugagaaggaaaaaaaaagucauguauauauacacauaa

SEQ ID NO: 25599 - RNA, 64 nt, hsa
ucuauggggauggcuauuuuauuuuugagaaggaaaaaaaaagucauguauauauacacauaaa

SEQ ID NO: 25600 - RNA, 64 nt, hsa
uuuucuuuuuaaaugucuuucuuauauggguuuuaaaaaaaaguaauaaaagccuguugcaaaa

SEQ ID NO: 25601 - RNA, 64 nt, hsa
ccugacuagagcaggugauguauuuuuauacaguaaaaaaaaaaaaccuuguaaauucuagaag

SEQ ID NO: 25602 - RNA, 64 nt, hsa
cugacuagagcaggugauguauuuuuauacaguaaaaaaaaaaaaccuuguaaauucuagaaga

SEQ ID NO: 25603 - RNA, 64 nt, hsa
ugacuagagcaggugauguauuuuuauacaguaaaaaaaaaaaaccuuguaaauucuagaagag

SEQ ID NO: 25604 - RNA, 64 nt, hsa
gacuagagcaggugauguauuuuuauacaguaaaaaaaaaaaaccuuguaaauucuagaagagu

SEQ ID NO: 25605 - RNA, 64 nt, hsa
acuagagcaggugauguauuuuuauacaguaaaaaaaaaaaaccuuguaaauucuagaagagug

SEQ ID NO: 25606 - RNA, 64 nt, hsa
gcagucaucaguucuuuaggggcugcaauguuuuaaaaaaaauaagucaucagauuuuaagaaa

SEQ ID NO: 25607 - RNA, 64 nt, hsa
ugcuuugaaagccaaugggggaaaaaaauccaugaaaaaaaaaagauugauaaaguagaugauu

SEQ ID NO: 25608 - RNA, 64 nt, hsa
gcuuugaaagccaaugggggaaaaaaauccaugaaaaaaaaaagauugauaaaguagaugauuu

SEQ ID NO: 25609 - RNA, 64 nt, hsa
cuuugaaagccaaugggggaaaaaaauccaugaaaaaaaaaagauugauaaaguagaugauuuu

SEQ ID NO: 25610 - RNA, 64 nt, hsa
acccacugcuaacuguagcaacaaaauuuaaaagaaaaaaaacauacuuuaucuggcuauuaua

SEQ ID NO: 25611 - RNA, 64 nt, hsa
guuuuuuuuuugccuuagcaaagggugguguuugaaaaaaaaaauguguagccccuuuuuaacc

SEQ ID NO: 25612 - RNA, 64 nt, hsa
uuuuuuuuuugccuuagcaaagggugguguuugaaaaaaaaaauguguagccccuuuuuaaccu

SEQ ID NO: 25613 - RNA, 64 nt, hsa
uuuuuuuuugccuuagcaaagggugguguuugaaaaaaaaaauguguagccccuuuuuaaccua

SEQ ID NO: 25614 - RNA, 64 nt, hsa
aauguguagccccuuuuuaaccuaguguucauucaaaaaaaaauugaugcaaaucuuuauucac

SEQ ID NO: 25615 - RNA, 64 nt, hsa
auguguagccccuuuuuaaccuaguguucauucaaaaaaaaauugaugcaaaucuuuauucacu

SEQ ID NO: 25616 - RNA, 64 nt, hsa
cacacuuuccuguucauagcaauauuaaaucaggaaaaaaaaaugcagggagguauuuaacagc

SEQ ID NO: 25617 - RNA, 64 nt, hsa
acacuuuccuguucauagcaauauuaaaucaggaaaaaaaaaugcagggagguauuuaacagcu

SEQ ID NO: 25618 - RNA, 64 nt, hsa
aagaauccacuaugaugggaaacauuucauucucaaaaaaaaaaaaaaaaauuucucuucuucc

SEQ ID NO: 25619 - RNA, 64 nt, hsa
agaauccacuaugaugggaaacauuucauucucaaaaaaaaaaaaaaaaauuucucuucuuccu

SEQ ID NO: 25620 - RNA, 64 nt, hsa
gaauccacuaugaugggaaacauuucauucucaaaaaaaaaaaaaaaaauuucucuucuuccug

SEQ ID NO: 25621 - RNA, 64 nt, hsa
aauccacuaugaugggaaacauuucauucucaaaaaaaaaaaaaaaaauuucucuucuuccugu

SEQ ID NO: 25622 - RNA, 64 nt, hsa
auccacuaugaugggaaacauuucauucucaaaaaaaaaaaaaaaaauuucucuucuuccuguu

SEQ ID NO: 25623 - RNA, 64 nt, hsa
uccacuaugaugggaaacauuucauucucaaaaaaaaaaaaaaaaauuucucuucuuccuguua

SEQ ID NO: 25624 - RNA, 64 nt, hsa
ccacuaugaugggaaacauuucauucucaaaaaaaaaaaaaaaaauuucucuucuuccuguuau

SEQ ID NO: 25625 - RNA, 64 nt, hsa
cacuaugaugggaaacauuucauucucaaaaaaaaaaaaaaaaauuucucuucuuccuguuauu

SEQ ID NO: 25626 - RNA, 64 nt, hsa
acuaugaugggaaacauuucauucucaaaaaaaaaaaaaaaaauuucucuucuuccuguuauug

SEQ ID NO: 25627 - RNA, 64 nt, hsa
cuaugaugggaaacauuucauucucaaaaaaaaaaaaaaaaauuucucuucuuccuguuauugg

SEQ ID NO: 25628 - RNA, 64 nt, hsa
ugauggcuaaauagcaaaauuuauauuuagaagcaaaaaaaaaaagcauagagauguguuuuau

SEQ ID NO: 25629 - RNA, 64 nt, hsa
gauggcuaaauagcaaaauuuauauuuagaagcaaaaaaaaaaagcauagagauguguuuuaua

SEQ ID NO: 25630 - RNA, 64 nt, hsa
auggcuaaauagcaaaauuuauauuuagaagcaaaaaaaaaaagcauagagauguguuuuauaa

SEQ ID NO: 25631 - RNA, 64 nt, hsa
uggcuaaauagcaaaauuuauauuuagaagcaaaaaaaaaaagcauagagauguguuuuauaaa

SEQ ID NO: 25632 - RNA, 64 nt, hsa
gacaagcuuuauuaaguugagagagagagaggggaaaaaaaaaagccuuucguaguucaguaau

SEQ ID NO: 25633 - RNA, 64 nt, hsa
acaagcuuuauuaaguugagagagagagaggggaaaaaaaaaagccuuucguaguucaguaauu

SEQ ID NO: 25634 - RNA, 64 nt, hsa
caagcuuuauuaaguugagagagagagaggggaaaaaaaaaagccuuucguaguucaguaauug

SEQ ID NO: 25635 - RNA, 64 nt, hsa
ucuaagcauacguauacaauaaaacuaugcuauuaaaaaaaaagaagguaacugauaaaccaaa

SEQ ID NO: 25636 - RNA, 64 nt, hsa
cuaagcauacguauacaauaaaacuaugcuauuaaaaaaaaagaagguaacugauaaaccaaaa

SEQ ID NO: 25637 - RNA, 64 nt, hsa
gggaggguaagaaaagcaguuugcacuuaaaaagaaaaaaaaaaaacggguggugugucucagg

SEQ ID NO: 25638 - RNA, 64 nt, hsa
ggaggguaagaaaagcaguuugcacuuaaaaagaaaaaaaaaaaacggguggugugucucagga

SEQ ID NO: 25639 - RNA, 64 nt, hsa
gaggguaagaaaagcaguuugcacuuaaaaagaaaaaaaaaaaacggguggugugucucaggac

SEQ ID NO: 25640 - RNA, 64 nt, hsa
aggguaagaaaagcaguuugcacuuaaaaagaaaaaaaaaaaacggguggugugucucaggaca

SEQ ID NO: 25641 - RNA, 64 nt, hsa
ggguaagaaaagcaguuugcacuuaaaaagaaaaaaaaaaaacggguggugugucucaggacaa

SEQ ID NO: 25642 - RNA, 64 nt, hsa
uauuuaauuuccuuagaaaaauaacaccauuuggaaaaaaaaacugguguuaugaagaacguaa

SEQ ID NO: 25643 - RNA, 64 nt, hsa
auuuaauuuccuuagaaaaauaacaccauuuggaaaaaaaaacugguguuaugaagaacguaaa

SEQ ID NO: 25644 - RNA, 64 nt, hsa
cccaguuuuucagcucaggauuauauuuguaaucaaaaaaaaaaaaucacuuggcgcaggaggg

SEQ ID NO: 25645 - RNA, 64 nt, hsa
ccaguuuuucagcucaggauuauauuuguaaucaaaaaaaaaaaaucacuuggcgcaggaggga

SEQ ID NO: 25646 - RNA, 64 nt, hsa
caguuuuucagcucaggauuauauuuguaaucaaaaaaaaaaaaucacuuggcgcaggagggag

SEQ ID NO: 25647 - RNA, 64 nt, hsa
aguuuuucagcucaggauuauauuuguaaucaaaaaaaaaaaaucacuuggcgcaggagggaga

SEQ ID NO: 25648 - RNA, 64 nt, hsa
guuuuucagcucaggauuauauuuguaaucaaaaaaaaaaaaucacuuggcgcaggagggagaa

SEQ ID NO: 25649 - RNA, 64 nt, hsa
agccuggccaacauggugaaacccugucucuacuaaaaaaaaaaaaaaaauagaaaaauuagcu

SEQ ID NO: 25650 - RNA, 64 nt, hsa
gccuggccaacauggugaaacccugucucuacuaaaaaaaaaaaaaaaauagaaaaauuagcug

SEQ ID NO: 25651 - RNA, 64 nt, hsa
ccuggccaacauggugaaacccugucucuacuaaaaaaaaaaaaaaaauagaaaaauuagcugg

SEQ ID NO: 25652 - RNA, 64 nt, hsa
cuggccaacauggugaaacccugucucuacuaaaaaaaaaaaaaaaauagaaaaauuagcuggg

SEQ ID NO: 25653 - RNA, 64 nt, hsa
uggccaacauggugaaacccugucucuacuaaaaaaaaaaaaaaaauagaaaaauuagcugggc

SEQ ID NO: 25654 - RNA, 64 nt, hsa
ggccaacauggugaaacccugucucuacuaaaaaaaaaaaaaaaauagaaaaauuagcugggca

SEQ ID NO: 25655 - RNA, 64 nt, hsa
gccaacauggugaaacccugucucuacuaaaaaaaaaaaaaaaauagaaaaauuagcugggcau

SEQ ID NO: 25656 - RNA, 64 nt, hsa
ccaacauggugaaacccugucucuacuaaaaaaaaaaaaaaaauagaaaaauuagcugggcaug

SEQ ID NO: 25657 - RNA, 64 nt, hsa
caacauggugaaacccugucucuacuaaaaaaaaaaaaaaaauagaaaaauuagcugggcaugg

SEQ ID NO: 25658 - RNA, 64 nt, hsa
gugaacauuagugauuguuagcagugguucaaaaaaaaaaaacuuuuuuuuuuuuuuugagaca

SEQ ID NO: 25659 - RNA, 64 nt, hsa
agugaacauuagugauuguuagcagugguucaaaaaaaaaaaacuuuuuuuuuuuuuuugagac

SEQ ID NO: 25660 - RNA, 64 nt, hsa
uagugaacauuagugauuguuagcagugguucaaaaaaaaaaaacuuuuuuuuuuuuuuugaga

SEQ ID NO: 25661 - RNA, 64 nt, hsa
uuagugaacauuagugauuguuagcagugguucaaaaaaaaaaaacuuuuuuuuuuuuuuugag

SEQ ID NO: 25662 - RNA, 64 nt, hsa
uuuagugaacauuagugauuguuagcagugguucaaaaaaaaaaaacuuuuuuuuuuuuuuuga

SEQ ID NO: 25663 - RNA, 64 nt, hsa
gggauaagucacuguuuucuuuauuucuuuaaaaaaaaaaaaguucuguugcaaacgacugcug

SEQ ID NO: 25664 - RNA, 64 nt, hsa
cgggauaagucacuguuuucuuuauuucuuuaaaaaaaaaaaaguucuguugcaaacgacugcu

SEQ ID NO: 25665 - RNA, 64 nt, hsa
gcgggauaagucacuguuuucuuuauuucuuuaaaaaaaaaaaaguucuguugcaaacgacugc

SEQ ID NO: 25666 - RNA, 64 nt, hsa
agcgggauaagucacuguuuucuuuauuucuuuaaaaaaaaaaaaguucuguugcaaacgacug

SEQ ID NO: 25667 - RNA, 64 nt, hsa
uagcgggauaagucacuguuuucuuuauuucuuuaaaaaaaaaaaaguucuguugcaaacgacu

SEQ ID NO: 25668 - RNA, 64 nt, hsa
cccaggcgacagagcgagacuccgucucgaaaaaaaaaaaaaguauaaggagagaaauaacuuu

SEQ ID NO: 25669 - RNA, 64 nt, hsa
gcccaggcgacagagcgagacuccgucucgaaaaaaaaaaaaaguauaaggagagaaauaacuu

SEQ ID NO: 25670 - RNA, 64 nt, hsa
agcccaggcgacagagcgagacuccgucucgaaaaaaaaaaaaaguauaaggagagaaauaacu

SEQ ID NO: 25671 - RNA, 64 nt, hsa
cagcccaggcgacagagcgagacuccgucucgaaaaaaaaaaaaaguauaaggagagaaauaac

SEQ ID NO: 25672 - RNA, 64 nt, hsa
ccagcccaggcgacagagcgagacuccgucucgaaaaaaaaaaaaaguauaaggagagaaauaa

SEQ ID NO: 25673 - RNA, 64 nt, hsa
uccagcccaggcgacagagcgagacuccgucucgaaaaaaaaaaaaaguauaaggagagaaaua

SEQ ID NO: 25674 - RNA, 64 nt, hsa
acagaugaggacagagcuggugauaaaaaaaaaaaaaaaaaagcauuuucuagauaccacuuaa

SEQ ID NO: 25675 - RNA, 64 nt, hsa
gacagaugaggacagagcuggugauaaaaaaaaaaaaaaaaaagcauuuucuagauaccacuua

SEQ ID NO: 25676 - RNA, 64 nt, hsa
agacagaugaggacagagcuggugauaaaaaaaaaaaaaaaaaagcauuuucuagauaccacuu

SEQ ID NO: 25677 - RNA, 64 nt, hsa
cagacagaugaggacagagcuggugauaaaaaaaaaaaaaaaaaagcauuuucuagauaccacu

SEQ ID NO: 25678 - RNA, 64 nt, hsa
acagacagaugaggacagagcuggugauaaaaaaaaaaaaaaaaaagcauuuucuagauaccac

SEQ ID NO: 25679 - RNA, 64 nt, hsa
aacagacagaugaggacagagcuggugauaaaaaaaaaaaaaaaaaagcauuuucuagauacca

SEQ ID NO: 25680 - RNA, 64 nt, hsa
gaacagacagaugaggacagagcuggugauaaaaaaaaaaaaaaaaaagcauuuucuagauacc

SEQ ID NO: 25681 - RNA, 64 nt, hsa
agaacagacagaugaggacagagcuggugauaaaaaaaaaaaaaaaaaagcauuuucuagauac

SEQ ID NO: 25682 - RNA, 64 nt, hsa
cagaacagacagaugaggacagagcuggugauaaaaaaaaaaaaaaaaaagcauuuucuagaua

SEQ ID NO: 25683 - RNA, 64 nt, hsa
acagaacagacagaugaggacagagcuggugauaaaaaaaaaaaaaaaaaagcauuuucuagau

SEQ ID NO: 25684 - RNA, 64 nt, hsa
aacagaacagacagaugaggacagagcuggugauaaaaaaaaaaaaaaaaaagcauuuucuaga

SEQ ID NO: 25685 - RNA, 64 nt, hsa
aggaauuuggaauccaagagcuauaauuuuuaaaaaaaaaaaucuuuuauuuuaauacauugua

SEQ ID NO: 25686 - RNA, 64 nt, hsa
uaggaauuuggaauccaagagcuauaauuuuuaaaaaaaaaaaucuuuuauuuuaauacauugu

SEQ ID NO: 25687 - RNA, 64 nt, hsa
auaggaauuuggaauccaagagcuauaauuuuuaaaaaaaaaaaucuuuuauuuuaauacauug

SEQ ID NO: 25688 - RNA, 64 nt, hsa
cauaggaauuuggaauccaagagcuauaauuuuuaaaaaaaaaaaucuuuuauuuuaauacauu

SEQ ID NO: 25689 - RNA, 64 nt, hsa
auuuagcccugccccauauggaacauguuaaaaaaaaaaaaagccaggccgagcguguuggcuc

SEQ ID NO: 25690 - RNA, 64 nt, hsa
cauuuagcccugccccauauggaacauguuaaaaaaaaaaaaagccaggccgagcguguuggcu

SEQ ID NO: 25691 - RNA, 64 nt, hsa
acauuuagcccugccccauauggaacauguuaaaaaaaaaaaaagccaggccgagcguguuggc

SEQ ID NO: 25692 - RNA, 64 nt, hsa
aacauuuagcccugccccauauggaacauguuaaaaaaaaaaaaagccaggccgagcguguugg

SEQ ID NO: 25693 - RNA, 64 nt, hsa
uaacauuuagcccugccccauauggaacauguuaaaaaaaaaaaaagccaggccgagcguguug

SEQ ID NO: 25694 - RNA, 64 nt, hsa
cuaacauuuagcccugccccauauggaacauguuaaaaaaaaaaaaagccaggccgagcguguu

SEQ ID NO: 25695 - RNA, 64 nt, hsa
gcaacagagcgagacuccgucucaaaaaaaaaaaaaaaaaaaguaauuggcagugacuaugggc

SEQ ID NO: 25696 - RNA, 64 nt, hsa
ggcaacagagcgagacuccgucucaaaaaaaaaaaaaaaaaaaguaauuggcagugacuauggg

SEQ ID NO: 25697 - RNA, 64 nt, hsa
gggcaacagagcgagacuccgucucaaaaaaaaaaaaaaaaaaaguaauuggcagugacuaugg

SEQ ID NO: 25698 - RNA, 64 nt, hsa
ugggcaacagagcgagacuccgucucaaaaaaaaaaaaaaaaaaaguaauuggcagugacuaug

SEQ ID NO: 25699 - RNA, 64 nt, hsa
cugggcaacagagcgagacuccgucucaaaaaaaaaaaaaaaaaaaguaauuggcagugacuau

SEQ ID NO: 25700 - RNA, 64 nt, hsa
ccugggcaacagagcgagacuccgucucaaaaaaaaaaaaaaaaaaaguaauuggcagugacua

SEQ ID NO: 25701 - RNA, 64 nt, hsa
gccugggcaacagagcgagacuccgucucaaaaaaaaaaaaaaaaaaaguaauuggcagugacu

SEQ ID NO: 25702 - RNA, 64 nt, hsa
agccugggcaacagagcgagacuccgucucaaaaaaaaaaaaaaaaaaaguaauuggcagugac

SEQ ID NO: 25703 - RNA, 64 nt, hsa
cagccugggcaacagagcgagacuccgucucaaaaaaaaaaaaaaaaaaaguaauuggcaguga

SEQ ID NO: 25704 - RNA, 64 nt, hsa
ccagccugggcaacagagcgagacuccgucucaaaaaaaaaaaaaaaaaaaguaauuggcagug

SEQ ID NO: 25705 - RNA, 64 nt, hsa
uccagccugggcaacagagcgagacuccgucucaaaaaaaaaaaaaaaaaaaguaauuggcagu

SEQ ID NO: 25706 - RNA, 64 nt, hsa
cuccagccugggcaacagagcgagacuccgucucaaaaaaaaaaaaaaaaaaaguaauuggcag

SEQ ID NO: 25707 - RNA, 64 nt, hsa
uaacauggugaaacccugucucuacuaaaaauacaaaaaaaauuagccagccaugguggcgggc

SEQ ID NO: 25708 - RNA, 64 nt, hsa
auccuggcgaacacggugaaaccccgucucuacuaaaaaaaauacaaaaaaauuagccaggcgu

SEQ ID NO: 25709 - RNA, 64 nt, hsa
ggugccagagcaagacuccaucucaaaaaaaaaaaaaaaaaauacagcuucuccuaugaggugc

SEQ ID NO: 25710 - RNA, 64 nt, hsa
gggugccagagcaagacuccaucucaaaaaaaaaaaaaaaaaauacagcuucuccuaugaggug

SEQ ID NO: 25711 - RNA, 64 nt, hsa
ugggugccagagcaagacuccaucucaaaaaaaaaaaaaaaaaauacagcuucuccuaugaggu

SEQ ID NO: 25712 - RNA, 64 nt, hsa
cugggugccagagcaagacuccaucucaaaaaaaaaaaaaaaaaauacagcuucuccuaugagg

SEQ ID NO: 25713 - RNA, 64 nt, hsa
ccugggugccagagcaagacuccaucucaaaaaaaaaaaaaaaaaauacagcuucuccuaugag

SEQ ID NO: 25714 - RNA, 64 nt, hsa
gccugggugccagagcaagacuccaucucaaaaaaaaaaaaaaaaaauacagcuucuccuauga

SEQ ID NO: 25715 - RNA, 64 nt, hsa
agccugggugccagagcaagacuccaucucaaaaaaaaaaaaaaaaaauacagcuucuccuaug

SEQ ID NO: 25716 - RNA, 64 nt, hsa
cagccugggugccagagcaagacuccaucucaaaaaaaaaaaaaaaaaauacagcuucuccuau

SEQ ID NO: 25717 - RNA, 64 nt, hsa
ccagccugggugccagagcaagacuccaucucaaaaaaaaaaaaaaaaaauacagcuucuccua

SEQ ID NO: 25718 - RNA, 64 nt, hsa
uccagccugggugccagagcaagacuccaucucaaaaaaaaaaaaaaaaaauacagcuucuccu

SEQ ID NO: 25719 - RNA, 64 nt, hsa
cuccagccugggugccagagcaagacuccaucucaaaaaaaaaaaaaaaaaauacagcuucucc

SEQ ID NO: 25720 - RNA, 64 nt, hsa
caacauuucuaaggaacuuggauuaauugggggaaaaaaaaaggaguacuuguacugcuuugau

SEQ ID NO: 25721 - RNA, 64 nt, hsa
gcaacauuucuaaggaacuuggauuaauugggggaaaaaaaaaggaguacuuguacugcuuuga

SEQ ID NO: 25722 - RNA, 64 nt, hsa
auuuauacaacagacuauuauucggccauuaaaaaaaaaaaagaguggcugacaccuguaaucu

SEQ ID NO: 25723 - RNA, 64 nt, hsa
uauuuauacaacagacuauuauucggccauuaaaaaaaaaaaagaguggcugacaccuguaauc

SEQ ID NO: 25724 - RNA, 64 nt, hsa
auauuuauacaacagacuauuauucggccauuaaaaaaaaaaaagaguggcugacaccuguaau

SEQ ID NO: 25725 - RNA, 64 nt, hsa
uauauuuauacaacagacuauuauucggccauuaaaaaaaaaaaagaguggcugacaccuguaa

SEQ ID NO: 25726 - RNA, 64 nt, hsa
guauauuuauacaacagacuauuauucggccauuaaaaaaaaaaaagaguggcugacaccugua

SEQ ID NO: 25727 - RNA, 64 nt, hsa
cuguggaccacagaacuccaagaauuguuuaaaaaaaaaaaagugcuacccugagaaaaguacu

SEQ ID NO: 25728 - RNA, 64 nt, hsa
gcuguggaccacagaacuccaagaauuguuuaaaaaaaaaaaagugcuacccugagaaaaguac

SEQ ID NO: 25729 - RNA, 64 nt, hsa
ugcuguggaccacagaacuccaagaauuguuuaaaaaaaaaaaagugcuacccugagaaaagua

SEQ ID NO: 25730 - RNA, 64 nt, hsa
augcuguggaccacagaacuccaagaauuguuuaaaaaaaaaaaagugcuacccugagaaaagu

SEQ ID NO: 25731 - RNA, 64 nt, hsa
aaugcuguggaccacagaacuccaagaauuguuuaaaaaaaaaaaagugcuacccugagaaaag

SEQ ID NO: 25732 - RNA, 64 nt, hsa
aaggacucauacuuaaaaaaauguuuagcaaaaaaaaaaaaaguugagaacuuuuaauuuauuu

SEQ ID NO: 25733 - RNA, 64 nt, hsa
caaggacucauacuuaaaaaaauguuuagcaaaaaaaaaaaaaguugagaacuuuuaauuuauu

SEQ ID NO: 25734 - RNA, 64 nt, hsa
acaaggacucauacuuaaaaaaauguuuagcaaaaaaaaaaaaaguugagaacuuuuaauuuau

SEQ ID NO: 25735 - RNA, 64 nt, hsa
aacaaggacucauacuuaaaaaaauguuuagcaaaaaaaaaaaaaguugagaacuuuuaauuua

SEQ ID NO: 25736 - RNA, 64 nt, hsa
aaacaaggacucauacuuaaaaaaauguuuagcaaaaaaaaaaaaaguugagaacuuuuaauuu

SEQ ID NO: 25737 - RNA, 64 nt, hsa
uaaacaaggacucauacuuaaaaaaauguuuagcaaaaaaaaaaaaaguugagaacuuuuaauu

SEQ ID NO: 25738 - RNA, 64 nt, hsa
agauacgauuggcucuagaucuacauucuucaaaaaaaaaaauuggcuuaacuguuucaucuuu

SEQ ID NO: 25739 - RNA, 64 nt, hsa
aagauacgauuggcucuagaucuacauucuucaaaaaaaaaaauuggcuuaacuguuucaucuu

SEQ ID NO: 25740 - RNA, 64 nt, hsa
caagauacgauuggcucuagaucuacauucuucaaaaaaaaaaauuggcuuaacuguuucaucu

SEQ ID NO: 25741 - RNA, 64 nt, hsa
gcaagauacgauuggcucuagaucuacauucuucaaaaaaaaaaauuggcuuaacuguuucauc

SEQ ID NO: 25742 - RNA, 64 nt, hsa
cugggcaacagagugagacuccgucucaaaaaaaaaaaaaaaccggaugucuaggccaaugaua

SEQ ID NO: 25743 - RNA, 64 nt, hsa
ccugggcaacagagugagacuccgucucaaaaaaaaaaaaaaaccggaugucuaggccaaugau

SEQ ID NO: 25744 - RNA, 64 nt, hsa
gccugggcaacagagugagacuccgucucaaaaaaaaaaaaaaaccggaugucuaggccaauga

SEQ ID NO: 25745 - RNA, 64 nt, hsa
agccugggcaacagagugagacuccgucucaaaaaaaaaaaaaaaccggaugucuaggccaaug

SEQ ID NO: 25746 - RNA, 64 nt, hsa
cagccugggcaacagagugagacuccgucucaaaaaaaaaaaaaaaccggaugucuaggccaau

SEQ ID NO: 25747 - RNA, 64 nt, hsa
ccagccugggcaacagagugagacuccgucucaaaaaaaaaaaaaaaccggaugucuaggccaa

SEQ ID NO: 25748 - RNA, 64 nt, hsa
uccagccugggcaacagagugagacuccgucucaaaaaaaaaaaaaaaccggaugucuaggcca

SEQ ID NO: 25749 - RNA, 64 nt, hsa
cuccagccugggcaacagagugagacuccgucucaaaaaaaaaaaaaaaccggaugucuaggcc

SEQ ID NO: 25750 - RNA, 64 nt, hsa
gaggcggagguugugaugagccaagauugagccaaaaaaaaauuagcagaauugguguugggcc

SEQ ID NO: 25751 - RNA, 64 nt, hsa
ggaggcggagguugugaugagccaagauugagccaaaaaaaaauuagcagaauugguguugggc

SEQ ID NO: 25752 - RNA, 64 nt, hsa
ccugagcaaaaaaaaaaaaaaaacaaaaaaacaaaaaaaaaacaaaacaguuuuuaaaacugau

SEQ ID NO: 25753 - RNA, 64 nt, hsa
uccugagcaaaaaaaaaaaaaaaacaaaaaaacaaaaaaaaaacaaaacaguuuuuaaaacuga

SEQ ID NO: 25754 - RNA, 64 nt, hsa
guccugagcaaaaaaaaaaaaaaaacaaaaaaacaaaaaaaaaacaaaacaguuuuuaaaacug

SEQ ID NO: 25755 - RNA, 64 nt, hsa
ugcucugaaagcaaauaguccugagcaaaaaaaaaaaaaaaacaaaaaaacaaaaaaaaaacaa

SEQ ID NO: 25756 - RNA, 64 nt, hsa
gugcucugaaagcaaauaguccugagcaaaaaaaaaaaaaaaacaaaaaaacaaaaaaaaaaca

SEQ ID NO: 25757 - RNA, 64 nt, hsa
ugugcucugaaagcaaauaguccugagcaaaaaaaaaaaaaaaacaaaaaaacaaaaaaaaaac

SEQ ID NO: 25758 - RNA, 64 nt, hsa
uugugcucugaaagcaaauaguccugagcaaaaaaaaaaaaaaaacaaaaaaacaaaaaaaaaa

SEQ ID NO: 25759 - RNA, 64 nt, hsa
uuugugcucugaaagcaaauaguccugagcaaaaaaaaaaaaaaaacaaaaaaacaaaaaaaaa

SEQ ID NO: 25760 - RNA, 64 nt, hsa
uuuugugcucugaaagcaaauaguccugagcaaaaaaaaaaaaaaaacaaaaaaacaaaaaaaa

SEQ ID NO: 25761 - RNA, 64 nt, hsa
guuuugugcucugaaagcaaauaguccugagcaaaaaaaaaaaaaaaacaaaaaaacaaaaaaa

SEQ ID NO: 25762 - RNA, 64 nt, hsa
uguuuugugcucugaaagcaaauaguccugagcaaaaaaaaaaaaaaaacaaaaaaacaaaaaa

SEQ ID NO: 25763 - RNA, 64 nt, hsa
cuguuuugugcucugaaagcaaauaguccugagcaaaaaaaaaaaaaaaacaaaaaaacaaaaa

SEQ ID NO: 25764 - RNA, 64 nt, hsa
gacagagcaagacucccgucucgggggcuuaaaaaaaaaaaaugcuguaucuaaaugaaucugu

SEQ ID NO: 25765 - RNA, 64 nt, hsa
ugacagagcaagacucccgucucgggggcuuaaaaaaaaaaaaugcuguaucuaaaugaaucug

SEQ ID NO: 25766 - RNA, 64 nt, hsa
gugacagagcaagacucccgucucgggggcuuaaaaaaaaaaaaugcuguaucuaaaugaaucu

SEQ ID NO: 25767 - RNA, 64 nt, hsa
ggugacagagcaagacucccgucucgggggcuuaaaaaaaaaaaaugcuguaucuaaaugaauc

SEQ ID NO: 25768 - RNA, 64 nt, hsa
gggugacagagcaagacucccgucucgggggcuuaaaaaaaaaaaaugcuguaucuaaaugaau

SEQ ID NO: 25769 - RNA, 64 nt, hsa
auugaaagguaaaaucugauuauuuagcaugagaaaaaaaaauccaacucugcuuuuggucuug

SEQ ID NO: 25770 - RNA, 64 nt, hsa
cauugaaagguaaaaucugauuauuuagcaugagaaaaaaaaauccaacucugcuuuuggucuu

SEQ ID NO: 25771 - RNA, 64 nt, hsa
gggugguugguuuaacaaaaaaaaaaagcuuuaaaaaaaaaagaaaaaaaggaaaagguuuuua

SEQ ID NO: 25772 - RNA, 64 nt, hsa
agggugguugguuuaacaaaaaaaaaaagcuuuaaaaaaaaaagaaaaaaaggaaaagguuuuu

SEQ ID NO: 25773 - RNA, 64 nt, hsa
cagggugguugguuuaacaaaaaaaaaaagcuuuaaaaaaaaaagaaaaaaaggaaaagguuuu

SEQ ID NO: 25774 - RNA, 64 nt, hsa
auguggaaacuuucagggugguugguuuaacaaaaaaaaaaagcuuuaaaaaaaaaagaaaaaa

SEQ ID NO: 25775 - RNA, 64 nt, hsa
cauguggaaacuuucagggugguugguuuaacaaaaaaaaaaagcuuuaaaaaaaaaagaaaaa

SEQ ID NO: 25776 - RNA, 64 nt, hsa
acauguggaaacuuucagggugguugguuuaacaaaaaaaaaaagcuuuaaaaaaaaaagaaaa

SEQ ID NO: 25777 - RNA, 64 nt, hsa
cacauguggaaacuuucagggugguugguuuaacaaaaaaaaaaagcuuuaaaaaaaaaagaaa

SEQ ID NO: 25778 - RNA, 64 nt, hsa
ugccuuguuauuacuagguuuuuugagauuaaaaaaaaaaaaucccugguuuaaaaccaacaau

SEQ ID NO: 25779 - RNA, 64 nt, hsa
uugccuuguuauuacuagguuuuuugagauuaaaaaaaaaaaaucccugguuuaaaaccaacaa

SEQ ID NO: 25780 - RNA, 64 nt, hsa
auugccuuguuauuacuagguuuuuugagauuaaaaaaaaaaaaucccugguuuaaaaccaaca

SEQ ID NO: 25781 - RNA, 64 nt, hsa
gauugccuuguuauuacuagguuuuuugagauuaaaaaaaaaaaaucccugguuuaaaaccaac

SEQ ID NO: 25782 - RNA, 64 nt, hsa
ugauugccuuguuauuacuagguuuuuugagauuaaaaaaaaaaaaucccugguuuaaaaccaa

SEQ ID NO: 25783 - RNA, 64 nt, hsa
uuaagcccaccugggcacuuuuagauaaaaaaaaaaaaaaaacaaaaaacaacaccaaaaaaac

SEQ ID NO: 25784 - RNA, 64 nt, hsa
cuuaagcccaccugggcacuuuuagauaaaaaaaaaaaaaaaacaaaaaacaacaccaaaaaaa

SEQ ID NO: 25785 - RNA, 64 nt, hsa
ccuuaagcccaccugggcacuuuuagauaaaaaaaaaaaaaaaacaaaaaacaacaccaaaaaa

SEQ ID NO: 25786 - RNA, 64 nt, hsa
gccuuaagcccaccugggcacuuuuagauaaaaaaaaaaaaaaaacaaaaaacaacaccaaaaa

SEQ ID NO: 25787 - RNA, 64 nt, hsa
agccuuaagcccaccugggcacuuuuagauaaaaaaaaaaaaaaaacaaaaaacaacaccaaaa

SEQ ID NO: 25788 - RNA, 64 nt, hsa
cagccuuaagcccaccugggcacuuuuagauaaaaaaaaaaaaaaaacaaaaaacaacaccaaa

SEQ ID NO: 25789 - RNA, 64 nt, hsa
gcagccuuaagcccaccugggcacuuuuagauaaaaaaaaaaaaaaaacaaaaaacaacaccaa

SEQ ID NO: 25790 - RNA, 64 nt, hsa
ggcagccuuaagcccaccugggcacuuuuagauaaaaaaaaaaaaaaaacaaaaaacaacacca

SEQ ID NO: 25791 - RNA, 64 nt, hsa
uggcagccuuaagcccaccugggcacuuuuagauaaaaaaaaaaaaaaaacaaaaaacaacacc

SEQ ID NO: 25792 - RNA, 64 nt, hsa
gcaucaaacuaguggucaaggacuaacuccuaaaaaaaaaaagcaacucuuaucaaggauuaau

SEQ ID NO: 25793 - RNA, 64 nt, hsa
ggcaucaaacuaguggucaaggacuaacuccuaaaaaaaaaaagcaacucuuaucaaggauuaa

SEQ ID NO: 25794 - RNA, 64 nt, hsa
uggcaucaaacuaguggucaaggacuaacuccuaaaaaaaaaaagcaacucuuaucaaggauua

SEQ ID NO: 25795 - RNA, 64 nt, hsa
auggcaucaaacuaguggucaaggacuaacuccuaaaaaaaaaaagcaacucuuaucaaggauu

SEQ ID NO: 25796 - RNA, 64 nt, hsa
auuauacaaaguuuguacaguaccaaaaaagaaaaaaaaaaagguguaaauuuuuuuuucauua

SEQ ID NO: 25797 - RNA, 64 nt, hsa
uauuauacaaaguuuguacaguaccaaaaaagaaaaaaaaaaagguguaaauuuuuuuuucauu

SEQ ID NO: 25798 - RNA, 64 nt, hsa
uuauuauacaaaguuuguacaguaccaaaaaagaaaaaaaaaaagguguaaauuuuuuuuucau

SEQ ID NO: 25799 - RNA, 64 nt, hsa
uuuauuauacaaaguuuguacaguaccaaaaaagaaaaaaaaaaagguguaaauuuuuuuuuca

SEQ ID NO: 25800 - RNA, 64 nt, hsa
cccaugaggaaaaaaaaaaaaguaaaacaaagacaaaaaaaaucuuuuguacagagauauauuu

SEQ ID NO: 25801 - RNA, 64 nt, hsa
acgccauauacccaucaccaucccaugaggaaaaaaaaaaaaguaaaacaaagacaaaaaaaau

SEQ ID NO: 25802 - RNA, 64 nt, hsa
uacgccauauacccaucaccaucccaugaggaaaaaaaaaaaaguaaaacaaagacaaaaaaaa

SEQ ID NO: 25803 - RNA, 64 nt, hsa
cuacgccauauacccaucaccaucccaugaggaaaaaaaaaaaaguaaaacaaagacaaaaaaa

SEQ ID NO: 25804 - RNA, 64 nt, hsa
ucuacgccauauacccaucaccaucccaugaggaaaaaaaaaaaaguaaaacaaagacaaaaaa

SEQ ID NO: 25805 - RNA, 64 nt, hsa
aucuacgccauauacccaucaccaucccaugaggaaaaaaaaaaaaguaaaacaaagacaaaaa

SEQ ID NO: 25806 - RNA, 64 nt, hsa
aaugggagcccacggaacuaaguagggucccaagaaaaaaaacgggagcuauuucacagagcug

SEQ ID NO: 25807 - RNA, 64 nt, hsa
gagcgaccuuuucaauuacaaagaaccuccuggaaaaaaaaacaaaagcugaacagaggcggcc

SEQ ID NO: 25808 - RNA, 64 nt, hsa
agagcgaccuuuucaauuacaaagaaccuccuggaaaaaaaaacaaaagcugaacagaggcggc

SEQ ID NO: 25809 - RNA, 64 nt, hsa
gccugggcgauauagugaggccccaucucaaaaaaaaaaaaaggggggggggggggaguugggc

SEQ ID NO: 25810 - RNA, 64 nt, hsa
agccugggcgauauagugaggccccaucucaaaaaaaaaaaaaggggggggggggggaguuggg

SEQ ID NO: 25811 - RNA, 64 nt, hsa
cagccugggcgauauagugaggccccaucucaaaaaaaaaaaaaggggggggggggggaguugg

SEQ ID NO: 25812 - RNA, 64 nt, hsa
ccagccugggcgauauagugaggccccaucucaaaaaaaaaaaaaggggggggggggggaguug

SEQ ID NO: 25813 - RNA, 64 nt, hsa
accagccugggcgauauagugaggccccaucucaaaaaaaaaaaaaggggggggggggggaguu

SEQ ID NO: 25814 - RNA, 64 nt, hsa
gaccagccugggcgauauagugaggccccaucucaaaaaaaaaaaaaggggggggggggggagu

SEQ ID NO: 25815 - RNA, 64 nt, hsa
agguaacauagugagacccugucucauuaaaaaaaaaaaaaaggcaugguggcacgcacuguag

SEQ ID NO: 25816 - RNA, 64 nt, hsa
uagguaacauagugagacccugucucauuaaaaaaaaaaaaaaggcaugguggcacgcacugua

SEQ ID NO: 25817 - RNA, 64 nt, hsa
cuagguaacauagugagacccugucucauuaaaaaaaaaaaaaaggcaugguggcacgcacugu

SEQ ID NO: 25818 - RNA, 64 nt, hsa
ccuagguaacauagugagacccugucucauuaaaaaaaaaaaaaaggcaugguggcacgcacug

SEQ ID NO: 25819 - RNA, 64 nt, hsa
gccuagguaacauagugagacccugucucauuaaaaaaaaaaaaaaggcaugguggcacgcacu

SEQ ID NO: 25820 - RNA, 64 nt, hsa
agccuagguaacauagugagacccugucucauuaaaaaaaaaaaaaaggcaugguggcacgcac

SEQ ID NO: 25821 - RNA, 64 nt, hsa
uagccuagguaacauagugagacccugucucauuaaaaaaaaaaaaaaggcaugguggcacgca

SEQ ID NO: 25822 - RNA, 62 nt, hsa
auuucccuacccuacccuccccccaaaaaaaagcaaaaaaaaaaaaaaaaaacuaacaaaaa

SEQ ID NO: 25823 - RNA, 64 nt, hsa
uuccccuuauauuucccuacccuacccuccccccaaaaaaaagcaaaaaaaaaaaaaaaaaacu

SEQ ID NO: 25824 - RNA, 64 nt, hsa
cuuuuuguucgguugcuuuggauuuuacaaaaaaaaaaaaaagcccagaaacuuucgaacaaaa

SEQ ID NO: 25825 - RNA, 64 nt, hsa
ucuuuuuguucgguugcuuuggauuuuacaaaaaaaaaaaaaagcccagaaacuuucgaacaaa

SEQ ID NO: 25826 - RNA, 64 nt, hsa
cucuuuuuguucgguugcuuuggauuuuacaaaaaaaaaaaaaagcccagaaacuuucgaacaa

SEQ ID NO: 25827 - RNA, 64 nt, hsa
acucuuuuuguucgguugcuuuggauuuuacaaaaaaaaaaaaaagcccagaaacuuucgaaca

SEQ ID NO: 25828 - RNA, 64 nt, hsa
gacucuuuuuguucgguugcuuuggauuuuacaaaaaaaaaaaaaagcccagaaacuuucgaac

SEQ ID NO: 25829 - RNA, 64 nt, hsa
ggacucuuuuuguucgguugcuuuggauuuuacaaaaaaaaaaaaaagcccagaaacuuucgaa

SEQ ID NO: 25830 - RNA, 64 nt, hsa
uggacucuuuuuguucgguugcuuuggauuuuacaaaaaaaaaaaaaagcccagaaacuuucga

SEQ ID NO: 25831 - RNA, 64 nt, hsa
ucaauuaauaaaaagagccaucuggaggaaauaaaaaaaaaaggaagacucuaugaagaaacag

SEQ ID NO: 25832 - RNA, 64 nt, hsa
gucaauuaauaaaaagagccaucuggaggaaauaaaaaaaaaaggaagacucuaugaagaaaca

SEQ ID NO: 25833 - RNA, 64 nt, hsa
agucaauuaauaaaaagagccaucuggaggaaauaaaaaaaaaaggaagacucuaugaagaaac

SEQ ID NO: 25834 - RNA, 64 nt, hsa
aaagaaacaaaacaaaucacauacauacauuuaaaaaaaaaacaacaacccacgaggagucuga

SEQ ID NO: 25835 - RNA, 64 nt, hsa
aaaagaaacaaaacaaaucacauacauacauuuaaaaaaaaaacaacaacccacgaggagucug

SEQ ID NO: 25836 - RNA, 64 nt, hsa
aaaaagaaacaaaacaaaucacauacauacauuuaaaaaaaaaacaacaacccacgaggagucu

SEQ ID NO: 25837 - RNA, 64 nt, hsa
gcgcaaggugaagaagcuucugggccaggaaggaaaaaaaaaugcccaccugcagcucugguga

SEQ ID NO: 25838 - RNA, 64 nt, hsa
ggcgcaaggugaagaagcuucugggccaggaaggaaaaaaaaaugcccaccugcagcucuggug

SEQ ID NO: 25839 - RNA, 64 nt, hsa
gauugcugcuaaagucaguaguaucguuuuuuuaaaaaaaaaguuugguguuuuuaaccaugcu

SEQ ID NO: 25840 - RNA, 64 nt, hsa
ugauugcugcuaaagucaguaguaucguuuuuuuaaaaaaaaaguuugguguuuuuaaccaugc

SEQ ID NO: 25841 - RNA, 64 nt, hsa
cuuuguggcuauccaucaacauaaguaaaaaaaaaaaaaaaacacuucaacucccucccccauu

SEQ ID NO: 25842 - RNA, 64 nt, hsa
gcuuuguggcuauccaucaacauaaguaaaaaaaaaaaaaaaacacuucaacucccucccccau

SEQ ID NO: 25843 - RNA, 64 nt, hsa
ugcuuuguggcuauccaucaacauaaguaaaaaaaaaaaaaaaacacuucaacucccuccccca

SEQ ID NO: 25844 - RNA, 64 nt, hsa
augcuuuguggcuauccaucaacauaaguaaaaaaaaaaaaaaaacacuucaacucccuccccc

SEQ ID NO: 25845 - RNA, 64 nt, hsa
uaugcuuuguggcuauccaucaacauaaguaaaaaaaaaaaaaaaacacuucaacucccucccc

SEQ ID NO: 25846 - RNA, 64 nt, hsa
uuaugcuuuguggcuauccaucaacauaaguaaaaaaaaaaaaaaaacacuucaacucccuccc

SEQ ID NO: 25847 - RNA, 64 nt, hsa
auuaugcuuuguggcuauccaucaacauaaguaaaaaaaaaaaaaaaacacuucaacucccucc

SEQ ID NO: 25848 - RNA, 64 nt, hsa
gauuaugcuuuguggcuauccaucaacauaaguaaaaaaaaaaaaaaaacacuucaacucccuc

SEQ ID NO: 25849 - RNA, 64 nt, hsa
ugauuaugcuuuguggcuauccaucaacauaaguaaaaaaaaaaaaaaaacacuucaacucccu

SEQ ID NO: 25850 - RNA, 64 nt, hsa
cuucuuaaaaaaaaaaaaaaaggaaaaaggaaaaaaaaaaaaggaaaaccagaagcccugcugu

SEQ ID NO: 25851 - RNA, 64 nt, hsa
ucuucuuaaaaaaaaaaaaaaaggaaaaaggaaaaaaaaaaaaggaaaaccagaagcccugcug

SEQ ID NO: 25852 - RNA, 64 nt, hsa
uucuucuuaaaaaaaaaaaaaaaggaaaaaggaaaaaaaaaaaaggaaaaccagaagcccugcu

SEQ ID NO: 25853 - RNA, 64 nt, hsa
uuucuucuuaaaaaaaaaaaaaaaggaaaaaggaaaaaaaaaaaaggaaaaccagaagcccugc

SEQ ID NO: 25854 - RNA, 64 nt, hsa
cuuucuucuuaaaaaaaaaaaaaaaggaaaaaggaaaaaaaaaaaaggaaaaccagaagcccug

SEQ ID NO: 25855 - RNA, 64 nt, hsa
cccaaucaaccucuaugcuuucuucuuaaaaaaaaaaaaaaaggaaaaaggaaaaaaaaaaaag

SEQ ID NO: 25856 - RNA, 64 nt, hsa
ccccaaucaaccucuaugcuuucuucuuaaaaaaaaaaaaaaaggaaaaaggaaaaaaaaaaaa

SEQ ID NO: 25857 - RNA, 64 nt, hsa
accccaaucaaccucuaugcuuucuucuuaaaaaaaaaaaaaaaggaaaaaggaaaaaaaaaaa

SEQ ID NO: 25858 - RNA, 64 nt, hsa
caccccaaucaaccucuaugcuuucuucuuaaaaaaaaaaaaaaaggaaaaaggaaaaaaaaaa

SEQ ID NO: 25859 - RNA, 64 nt, hsa
ccaccccaaucaaccucuaugcuuucuucuuaaaaaaaaaaaaaaaggaaaaaggaaaaaaaaa

SEQ ID NO: 25860 - RNA, 64 nt, hsa
cccaccccaaucaaccucuaugcuuucuucuuaaaaaaaaaaaaaaaggaaaaaggaaaaaaaa

SEQ ID NO: 25861 - RNA, 64 nt, hsa
ccccaccccaaucaaccucuaugcuuucuucuuaaaaaaaaaaaaaaaggaaaaaggaaaaaaa

SEQ ID NO: 25862 - RNA, 64 nt, hsa
cccccaccccaaucaaccucuaugcuuucuucuuaaaaaaaaaaaaaaaggaaaaaggaaaaaa

SEQ ID NO: 25863 - RNA, 64 nt, hsa
aaaaacuuuugcccgacugauuuuuaaaaaggaaaaaaaaaauguuuuacuauguggccuucca

SEQ ID NO: 25864 - RNA, 64 nt, hsa
gaaaaacuuuugcccgacugauuuuuaaaaaggaaaaaaaaaauguuuuacuauguggccuucc

SEQ ID NO: 25865 - RNA, 64 nt, hsa
ggaaaaacuuuugcccgacugauuuuuaaaaaggaaaaaaaaaauguuuuacuauguggccuuc

SEQ ID NO: 25866 - RNA, 64 nt, hsa
auguuacuuuuuaaaaaaugauguuugaagugaaaaaaaaaaggauauucagggucaaaucaug

SEQ ID NO: 25867 - RNA, 64 nt, hsa
uauguuacuuuuuaaaaaaugauguuugaagugaaaaaaaaaaggauauucagggucaaaucau

SEQ ID NO: 25868 - RNA, 64 nt, hsa
uuauguuacuuuuuaaaaaaugauguuugaagugaaaaaaaaaaggauauucagggucaaauca

SEQ ID NO: 25869 - RNA, 64 nt, hsa
augcuuaaggauuccaaacgacuaagaaauuaaaaaaaaaaagacugucauucauaccauucac

SEQ ID NO: 25870 - RNA, 64 nt, hsa
caugcuuaaggauuccaaacgacuaagaaauuaaaaaaaaaaagacugucauucauaccauuca

SEQ ID NO: 25871 - RNA, 64 nt, hsa
gcaugcuuaaggauuccaaacgacuaagaaauuaaaaaaaaaaagacugucauucauaccauuc

SEQ ID NO: 25872 - RNA, 64 nt, hsa
ugcaugcuuaaggauuccaaacgacuaagaaauuaaaaaaaaaaagacugucauucauaccauu

SEQ ID NO: 25873 - RNA, 64 nt, hsa
guauguggaauacggugaggaaaaaaaaaauuaaaaaaaaaaugcaagcugucaggaugcuuaa

SEQ ID NO: 25874 - RNA, 64 nt, hsa
gguauguggaauacggugaggaaaaaaaaaauuaaaaaaaaaaugcaagcugucaggaugcuua

SEQ ID NO: 25875 - RNA, 64 nt, hsa
agguauguggaauacggugaggaaaaaaaaaauuaaaaaaaaaaugcaagcugucaggaugcuu

SEQ ID NO: 25876 - RNA, 64 nt, hsa
ccccagccacagguauguggaauacggugaggaaaaaaaaaauuaaaaaaaaaaugcaagcugu

SEQ ID NO: 25877 - RNA, 64 nt, hsa
uccccagccacagguauguggaauacggugaggaaaaaaaaaauuaaaaaaaaaaugcaagcug

SEQ ID NO: 25878 - RNA, 64 nt, hsa
uuccccagccacagguauguggaauacggugaggaaaaaaaaaauuaaaaaaaaaaugcaagcu

SEQ ID NO: 25879 - RNA, 64 nt, hsa
agcacugaguugagcaagcaauuccuuuauuuaaaaaaaaaaguacguauuuagauaaucauac

SEQ ID NO: 25880 - RNA, 64 nt, hsa
aagcacugaguugagcaagcaauuccuuuauuuaaaaaaaaaaguacguauuuagauaaucaua

SEQ ID NO: 25881 - RNA, 64 nt, hsa
aaagcacugaguugagcaagcaauuccuuuauuuaaaaaaaaaaguacguauuuagauaaucau

SEQ ID NO: 25882 - RNA, 64 nt, hsa
uauguugcuauauacuuuuguuauccguauacuaaaaaaaaagaauaaauaaauguuuugauug

SEQ ID NO: 25883 - RNA, 64 nt, hsa
uuauguugcuauauacuuuuguuauccguauacuaaaaaaaaagaauaaauaaauguuuugauu

SEQ ID NO: 25884 - RNA, 64 nt, hsa
cugggugacagagugagauccugucucaaaaaaaaaaaaaaaucacccuuaaaucaacaaaaag

SEQ ID NO: 25885 - RNA, 64 nt, hsa
ccugggugacagagugagauccugucucaaaaaaaaaaaaaaaucacccuuaaaucaacaaaaa

SEQ ID NO: 25886 - RNA, 64 nt, hsa
gccugggugacagagugagauccugucucaaaaaaaaaaaaaaaucacccuuaaaucaacaaaa

SEQ ID NO: 25887 - RNA, 64 nt, hsa
agccugggugacagagugagauccugucucaaaaaaaaaaaaaaaucacccuuaaaucaacaaa

SEQ ID NO: 25888 - RNA, 64 nt, hsa
cagccugggugacagagugagauccugucucaaaaaaaaaaaaaaaucacccuuaaaucaacaa

SEQ ID NO: 25889 - RNA, 64 nt, hsa
ccagccugggugacagagugagauccugucucaaaaaaaaaaaaaaaucacccuuaaaucaaca

SEQ ID NO: 25890 - RNA, 64 nt, hsa
uccagccugggugacagagugagauccugucucaaaaaaaaaaaaaaaucacccuuaaaucaac

SEQ ID NO: 25891 - RNA, 64 nt, hsa
cuccagccugggugacagagugagauccugucucaaaaaaaaaaaaaaaucacccuuaaaucaa

SEQ ID NO: 25892 - RNA, 64 nt, hsa
uuuaauuuaccagucuuuaaagcaacauccagaaaaaaaaaagucuuuucccauuuaaaauagg

SEQ ID NO: 25893 - RNA, 64 nt, hsa
uuuuaauuuaccagucuuuaaagcaacauccagaaaaaaaaaagucuuuucccauuuaaaauag

SEQ ID NO: 25894 - RNA, 64 nt, hsa
uuuuuaauuuaccagucuuuaaagcaacauccagaaaaaaaaaagucuuuucccauuuaaaaua

SEQ ID NO: 25895 - RNA, 64 nt, hsa
guacaaugaucaaaaucauguuuuuucuuaaaaaaaaaaaaagacuguaaauugugcaacaaag

SEQ ID NO: 25896 - RNA, 64 nt, hsa
gguacaaugaucaaaaucauguuuuuucuuaaaaaaaaaaaaagacuguaaauugugcaacaaa

SEQ ID NO: 25897 - RNA, 64 nt, hsa
ugguacaaugaucaaaaucauguuuuuucuuaaaaaaaaaaaaagacuguaaauugugcaacaa

SEQ ID NO: 25898 - RNA, 64 nt, hsa
gugguacaaugaucaaaaucauguuuuuucuuaaaaaaaaaaaaagacuguaaauugugcaaca

SEQ ID NO: 25899 - RNA, 64 nt, hsa
ugugguacaaugaucaaaaucauguuuuuucuuaaaaaaaaaaaaagacuguaaauugugcaac

SEQ ID NO: 25900 - RNA, 64 nt, hsa
augugguacaaugaucaaaaucauguuuuuucuuaaaaaaaaaaaaagacuguaaauugugcaa

SEQ ID NO: 25901 - RNA, 64 nt, hsa
ggcgacagagcgaaacuccgucucaaaaaaaaaaaaaaaaaaucaacucauaacuuagaaaccg

SEQ ID NO: 25902 - RNA, 64 nt, hsa
gggcgacagagcgaaacuccgucucaaaaaaaaaaaaaaaaaaucaacucauaacuuagaaacc

SEQ ID NO: 25903 - RNA, 64 nt, hsa
ugggcgacagagcgaaacuccgucucaaaaaaaaaaaaaaaaaaucaacucauaacuuagaaac

SEQ ID NO: 25904 - RNA, 64 nt, hsa
cugggcgacagagcgaaacuccgucucaaaaaaaaaaaaaaaaaaucaacucauaacuuagaaa

SEQ ID NO: 25905 - RNA, 64 nt, hsa
ccugggcgacagagcgaaacuccgucucaaaaaaaaaaaaaaaaaaucaacucauaacuuagaa

SEQ ID NO: 25906 - RNA, 64 nt, hsa
gccugggcgacagagcgaaacuccgucucaaaaaaaaaaaaaaaaaaucaacucauaacuuaga

SEQ ID NO: 25907 - RNA, 64 nt, hsa
agccugggcgacagagcgaaacuccgucucaaaaaaaaaaaaaaaaaaucaacucauaacuuag

SEQ ID NO: 25908 - RNA, 64 nt, hsa
cagccugggcgacagagcgaaacuccgucucaaaaaaaaaaaaaaaaaaucaacucauaacuua

SEQ ID NO: 25909 - RNA, 64 nt, hsa
ccagccugggcgacagagcgaaacuccgucucaaaaaaaaaaaaaaaaaaucaacucauaacuu

SEQ ID NO: 25910 - RNA, 64 nt, hsa
uccagccugggcgacagagcgaaacuccgucucaaaaaaaaaaaaaaaaaaucaacucauaacu

SEQ ID NO: 25911 - RNA, 64 nt, hsa
cuccagccugggcgacagagcgaaacuccgucucaaaaaaaaaaaaaaaaaaucaacucauaac

SEQ ID NO: 25912 - RNA, 64 nt, hsa
gggugaguguuuccacucaaaauaugucaacuuaaaaaaaaauaggcccuuucauaaaaaccaa

SEQ ID NO: 25913 - RNA, 64 nt, hsa
agggugaguguuuccacucaaaauaugucaacuuaaaaaaaaauaggcccuuucauaaaaacca

SEQ ID NO: 25914 - RNA, 64 nt, hsa
gcacaguuuugcacaguauguugcaugcggcaaaaaaaaaaauaugaaauagaguagaagagau

SEQ ID NO: 25915 - RNA, 64 nt, hsa
ggcacaguuuugcacaguauguugcaugcggcaaaaaaaaaaauaugaaauagaguagaagaga

SEQ ID NO: 25916 - RNA, 64 nt, hsa
aggcacaguuuugcacaguauguugcaugcggcaaaaaaaaaaauaugaaauagaguagaagag

SEQ ID NO: 25917 - RNA, 64 nt, hsa
gaggcacaguuuugcacaguauguugcaugcggcaaaaaaaaaaauaugaaauagaguagaaga

SEQ ID NO: 25918 - RNA, 64 nt, hsa
guacuuucuacucucauuuuuguuagccuaugaaaaaaaaaacauuuuguuaaccuauggaaaa

SEQ ID NO: 25919 - RNA, 64 nt, hsa
gguacuuucuacucucauuuuuguuagccuaugaaaaaaaaaacauuuuguuaaccuauggaaa

SEQ ID NO: 25920 - RNA, 64 nt, hsa
ggguacuuucuacucucauuuuuguuagccuaugaaaaaaaaaacauuuuguuaaccuauggaa

SEQ ID NO: 25921 - RNA, 64 nt, hsa
cugggcgacagagcgagacuccaucucaaaaaaaaaaaaaaacucuuguaucucaauauuuuua

SEQ ID NO: 25922 - RNA, 64 nt, hsa
ccugggcgacagagcgagacuccaucucaaaaaaaaaaaaaaacucuuguaucucaauauuuuu

SEQ ID NO: 25923 - RNA, 64 nt, hsa
gccugggcgacagagcgagacuccaucucaaaaaaaaaaaaaaacucuuguaucucaauauuuu

SEQ ID NO: 25924 - RNA, 64 nt, hsa
agccugggcgacagagcgagacuccaucucaaaaaaaaaaaaaaacucuuguaucucaauauuu

SEQ ID NO: 25925 - RNA, 64 nt, hsa
cagccugggcgacagagcgagacuccaucucaaaaaaaaaaaaaaacucuuguaucucaauauu

SEQ ID NO: 25926 - RNA, 64 nt, hsa
ccagccugggcgacagagcgagacuccaucucaaaaaaaaaaaaaaacucuuguaucucaauau

SEQ ID NO: 25927 - RNA, 64 nt, hsa
uccagccugggcgacagagcgagacuccaucucaaaaaaaaaaaaaaacucuuguaucucaaua

SEQ ID NO: 25928 - RNA, 64 nt, hsa
cuccagccugggcgacagagcgagacuccaucucaaaaaaaaaaaaaaacucuuguaucucaau

SEQ ID NO: 25929 - RNA, 64 nt, hsa
gacuaggaaggacuaaaagccagaaaggggaugaaaaaaaaauccuuaauucagggccgacauu

SEQ ID NO: 25930 - RNA, 64 nt, hsa
ugacuaggaaggacuaaaagccagaaaggggaugaaaaaaaaauccuuaauucagggccgacau

SEQ ID NO: 25931 - RNA, 64 nt, hsa
aucaggguaauguauauacauauuuuuuauuuccaaaaaaaauucauuaauugcuucuuaacuc

SEQ ID NO: 25932 - RNA, 64 nt, hsa
ggguggcagagcaacacuuugucucagaaaaaaaaaaaaaaaccaaaaagccaagugugguggu

SEQ ID NO: 25933 - RNA, 64 nt, hsa
uggguggcagagcaacacuuugucucagaaaaaaaaaaaaaaaccaaaaagccaaguguggugg

SEQ ID NO: 25934 - RNA, 64 nt, hsa
cuggguggcagagcaacacuuugucucagaaaaaaaaaaaaaaaccaaaaagccaaguguggug

SEQ ID NO: 25935 - RNA, 64 nt, hsa
ccuggguggcagagcaacacuuugucucagaaaaaaaaaaaaaaaccaaaaagccaaguguggu

SEQ ID NO: 25936 - RNA, 64 nt, hsa
gccuggguggcagagcaacacuuugucucagaaaaaaaaaaaaaaaccaaaaagccaagugugg

SEQ ID NO: 25937 - RNA, 64 nt, hsa
agccuggguggcagagcaacacuuugucucagaaaaaaaaaaaaaaaccaaaaagccaagugug

SEQ ID NO: 25938 - RNA, 64 nt, hsa
cagccuggguggcagagcaacacuuugucucagaaaaaaaaaaaaaaaccaaaaagccaagugu

SEQ ID NO: 25939 - RNA, 64 nt, hsa
ccagccuggguggcagagcaacacuuugucucagaaaaaaaaaaaaaaaccaaaaagccaagug

SEQ ID NO: 25940 - RNA, 64 nt, hsa
uuuaaauguagcagccacugacauuucuuuuuuuaaaaaaaauuugagaagucuacuuccuuuu

SEQ ID NO: 25941 - RNA, 64 nt, hsa
cccugaaaauaagcacauuugaaaacucuuagaaaaaaaaaauucuguaauguccucuagauuu

SEQ ID NO: 25942 - RNA, 64 nt, hsa
acccugaaaauaagcacauuugaaaacucuuagaaaaaaaaaauucuguaauguccucuagauu

SEQ ID NO: 25943 - RNA, 64 nt, hsa
gacccugaaaauaagcacauuugaaaacucuuagaaaaaaaaaauucuguaauguccucuagau

SEQ ID NO: 25944 - RNA, 64 nt, hsa
ggccuaucauguccuugucaugaaaagcacuaaaaaaaaaaagaguuuaaguggcuaaagucau

SEQ ID NO: 25945 - RNA, 64 nt, hsa
aggccuaucauguccuugucaugaaaagcacuaaaaaaaaaaagaguuuaaguggcuaaaguca

SEQ ID NO: 25946 - RNA, 64 nt, hsa
aaggccuaucauguccuugucaugaaaagcacuaaaaaaaaaaagaguuuaaguggcuaaaguc

SEQ ID NO: 25947 - RNA, 64 nt, hsa
caaggccuaucauguccuugucaugaaaagcacuaaaaaaaaaaagaguuuaaguggcuaaagu

SEQ ID NO: 25948 - RNA, 64 nt, hsa
ucaucccuagcuccuuaagagaaaaacauuuagaaaaaaaaauuuuuucuaucucugcccaccc

SEQ ID NO: 25949 - RNA, 64 nt, hsa
gucaucccuagcuccuuaagagaaaaacauuuagaaaaaaaaauuuuuucuaucucugcccacc

SEQ ID NO: 25950 - RNA, 64 nt, hsa
cgagacucugucucaaaaaaaaaaaaaaaaaaaaaaaaaaaacauucaaagagacauauacuaa

SEQ ID NO: 25951 - RNA, 64 nt, hsa
gcgagacucugucucaaaaaaaaaaaaaaaaaaaaaaaaaaaacauucaaagagacauauacua

SEQ ID NO: 25952 - RNA, 64 nt, hsa
ggcgagacucugucucaaaaaaaaaaaaaaaaaaaaaaaaaaaacauucaaagagacauauacu

SEQ ID NO: 25953 - RNA, 64 nt, hsa
gggcgagacucugucucaaaaaaaaaaaaaaaaaaaaaaaaaaaacauucaaagagacauauac

SEQ ID NO: 25954 - RNA, 64 nt, hsa
agggcgagacucugucucaaaaaaaaaaaaaaaaaaaaaaaaaaaacauucaaagagacauaua

SEQ ID NO: 25955 - RNA, 64 nt, hsa
cagggcgagacucugucucaaaaaaaaaaaaaaaaaaaaaaaaaaaacauucaaagagacauau

SEQ ID NO: 25956 - RNA, 64 nt, hsa
acagggcgagacucugucucaaaaaaaaaaaaaaaaaaaaaaaaaaaacauucaaagagacaua

SEQ ID NO: 25957 - RNA, 64 nt, hsa
uacagggcgagacucugucucaaaaaaaaaaaaaaaaaaaaaaaaaaaacauucaaagagacau

SEQ ID NO: 25958 - RNA, 64 nt, hsa
cuacagggcgagacucugucucaaaaaaaaaaaaaaaaaaaaaaaaaaaacauucaaagagaca

SEQ ID NO: 25959 - RNA, 64 nt, hsa
gcuacagggcgagacucugucucaaaaaaaaaaaaaaaaaaaaaaaaaaaacauucaaagagac

SEQ ID NO: 25960 - RNA, 64 nt, hsa
ggcuacagggcgagacucugucucaaaaaaaaaaaaaaaaaaaaaaaaaaaacauucaaagaga

SEQ ID NO: 25961 - RNA, 64 nt, hsa
uggcuacagggcgagacucugucucaaaaaaaaaaaaaaaaaaaaaaaaaaaacauucaaagag

SEQ ID NO: 25962 - RNA, 64 nt, hsa
cuggcuacagggcgagacucugucucaaaaaaaaaaaaaaaaaaaaaaaaaaaacauucaaaga

SEQ ID NO: 25963 - RNA, 64 nt, hsa
ccuggcuacagggcgagacucugucucaaaaaaaaaaaaaaaaaaaaaaaaaaaacauucaaag

SEQ ID NO: 25964 - RNA, 64 nt, hsa
gccuggcuacagggcgagacucugucucaaaaaaaaaaaaaaaaaaaaaaaaaaaacauucaaa

SEQ ID NO: 25965 - RNA, 64 nt, hsa
agccuggcuacagggcgagacucugucucaaaaaaaaaaaaaaaaaaaaaaaaaaaacauucaa

SEQ ID NO: 25966 - RNA, 64 nt, hsa
cagccuggcuacagggcgagacucugucucaaaaaaaaaaaaaaaaaaaaaaaaaaaacauuca

SEQ ID NO: 25967 - RNA, 64 nt, hsa
ccagccuggcuacagggcgagacucugucucaaaaaaaaaaaaaaaaaaaaaaaaaaaacauuc

SEQ ID NO: 25968 - RNA, 64 nt, hsa
uccagccuggcuacagggcgagacucugucucaaaaaaaaaaaaaaaaaaaaaaaaaaaacauu

SEQ ID NO: 25969 - RNA, 64 nt, hsa
cuccagccuggcuacagggcgagacucugucucaaaaaaaaaaaaaaaaaaaaaaaaaaaacau

SEQ ID NO: 25970 - RNA, 64 nt, hsa
acuccagccuggcuacagggcgagacucugucucaaaaaaaaaaaaaaaaaaaaaaaaaaaaca

SEQ ID NO: 25971 - RNA, 64 nt, hsa
ugcauuuaaauaaaaaccucagaaagacugaggaaaaaaaaauccuaauuaucucucuucuguu

SEQ ID NO: 25972 - RNA, 64 nt, hsa
gugcauuuaaauaaaaaccucagaaagacugaggaaaaaaaaauccuaauuaucucucuucugu

SEQ ID NO: 25973 - RNA, 64 nt, hsa
auuugaaauauuuacauuaacauaggcaaaaaaaaaaaaaaauacaagaugcugcuuuauuaug

SEQ ID NO: 25974 - RNA, 64 nt, hsa
gauuugaaauauuuacauuaacauaggcaaaaaaaaaaaaaaauacaagaugcugcuuuauuau

SEQ ID NO: 25975 - RNA, 64 nt, hsa
agauuugaaauauuuacauuaacauaggcaaaaaaaaaaaaaaauacaagaugcugcuuuauua

SEQ ID NO: 25976 - RNA, 64 nt, hsa
aagauuugaaauauuuacauuaacauaggcaaaaaaaaaaaaaaauacaagaugcugcuuuauu

SEQ ID NO: 25977 - RNA, 64 nt, hsa
uaagauuugaaauauuuacauuaacauaggcaaaaaaaaaaaaaaauacaagaugcugcuuuau

SEQ ID NO: 25978 - RNA, 64 nt, hsa
guaagauuugaaauauuuacauuaacauaggcaaaaaaaaaaaaaaauacaagaugcugcuuua

SEQ ID NO: 25979 - RNA, 64 nt, hsa
gguaagauuugaaauauuuacauuaacauaggcaaaaaaaaaaaaaaauacaagaugcugcuuu

SEQ ID NO: 25980 - RNA, 64 nt, hsa
ugguaagauuugaaauauuuacauuaacauaggcaaaaaaaaaaaaaaauacaagaugcugcuu

SEQ ID NO: 25981 - RNA, 64 nt, hsa
cuguuauuuaaagcccaguggauauuucaauuaaaaaaaaaaucuaaagaugaauaguccuugg

SEQ ID NO: 25982 - RNA, 64 nt, hsa
ucuguuauuuaaagcccaguggauauuucaauuaaaaaaaaaaucuaaagaugaauaguccuug

SEQ ID NO: 25983 - RNA, 64 nt, hsa
aucuguuauuuaaagcccaguggauauuucaauuaaaaaaaaaaucuaaagaugaauaguccuu

SEQ ID NO: 25984 - RNA, 64 nt, hsa
uucuacauugccagaauauacuauaaaaaguuaaaaaaaaaacuuacuuuguggguugcaauac

SEQ ID NO: 25985 - RNA, 64 nt, hsa
uuucuacauugccagaauauacuauaaaaaguuaaaaaaaaaacuuacuuuguggguugcaaua

SEQ ID NO: 25986 - RNA, 64 nt, hsa
auuucuacauugccagaauauacuauaaaaaguuaaaaaaaaaacuuacuuuguggguugcaau

SEQ ID NO: 25987 - RNA, 64 nt, hsa
acccgguuucuuuuacugauuuaaaaacaaaacaaaaaaaaauaaaaaaguugugccugaaaug

SEQ ID NO: 25988 - RNA, 64 nt, hsa
gacccgguuucuuuuacugauuuaaaaacaaaacaaaaaaaaauaaaaaaguugugccugaaau

SEQ ID NO: 25989 - RNA, 64 nt, hsa
cagugugauaauuuaaacauauuuaaacaaaaacaaaaaaaaugaaugcacaaacuugcugcug

SEQ ID NO: 25990 - RNA, 64 nt, hsa
ggaguucauacugaugcccugaggcacugaaaaaaaaaaaaaucccaaagugccuucugagcug

SEQ ID NO: 25991 - RNA, 64 nt, hsa
uggaguucauacugaugcccugaggcacugaaaaaaaaaaaaaucccaaagugccuucugagcu

SEQ ID NO: 25992 - RNA, 64 nt, hsa
uuggaguucauacugaugcccugaggcacugaaaaaaaaaaaaaucccaaagugccuucugagc

SEQ ID NO: 25993 - RNA, 64 nt, hsa
auuggaguucauacugaugcccugaggcacugaaaaaaaaaaaaaucccaaagugccuucugag

SEQ ID NO: 25994 - RNA, 64 nt, hsa
aauuggaguucauacugaugcccugaggcacugaaaaaaaaaaaaaucccaaagugccuucuga

SEQ ID NO: 25995 - RNA, 64 nt, hsa
uaauuggaguucauacugaugcccugaggcacugaaaaaaaaaaaaaucccaaagugccuucug

SEQ ID NO: 25996 - RNA, 64 nt, hsa
gugaugaauuuagcaaauuaaguuauuuuccuaaaaaaaaaagaaaaaaagaauucagaacuac

SEQ ID NO: 25997 - RNA, 64 nt, hsa
ugugaugaauuuagcaaauuaaguuauuuuccuaaaaaaaaaagaaaaaaagaauucagaacua

SEQ ID NO: 25998 - RNA, 64 nt, hsa
gugugaugaauuuagcaaauuaaguuauuuuccuaaaaaaaaaagaaaaaaagaauucagaacu

SEQ ID NO: 25999 - RNA, 64 nt, hsa
caaacaaugguuucucugcguuaauuauugaggaaaaaaaaagaugggguaagaaaacuaccca

SEQ ID NO: 26000 - RNA, 64 nt, hsa
ucaaacaaugguuucucugcguuaauuauugaggaaaaaaaaagaugggguaagaaaacuaccc

SEQ ID NO: 26001 - RNA, 64 nt, hsa
ggguaacacagcaagacucuaucucaaaaaaaagaaaaaaaagaaauacauagaguucaguccc

SEQ ID NO: 26002 - RNA, 64 nt, hsa
auccacccuggguaacacagcaagacucuaucucaaaaaaaagaaaaaaaagaaauacauagag

SEQ ID NO: 26003 - RNA, 64 nt, hsa
gagaguuugacagauuuugaaaaugaguaaaggcaaaaaaaauuuuuuuagccuuuauuuugcu

SEQ ID NO: 26004 - RNA, 64 nt, hsa
agagcuuuaugaguucacggaauuuauuuuaagaaaaaaaaauauacauaugagaagaagguaa

SEQ ID NO: 26005 - RNA, 64 nt, hsa
gagagcuuuaugaguucacggaauuuauuuuaagaaaaaaaaauauacauaugagaagaaggua

SEQ ID NO: 26006 - RNA, 64 nt, hsa
gaaagcauuguaccucucagauuccccuuguggaaaaaaaaauucugcugugaagaugaaaaua

SEQ ID NO: 26007 - RNA, 64 nt, hsa
agaaagcauuguaccucucagauuccccuuguggaaaaaaaaauucugcugugaagaugaaaau

SEQ ID NO: 26008 - RNA, 64 nt, hsa
aguguguuucccuaacuuucuguuuuuccugagaaaaaaaaauaaaucuuuuauucaaauacag

SEQ ID NO: 26009 - RNA, 64 nt, hsa
uaguguguuucccuaacuuucuguuuuuccugagaaaaaaaaauaaaucuuuuauucaaauaca

SEQ ID NO: 26010 - RNA, 64 nt, hsa
gagaaccuuauagauaucacagucuugagggucaaaaaaaaauacuuaggaagcuagccaugga

SEQ ID NO: 26011 - RNA, 64 nt, hsa
agagaaccuuauagauaucacagucuugagggucaaaaaaaaauacuuaggaagcuagccaugg

SEQ ID NO: 26012 - RNA, 64 nt, hsa
caagaacccaucucaaacaaacaaacaaacaaaaaaaaaaaacucuugucuccuuaggauaugu

SEQ ID NO: 26013 - RNA, 64 nt, hsa
acaagaacccaucucaaacaaacaaacaaacaaaaaaaaaaaacucuugucuccuuaggauaug

SEQ ID NO: 26014 - RNA, 64 nt, hsa
aacaagaacccaucucaaacaaacaaacaaacaaaaaaaaaaaacucuugucuccuuaggauau

SEQ ID NO: 26015 - RNA, 64 nt, hsa
gaacaagaacccaucucaaacaaacaaacaaacaaaaaaaaaaaacucuugucuccuuaggaua

SEQ ID NO: 26016 - RNA, 64 nt, hsa
agaacaagaacccaucucaaacaaacaaacaaacaaaaaaaaaaaacucuugucuccuuaggau

SEQ ID NO: 26017 - RNA, 64 nt, hsa
uucauaaagaauagggauuuaucauuucaggaaaaaaaaaaacauucaaaugugggcuuuagcu

SEQ ID NO: 26018 - RNA, 64 nt, hsa
uuucauaaagaauagggauuuaucauuucaggaaaaaaaaaaacauucaaaugugggcuuuagc

SEQ ID NO: 26019 - RNA, 64 nt, hsa
auuucauaaagaauagggauuuaucauuucaggaaaaaaaaaaacauucaaaugugggcuuuag

SEQ ID NO: 26020 - RNA, 64 nt, hsa
uauuucauaaagaauagggauuuaucauuucaggaaaaaaaaaaacauucaaaugugggcuuua

SEQ ID NO: 26021 - RNA, 64 nt, hsa
agaaugaugguuguuuuguaucauuugauuaauaaaaaaaaaugaaaaaagugaaacauguugu

SEQ ID NO: 26022 - RNA, 64 nt, hsa
cagaaugaugguuguuuuguaucauuugauuaauaaaaaaaaaugaaaaaagugaaacauguug

SEQ ID NO: 26023 - RNA, 64 nt, hsa
cagugacuuaacaauauacauuccucauaaauaaaaaaaaaacaagaaucugaauucuuagaaa

SEQ ID NO: 26024 - RNA, 64 nt, hsa
acagugacuuaacaauauacauuccucauaaauaaaaaaaaaacaagaaucugaauucuuagaa

SEQ ID NO: 26025 - RNA, 64 nt, hsa
aacagugacuuaacaauauacauuccucauaaauaaaaaaaaaacaagaaucugaauucuuaga

SEQ ID NO: 26026 - RNA, 64 nt, hsa
gaagaauuuucuucuugccaauuuuguuguuuaaaaaaaaaauucagggaaaauuaaaaaccug

SEQ ID NO: 26027 - RNA, 64 nt, hsa
cgaagaauuuucuucuugccaauuuuguuguuuaaaaaaaaaauucagggaaaauuaaaaaccu

SEQ ID NO: 26028 - RNA, 64 nt, hsa
ucgaagaauuuucuucuugccaauuuuguuguuuaaaaaaaaaauucagggaaaauuaaaaacc

SEQ ID NO: 26029 - RNA, 64 nt, hsa
uuuuaggaaauguuuuuaauaaaagaaaauuacaaaaaaaaauuuuaaagaccccuaacccuuu

SEQ ID NO: 26030 - RNA, 64 nt, hsa
uuuuuaggaaauguuuuuaauaaaagaaaauuacaaaaaaaaauuuuaaagaccccuaacccuu

SEQ ID NO: 26031 - RNA, 64 nt, hsa
uuucuaauucaccaugucacagacuggugaaaaaaaaaaaaagguguucacugaccagcacaag

SEQ ID NO: 26032 - RNA, 64 nt, hsa
auuucuaauucaccaugucacagacuggugaaaaaaaaaaaaagguguucacugaccagcacaa

SEQ ID NO: 26033 - RNA, 64 nt, hsa
aauuucuaauucaccaugucacagacuggugaaaaaaaaaaaaagguguucacugaccagcaca

SEQ ID NO: 26034 - RNA, 64 nt, hsa
caauuucuaauucaccaugucacagacuggugaaaaaaaaaaaaagguguucacugaccagcac

SEQ ID NO: 26035 - RNA, 64 nt, hsa
ucaauuucuaauucaccaugucacagacuggugaaaaaaaaaaaaagguguucacugaccagca

SEQ ID NO: 26036 - RNA, 64 nt, hsa
cucaauuucuaauucaccaugucacagacuggugaaaaaaaaaaaaagguguucacugaccagc

SEQ ID NO: 26037 - RNA, 64 nt, hsa
ccugggugacagagcaagacucugucucaaaaaaaaaaaaaaggaaaacucugugauggacauu

SEQ ID NO: 26038 - RNA, 64 nt, hsa
gccugggugacagagcaagacucugucucaaaaaaaaaaaaaaggaaaacucugugauggacau

SEQ ID NO: 26039 - RNA, 64 nt, hsa
agccugggugacagagcaagacucugucucaaaaaaaaaaaaaaggaaaacucugugauggaca

SEQ ID NO: 26040 - RNA, 64 nt, hsa
cagccugggugacagagcaagacucugucucaaaaaaaaaaaaaaggaaaacucugugauggac

SEQ ID NO: 26041 - RNA, 64 nt, hsa
ccagccugggugacagagcaagacucugucucaaaaaaaaaaaaaaggaaaacucugugaugga

SEQ ID NO: 26042 - RNA, 64 nt, hsa
uccagccugggugacagagcaagacucugucucaaaaaaaaaaaaaaggaaaacucugugaugg

SEQ ID NO: 26043 - RNA, 64 nt, hsa
uuccagccugggugacagagcaagacucugucucaaaaaaaaaaaaaaggaaaacucugugaug

SEQ ID NO: 26044 - RNA, 64 nt, hsa
gagccuggcaacaagagcaaaacuccagcucaaaaaaaaaaagaaagaaaagaaagcuggagcu

SEQ ID NO: 26045 - RNA, 64 nt, hsa
ggagccuggcaacaagagcaaaacuccagcucaaaaaaaaaaagaaagaaaagaaagcuggagc

SEQ ID NO: 26046 - RNA, 64 nt, hsa
aggagccuggcaacaagagcaaaacuccagcucaaaaaaaaaaagaaagaaaagaaagcuggag

SEQ ID NO: 26047 - RNA, 64 nt, hsa
caggagccuggcaacaagagcaaaacuccagcucaaaaaaaaaaagaaagaaaagaaagcugga

SEQ ID NO: 26048 - RNA, 64 nt, hsa
ugcucguguuauaaauuacccaguuuagaggggaaaaaaaaacaauuauuccuaaauaaaugga

SEQ ID NO: 26049 - RNA, 64 nt, hsa
uugcucguguuauaaauuacccaguuuagaggggaaaaaaaaacaauuauuccuaaauaaaugg

SEQ ID NO: 26050 - RNA, 64 nt, hsa
acuuuuaagguacacugcauuuugcaaaaaaaaaaaaaaaaaguaaucuuuuagcaaccccagu

SEQ ID NO: 26051 - RNA, 64 nt, hsa
cacuuuuaagguacacugcauuuugcaaaaaaaaaaaaaaaaaguaaucuuuuagcaaccccag

SEQ ID NO: 26052 - RNA, 64 nt, hsa
acacuuuuaagguacacugcauuuugcaaaaaaaaaaaaaaaaaguaaucuuuuagcaacccca

SEQ ID NO: 26053 - RNA, 64 nt, hsa
gacacuuuuaagguacacugcauuuugcaaaaaaaaaaaaaaaaaguaaucuuuuagcaacccc

SEQ ID NO: 26054 - RNA, 64 nt, hsa
agacacuuuuaagguacacugcauuuugcaaaaaaaaaaaaaaaaaguaaucuuuuagcaaccc

SEQ ID NO: 26055 - RNA, 64 nt, hsa
gagacacuuuuaagguacacugcauuuugcaaaaaaaaaaaaaaaaaguaaucuuuuagcaacc

SEQ ID NO: 26056 - RNA, 64 nt, hsa
ugagacacuuuuaagguacacugcauuuugcaaaaaaaaaaaaaaaaaguaaucuuuuagcaac

SEQ ID NO: 26057 - RNA, 64 nt, hsa
gugagacacuuuuaagguacacugcauuuugcaaaaaaaaaaaaaaaaaguaaucuuuuagcaa

SEQ ID NO: 26058 - RNA, 64 nt, hsa
ggugagacacuuuuaagguacacugcauuuugcaaaaaaaaaaaaaaaaaguaaucuuuuagca

SEQ ID NO: 26059 - RNA, 64 nt, hsa
aggugagacacuuuuaagguacacugcauuuugcaaaaaaaaaaaaaaaaaguaaucuuuuagc

SEQ ID NO: 26060 - RNA, 64 nt, hsa
cuugccuagucuugaagaaaaaaaacaaaaaacaaaaaaaaaccuuguuccuuuauagguuccu

SEQ ID NO: 26061 - RNA, 64 nt, hsa
acuugccuagucuugaagaaaaaaaacaaaaaacaaaaaaaaaccuuguuccuuuauagguucc

SEQ ID NO: 26062 - RNA, 64 nt, hsa
ccauucccacugcuucacuugccuagucuugaagaaaaaaaacaaaaaacaaaaaaaaaccuug

SEQ ID NO: 26063 - RNA, 64 nt, hsa
gggcagguacuagguguuucauuuccagaauuaaaaaaaaaauccauuuaagacguaccacugu

SEQ ID NO: 26064 - RNA, 64 nt, hsa
agggcagguacuagguguuucauuuccagaauuaaaaaaaaaauccauuuaagacguaccacug

SEQ ID NO: 26065 - RNA, 64 nt, hsa
aagggcagguacuagguguuucauuuccagaauuaaaaaaaaaauccauuuaagacguaccacu

SEQ ID NO: 26066 - RNA, 64 nt, hsa
gggaccagaagcaucuaaagcaaaaaaaaaaccaaaaaaaaaucuagagauguggcuguggcuu

SEQ ID NO: 26067 - RNA, 64 nt, hsa
ugggaccagaagcaucuaaagcaaaaaaaaaaccaaaaaaaaaucuagagauguggcuguggcu

SEQ ID NO: 26068 - RNA, 64 nt, hsa
gucccagugaugggaccagaagcaucuaaagcaaaaaaaaaaccaaaaaaaaaucuagagaugu

SEQ ID NO: 26069 - RNA, 64 nt, hsa
ggucccagugaugggaccagaagcaucuaaagcaaaaaaaaaaccaaaaaaaaaucuagagaug

SEQ ID NO: 26070 - RNA, 64 nt, hsa
aggucccagugaugggaccagaagcaucuaaagcaaaaaaaaaaccaaaaaaaaaucuagagau

SEQ ID NO: 26071 - RNA, 64 nt, hsa
uuuuucuaauuuacugaucuuacuacuacaaagaaaaaaaaacccaaccaaucugcaauucaaa

SEQ ID NO: 26072 - RNA, 64 nt, hsa
uuuuuucuaauuuacugaucuuacuacuacaaagaaaaaaaaacccaaccaaucugcaauucaa

SEQ ID NO: 26073 - RNA, 64 nt, hsa
ccauaguauuaaauacauaucauuuuuaaaaauaaaaaaaaacccaaaaauaaugcaugcauaa

SEQ ID NO: 26074 - RNA, 64 nt, hsa
cccauaguauuaaauacauaucauuuuuaaaaauaaaaaaaaacccaaaaauaaugcaugcaua

SEQ ID NO: 26075 - RNA, 64 nt, hsa
gcaagugcaagaggacaaaaaaaaaaaaaaaaaaaaaaaaaaugcgcuccagcagccuguuugg

SEQ ID NO: 26076 - RNA, 64 nt, hsa
agcaagugcaagaggacaaaaaaaaaaaaaaaaaaaaaaaaaaugcgcuccagcagccuguuug

SEQ ID NO: 26077 - RNA, 64 nt, hsa
aagcaagugcaagaggacaaaaaaaaaaaaaaaaaaaaaaaaaaugcgcuccagcagccuguuu

SEQ ID NO: 26078 - RNA, 64 nt, hsa
aaagcaagugcaagaggacaaaaaaaaaaaaaaaaaaaaaaaaaaugcgcuccagcagccuguu

SEQ ID NO: 26079 - RNA, 64 nt, hsa
caaagcaagugcaagaggacaaaaaaaaaaaaaaaaaaaaaaaaaaugcgcuccagcagccugu

SEQ ID NO: 26080 - RNA, 64 nt, hsa
gcaaagcaagugcaagaggacaaaaaaaaaaaaaaaaaaaaaaaaaaugcgcuccagcagccug

SEQ ID NO: 26081 - RNA, 64 nt, hsa
ugcaaagcaagugcaagaggacaaaaaaaaaaaaaaaaaaaaaaaaaaugcgcuccagcagccu

SEQ ID NO: 26082 - RNA, 64 nt, hsa
cugcaaagcaagugcaagaggacaaaaaaaaaaaaaaaaaaaaaaaaaaugcgcuccagcagcc

SEQ ID NO: 26083 - RNA, 64 nt, hsa
ucugcaaagcaagugcaagaggacaaaaaaaaaaaaaaaaaaaaaaaaaaugcgcuccagcagc

SEQ ID NO: 26084 - RNA, 64 nt, hsa
uucugcaaagcaagugcaagaggacaaaaaaaaaaaaaaaaaaaaaaaaaaugcgcuccagcag

SEQ ID NO: 26085 - RNA, 64 nt, hsa
guucugcaaagcaagugcaagaggacaaaaaaaaaaaaaaaaaaaaaaaaaaugcgcuccagca

SEQ ID NO: 26086 - RNA, 64 nt, hsa
gguucugcaaagcaagugcaagaggacaaaaaaaaaaaaaaaaaaaaaaaaaaugcgcuccagc

SEQ ID NO: 26087 - RNA, 64 nt, hsa
agguucugcaaagcaagugcaagaggacaaaaaaaaaaaaaaaaaaaaaaaaaaugcgcuccag

SEQ ID NO: 26088 - RNA, 64 nt, hsa
cagguucugcaaagcaagugcaagaggacaaaaaaaaaaaaaaaaaaaaaaaaaaugcgcucca

SEQ ID NO: 26089 - RNA, 64 nt, hsa
gcagguucugcaaagcaagugcaagaggacaaaaaaaaaaaaaaaaaaaaaaaaaaugcgcucc

SEQ ID NO: 26090 - RNA, 64 nt, hsa
ggcagguucugcaaagcaagugcaagaggacaaaaaaaaaaaaaaaaaaaaaaaaaaugcgcuc

SEQ ID NO: 26091 - RNA, 64 nt, hsa
aggcagguucugcaaagcaagugcaagaggacaaaaaaaaaaaaaaaaaaaaaaaaaaugcgcu

SEQ ID NO: 26092 - RNA, 64 nt, hsa
gaggcagguucugcaaagcaagugcaagaggacaaaaaaaaaaaaaaaaaaaaaaaaaaugcgc

SEQ ID NO: 26093 - RNA, 64 nt, hsa
ggaggcagguucugcaaagcaagugcaagaggacaaaaaaaaaaaaaaaaaaaaaaaaaaugcg

SEQ ID NO: 26094 - RNA, 64 nt, hsa
cauuuggugcacuuuucugugucauaccacaauaaaaaaaaaccuagcaucuuacaaaaacaag

SEQ ID NO: 26095 - RNA, 64 nt, hsa
acauuuggugcacuuuucugugucauaccacaauaaaaaaaaaccuagcaucuuacaaaaacaa

SEQ ID NO: 26096 - RNA, 64 nt, hsa
cuauuugccuucuggagcucuuugugaaaaauuaaaaaaaaacuuagcucaaagauaugauugu

SEQ ID NO: 26097 - RNA, 64 nt, hsa
acuauuugccuucuggagcucuuugugaaaaauuaaaaaaaaacuuagcucaaagauaugauug

SEQ ID NO: 26098 - RNA, 64 nt, hsa
ucacaagucuuauugaaaaguagauuuuuuaaaaaaaaaaaaucuuagucccuguuauccagua

SEQ ID NO: 26099 - RNA, 64 nt, hsa
gucacaagucuuauugaaaaguagauuuuuuaaaaaaaaaaaaucuuagucccuguuauccagu

SEQ ID NO: 26100 - RNA, 64 nt, hsa
ugucacaagucuuauugaaaaguagauuuuuuaaaaaaaaaaaaucuuagucccuguuauccag

SEQ ID NO: 26101 - RNA, 64 nt, hsa
cugucacaagucuuauugaaaaguagauuuuuuaaaaaaaaaaaaucuuagucccuguuaucca

SEQ ID NO: 26102 - RNA, 64 nt, hsa
ucugucacaagucuuauugaaaaguagauuuuuuaaaaaaaaaaaaucuuagucccuguuaucc

SEQ ID NO: 26103 - RNA, 64 nt, hsa
ugaggguuugccuucuaaagucugcaacuucaagaaaaaaaaucgacacuguggauugacuuuc

SEQ ID NO: 26104 - RNA, 64 nt, hsa
ugcauuacacauaguaaacuuucuuuaaaaaaaaaaaaaaaagauuuuggagacuaccagggua

SEQ ID NO: 26105 - RNA, 64 nt, hsa
uugcauuacacauaguaaacuuucuuuaaaaaaaaaaaaaaaagauuuuggagacuaccagggu

SEQ ID NO: 26106 - RNA, 64 nt, hsa
cuugcauuacacauaguaaacuuucuuuaaaaaaaaaaaaaaaagauuuuggagacuaccaggg

SEQ ID NO: 26107 - RNA, 64 nt, hsa
ccuugcauuacacauaguaaacuuucuuuaaaaaaaaaaaaaaaagauuuuggagacuaccagg

SEQ ID NO: 26108 - RNA, 64 nt, hsa
gccuugcauuacacauaguaaacuuucuuuaaaaaaaaaaaaaaaagauuuuggagacuaccag

SEQ ID NO: 26109 - RNA, 64 nt, hsa
ugccuugcauuacacauaguaaacuuucuuuaaaaaaaaaaaaaaaagauuuuggagacuacca

SEQ ID NO: 26110 - RNA, 64 nt, hsa
gugccuugcauuacacauaguaaacuuucuuuaaaaaaaaaaaaaaaagauuuuggagacuacc

SEQ ID NO: 26111 - RNA, 64 nt, hsa
agugccuugcauuacacauaguaaacuuucuuuaaaaaaaaaaaaaaaagauuuuggagacuac

SEQ ID NO: 26112 - RNA, 64 nt, hsa
aagugccuugcauuacacauaguaaacuuucuuuaaaaaaaaaaaaaaaagauuuuggagacua

SEQ ID NO: 26113 - RNA, 64 nt, hsa
uugggcaacaaaaugagacccugucucaaaaaaaaaaaaaaaguuuucuagaauaagcaggaug

SEQ ID NO: 26114 - RNA, 64 nt, hsa
cuugggcaacaaaaugagacccugucucaaaaaaaaaaaaaaaguuuucuagaauaagcaggau

SEQ ID NO: 26115 - RNA, 64 nt, hsa
gcuugggcaacaaaaugagacccugucucaaaaaaaaaaaaaaaguuuucuagaauaagcagga

SEQ ID NO: 26116 - RNA, 64 nt, hsa
agcuugggcaacaaaaugagacccugucucaaaaaaaaaaaaaaaguuuucuagaauaagcagg

SEQ ID NO: 26117 - RNA, 64 nt, hsa
cagcuugggcaacaaaaugagacccugucucaaaaaaaaaaaaaaaguuuucuagaauaagcag

SEQ ID NO: 26118 - RNA, 64 nt, hsa
ccagcuugggcaacaaaaugagacccugucucaaaaaaaaaaaaaaaguuuucuagaauaagca

SEQ ID NO: 26119 - RNA, 64 nt, hsa
uccagcuugggcaacaaaaugagacccugucucaaaaaaaaaaaaaaaguuuucuagaauaagc

SEQ ID NO: 26120 - RNA, 64 nt, hsa
cuccagcuugggcaacaaaaugagacccugucucaaaaaaaaaaaaaaaguuuucuagaauaag

SEQ ID NO: 26121 - RNA, 64 nt, hsa
acugcaugccacgcacuguguugggcuuaguaauaaaaaaaagaaaagauaagugcuuguucua

SEQ ID NO: 26122 - RNA, 64 nt, hsa
gcccaggcugauguaacuauaaaaauuaguugaaaaaaaaaauauuguuuccuuaauggaauuc

SEQ ID NO: 26123 - RNA, 64 nt, hsa
agcccaggcugauguaacuauaaaaauuaguugaaaaaaaaaauauuguuuccuuaauggaauu

SEQ ID NO: 26124 - RNA, 64 nt, hsa
uagcccaggcugauguaacuauaaaaauuaguugaaaaaaaaaauauuguuuccuuaauggaau

SEQ ID NO: 26125 - RNA, 64 nt, hsa
gcuuguauaaaacacuguucacuguuuuuuuuaaaaaaaaaacuugauuuguuauuaacauuga

SEQ ID NO: 26126 - RNA, 64 nt, hsa
ugcuuguauaaaacacuguucacuguuuuuuuuaaaaaaaaaacuugauuuguuauuaacauug

SEQ ID NO: 26127 - RNA, 64 nt, hsa
augcuuguauaaaacacuguucacuguuuuuuuuaaaaaaaaaacuugauuuguuauuaacauu

SEQ ID NO: 26128 - RNA, 64 nt, hsa
gcuauuuagcuccucuuaagaagauuaaaagagaaaaaaaaaggcccuuuuaaaaauaguauac

SEQ ID NO: 26129 - RNA, 64 nt, hsa
ugcuauuuagcuccucuuaagaagauuaaaagagaaaaaaaaaggcccuuuuaaaaauaguaua

SEQ ID NO: 26130 - RNA, 64 nt, hsa
caguugaaguccuagaauaauggauuuuuuuaaaaaaaaaaaguuguuaguuugaauacugaga

SEQ ID NO: 26131 - RNA, 64 nt, hsa
acaguugaaguccuagaauaauggauuuuuuuaaaaaaaaaaaguuguuaguuugaauacugag

SEQ ID NO: 26132 - RNA, 64 nt, hsa
cacaguugaaguccuagaauaauggauuuuuuuaaaaaaaaaaaguuguuaguuugaauacuga

SEQ ID NO: 26133 - RNA, 64 nt, hsa
gcacaguugaaguccuagaauaauggauuuuuuuaaaaaaaaaaaguuguuaguuugaauacug

SEQ ID NO: 26134 - RNA, 64 nt, hsa
uguaaacuguaaagucuagcccagcccuugugaaaaaaaaaaucacaaauaaaacagugaaguu

SEQ ID NO: 26135 - RNA, 64 nt, hsa
guguaaacuguaaagucuagcccagcccuugugaaaaaaaaaaucacaaauaaaacagugaagu

SEQ ID NO: 26136 - RNA, 64 nt, hsa
uguguaaacuguaaagucuagcccagcccuugugaaaaaaaaaaucacaaauaaaacagugaag

SEQ ID NO: 26137 - RNA, 64 nt, hsa
gccaccaacuaaauguacaucacaguuuucaagaaaaaaaaaggugugugagugccaccugguu

SEQ ID NO: 26138 - RNA, 64 nt, hsa
agccaccaacuaaauguacaucacaguuuucaagaaaaaaaaaggugugugagugccaccuggu

SEQ ID NO: 26139 - RNA, 64 nt, hsa
aaagacaaaaaaaaaccaaaaaaaaaaaaccuacaaaaaaaacuuuguugcuaggauuaagguu

SEQ ID NO: 26140 - RNA, 64 nt, hsa
uaaacgcaaaaaaaaagacaaaaaaaaaccaaaaaaaaaaaaccuacaaaaaaaacuuuguugc

SEQ ID NO: 26141 - RNA, 64 nt, hsa
uuaaacgcaaaaaaaaagacaaaaaaaaaccaaaaaaaaaaaaccuacaaaaaaaacuuuguug

SEQ ID NO: 26142 - RNA, 64 nt, hsa
uuuaaacgcaaaaaaaaagacaaaaaaaaaccaaaaaaaaaaaaccuacaaaaaaaacuuuguu

SEQ ID NO: 26143 - RNA, 64 nt, hsa
uuuuaaacgcaaaaaaaaagacaaaaaaaaaccaaaaaaaaaaaaccuacaaaaaaaacuuugu

SEQ ID NO: 26144 - RNA, 64 nt, hsa
guuuuaaacgcaaaaaaaaagacaaaaaaaaaccaaaaaaaaaaaaccuacaaaaaaaacuuug

SEQ ID NO: 26145 - RNA, 64 nt, hsa
uagcccaaauguuuuaaacgcaaaaaaaaagacaaaaaaaaaccaaaaaaaaaaaaccuacaaa

SEQ ID NO: 26146 - RNA, 64 nt, hsa
auagcccaaauguuuuaaacgcaaaaaaaaagacaaaaaaaaaccaaaaaaaaaaaaccuacaa

SEQ ID NO: 26147 - RNA, 64 nt, hsa
aucgucagggaauagcccaaauguuuuaaacgcaaaaaaaaagacaaaaaaaaaccaaaaaaaa

SEQ ID NO: 26148 - RNA, 64 nt, hsa
gaucgucagggaauagcccaaauguuuuaaacgcaaaaaaaaagacaaaaaaaaaccaaaaaaa

SEQ ID NO: 26149 - RNA, 64 nt, hsa
uaggugacagaaugagacucuaucucaaaaaaaaaaaaaaaaugauaucaguugguggaugcuc

SEQ ID NO: 26150 - RNA, 64 nt, hsa
cuaggugacagaaugagacucuaucucaaaaaaaaaaaaaaaaugauaucaguugguggaugcu

SEQ ID NO: 26151 - RNA, 64 nt, hsa
ccuaggugacagaaugagacucuaucucaaaaaaaaaaaaaaaaugauaucaguugguggaugc

SEQ ID NO: 26152 - RNA, 64 nt, hsa
gccuaggugacagaaugagacucuaucucaaaaaaaaaaaaaaaaugauaucaguugguggaug

SEQ ID NO: 26153 - RNA, 64 nt, hsa
agccuaggugacagaaugagacucuaucucaaaaaaaaaaaaaaaaugauaucaguugguggau

SEQ ID NO: 26154 - RNA, 64 nt, hsa
cagccuaggugacagaaugagacucuaucucaaaaaaaaaaaaaaaaugauaucaguuggugga

SEQ ID NO: 26155 - RNA, 64 nt, hsa
ccagccuaggugacagaaugagacucuaucucaaaaaaaaaaaaaaaaugauaucaguuggugg

SEQ ID NO: 26156 - RNA, 64 nt, hsa
uccagccuaggugacagaaugagacucuaucucaaaaaaaaaaaaaaaaugauaucaguuggug

SEQ ID NO: 26157 - RNA, 64 nt, hsa
cuccagccuaggugacagaaugagacucuaucucaaaaaaaaaaaaaaaaugauaucaguuggu

SEQ ID NO: 26158 - RNA, 64 nt, hsa
gagaugaguaguuguguuacaguucauuuucuuuaaaaaaaaguauuuugagaaaaggugcaaa

SEQ ID NO: 26159 - RNA, 64 nt, hsa
aacagagcgagacucuaucucaaaaaaaaacaaaaaaaaaaacaaaaaacaaagaugagucgca

SEQ ID NO: 26160 - RNA, 64 nt, hsa
caacagagcgagacucuaucucaaaaaaaaacaaaaaaaaaaacaaaaaacaaagaugagucgc

SEQ ID NO: 26161 - RNA, 64 nt, hsa
gcaacagagcgagacucuaucucaaaaaaaaacaaaaaaaaaaacaaaaaacaaagaugagucg

SEQ ID NO: 26162 - RNA, 64 nt, hsa
ggcaacagagcgagacucuaucucaaaaaaaaacaaaaaaaaaaacaaaaaacaaagaugaguc

SEQ ID NO: 26163 - RNA, 64 nt, hsa
uccagccugggcaacagagcgagacucuaucucaaaaaaaaacaaaaaaaaaaacaaaaaacaa

SEQ ID NO: 26164 - RNA, 64 nt, hsa
cuccagccugggcaacagagcgagacucuaucucaaaaaaaaacaaaaaaaaaaacaaaaaaca

SEQ ID NO: 26165 - RNA, 64 nt, hsa
ugggcgacagagugagacucugucucaaaaaaaaaaaaaaaauagaauguguaugcauauauuu

SEQ ID NO: 26166 - RNA, 64 nt, hsa
cugggcgacagagugagacucugucucaaaaaaaaaaaaaaaauagaauguguaugcauauauu

SEQ ID NO: 26167 - RNA, 64 nt, hsa
ccugggcgacagagugagacucugucucaaaaaaaaaaaaaaaauagaauguguaugcauauau

SEQ ID NO: 26168 - RNA, 64 nt, hsa
gccugggcgacagagugagacucugucucaaaaaaaaaaaaaaaauagaauguguaugcauaua

SEQ ID NO: 26169 - RNA, 64 nt, hsa
agccugggcgacagagugagacucugucucaaaaaaaaaaaaaaaauagaauguguaugcauau

SEQ ID NO: 26170 - RNA, 64 nt, hsa
cagccugggcgacagagugagacucugucucaaaaaaaaaaaaaaaauagaauguguaugcaua

SEQ ID NO: 26171 - RNA, 64 nt, hsa
ccagccugggcgacagagugagacucugucucaaaaaaaaaaaaaaaauagaauguguaugcau

SEQ ID NO: 26172 - RNA, 64 nt, hsa
uccagccugggcgacagagugagacucugucucaaaaaaaaaaaaaaaauagaauguguaugca

SEQ ID NO: 26173 - RNA, 64 nt, hsa
cuccagccugggcgacagagugagacucugucucaaaaaaaaaaaaaaaauagaauguguaugc

SEQ ID NO: 26174 - RNA, 64 nt, hsa
acaucaccaagaggcccugaaaagaggaaaaaaaaaaaaaaagaggccaggcaugguggcucac

SEQ ID NO: 26175 - RNA, 64 nt, hsa
uacaucaccaagaggcccugaaaagaggaaaaaaaaaaaaaaagaggccaggcaugguggcuca

SEQ ID NO: 26176 - RNA, 64 nt, hsa
uuacaucaccaagaggcccugaaaagaggaaaaaaaaaaaaaaagaggccaggcaugguggcuc

SEQ ID NO: 26177 - RNA, 64 nt, hsa
guuacaucaccaagaggcccugaaaagaggaaaaaaaaaaaaaaagaggccaggcaugguggcu

SEQ ID NO: 26178 - RNA, 64 nt, hsa
uguuacaucaccaagaggcccugaaaagaggaaaaaaaaaaaaaaagaggccaggcaugguggc

SEQ ID NO: 26179 - RNA, 64 nt, hsa
cuguuacaucaccaagaggcccugaaaagaggaaaaaaaaaaaaaaagaggccaggcauggugg

SEQ ID NO: 26180 - RNA, 64 nt, hsa
acuguuacaucaccaagaggcccugaaaagaggaaaaaaaaaaaaaaagaggccaggcauggug

SEQ ID NO: 26181 - RNA, 64 nt, hsa
cacuguuacaucaccaagaggcccugaaaagaggaaaaaaaaaaaaaaagaggccaggcauggu

SEQ ID NO: 26182 - RNA, 64 nt, hsa
cauuuuaguagauuuuucacacaccucauuauuaaaaaaaaacaaacaugcuggugucuugguu

SEQ ID NO: 26183 - RNA, 64 nt, hsa
acauuuuaguagauuuuucacacaccucauuauuaaaaaaaaacaaacaugcuggugucuuggu

SEQ ID NO: 26184 - RNA, 64 nt, hsa
aaaaaaaaagaaaaaaaaagaaaaaagagggaggaaaaaaaagaaccuacuuaagauagaacau

SEQ ID NO: 26185 - RNA, 64 nt, hsa
aagugaugauggucuggggagagauuuuauuaaaaaaaaaaagaaaaaagagggaggaaaaaaa

SEQ ID NO: 26186 - RNA, 64 nt, hsa
aaagugaugauggucuggggagagauuuuauuaaaaaaaaaaagaaaaaaaaagaaaaaagagg

SEQ ID NO: 26187 - RNA, 64 nt, hsa
aaaagugaugauggucuggggagagauuuuauuaaaaaaaaaaagaaaaaaaaagaaaaaagag

SEQ ID NO: 26188 - RNA, 64 nt, hsa
uaaaagugaugauggucuggggagagauuuuauuaaaaaaaaaaagaaaaaaaaagaaaaaaga

SEQ ID NO: 26189 - RNA, 64 nt, hsa
ucagccugggugacagagaaggacuccgucucaaaaaaaaaagaaaaaagaauagucauuuuua

SEQ ID NO: 26190 - RNA, 64 nt, hsa
uucagccugggugacagagaaggacuccgucucaaaaaaaaaagaaaaaagaauagucauuuuu

SEQ ID NO: 26191 - RNA, 64 nt, hsa
cuucagccugggugacagagaaggacuccgucucaaaaaaaaaagaaaaaagaauagucauuuu

SEQ ID NO: 26192 - RNA, 62 nt, hsa
acauuuuuggagccagcugagaggucuauuuaaaaaaaaagucagagacagauaccuccaac

SEQ ID NO: 26193 - RNA, 61 nt, hsa
acauuuuuggagccagcugagaggucuauuuaaaaaaaaagucagagacagauaccuccaa

SEQ ID NO: 26194 - RNA, 64 nt, hsa
aaaagguugcuguuuucuauuuuuaaauaaaccaaaaaaaaacagaaaagaugugaauuuuccc

SEQ ID NO: 26195 - RNA, 64 nt, hsa
aaaaagguugcuguuuucuauuuuuaaauaaaccaaaaaaaaacagaaaagaugugaauuuucc

SEQ ID NO: 26196 - RNA, 64 nt, hsa
gcauuauuuuacaugugcaaaucagaauauauuuaaaaaaaagcaaaagaaauucaauggaugg

SEQ ID NO: 26197 - RNA, 64 nt, hsa
guguuucccugguauacaucuuucuaggaaaaaaaaaaaaaagagagagagcuguauaaugauu

SEQ ID NO: 26198 - RNA, 64 nt, hsa
uguguuucccugguauacaucuuucuaggaaaaaaaaaaaaaagagagagagcuguauaaugau

SEQ ID NO: 26199 - RNA, 64 nt, hsa
uuguguuucccugguauacaucuuucuaggaaaaaaaaaaaaaagagagagagcuguauaauga

SEQ ID NO: 26200 - RNA, 64 nt, hsa
guuguguuucccugguauacaucuuucuaggaaaaaaaaaaaaaagagagagagcuguauaaug

SEQ ID NO: 26201 - RNA, 64 nt, hsa
uguuguguuucccugguauacaucuuucuaggaaaaaaaaaaaaaagagagagagcuguauaau

SEQ ID NO: 26202 - RNA, 64 nt, hsa
cuguuguguuucccugguauacaucuuucuaggaaaaaaaaaaaaaagagagagagcuguauaa

SEQ ID NO: 26203 - RNA, 64 nt, hsa
ucuguuguguuucccugguauacaucuuucuaggaaaaaaaaaaaaaagagagagagcuguaua

SEQ ID NO: 26204 - RNA, 64 nt, hsa
uuuaagaggcaauaaggcaaaugccagaauuaaaaaaaaaaaucaucaaagacagaaaaugccu

SEQ ID NO: 26205 - RNA, 64 nt, hsa
auuuaagaggcaauaaggcaaaugccagaauuaaaaaaaaaaaucaucaaagacagaaaaugcc

SEQ ID NO: 26206 - RNA, 64 nt, hsa
cauuuaagaggcaauaaggcaaaugccagaauuaaaaaaaaaaaucaucaaagacagaaaaugc

SEQ ID NO: 26207 - RNA, 64 nt, hsa
ucauuuaagaggcaauaaggcaaaugccagaauuaaaaaaaaaaaucaucaaagacagaaaaug

SEQ ID NO: 26208 - RNA, 64 nt, hsa
cccuuuuuucuaaauuugaaauagcuuuaguuuaaaaaaaaauccucccuucccccuuuccuuu

SEQ ID NO: 26209 - RNA, 64 nt, hsa
ccccuuuuuucuaaauuugaaauagcuuuaguuuaaaaaaaaauccucccuucccccuuuccuu

SEQ ID NO: 26210 - RNA, 64 nt, hsa
cugagugacaggaguuaagcccugucucagaaaaaaaaaaaacaaaaacccaaaaaguacuuaa

SEQ ID NO: 26211 - RNA, 64 nt, hsa
ccugagugacaggaguuaagcccugucucagaaaaaaaaaaaacaaaaacccaaaaaguacuua

SEQ ID NO: 26212 - RNA, 64 nt, hsa
gccugagugacaggaguuaagcccugucucagaaaaaaaaaaaacaaaaacccaaaaaguacuu

SEQ ID NO: 26213 - RNA, 64 nt, hsa
agccugagugacaggaguuaagcccugucucagaaaaaaaaaaaacaaaaacccaaaaaguacu

SEQ ID NO: 26214 - RNA, 64 nt, hsa
cagccugagugacaggaguuaagcccugucucagaaaaaaaaaaaacaaaaacccaaaaaguac

SEQ ID NO: 26215 - RNA, 64 nt, hsa
uauuaucuuguaaaacuuauguaaaaaaaaaaaaaaaaaaaaggcaaagauacuaaaaauuuua

SEQ ID NO: 26216 - RNA, 64 nt, hsa
guauuaucuuguaaaacuuauguaaaaaaaaaaaaaaaaaaaaggcaaagauacuaaaaauuuu

SEQ ID NO: 26217 - RNA, 64 nt, hsa
uguauuaucuuguaaaacuuauguaaaaaaaaaaaaaaaaaaaaggcaaagauacuaaaaauuu

SEQ ID NO: 26218 - RNA, 64 nt, hsa
auguauuaucuuguaaaacuuauguaaaaaaaaaaaaaaaaaaaaggcaaagauacuaaaaauu

SEQ ID NO: 26219 - RNA, 64 nt, hsa
aauguauuaucuuguaaaacuuauguaaaaaaaaaaaaaaaaaaaaggcaaagauacuaaaaau

SEQ ID NO: 26220 - RNA, 64 nt, hsa
aaauguauuaucuuguaaaacuuauguaaaaaaaaaaaaaaaaaaaaggcaaagauacuaaaaa

SEQ ID NO: 26221 - RNA, 64 nt, hsa
aaaauguauuaucuuguaaaacuuauguaaaaaaaaaaaaaaaaaaaaggcaaagauacuaaaa

SEQ ID NO: 26222 - RNA, 64 nt, hsa
aaaaauguauuaucuuguaaaacuuauguaaaaaaaaaaaaaaaaaaaaggcaaagauacuaaa

SEQ ID NO: 26223 - RNA, 64 nt, hsa
uaaaaauguauuaucuuguaaaacuuauguaaaaaaaaaaaaaaaaaaaaggcaaagauacuaa

SEQ ID NO: 26224 - RNA, 64 nt, hsa
guaaaaauguauuaucuuguaaaacuuauguaaaaaaaaaaaaaaaaaaaaggcaaagauacua

SEQ ID NO: 26225 - RNA, 64 nt, hsa
uguaaaaauguauuaucuuguaaaacuuauguaaaaaaaaaaaaaaaaaaaaggcaaagauacu

SEQ ID NO: 26226 - RNA, 64 nt, hsa
cuguaaaaauguauuaucuuguaaaacuuauguaaaaaaaaaaaaaaaaaaaaggcaaagauac

SEQ ID NO: 26227 - RNA, 64 nt, hsa
acuguaaaaauguauuaucuuguaaaacuuauguaaaaaaaaaaaaaaaaaaaaggcaaagaua

SEQ ID NO: 26228 - RNA, 64 nt, hsa
aaaaaauuuauuuaaaaauauuuuucgcaaaaaaaaaaaaaaucuugguguguuucuguugauu

SEQ ID NO: 26229 - RNA, 64 nt, hsa
aaaaaaauuuauuuaaaaauauuuuucgcaaaaaaaaaaaaaaucuugguguguuucuguugau

SEQ ID NO: 26230 - RNA, 64 nt, hsa
aaaaaaaauuuauuuaaaaauauuuuucgcaaaaaaaaaaaaaaucuugguguguuucuguuga

SEQ ID NO: 26231 - RNA, 64 nt, hsa
aaaaaaaaauuuauuuaaaaauauuuuucgcaaaaaaaaaaaaaaucuugguguguuucuguug

SEQ ID NO: 26232 - RNA, 64 nt, hsa
gaaaaaaaaauuuauuuaaaaauauuuuucgcaaaaaaaaaaaaaaucuugguguguuucuguu

SEQ ID NO: 26233 - RNA, 64 nt, hsa
agaaaaaaaaauuuauuuaaaaauauuuuucgcaaaaaaaaaaaaaaucuugguguguuucugu

SEQ ID NO: 26234 - RNA, 64 nt, hsa
aagaaaaaaaaauuuauuuaaaaauauuuuucgcaaaaaaaaaaaaaaucuugguguguuucug

SEQ ID NO: 26235 - RNA, 64 nt, hsa
aaaccuuguuacauauguauaucagaauguaagaaaaaaaaauuuauuuaaaaauauuuuucgc

SEQ ID NO: 26236 - RNA, 64 nt, hsa
uaaaccuuguuacauauguauaucagaauguaagaaaaaaaaauuuauuuaaaaauauuuuucg

SEQ ID NO: 26237 - RNA, 64 nt, hsa
augauguauguguaaacugacaaaaaaaaaaaaaaaaaaaaaccaguguugaaucaugcuauau

SEQ ID NO: 26238 - RNA, 64 nt, hsa
caugauguauguguaaacugacaaaaaaaaaaaaaaaaaaaaaccaguguugaaucaugcuaua

SEQ ID NO: 26239 - RNA, 64 nt, hsa
acaugauguauguguaaacugacaaaaaaaaaaaaaaaaaaaaaccaguguugaaucaugcuau

SEQ ID NO: 26240 - RNA, 64 nt, hsa
aacaugauguauguguaaacugacaaaaaaaaaaaaaaaaaaaaaccaguguugaaucaugcua

SEQ ID NO: 26241 - RNA, 64 nt, hsa
uaacaugauguauguguaaacugacaaaaaaaaaaaaaaaaaaaaaccaguguugaaucaugcu

SEQ ID NO: 26242 - RNA, 64 nt, hsa
uuaacaugauguauguguaaacugacaaaaaaaaaaaaaaaaaaaaaccaguguugaaucaugc

SEQ ID NO: 26243 - RNA, 64 nt, hsa
auuaacaugauguauguguaaacugacaaaaaaaaaaaaaaaaaaaaaccaguguugaaucaug

SEQ ID NO: 26244 - RNA, 64 nt, hsa
uauuaacaugauguauguguaaacugacaaaaaaaaaaaaaaaaaaaaaccaguguugaaucau

SEQ ID NO: 26245 - RNA, 64 nt, hsa
auauuaacaugauguauguguaaacugacaaaaaaaaaaaaaaaaaaaaaccaguguugaauca

SEQ ID NO: 26246 - RNA, 64 nt, hsa
aauauuaacaugauguauguguaaacugacaaaaaaaaaaaaaaaaaaaaaccaguguugaauc

SEQ ID NO: 26247 - RNA, 64 nt, hsa
uaauauuaacaugauguauguguaaacugacaaaaaaaaaaaaaaaaaaaaaccaguguugaau

SEQ ID NO: 26248 - RNA, 64 nt, hsa
cuaauauuaacaugauguauguguaaacugacaaaaaaaaaaaaaaaaaaaaaccaguguugaa

SEQ ID NO: 26249 - RNA, 64 nt, hsa
ucuaauauuaacaugauguauguguaaacugacaaaaaaaaaaaaaaaaaaaaaccaguguuga

SEQ ID NO: 26250 - RNA, 64 nt, hsa
gucuaauauuaacaugauguauguguaaacugacaaaaaaaaaaaaaaaaaaaaaccaguguug

SEQ ID NO: 26251 - RNA, 64 nt, hsa
caggucaaaagugcauuguugugagauuuauuaaaaaaaaaaugauaacacacuauuuucauau

SEQ ID NO: 26252 - RNA, 64 nt, hsa
ucaggucaaaagugcauuguugugagauuuauuaaaaaaaaaaugauaacacacuauuuucaua

SEQ ID NO: 26253 - RNA, 64 nt, hsa
uucaggucaaaagugcauuguugugagauuuauuaaaaaaaaaaugauaacacacuauuuucau

SEQ ID NO: 26254 - RNA, 64 nt, hsa
gugccugaauauuaacaguguucugauuaaaaacaaaaaaaagauacauaugccuuguaaaugg

SEQ ID NO: 26255 - RNA, 64 nt, hsa
auaguuggaaaagcuuuguggggggauuaaaaaaaaaaaaaagcacuguuguguuuaacacuag

SEQ ID NO: 26256 - RNA, 64 nt, hsa
cauaguuggaaaagcuuuguggggggauuaaaaaaaaaaaaaagcacuguuguguuuaacacua

SEQ ID NO: 26257 - RNA, 64 nt, hsa
acauaguuggaaaagcuuuguggggggauuaaaaaaaaaaaaaagcacuguuguguuuaacacu

SEQ ID NO: 26258 - RNA, 64 nt, hsa
uacauaguuggaaaagcuuuguggggggauuaaaaaaaaaaaaaagcacuguuguguuuaacac

SEQ ID NO: 26259 - RNA, 64 nt, hsa
guacauaguuggaaaagcuuuguggggggauuaaaaaaaaaaaaaagcacuguuguguuuaaca

SEQ ID NO: 26260 - RNA, 64 nt, hsa
aguacauaguuggaaaagcuuuguggggggauuaaaaaaaaaaaaaagcacuguuguguuuaac

SEQ ID NO: 26261 - RNA, 64 nt, hsa
uaguacauaguuggaaaagcuuuguggggggauuaaaaaaaaaaaaaagcacuguuguguuuaa

SEQ ID NO: 26262 - RNA, 64 nt, hsa
auacccagugcucaguuuugaaagauaggcaaaaaaaaaaaaguauaggagaaacugaagaaug

SEQ ID NO: 26263 - RNA, 64 nt, hsa
aauacccagugcucaguuuugaaagauaggcaaaaaaaaaaaaguauaggagaaacugaagaau

SEQ ID NO: 26264 - RNA, 64 nt, hsa
aaauacccagugcucaguuuugaaagauaggcaaaaaaaaaaaaguauaggagaaacugaagaa

SEQ ID NO: 26265 - RNA, 64 nt, hsa
aaaauacccagugcucaguuuugaaagauaggcaaaaaaaaaaaaguauaggagaaacugaaga

SEQ ID NO: 26266 - RNA, 64 nt, hsa
aaaaauacccagugcucaguuuugaaagauaggcaaaaaaaaaaaaguauaggagaaacugaag

SEQ ID NO: 26267 - RNA, 64 nt, hsa
auauuaauacauuucaguggauaauuuauuuuaaaaaaaaaacuaugccuaaauaucccuuauu

SEQ ID NO: 26268 - RNA, 64 nt, hsa
cauauuaauacauuucaguggauaauuuauuuuaaaaaaaaaacuaugccuaaauaucccuuau

SEQ ID NO: 26269 - RNA, 64 nt, hsa
ucauauuaauacauuucaguggauaauuuauuuuaaaaaaaaaacuaugccuaaauaucccuua

SEQ ID NO: 26270 - RNA, 64 nt, hsa
gaugacagcaggcccagaaggugucuuacucagaaaaaaaaaugccuggucagcaauucacugu

SEQ ID NO: 26271 - RNA, 64 nt, hsa
ggaugacagcaggcccagaaggugucuuacucagaaaaaaaaaugccuggucagcaauucacug

SEQ ID NO: 26272 - RNA, 64 nt, hsa
uauaauggaucuccuauuuuucuuuaaauacaaaaaaaaaaagguaaaugaacuauucuccuug

SEQ ID NO: 26273 - RNA, 64 nt, hsa
cuauaauggaucuccuauuuuucuuuaaauacaaaaaaaaaaagguaaaugaacuauucuccuu

SEQ ID NO: 26274 - RNA, 64 nt, hsa
acuauaauggaucuccuauuuuucuuuaaauacaaaaaaaaaaagguaaaugaacuauucuccu

SEQ ID NO: 26275 - RNA, 64 nt, hsa
aacuauaauggaucuccuauuuuucuuuaaauacaaaaaaaaaaagguaaaugaacuauucucc

SEQ ID NO: 26276 - RNA, 64 nt, hsa
auuuugauuaugccuuuauuucuccuuucuugaaaaaaaaaagguguuauuuugacaauuaggc

SEQ ID NO: 26277 - RNA, 64 nt, hsa
aauuuugauuaugccuuuauuucuccuuucuugaaaaaaaaaagguguuauuuugacaauuagg

SEQ ID NO: 26278 - RNA, 64 nt, hsa
uaauuuugauuaugccuuuauuucuccuuucuugaaaaaaaaaagguguuauuuugacaauuag

SEQ ID NO: 26279 - RNA, 64 nt, hsa
agcuugaaaaaaugcagacuguacaaacgcuuacaaaaaaaaaaacugugaacugacuuaagau

SEQ ID NO: 26280 - RNA, 64 nt, hsa
gcuugaaaaaaugcagacuguacaaacgcuuacaaaaaaaaaaacugugaacugacuuaagauc

SEQ ID NO: 26281 - RNA, 64 nt, hsa
cuugaaaaaaugcagacuguacaaacgcuuacaaaaaaaaaaacugugaacugacuuaagauca

SEQ ID NO: 26282 - RNA, 64 nt, hsa
uugaaaaaaugcagacuguacaaacgcuuacaaaaaaaaaaacugugaacugacuuaagaucag

SEQ ID NO: 26283 - RNA, 64 nt, hsa
aaaauaauccuugcaucuaaaggccuugugguuuaaaaaaaaaaagcaaacuuuuuuuuguaca

SEQ ID NO: 26284 - RNA, 64 nt, hsa
aaauaauccuugcaucuaaaggccuugugguuuaaaaaaaaaaagcaaacuuuuuuuuguacag

SEQ ID NO: 26285 - RNA, 64 nt, hsa
aauaauccuugcaucuaaaggccuugugguuuaaaaaaaaaaagcaaacuuuuuuuuguacagc

SEQ ID NO: 26286 - RNA, 64 nt, hsa
auaauccuugcaucuaaaggccuugugguuuaaaaaaaaaaagcaaacuuuuuuuuguacagcu

SEQ ID NO: 26287 - RNA, 64 nt, hsa
uuugaaacuggauucucgauuuuuagcaaaaaagaaaaaaaaaaggcacauaguuuaaaaaguu

SEQ ID NO: 26288 - RNA, 64 nt, hsa
uugaaacuggauucucgauuuuuagcaaaaaagaaaaaaaaaaggcacauaguuuaaaaaguuu

SEQ ID NO: 26289 - RNA, 64 nt, hsa
ugaaacuggauucucgauuuuuagcaaaaaagaaaaaaaaaaggcacauaguuuaaaaaguuuc

SEQ ID NO: 26290 - RNA, 64 nt, hsa
caguuuguugauacaacuuaguaucuuauugccuaaaaaaaaauuucuuaucauuguuucaaaa

SEQ ID NO: 26291 - RNA, 64 nt, hsa
aguuuguugauacaacuuaguaucuuauugccuaaaaaaaaauuucuuaucauuguuucaaaaa

SEQ ID NO: 26292 - RNA, 64 nt, hsa
guccaggcaaauaaaaggucauuuuaauuuaaggaaaaaaaauauuccuacuuaaauuuuaagu

SEQ ID NO: 26293 - RNA, 64 nt, hsa
aaggaggacaaguugaauggaccuuuuuaaaaagaaaaaaaaaauggaaggaaaacuaagaaug

SEQ ID NO: 26294 - RNA, 64 nt, hsa
aggaggacaaguugaauggaccuuuuuaaaaagaaaaaaaaaauggaaggaaaacuaagaauga

SEQ ID NO: 26295 - RNA, 64 nt, hsa
ggaggacaaguugaauggaccuuuuuaaaaagaaaaaaaaaauggaaggaaaacuaagaaugau

SEQ ID NO: 26296 - RNA, 64 nt, hsa
cuccagccugggugacagaguaagacuccaugucaaaaaaaaaaaaaaaaaaaaaaaaguccug

SEQ ID NO: 26297 - RNA, 64 nt, hsa
uccagccugggugacagaguaagacuccaugucaaaaaaaaaaaaaaaaaaaaaaaaguccugc

SEQ ID NO: 26298 - RNA, 64 nt, hsa
ccagccugggugacagaguaagacuccaugucaaaaaaaaaaaaaaaaaaaaaaaaguccugcc

SEQ ID NO: 26299 - RNA, 64 nt, hsa
cagccugggugacagaguaagacuccaugucaaaaaaaaaaaaaaaaaaaaaaaaguccugccu

SEQ ID NO: 26300 - RNA, 64 nt, hsa
agccugggugacagaguaagacuccaugucaaaaaaaaaaaaaaaaaaaaaaaaguccugccuu

SEQ ID NO: 26301 - RNA, 64 nt, hsa
gccugggugacagaguaagacuccaugucaaaaaaaaaaaaaaaaaaaaaaaaguccugccuua

SEQ ID NO: 26302 - RNA, 64 nt, hsa
ccugggugacagaguaagacuccaugucaaaaaaaaaaaaaaaaaaaaaaaaguccugccuuaa

SEQ ID NO: 26303 - RNA, 64 nt, hsa
cugggugacagaguaagacuccaugucaaaaaaaaaaaaaaaaaaaaaaaaguccugccuuaac

SEQ ID NO: 26304 - RNA, 64 nt, hsa
ugggugacagaguaagacuccaugucaaaaaaaaaaaaaaaaaaaaaaaaguccugccuuaacu

SEQ ID NO: 26305 - RNA, 64 nt, hsa
gggugacagaguaagacuccaugucaaaaaaaaaaaaaaaaaaaaaaaaguccugccuuaacua

SEQ ID NO: 26306 - RNA, 64 nt, hsa
ggugacagaguaagacuccaugucaaaaaaaaaaaaaaaaaaaaaaaaguccugccuuaacuaa

SEQ ID NO: 26307 - RNA, 64 nt, hsa
gugacagaguaagacuccaugucaaaaaaaaaaaaaaaaaaaaaaaaguccugccuuaacuaac

SEQ ID NO: 26308 - RNA, 64 nt, hsa
ugacagaguaagacuccaugucaaaaaaaaaaaaaaaaaaaaaaaaguccugccuuaacuaacu

SEQ ID NO: 26309 - RNA, 64 nt, hsa
gacagaguaagacuccaugucaaaaaaaaaaaaaaaaaaaaaaaaguccugccuuaacuaacuc

SEQ ID NO: 26310 - RNA, 64 nt, hsa
acagaguaagacuccaugucaaaaaaaaaaaaaaaaaaaaaaaaguccugccuuaacuaacucc

SEQ ID NO: 26311 - RNA, 64 nt, hsa
cagaguaagacuccaugucaaaaaaaaaaaaaaaaaaaaaaaaguccugccuuaacuaacuccu

SEQ ID NO: 26312 - RNA, 64 nt, hsa
agaguaagacuccaugucaaaaaaaaaaaaaaaaaaaaaaaaguccugccuuaacuaacuccuc

SEQ ID NO: 26313 - RNA, 64 nt, hsa
caaccaccuagcugguaauuaaugagguucacuuaaaaaaaaaauucggugcacacagacugac

SEQ ID NO: 26314 - RNA, 64 nt, hsa
aaccaccuagcugguaauuaaugagguucacuuaaaaaaaaaauucggugcacacagacugaca

SEQ ID NO: 26315 - RNA, 64 nt, hsa
accaccuagcugguaauuaaugagguucacuuaaaaaaaaaauucggugcacacagacugacau

SEQ ID NO: 26316 - RNA, 64 nt, hsa
gcaugugaaaaguaaaacagauuuguucauuccgaaaaaaaaauguucauucuaugacaauaaa

SEQ ID NO: 26317 - RNA, 64 nt, hsa
caugugaaaaguaaaacagauuuguucauuccgaaaaaaaaauguucauucuaugacaauaaau

SEQ ID NO: 26318 - RNA, 64 nt, hsa
cugcagccauucuucaggucguagcauuuggagcaaaaaaaaaaaaaaaaaaaaaaaaaggagu

SEQ ID NO: 26319 - RNA, 64 nt, hsa
ugcagccauucuucaggucguagcauuuggagcaaaaaaaaaaaaaaaaaaaaaaaaaggaguu

SEQ ID NO: 26320 - RNA, 64 nt, hsa
gcagccauucuucaggucguagcauuuggagcaaaaaaaaaaaaaaaaaaaaaaaaaggaguuu

SEQ ID NO: 26321 - RNA, 64 nt, hsa
cagccauucuucaggucguagcauuuggagcaaaaaaaaaaaaaaaaaaaaaaaaaggaguuug

SEQ ID NO: 26322 - RNA, 64 nt, hsa
agccauucuucaggucguagcauuuggagcaaaaaaaaaaaaaaaaaaaaaaaaaggaguuugc

SEQ ID NO: 26323 - RNA, 64 nt, hsa
gccauucuucaggucguagcauuuggagcaaaaaaaaaaaaaaaaaaaaaaaaaggaguuugcu

SEQ ID NO: 26324 - RNA, 64 nt, hsa
ccauucuucaggucguagcauuuggagcaaaaaaaaaaaaaaaaaaaaaaaaaggaguuugcuu

SEQ ID NO: 26325 - RNA, 64 nt, hsa
cauucuucaggucguagcauuuggagcaaaaaaaaaaaaaaaaaaaaaaaaaggaguuugcuuu

SEQ ID NO: 26326 - RNA, 64 nt, hsa
auucuucaggucguagcauuuggagcaaaaaaaaaaaaaaaaaaaaaaaaaggaguuugcuuuu

SEQ ID NO: 26327 - RNA, 64 nt, hsa
uucuucaggucguagcauuuggagcaaaaaaaaaaaaaaaaaaaaaaaaaggaguuugcuuuug

SEQ ID NO: 26328 - RNA, 64 nt, hsa
ucuucaggucguagcauuuggagcaaaaaaaaaaaaaaaaaaaaaaaaaggaguuugcuuuugu

SEQ ID NO: 26329 - RNA, 64 nt, hsa
cuucaggucguagcauuuggagcaaaaaaaaaaaaaaaaaaaaaaaaaggaguuugcuuuuguc

SEQ ID NO: 26330 - RNA, 64 nt, hsa
uucaggucguagcauuuggagcaaaaaaaaaaaaaaaaaaaaaaaaaggaguuugcuuuugucg

SEQ ID NO: 26331 - RNA, 64 nt, hsa
ucaggucguagcauuuggagcaaaaaaaaaaaaaaaaaaaaaaaaaggaguuugcuuuugucgg

SEQ ID NO: 26332 - RNA, 64 nt, hsa
caggucguagcauuuggagcaaaaaaaaaaaaaaaaaaaaaaaaaggaguuugcuuuugucggg

SEQ ID NO: 26333 - RNA, 64 nt, hsa
aggucguagcauuuggagcaaaaaaaaaaaaaaaaaaaaaaaaaggaguuugcuuuugucggga

SEQ ID NO: 26334 - RNA, 64 nt, hsa
ggucguagcauuuggagcaaaaaaaaaaaaaaaaaaaaaaaaaggaguuugcuuuugucgggag

SEQ ID NO: 26335 - RNA, 64 nt, hsa
gucguagcauuuggagcaaaaaaaaaaaaaaaaaaaaaaaaaggaguuugcuuuugucgggaga

SEQ ID NO: 26336 - RNA, 64 nt, hsa
uuuccugacucagugcuuuugcauaaggaacuagaaaaaaaaaguaaggaaaauuggagaugcu

SEQ ID NO: 26337 - RNA, 64 nt, hsa
uuccugacucagugcuuuugcauaaggaacuagaaaaaaaaaguaaggaaaauuggagaugcua

SEQ ID NO: 26338 - RNA, 64 nt, hsa
acauuaaaaaggaauuuuagagauugauuguuuuaaaaaaaaauacgcacauuguccaauccag

SEQ ID NO: 26339 - RNA, 64 nt, hsa
cauuaaaaaggaauuuuagagauugauuguuuuaaaaaaaaauacgcacauuguccaauccagu

SEQ ID NO: 26340 - RNA, 64 nt, hsa
uuuuugucuccauggcaaccauaacuuuugaaccaaaaaaaauuguuuuuacaucuuuaugcug

SEQ ID NO: 26341 - RNA, 64 nt, hsa
aaccaucaauuuuuuuaaacucaauaauuuugugaaaaaaaaaaccaccaccaaacuuuugguu

SEQ ID NO: 26342 - RNA, 64 nt, hsa
accaucaauuuuuuuaaacucaauaauuuugugaaaaaaaaaaccaccaccaaacuuuugguug

SEQ ID NO: 26343 - RNA, 64 nt, hsa
ccaucaauuuuuuuaaacucaauaauuuugugaaaaaaaaaaccaccaccaaacuuuugguugu

SEQ ID NO: 26344 - RNA, 64 nt, hsa
auuguauauuauucaagcaccuuuguugaagcucaaaaaaaaugaugccucuuuaaacuuuagc

SEQ ID NO: 26345 - RNA, 64 nt, hsa
guuguaaauacuuggacagagguugcugaacuuuaaaaaaaauuaauuuauuauuauaaugacc

SEQ ID NO: 26346 - RNA, 64 nt, hsa
aauuaauccauuccuggcauaaaaagucuuuaucaaaaaaaauuguagaugcuugcuuuuuguu

SEQ ID NO: 26347 - RNA, 64 nt, hsa
uccagccugggcaacaagagcaaaaaucccucucaaaaaaaaaaguaaacaugggcacugauug

SEQ ID NO: 26348 - RNA, 64 nt, hsa
ccagccugggcaacaagagcaaaaaucccucucaaaaaaaaaaguaaacaugggcacugauugu

SEQ ID NO: 26349 - RNA, 64 nt, hsa
cagccugggcaacaagagcaaaaaucccucucaaaaaaaaaaguaaacaugggcacugauuguu

SEQ ID NO: 26350 - RNA, 64 nt, hsa
ccacccccuuucucuuucucucucucucucaaagaaaaaaaaaaugggagugcaaaaaaaacaa

SEQ ID NO: 26351 - RNA, 64 nt, hsa
cacccccuuucucuuucucucucucucucaaagaaaaaaaaaaugggagugcaaaaaaaacaaa

SEQ ID NO: 26352 - RNA, 64 nt, hsa
acccccuuucucuuucucucucucucucaaagaaaaaaaaaaugggagugcaaaaaaaacaaag

SEQ ID NO: 26353 - RNA, 64 nt, hsa
cucucucucucaaagaaaaaaaaaaugggagugcaaaaaaaacaaagccaaaaaauauaugaag

SEQ ID NO: 26354 - RNA, 64 nt, hsa
cuccaaaggugaaaaaacaaugcauucuugcuuuaaaaaaaaaaaagaaggcuaaaaaauuacc

SEQ ID NO: 26355 - RNA, 64 nt, hsa
uccaaaggugaaaaaacaaugcauucuugcuuuaaaaaaaaaaaagaaggcuaaaaaauuaccu

SEQ ID NO: 26356 - RNA, 64 nt, hsa
ccaaaggugaaaaaacaaugcauucuugcuuuaaaaaaaaaaaagaaggcuaaaaaauuaccuc

SEQ ID NO: 26357 - RNA, 64 nt, hsa
caaaggugaaaaaacaaugcauucuugcuuuaaaaaaaaaaaagaaggcuaaaaaauuaccucu

SEQ ID NO: 26358 - RNA, 64 nt, hsa
aaaggugaaaaaacaaugcauucuugcuuuaaaaaaaaaaaagaaggcuaaaaaauuaccucuu

SEQ ID NO: 26359 - RNA, 64 nt, hsa
cuucccuaccaucaaaagcauaccugcucuaauuaaaaaaaaaaaaaaaaaaaauucaaguuca

SEQ ID NO: 26360 - RNA, 64 nt, hsa
uucccuaccaucaaaagcauaccugcucuaauuaaaaaaaaaaaaaaaaaaaauucaaguucag

SEQ ID NO: 26361 - RNA, 64 nt, hsa
ucccuaccaucaaaagcauaccugcucuaauuaaaaaaaaaaaaaaaaaaaauucaaguucagc

SEQ ID NO: 26362 - RNA, 64 nt, hsa
cccuaccaucaaaagcauaccugcucuaauuaaaaaaaaaaaaaaaaaaaauucaaguucagcu

SEQ ID NO: 26363 - RNA, 64 nt, hsa
ccuaccaucaaaagcauaccugcucuaauuaaaaaaaaaaaaaaaaaaaauucaaguucagcug

SEQ ID NO: 26364 - RNA, 64 nt, hsa
cuaccaucaaaagcauaccugcucuaauuaaaaaaaaaaaaaaaaaaaauucaaguucagcuga

SEQ ID NO: 26365 - RNA, 64 nt, hsa
uaccaucaaaagcauaccugcucuaauuaaaaaaaaaaaaaaaaaaaauucaaguucagcugau

SEQ ID NO: 26366 - RNA, 64 nt, hsa
accaucaaaagcauaccugcucuaauuaaaaaaaaaaaaaaaaaaaauucaaguucagcugauu

SEQ ID NO: 26367 - RNA, 64 nt, hsa
ccaucaaaagcauaccugcucuaauuaaaaaaaaaaaaaaaaaaaauucaaguucagcugauuu

SEQ ID NO: 26368 - RNA, 64 nt, hsa
caucaaaagcauaccugcucuaauuaaaaaaaaaaaaaaaaaaaauucaaguucagcugauuug

SEQ ID NO: 26369 - RNA, 64 nt, hsa
aucaaaagcauaccugcucuaauuaaaaaaaaaaaaaaaaaaaauucaaguucagcugauuugu

SEQ ID NO: 26370 - RNA, 64 nt, hsa
ucaaaagcauaccugcucuaauuaaaaaaaaaaaaaaaaaaaauucaaguucagcugauuuguu

SEQ ID NO: 26371 - RNA, 64 nt, hsa
caaaagcauaccugcucuaauuaaaaaaaaaaaaaaaaaaaauucaaguucagcugauuuguug

SEQ ID NO: 26372 - RNA, 64 nt, hsa
acuggugguguccuucuuacaaaacuuuugaaauaaaaaaaaaacucaaaucuucacugucugu

SEQ ID NO: 26373 - RNA, 64 nt, hsa
cuggugguguccuucuuacaaaacuuuugaaauaaaaaaaaaacucaaaucuucacugucugug

SEQ ID NO: 26374 - RNA, 64 nt, hsa
uggugguguccuucuuacaaaacuuuugaaauaaaaaaaaaacucaaaucuucacugucuguga

SEQ ID NO: 26375 - RNA, 64 nt, hsa
cacacuaggugguaugccuuuauuagcauaaaacaaaaaaaacuuuaacaggagcuuuuacaua

SEQ ID NO: 26376 - RNA, 64 nt, hsa
uuuaacuggaguugucaaguaugagucccucaggaaaaaaaaaaaauucuguuuuaaaaagcaa

SEQ ID NO: 26377 - RNA, 64 nt, hsa
uuaacuggaguugucaaguaugagucccucaggaaaaaaaaaaaauucuguuuuaaaaagcaau

SEQ ID NO: 26378 - RNA, 64 nt, hsa
uaacuggaguugucaaguaugagucccucaggaaaaaaaaaaaauucuguuuuaaaaagcaauc

SEQ ID NO: 26379 - RNA, 64 nt, hsa
aacuggaguugucaaguaugagucccucaggaaaaaaaaaaaauucuguuuuaaaaagcaaucu

SEQ ID NO: 26380 - RNA, 64 nt, hsa
acuggaguugucaaguaugagucccucaggaaaaaaaaaaaauucuguuuuaaaaagcaaucug

SEQ ID NO: 26381 - RNA, 64 nt, hsa
uucaacuaguagauuccugaggucccccuagcuuaaaaaaaaaaaaaaucugccccaugauucu

SEQ ID NO: 26382 - RNA, 64 nt, hsa
ucaacuaguagauuccugaggucccccuagcuuaaaaaaaaaaaaaaucugccccaugauucua

SEQ ID NO: 26383 - RNA, 64 nt, hsa
caacuaguagauuccugaggucccccuagcuuaaaaaaaaaaaaaaucugccccaugauucuaa

SEQ ID NO: 26384 - RNA, 64 nt, hsa
aacuaguagauuccugaggucccccuagcuuaaaaaaaaaaaaaaucugccccaugauucuaac

SEQ ID NO: 26385 - RNA, 64 nt, hsa
acuaguagauuccugaggucccccuagcuuaaaaaaaaaaaaaaucugccccaugauucuaaca

SEQ ID NO: 26386 - RNA, 64 nt, hsa
cuaguagauuccugaggucccccuagcuuaaaaaaaaaaaaaaucugccccaugauucuaacac

SEQ ID NO: 26387 - RNA, 64 nt, hsa
uaguagauuccugaggucccccuagcuuaaaaaaaaaaaaaaucugccccaugauucuaacacu

SEQ ID NO: 26388 - RNA, 64 nt, hsa
aucugugagauucuguuucauuugagguuuacagaaaaaaaaaaguggccagauguguuccccc

SEQ ID NO: 26389 - RNA, 64 nt, hsa
ucugugagauucuguuucauuugagguuuacagaaaaaaaaaaguggccagauguguucccccc

SEQ ID NO: 26390 - RNA, 64 nt, hsa
cugugagauucuguuucauuugagguuuacagaaaaaaaaaaguggccagauguguucccccca

SEQ ID NO: 26391 - RNA, 64 nt, hsa
uaagcaaauguuucagcccaaugucaacccaguuaaaaaaaaaauuaaugcuguguaaaauggu

SEQ ID NO: 26392 - RNA, 64 nt, hsa
aagcaaauguuucagcccaaugucaacccaguuaaaaaaaaaauuaaugcuguguaaaaugguu

SEQ ID NO: 26393 - RNA, 64 nt, hsa
agcaaauguuucagcccaaugucaacccaguuaaaaaaaaaauuaaugcuguguaaaaugguug

SEQ ID NO: 26394 - RNA, 64 nt, hsa
aguuaaugucuuaauccagcuugcaagugaauggaaaaaaaaauaagcuucaaacuagguauuc

SEQ ID NO: 26395 - RNA, 64 nt, hsa
guuaaugucuuaauccagcuugcaagugaauggaaaaaaaaauaagcuucaaacuagguauucu

SEQ ID NO: 26396 - RNA, 64 nt, hsa
acuguacuccagccugggcaacagagaccaucuuaaaaaaaaaaaauccuuccauugaauagaa

SEQ ID NO: 26397 - RNA, 64 nt, hsa
cuguacuccagccugggcaacagagaccaucuuaaaaaaaaaaaauccuuccauugaauagaaa

SEQ ID NO: 26398 - RNA, 64 nt, hsa
uguacuccagccugggcaacagagaccaucuuaaaaaaaaaaaauccuuccauugaauagaaac

SEQ ID NO: 26399 - RNA, 64 nt, hsa
guacuccagccugggcaacagagaccaucuuaaaaaaaaaaaauccuuccauugaauagaaacu

SEQ ID NO: 26400 - RNA, 64 nt, hsa
uacuccagccugggcaacagagaccaucuuaaaaaaaaaaaauccuuccauugaauagaaacuu

SEQ ID NO: 26401 - RNA, 64 nt, hsa
uccagccuggcaacagagcgagacucugucucagaaaaaaaaaacaaaaaccaguuuaggcugg

SEQ ID NO: 26402 - RNA, 64 nt, hsa
ccagccuggcaacagagcgagacucugucucagaaaaaaaaaacaaaaaccaguuuaggcuggg

SEQ ID NO: 26403 - RNA, 64 nt, hsa
cagccuggcaacagagcgagacucugucucagaaaaaaaaaacaaaaaccaguuuaggcugggu

SEQ ID NO: 26404 - RNA, 64 nt, hsa
uuauuuaagaaguuaaauacaaggaguaaaacuuaaaaaaaaaauacaaagcccaaagcuuucc

SEQ ID NO: 26405 - RNA, 64 nt, hsa
uauuuaagaaguuaaauacaaggaguaaaacuuaaaaaaaaaauacaaagcccaaagcuuuccc

SEQ ID NO: 26406 - RNA, 64 nt, hsa
auuuaagaaguuaaauacaaggaguaaaacuuaaaaaaaaaauacaaagcccaaagcuuuccca

SEQ ID NO: 26407 - RNA, 64 nt, hsa
cuuaaggcuuuuuuaaaaaacaaaacaaaacaacaaaaaaaaaucuuuauaagaaagagaacug

SEQ ID NO: 26408 - RNA, 64 nt, hsa
uuaaggcuuuuuuaaaaaacaaaacaaaacaacaaaaaaaaaucuuuauaagaaagagaacuga

SEQ ID NO: 26409 - RNA, 64 nt, hsa
gaaugucaggucuuaaggcauuuaauugagggacaaaaaaaaaaaaagccgauauaguagcuag

SEQ ID NO: 26410 - RNA, 64 nt, hsa
aaugucaggucuuaaggcauuuaauugagggacaaaaaaaaaaaaagccgauauaguagcuagc

SEQ ID NO: 26411 - RNA, 64 nt, hsa
augucaggucuuaaggcauuuaauugagggacaaaaaaaaaaaaagccgauauaguagcuagcu

SEQ ID NO: 26412 - RNA, 64 nt, hsa
ugucaggucuuaaggcauuuaauugagggacaaaaaaaaaaaaagccgauauaguagcuagcua

SEQ ID NO: 26413 - RNA, 64 nt, hsa
gucaggucuuaaggcauuuaauugagggacaaaaaaaaaaaaagccgauauaguagcuagcuac

SEQ ID NO: 26414 - RNA, 64 nt, hsa
ucaggucuuaaggcauuuaauugagggacaaaaaaaaaaaaagccgauauaguagcuagcuacu

SEQ ID NO: 26415 - RNA, 64 nt, hsa
cagccugguugacagagugacccuugucuccaagaaaaaaaaaaagcaaaugggauuaaggacu

SEQ ID NO: 26416 - RNA, 64 nt, hsa
agccugguugacagagugacccuugucuccaagaaaaaaaaaaagcaaaugggauuaaggacuc

SEQ ID NO: 26417 - RNA, 64 nt, hsa
gccugguugacagagugacccuugucuccaagaaaaaaaaaaagcaaaugggauuaaggacuca

SEQ ID NO: 26418 - RNA, 64 nt, hsa
ccugguugacagagugacccuugucuccaagaaaaaaaaaaagcaaaugggauuaaggacucau

SEQ ID NO: 26419 - RNA, 64 nt, hsa
guaaagcagacuccccuuucagcaaccucaaagcaaaaaaaaaaaaaaaaaaaccaguuagcug

SEQ ID NO: 26420 - RNA, 64 nt, hsa
uaaagcagacuccccuuucagcaaccucaaagcaaaaaaaaaaaaaaaaaaaccaguuagcugc

SEQ ID NO: 26421 - RNA, 64 nt, hsa
aaagcagacuccccuuucagcaaccucaaagcaaaaaaaaaaaaaaaaaaaccaguuagcugcu

SEQ ID NO: 26422 - RNA, 64 nt, hsa
aagcagacuccccuuucagcaaccucaaagcaaaaaaaaaaaaaaaaaaaccaguuagcugcua

SEQ ID NO: 26423 - RNA, 64 nt, hsa
agcagacuccccuuucagcaaccucaaagcaaaaaaaaaaaaaaaaaaaccaguuagcugcuau

SEQ ID NO: 26424 - RNA, 64 nt, hsa
gcagacuccccuuucagcaaccucaaagcaaaaaaaaaaaaaaaaaaaccaguuagcugcuaua

SEQ ID NO: 26425 - RNA, 64 nt, hsa
cagacuccccuuucagcaaccucaaagcaaaaaaaaaaaaaaaaaaaccaguuagcugcuauau

SEQ ID NO: 26426 - RNA, 64 nt, hsa
agacuccccuuucagcaaccucaaagcaaaaaaaaaaaaaaaaaaaccaguuagcugcuauaua

SEQ ID NO: 26427 - RNA, 64 nt, hsa
gacuccccuuucagcaaccucaaagcaaaaaaaaaaaaaaaaaaaccaguuagcugcuauauaa

SEQ ID NO: 26428 - RNA, 64 nt, hsa
acuccccuuucagcaaccucaaagcaaaaaaaaaaaaaaaaaaaccaguuagcugcuauauaaa

SEQ ID NO: 26429 - RNA, 64 nt, hsa
cuccccuuucagcaaccucaaagcaaaaaaaaaaaaaaaaaaaccaguuagcugcuauauaaac

SEQ ID NO: 26430 - RNA, 64 nt, hsa
uccccuuucagcaaccucaaagcaaaaaaaaaaaaaaaaaaaccaguuagcugcuauauaaaca

SEQ ID NO: 26431 - RNA, 64 nt, hsa
gaccagccugagcaacacagugaaaacccaucucaaaaaaaaaaaaaaaaaaccaaaaaaacug

SEQ ID NO: 26432 - RNA, 64 nt, hsa
accagccugagcaacacagugaaaacccaucucaaaaaaaaaaaaaaaaaaccaaaaaaacugu

SEQ ID NO: 26433 - RNA, 64 nt, hsa
ccagccugagcaacacagugaaaacccaucucaaaaaaaaaaaaaaaaaaccaaaaaaacuguc

SEQ ID NO: 26434 - RNA, 64 nt, hsa
cagccugagcaacacagugaaaacccaucucaaaaaaaaaaaaaaaaaaccaaaaaaacugucc

SEQ ID NO: 26435 - RNA, 64 nt, hsa
agccugagcaacacagugaaaacccaucucaaaaaaaaaaaaaaaaaaccaaaaaaacugucca

SEQ ID NO: 26436 - RNA, 64 nt, hsa
gccugagcaacacagugaaaacccaucucaaaaaaaaaaaaaaaaaaccaaaaaaacuguccag

SEQ ID NO: 26437 - RNA, 64 nt, hsa
ccugagcaacacagugaaaacccaucucaaaaaaaaaaaaaaaaaaccaaaaaaacuguccagc

SEQ ID NO: 26438 - RNA, 64 nt, hsa
cugagcaacacagugaaaacccaucucaaaaaaaaaaaaaaaaaaccaaaaaaacuguccagcu

SEQ ID NO: 26439 - RNA, 64 nt, hsa
ugagcaacacagugaaaacccaucucaaaaaaaaaaaaaaaaaaccaaaaaaacuguccagcug

SEQ ID NO: 26440 - RNA, 64 nt, hsa
gagcaacacagugaaaacccaucucaaaaaaaaaaaaaaaaaaccaaaaaaacuguccagcugu

SEQ ID NO: 26441 - RNA, 64 nt, hsa
agcaacacagugaaaacccaucucaaaaaaaaaaaaaaaaaaccaaaaaaacuguccagcugug

SEQ ID NO: 26442 - RNA, 64 nt, hsa
cuugaagaccuagaacauagaagaaugccuaguuaaaaaaaaaaaucaaugaaacuacgaguuu

SEQ ID NO: 26443 - RNA, 64 nt, hsa
uugaagaccuagaacauagaagaaugccuaguuaaaaaaaaaaaucaaugaaacuacgaguuuu

SEQ ID NO: 26444 - RNA, 64 nt, hsa
ugaagaccuagaacauagaagaaugccuaguuaaaaaaaaaaaucaaugaaacuacgaguuuua

SEQ ID NO: 26445 - RNA, 64 nt, hsa
gaagaccuagaacauagaagaaugccuaguuaaaaaaaaaaaucaaugaaacuacgaguuuuag

SEQ ID NO: 26446 - RNA, 64 nt, hsa
aacuugaguucauguuuuauaugaaauauuuaccaaaaaaaaaaaaugagguaaacuguauuua

SEQ ID NO: 26447 - RNA, 64 nt, hsa
acuugaguucauguuuuauaugaaauauuuaccaaaaaaaaaaaaugagguaaacuguauuuaa

SEQ ID NO: 26448 - RNA, 64 nt, hsa
cuugaguucauguuuuauaugaaauauuuaccaaaaaaaaaaaaugagguaaacuguauuuaaa

SEQ ID NO: 26449 - RNA, 64 nt, hsa
uugaguucauguuuuauaugaaauauuuaccaaaaaaaaaaaaugagguaaacuguauuuaaaa

SEQ ID NO: 26450 - RNA, 64 nt, hsa
ugaguucauguuuuauaugaaauauuuaccaaaaaaaaaaaaugagguaaacuguauuuaaaac

SEQ ID NO: 26451 - RNA, 64 nt, hsa
uggaaaaaagaaaacaaccacccccccacugcccaaaaaaaaaagcccugcccuguugcucgug

SEQ ID NO: 26452 - RNA, 64 nt, hsa
ggaaaaaagaaaacaaccacccccccacugcccaaaaaaaaaagcccugcccuguugcucgugg

SEQ ID NO: 26453 - RNA, 64 nt, hsa
gaaaaaagaaaacaaccacccccccacugcccaaaaaaaaaagcccugcccuguugcucguggg

SEQ ID NO: 26454 - RNA, 64 nt, hsa
ugcaccguuacgcugugauggcaacuggggauagaaaaaaaauggggaaagacaggaauccuaa

SEQ ID NO: 26455 - RNA, 64 nt, hsa
caacagggaugcaaauugguucuucaguaaggauaaaaaaaaaucacaagcaguuguuuguggc

SEQ ID NO: 26456 - RNA, 64 nt, hsa
aacagggaugcaaauugguucuucaguaaggauaaaaaaaaaucacaagcaguuguuuguggcc

SEQ ID NO: 26457 - RNA, 64 nt, hsa
ccaggcaacaagagugaaacccugucucaaaaagaaaaaaaaaguugaccuugagaauuuauaa

SEQ ID NO: 26458 - RNA, 64 nt, hsa
caggcaacaagagugaaacccugucucaaaaagaaaaaaaaaguugaccuugagaauuuauaau

SEQ ID NO: 26459 - RNA, 64 nt, hsa
cuccagccugggugacagagcgagacuccauuucaaaaaaaaaaaaaaaaaaaaaaaaucacuu

SEQ ID NO: 26460 - RNA, 64 nt, hsa
uccagccugggugacagagcgagacuccauuucaaaaaaaaaaaaaaaaaaaaaaaaucacuug

SEQ ID NO: 26461 - RNA, 64 nt, hsa
ccagccugggugacagagcgagacuccauuucaaaaaaaaaaaaaaaaaaaaaaaaucacuugu

SEQ ID NO: 26462 - RNA, 64 nt, hsa
cagccugggugacagagcgagacuccauuucaaaaaaaaaaaaaaaaaaaaaaaaucacuugua

SEQ ID NO: 26463 - RNA, 64 nt, hsa
agccugggugacagagcgagacuccauuucaaaaaaaaaaaaaaaaaaaaaaaaucacuuguag

SEQ ID NO: 26464 - RNA, 64 nt, hsa
gccugggugacagagcgagacuccauuucaaaaaaaaaaaaaaaaaaaaaaaaucacuuguagu

SEQ ID NO: 26465 - RNA, 64 nt, hsa
ccugggugacagagcgagacuccauuucaaaaaaaaaaaaaaaaaaaaaaaaucacuuguaguc

SEQ ID NO: 26466 - RNA, 64 nt, hsa
cugggugacagagcgagacuccauuucaaaaaaaaaaaaaaaaaaaaaaaaucacuuguagucu

SEQ ID NO: 26467 - RNA, 64 nt, hsa
ugggugacagagcgagacuccauuucaaaaaaaaaaaaaaaaaaaaaaaaucacuuguagucuu

SEQ ID NO: 26468 - RNA, 64 nt, hsa
gggugacagagcgagacuccauuucaaaaaaaaaaaaaaaaaaaaaaaaucacuuguagucuug

SEQ ID NO: 26469 - RNA, 64 nt, hsa
ggugacagagcgagacuccauuucaaaaaaaaaaaaaaaaaaaaaaaaucacuuguagucuugg

SEQ ID NO: 26470 - RNA, 64 nt, hsa
gugacagagcgagacuccauuucaaaaaaaaaaaaaaaaaaaaaaaaucacuuguagucuuggu

SEQ ID NO: 26471 - RNA, 64 nt, hsa
ugacagagcgagacuccauuucaaaaaaaaaaaaaaaaaaaaaaaaucacuuguagucuuggug

SEQ ID NO: 26472 - RNA, 64 nt, hsa
gacagagcgagacuccauuucaaaaaaaaaaaaaaaaaaaaaaaaucacuuguagucuuggugu

SEQ ID NO: 26473 - RNA, 64 nt, hsa
acagagcgagacuccauuucaaaaaaaaaaaaaaaaaaaaaaaaucacuuguagucuuggugug

SEQ ID NO: 26474 - RNA, 64 nt, hsa
cagagcgagacuccauuucaaaaaaaaaaaaaaaaaaaaaaaaucacuuguagucuuggugugg

SEQ ID NO: 26475 - RNA, 64 nt, hsa
agagcgagacuccauuucaaaaaaaaaaaaaaaaaaaaaaaaucacuuguagucuugguguggu

SEQ ID NO: 26476 - RNA, 64 nt, hsa
cugggcaacauggcuaaacucugucucuauuaagaaaaaaaauguuaacauuaugauuuaaaag

SEQ ID NO: 26477 - RNA, 64 nt, hsa
agaacugugaaaaauaaauuuguuauuuaaaaagaaaaaaaaaaaaacaaaaaccugaguuucu

SEQ ID NO: 26478 - RNA, 64 nt, hsa
gaacugugaaaaauaaauuuguuauuuaaaaagaaaaaaaaaaaaacaaaaaccugaguuucuu

SEQ ID NO: 26479 - RNA, 64 nt, hsa
aacugugaaaaauaaauuuguuauuuaaaaagaaaaaaaaaaaaacaaaaaccugaguuucuua

SEQ ID NO: 26480 - RNA, 64 nt, hsa
acugugaaaaauaaauuuguuauuuaaaaagaaaaaaaaaaaaacaaaaaccugaguuucuuag

SEQ ID NO: 26481 - RNA, 64 nt, hsa
cugugaaaaauaaauuuguuauuuaaaaagaaaaaaaaaaaaacaaaaaccugaguuucuuagu

SEQ ID NO: 26482 - RNA, 63 nt, hsa
ugugaaaaauaaauuuguuauuuaaaaagaaaaaaaaaaaaacaaaaaccugaguuucuuagu

SEQ ID NO: 26483 - RNA, 63 nt, hsa
cacuggcugcagcaccuugauguaaagaccauuaaaaaaaaaacagaggaagguauuucuaau

SEQ ID NO: 26484 - RNA, 64 nt, hsa
cacuggcugcagcaccuugauguaaagaccauuaaaaaaaaaacagaggaagguauuucuaauu

SEQ ID NO: 26485 - RNA, 64 nt, hsa
acuggcugcagcaccuugauguaaagaccauuaaaaaaaaaacagaggaagguauuucuaauuc

SEQ ID NO: 26486 - RNA, 64 nt, hsa
ugggaagggaagacaggguuaaggaacuuuauuuaaaaaaaaaauauuuuuuuccuaaaaacua

SEQ ID NO: 26487 - RNA, 64 nt, hsa
gggaagggaagacaggguuaaggaacuuuauuuaaaaaaaaaauauuuuuuuccuaaaaacuau

SEQ ID NO: 26488 - RNA, 64 nt, hsa
ggaagggaagacaggguuaaggaacuuuauuuaaaaaaaaaauauuuuuuuccuaaaaacuaua

SEQ ID NO: 26489 - RNA, 64 nt, hsa
gagggaggguucaugaaccagguggauccucuuuaaaaaaaaaaaaguuuuuguuauaucucua

SEQ ID NO: 26490 - RNA, 64 nt, hsa
agggaggguucaugaaccagguggauccucuuuaaaaaaaaaaaaguuuuuguuauaucucuag

SEQ ID NO: 26491 - RNA, 64 nt, hsa
gggaggguucaugaaccagguggauccucuuuaaaaaaaaaaaaguuuuuguuauaucucuaga

SEQ ID NO: 26492 - RNA, 64 nt, hsa
ggaggguucaugaaccagguggauccucuuuaaaaaaaaaaaaguuuuuguuauaucucuagaa

SEQ ID NO: 26493 - RNA, 64 nt, hsa
gaggguucaugaaccagguggauccucuuuaaaaaaaaaaaaguuuuuguuauaucucuagaac

SEQ ID NO: 26494 - RNA, 64 nt, hsa
gccugggugauaggaugagacuccaucucaggggaaaaaaaaaaauuuuuuuuucacugacuaa

SEQ ID NO: 26495 - RNA, 64 nt, hsa
ccugggugauaggaugagacuccaucucaggggaaaaaaaaaaauuuuuuuuucacugacuaaa

SEQ ID NO: 26496 - RNA, 64 nt, hsa
cugggugauaggaugagacuccaucucaggggaaaaaaaaaaauuuuuuuuucacugacuaaac

SEQ ID NO: 26497 - RNA, 64 nt, hsa
ugggugauaggaugagacuccaucucaggggaaaaaaaaaaauuuuuuuuucacugacuaaacc

SEQ ID NO: 26498 - RNA, 64 nt, hsa
uaccagguugccuaaaucaugugcagaugguucuaaaaaaaaaaaaaaaaaaaaaaaaaaaagg

SEQ ID NO: 26499 - RNA, 64 nt, hsa
accagguugccuaaaucaugugcagaugguucuaaaaaaaaaaaaaaaaaaaaaaaaaaaagga

SEQ ID NO: 26500 - RNA, 64 nt, hsa
ccagguugccuaaaucaugugcagaugguucuaaaaaaaaaaaaaaaaaaaaaaaaaaaaggaa

SEQ ID NO: 26501 - RNA, 64 nt, hsa
cagguugccuaaaucaugugcagaugguucuaaaaaaaaaaaaaaaaaaaaaaaaaaaaggaaa

SEQ ID NO: 26502 - RNA, 64 nt, hsa
agguugccuaaaucaugugcagaugguucuaaaaaaaaaaaaaaaaaaaaaaaaaaaaggaaaa

SEQ ID NO: 26503 - RNA, 64 nt, hsa
gguugccuaaaucaugugcagaugguucuaaaaaaaaaaaaaaaaaaaaaaaaaaaaggaaaaa

SEQ ID NO: 26504 - RNA, 64 nt, hsa
guugccuaaaucaugugcagaugguucuaaaaaaaaaaaaaaaaaaaaaaaaaaaaggaaaaaa

SEQ ID NO: 26505 - RNA, 64 nt, hsa
uugccuaaaucaugugcagaugguucuaaaaaaaaaaaaaaaaaaaaaaaaaaaaggaaaaaaa

SEQ ID NO: 26506 - RNA, 64 nt, hsa
ugccuaaaucaugugcagaugguucuaaaaaaaaaaaaaaaaaaaaaaaaaaaaggaaaaaaaa

SEQ ID NO: 26507 - RNA, 64 nt, hsa
gccuaaaucaugugcagaugguucuaaaaaaaaaaaaaaaaaaaaaaaaaaaaggaaaaaaaaa

SEQ ID NO: 26508 - RNA, 64 nt, hsa
ccuaaaucaugugcagaugguucuaaaaaaaaaaaaaaaaaaaaaaaaaaaaggaaaaaaaaaa

SEQ ID NO: 26509 - RNA, 64 nt, hsa
cuaaaucaugugcagaugguucuaaaaaaaaaaaaaaaaaaaaaaaaaaaaggaaaaaaaaaaa

SEQ ID NO: 26510 - RNA, 64 nt, hsa
uaaaucaugugcagaugguucuaaaaaaaaaaaaaaaaaaaaaaaaaaaaggaaaaaaaaaaag

SEQ ID NO: 26511 - RNA, 64 nt, hsa
aaaucaugugcagaugguucuaaaaaaaaaaaaaaaaaaaaaaaaaaaaggaaaaaaaaaaaga

SEQ ID NO: 26512 - RNA, 64 nt, hsa
aaucaugugcagaugguucuaaaaaaaaaaaaaaaaaaaaaaaaaaaaggaaaaaaaaaaagaa

SEQ ID NO: 26513 - RNA, 64 nt, hsa
aucaugugcagaugguucuaaaaaaaaaaaaaaaaaaaaaaaaaaaaggaaaaaaaaaaagaaa

SEQ ID NO: 26514 - RNA, 64 nt, hsa
ucaugugcagaugguucuaaaaaaaaaaaaaaaaaaaaaaaaaaaaggaaaaaaaaaaagaaaa

SEQ ID NO: 26515 - RNA, 64 nt, hsa
caugugcagaugguucuaaaaaaaaaaaaaaaaaaaaaaaaaaaaggaaaaaaaaaaagaaaaa

SEQ ID NO: 26516 - RNA, 64 nt, hsa
augugcagaugguucuaaaaaaaaaaaaaaaaaaaaaaaaaaaaggaaaaaaaaaaagaaaaag

SEQ ID NO: 26517 - RNA, 64 nt, hsa
ugugcagaugguucuaaaaaaaaaaaaaaaaaaaaaaaaaaaaggaaaaaaaaaaagaaaaaga

SEQ ID NO: 26518 - RNA, 64 nt, hsa
gugcagaugguucuaaaaaaaaaaaaaaaaaaaaaaaaaaaaggaaaaaaaaaaagaaaaagaa

SEQ ID NO: 26519 - RNA, 64 nt, hsa
uucuaaaaaaaaaaaaaaaaaaaaaaaaaaaaggaaaaaaaaaaagaaaaagaaaacgugugca

SEQ ID NO: 26520 - RNA, 64 nt, hsa
ucuaaaaaaaaaaaaaaaaaaaaaaaaaaaaggaaaaaaaaaaagaaaaagaaaacgugugcau

SEQ ID NO: 26521 - RNA, 64 nt, hsa
cuaaaaaaaaaaaaaaaaaaaaaaaaaaaaggaaaaaaaaaaagaaaaagaaaacgugugcauu

SEQ ID NO: 26522 - RNA, 64 nt, hsa
uaaaaaaaaaaaaaaaaaaaaaaaaaaaaggaaaaaaaaaaagaaaaagaaaacgugugcauuu

SEQ ID NO: 26523 - RNA, 64 nt, hsa
uugaagcuccaugucuguaagucaaauguuacacaaaaaaaaaugcaaaugguguuucauugga

SEQ ID NO: 26524 - RNA, 64 nt, hsa
ugaagcuccaugucuguaagucaaauguuacacaaaaaaaaaugcaaaugguguuucauuggaa

SEQ ID NO: 26525 - RNA, 64 nt, hsa
ugucaguguuaaaaugcuucucccugaaaaagagaaaaaaaaaaggaaaaaaagaaaagaaaag

SEQ ID NO: 26526 - RNA, 64 nt, hsa
gucaguguuaaaaugcuucucccugaaaaagagaaaaaaaaaaggaaaaaaagaaaagaaaagu

SEQ ID NO: 26527 - RNA, 64 nt, hsa
ucaguguuaaaaugcuucucccugaaaaagagaaaaaaaaaaggaaaaaaagaaaagaaaagug

SEQ ID NO: 26528 - RNA, 64 nt, hsa
cccuuauccauuuguugacauguagacuguuuacaaaaaaaaaacacaugguuaaauguuaaau

SEQ ID NO: 26529 - RNA, 64 nt, hsa
ccuuauccauuuguugacauguagacuguuuacaaaaaaaaaacacaugguuaaauguuaaauu

SEQ ID NO: 26530 - RNA, 64 nt, hsa
cuuauccauuuguugacauguagacuguuuacaaaaaaaaaacacaugguuaaauguuaaauuu

SEQ ID NO: 26531 - RNA, 64 nt, hsa
ugcacuccagccugggcaacggagacucugucucaaaaaaaaaaaaaaaaaagaugaaugaaaa

SEQ ID NO: 26532 - RNA, 64 nt, hsa
gcacuccagccugggcaacggagacucugucucaaaaaaaaaaaaaaaaaagaugaaugaaaau

SEQ ID NO: 26533 - RNA, 64 nt, hsa
cacuccagccugggcaacggagacucugucucaaaaaaaaaaaaaaaaaagaugaaugaaaaua

SEQ ID NO: 26534 - RNA, 64 nt, hsa
acuccagccugggcaacggagacucugucucaaaaaaaaaaaaaaaaaagaugaaugaaaauau

SEQ ID NO: 26535 - RNA, 64 nt, hsa
cuccagccugggcaacggagacucugucucaaaaaaaaaaaaaaaaaagaugaaugaaaauaug

SEQ ID NO: 26536 - RNA, 64 nt, hsa
uccagccugggcaacggagacucugucucaaaaaaaaaaaaaaaaaagaugaaugaaaauauga

SEQ ID NO: 26537 - RNA, 64 nt, hsa
ccagccugggcaacggagacucugucucaaaaaaaaaaaaaaaaaagaugaaugaaaauaugaa

SEQ ID NO: 26538 - RNA, 64 nt, hsa
cagccugggcaacggagacucugucucaaaaaaaaaaaaaaaaaagaugaaugaaaauaugaaa

SEQ ID NO: 26539 - RNA, 64 nt, hsa
agccugggcaacggagacucugucucaaaaaaaaaaaaaaaaaagaugaaugaaaauaugaaau

SEQ ID NO: 26540 - RNA, 64 nt, hsa
gccugggcaacggagacucugucucaaaaaaaaaaaaaaaaaagaugaaugaaaauaugaaaua

SEQ ID NO: 26541 - RNA, 64 nt, hsa
ccugggcaacggagacucugucucaaaaaaaaaaaaaaaaaagaugaaugaaaauaugaaauau

SEQ ID NO: 26542 - RNA, 64 nt, hsa
uuaucuuggaagaauugcauaaggcuuaugacuuaaaaaaaaaaauucuuuuuggaaacacaag

SEQ ID NO: 26543 - RNA, 64 nt, hsa
uaucuuggaagaauugcauaaggcuuaugacuuaaaaaaaaaaauucuuuuuggaaacacaagc

SEQ ID NO: 26544 - RNA, 64 nt, hsa
aucuuggaagaauugcauaaggcuuaugacuuaaaaaaaaaaauucuuuuuggaaacacaagca

SEQ ID NO: 26545 - RNA, 64 nt, hsa
ucuuggaagaauugcauaaggcuuaugacuuaaaaaaaaaaauucuuuuuggaaacacaagcau

SEQ ID NO: 26546 - RNA, 64 nt, hsa
gagacuucaucucuacaaaaaaagcaacaacgacaaaaaaaauuagccaagcauaguggcacac

SEQ ID NO: 26547 - RNA, 64 nt, hsa
caaucugggcaacauggggaaaccccagcucuacaaaaaaaauuagccuggugugguggcacau

SEQ ID NO: 26548 - RNA, 64 nt, hsa
auuugcugugaagauugaaaaugaacaaaguuagaaaaaaaaacagcaaaaucagugauuuagu

SEQ ID NO: 26549 - RNA, 64 nt, hsa
uuugcugugaagauugaaaaugaacaaaguuagaaaaaaaaacagcaaaaucagugauuuaguc

SEQ ID NO: 26550 - RNA, 64 nt, hsa
gccauaaugcugcucgcaggaaauggcauuuuacaaaaaaaaaaugaagaacucaaaaaaacuu

SEQ ID NO: 26551 - RNA, 64 nt, hsa
ccauaaugcugcucgcaggaaauggcauuuuacaaaaaaaaaaugaagaacucaaaaaaacuuu

SEQ ID NO: 26552 - RNA, 64 nt, hsa
cauaaugcugcucgcaggaaauggcauuuuacaaaaaaaaaaugaagaacucaaaaaaacuuug

SEQ ID NO: 26553 - RNA, 64 nt, hsa
uauaagcugaauaaauuuagagcuuucaaacuggaaaaaaaaaugaaacaaaacaaauacacca

SEQ ID NO: 26554 - RNA, 64 nt, hsa
auaagcugaauaaauuuagagcuuucaaacuggaaaaaaaaaugaaacaaaacaaauacaccaa

SEQ ID NO: 26555 - RNA, 64 nt, hsa
ccuccucaauuuuguauuuuuaaaaguacaugguaaaaaaaaaaauucacaacaguauauaagg

SEQ ID NO: 26556 - RNA, 64 nt, hsa
cuccucaauuuuguauuuuuaaaaguacaugguaaaaaaaaaaauucacaacaguauauaaggc

SEQ ID NO: 26557 - RNA, 64 nt, hsa
uccucaauuuuguauuuuuaaaaguacaugguaaaaaaaaaaauucacaacaguauauaaggcu

SEQ ID NO: 26558 - RNA, 64 nt, hsa
ccucaauuuuguauuuuuaaaaguacaugguaaaaaaaaaaauucacaacaguauauaaggcug

SEQ ID NO: 26559 - RNA, 50 nt, hsa
gaagauuuagccacuuauaaaaaaaaaaaaaaggaugaucaaaacacaca

SEQ ID NO: 26560 - RNA, 51 nt, hsa
gaagauuuagccacuuauaaaaaaaaaaaaaaggaugaucaaaacacacag

SEQ ID NO: 26561 - RNA, 52 nt, hsa
gaagauuuagccacuuauaaaaaaaaaaaaaaggaugaucaaaacacacagu

SEQ ID NO: 26562 - RNA, 53 nt, hsa
gaagauuuagccacuuauaaaaaaaaaaaaaaggaugaucaaaacacacagug

SEQ ID NO: 26563 - RNA, 54 nt, hsa
gaagauuuagccacuuauaaaaaaaaaaaaaaggaugaucaaaacacacagugu

SEQ ID NO: 26564 - RNA, 64 nt, hsa
agaaaaauucuuacccuaaaacuuaaaguauaauaaaaaaaaaaaaacuucaguuuucuaaaaa

SEQ ID NO: 26565 - RNA, 64 nt, hsa
gaaaaauucuuacccuaaaacuuaaaguauaauaaaaaaaaaaaaacuucaguuuucuaaaaau

SEQ ID NO: 26566 - RNA, 64 nt, hsa
aaaaauucuuacccuaaaacuuaaaguauaauaaaaaaaaaaaaacuucaguuuucuaaaaauu

SEQ ID NO: 26567 - RNA, 64 nt, hsa
aaaauucuuacccuaaaacuuaaaguauaauaaaaaaaaaaaaacuucaguuuucuaaaaauua

SEQ ID NO: 26568 - RNA, 64 nt, hsa
aaauucuuacccuaaaacuuaaaguauaauaaaaaaaaaaaaacuucaguuuucuaaaaauuau

SEQ ID NO: 26569 - RNA, 64 nt, hsa
aauucuuacccuaaaacuuaaaguauaauaaaaaaaaaaaaacuucaguuuucuaaaaauuaua

SEQ ID NO: 26570 - RNA, 64 nt, hsa
gagaucaaagaugaaaaguauauugauaaccuugaaaaaaaacaguggaucacaaaguggaacg

SEQ ID NO: 26571 - RNA, 64 nt, hsa
gaacgaaaaugaaagcuacucauagcgggggccuaaaaaaaaaaagcuucacaguacccaaacu

SEQ ID NO: 26572 - RNA, 64 nt, hsa
aacgaaaaugaaagcuacucauagcgggggccuaaaaaaaaaaagcuucacaguacccaaacug

SEQ ID NO: 26573 - RNA, 64 nt, hsa
acgaaaaugaaagcuacucauagcgggggccuaaaaaaaaaaagcuucacaguacccaaacugc

SEQ ID NO: 26574 - RNA, 64 nt, hsa
cgaaaaugaaagcuacucauagcgggggccuaaaaaaaaaaagcuucacaguacccaaacugcu

SEQ ID NO: 26575 - RNA, 64 nt, hsa
gauacuuugacaguguuuuuagaccuguguuacuaaaaaaaagaugaauguccugaaaagggug

SEQ ID NO: 26576 - RNA, 64 nt, hsa
ucaaauccagacagauguuguacuuccaucaugcaaaaaaaaagcuccugcugaaacuccugug

SEQ ID NO: 26577 - RNA, 64 nt, hsa
caaauccagacagauguuguacuuccaucaugcaaaaaaaaagcuccugcugaaacuccuguga

SEQ ID NO: 26578 - RNA, 64 nt, hsa
ggauccuuucuguuuugcugcaaccauauuccuuaaaaaaaaaaaaaaaaaaaaaaaaaaaauc

SEQ ID NO: 26579 - RNA, 64 nt, hsa
gauccuuucuguuuugcugcaaccauauuccuuaaaaaaaaaaaaaaaaaaaaaaaaaaaaucc

SEQ ID NO: 26580 - RNA, 64 nt, hsa
auccuuucuguuuugcugcaaccauauuccuuaaaaaaaaaaaaaaaaaaaaaaaaaaaaucca

SEQ ID NO: 26581 - RNA, 64 nt, hsa
uccuuucuguuuugcugcaaccauauuccuuaaaaaaaaaaaaaaaaaaaaaaaaaaaauccac

SEQ ID NO: 26582 - RNA, 64 nt, hsa
ccuuucuguuuugcugcaaccauauuccuuaaaaaaaaaaaaaaaaaaaaaaaaaaaauccaca

SEQ ID NO: 26583 - RNA, 64 nt, hsa
cuuucuguuuugcugcaaccauauuccuuaaaaaaaaaaaaaaaaaaaaaaaaaaaauccacac

SEQ ID NO: 26584 - RNA, 64 nt, hsa
uuucuguuuugcugcaaccauauuccuuaaaaaaaaaaaaaaaaaaaaaaaaaaaauccacacc

SEQ ID NO: 26585 - RNA, 64 nt, hsa
uucuguuuugcugcaaccauauuccuuaaaaaaaaaaaaaaaaaaaaaaaaaaaauccacaccg

SEQ ID NO: 26586 - RNA, 64 nt, hsa
ucuguuuugcugcaaccauauuccuuaaaaaaaaaaaaaaaaaaaaaaaaaaaauccacaccgu

SEQ ID NO: 26587 - RNA, 64 nt, hsa
cuguuuugcugcaaccauauuccuuaaaaaaaaaaaaaaaaaaaaaaaaaaaauccacaccguc

SEQ ID NO: 26588 - RNA, 64 nt, hsa
uguuuugcugcaaccauauuccuuaaaaaaaaaaaaaaaaaaaaaaaaaaaauccacaccgucc

SEQ ID NO: 26589 - RNA, 64 nt, hsa
guuuugcugcaaccauauuccuuaaaaaaaaaaaaaaaaaaaaaaaaaaaauccacaccguccu

SEQ ID NO: 26590 - RNA, 64 nt, hsa
uuuugcugcaaccauauuccuuaaaaaaaaaaaaaaaaaaaaaaaaaaaauccacaccguccuu

SEQ ID NO: 26591 - RNA, 64 nt, hsa
uuugcugcaaccauauuccuuaaaaaaaaaaaaaaaaaaaaaaaaaaaauccacaccguccuug

SEQ ID NO: 26592 - RNA, 64 nt, hsa
uugcugcaaccauauuccuuaaaaaaaaaaaaaaaaaaaaaaaaaaaauccacaccguccuugg

SEQ ID NO: 26593 - RNA, 64 nt, hsa
ugcugcaaccauauuccuuaaaaaaaaaaaaaaaaaaaaaaaaaaaauccacaccguccuugga

SEQ ID NO: 26594 - RNA, 64 nt, hsa
gcugcaaccauauuccuuaaaaaaaaaaaaaaaaaaaaaaaaaaaauccacaccguccuuggaa

SEQ ID NO: 26595 - RNA, 64 nt, hsa
cugcaaccauauuccuuaaaaaaaaaaaaaaaaaaaaaaaaaaaauccacaccguccuuggaaa

SEQ ID NO: 26596 - RNA, 64 nt, hsa
ugcaaccauauuccuuaaaaaaaaaaaaaaaaaaaaaaaaaaaauccacaccguccuuggaaag

SEQ ID NO: 26597 - RNA, 64 nt, hsa
gcaaccauauuccuuaaaaaaaaaaaaaaaaaaaaaaaaaaaauccacaccguccuuggaaagc

SEQ ID NO: 26598 - RNA, 64 nt, hsa
caaccauauuccuuaaaaaaaaaaaaaaaaaaaaaaaaaaaauccacaccguccuuggaaagca

SEQ ID NO: 26599 - RNA, 64 nt, hsa
auuuguuuuguuaaagucaaaaaucucauuuuccaaaaaaaaaaaaaaaacccaguuacugcuc

SEQ ID NO: 26600 - RNA, 64 nt, hsa
uuuguuuuguuaaagucaaaaaucucauuuuccaaaaaaaaaaaaaaaacccaguuacugcuca

SEQ ID NO: 26601 - RNA, 64 nt, hsa
uuguuuuguuaaagucaaaaaucucauuuuccaaaaaaaaaaaaaaaacccaguuacugcucag

SEQ ID NO: 26602 - RNA, 64 nt, hsa
uguuuuguuaaagucaaaaaucucauuuuccaaaaaaaaaaaaaaaacccaguuacugcucagu

SEQ ID NO: 26603 - RNA, 64 nt, hsa
guuuuguuaaagucaaaaaucucauuuuccaaaaaaaaaaaaaaaacccaguuacugcucaguu

SEQ ID NO: 26604 - RNA, 64 nt, hsa
uuuuguuaaagucaaaaaucucauuuuccaaaaaaaaaaaaaaaacccaguuacugcucaguuu

SEQ ID NO: 26605 - RNA, 64 nt, hsa
uuuguuaaagucaaaaaucucauuuuccaaaaaaaaaaaaaaaacccaguuacugcucaguuua

SEQ ID NO: 26606 - RNA, 64 nt, hsa
uuguuaaagucaaaaaucucauuuuccaaaaaaaaaaaaaaaacccaguuacugcucaguuuag

SEQ ID NO: 26607 - RNA, 64 nt, hsa
uguuaaagucaaaaaucucauuuuccaaaaaaaaaaaaaaaacccaguuacugcucaguuuagu

SEQ ID NO: 26608 - RNA, 64 nt, hsa
acuccagcuugggcaacagggcgagaccuuguuuaaaaaaaaaauucaauauugggguuggaac

SEQ ID NO: 26609 - RNA, 64 nt, hsa
cuccagcuugggcaacagggcgagaccuuguuuaaaaaaaaaauucaauauugggguuggaaca

SEQ ID NO: 26610 - RNA, 64 nt, hsa
uccagcuugggcaacagggcgagaccuuguuuaaaaaaaaaauucaauauugggguuggaacau

SEQ ID NO: 26611 - RNA, 64 nt, hsa
augucuucagccucauaauaaaggaaaguuaauuaaaaaaaaaaagcaaagagccauuuugucc

SEQ ID NO: 26612 - RNA, 64 nt, hsa
ugucuucagccucauaauaaaggaaaguuaauuaaaaaaaaaaagcaaagagccauuuuguccu

SEQ ID NO: 26613 - RNA, 64 nt, hsa
gucuucagccucauaauaaaggaaaguuaauuaaaaaaaaaaagcaaagagccauuuuguccug

SEQ ID NO: 26614 - RNA, 64 nt, hsa
ucuucagccucauaauaaaggaaaguuaauuaaaaaaaaaaagcaaagagccauuuuguccugu

SEQ ID NO: 26615 - RNA, 64 nt, hsa
gcaucauuuaaacaugcagaagauguuuaaaaauaaaaaaaaaacugcuuuauccuccugucag

SEQ ID NO: 26616 - RNA, 64 nt, hsa
caucauuuaaacaugcagaagauguuuaaaaauaaaaaaaaaacugcuuuauccuccugucagc

SEQ ID NO: 26617 - RNA, 64 nt, hsa
aucauuuaaacaugcagaagauguuuaaaaauaaaaaaaaaacugcuuuauccuccugucagca

SEQ ID NO: 26618 - RNA, 64 nt, hsa
uaaauucuuaaaacuuucuaaaugcauaauuggcaaaaaaaaaaacccacuguuaccaguguag

SEQ ID NO: 26619 - RNA, 64 nt, hsa
aaauucuuaaaacuuucuaaaugcauaauuggcaaaaaaaaaaacccacuguuaccaguguagg

SEQ ID NO: 26620 - RNA, 64 nt, hsa
aauucuuaaaacuuucuaaaugcauaauuggcaaaaaaaaaaacccacuguuaccaguguagga

SEQ ID NO: 26621 - RNA, 64 nt, hsa
auucuuaaaacuuucuaaaugcauaauuggcaaaaaaaaaaacccacuguuaccaguguaggaa

SEQ ID NO: 26622 - RNA, 64 nt, hsa
cacugcagccuaggcgacagagcaagacugccucaaaaaaaaaacauaaaaauucagucacuau

SEQ ID NO: 26623 - RNA, 64 nt, hsa
acugcagccuaggcgacagagcaagacugccucaaaaaaaaaacauaaaaauucagucacuaua

SEQ ID NO: 26624 - RNA, 64 nt, hsa
cugcagccuaggcgacagagcaagacugccucaaaaaaaaaacauaaaaauucagucacuauac

SEQ ID NO: 26625 - RNA, 64 nt, hsa
gcaaucuguuuuuuaaccaccucugaagaaguucaaaaaaaauuauaugaagagauaaaccaag

SEQ ID NO: 26626 - RNA, 64 nt, hsa
ucauuguuaaauugauugaggaaaacaaccauuuaaaaaaaaucuauguugaauccuuuuauaa

SEQ ID NO: 26627 - RNA, 64 nt, hsa
uucacuaagcucgauaaaucuaacaguuacucuuaaaaaaaaaaaaaaaagacuaagguggauu

SEQ ID NO: 26628 - RNA, 64 nt, hsa
ucacuaagcucgauaaaucuaacaguuacucuuaaaaaaaaaaaaaaaagacuaagguggauuu

SEQ ID NO: 26629 - RNA, 64 nt, hsa
cacuaagcucgauaaaucuaacaguuacucuuaaaaaaaaaaaaaaaagacuaagguggauuuu

SEQ ID NO: 26630 - RNA, 64 nt, hsa
acuaagcucgauaaaucuaacaguuacucuuaaaaaaaaaaaaaaaagacuaagguggauuuua

SEQ ID NO: 26631 - RNA, 64 nt, hsa
cuaagcucgauaaaucuaacaguuacucuuaaaaaaaaaaaaaaaagacuaagguggauuuuaa

SEQ ID NO: 26632 - RNA, 64 nt, hsa
uaagcucgauaaaucuaacaguuacucuuaaaaaaaaaaaaaaaagacuaagguggauuuuaaa

SEQ ID NO: 26633 - RNA, 64 nt, hsa
aagcucgauaaaucuaacaguuacucuuaaaaaaaaaaaaaaaagacuaagguggauuuuaaaa

SEQ ID NO: 26634 - RNA, 64 nt, hsa
agcucgauaaaucuaacaguuacucuuaaaaaaaaaaaaaaaagacuaagguggauuuuaaaaa

SEQ ID NO: 26635 - RNA, 64 nt, hsa
gcucgauaaaucuaacaguuacucuuaaaaaaaaaaaaaaaagacuaagguggauuuuaaaaau

SEQ ID NO: 26636 - RNA, 64 nt, hsa
caacggggugaaacccugucucuacuaaaaauacaaaaaaaaaaaaaaauuagccgggcguggu

SEQ ID NO: 26637 - RNA, 64 nt, hsa
aacggggugaaacccugucucuacuaaaaauacaaaaaaaaaaaaaaauuagccgggcguggug

SEQ ID NO: 26638 - RNA, 64 nt, hsa
acggggugaaacccugucucuacuaaaaauacaaaaaaaaaaaaaaauuagccgggcguggugg

SEQ ID NO: 26639 - RNA, 64 nt, hsa
cggggugaaacccugucucuacuaaaaauacaaaaaaaaaaaaaaauuagccgggcgugguggu

SEQ ID NO: 26640 - RNA, 64 nt, hsa
ggggugaaacccugucucuacuaaaaauacaaaaaaaaaaaaaaauuagccgggcgugguggug

SEQ ID NO: 26641 - RNA, 64 nt, hsa
gggugaaacccugucucuacuaaaaauacaaaaaaaaaaaaaaauuagccgggcguggugguga

SEQ ID NO: 26642 - RNA, 64 nt, hsa
ggugaaacccugucucuacuaaaaauacaaaaaaaaaaaaaaauuagccgggcgugguggugag

SEQ ID NO: 26643 - RNA, 64 nt, hsa
gugaaacccugucucuacuaaaaauacaaaaaaaaaaaaaaauuagccgggcgugguggugagu

SEQ ID NO: 26644 - RNA, 64 nt, hsa
ggucaauuuuguuauguauauuuuauaucaauuuaaaaaaaaaccugagccccaaaagguauuu

SEQ ID NO: 26645 - RNA, 64 nt, hsa
gucaauuuuguuauguauauuuuauaucaauuuaaaaaaaaaccugagccccaaaagguauuuu

SEQ ID NO: 26646 - RNA, 64 nt, hsa
ugugcuugcaaagacuucauaguucccaagaauuaaaaaaaaaaaaaaaagaauuccacuugau

SEQ ID NO: 26647 - RNA, 64 nt, hsa
gugcuugcaaagacuucauaguucccaagaauuaaaaaaaaaaaaaaaagaauuccacuugauc

SEQ ID NO: 26648 - RNA, 64 nt, hsa
ugcuugcaaagacuucauaguucccaagaauuaaaaaaaaaaaaaaaagaauuccacuugauca

SEQ ID NO: 26649 - RNA, 64 nt, hsa
gcuugcaaagacuucauaguucccaagaauuaaaaaaaaaaaaaaaagaauuccacuugaucaa

SEQ ID NO: 26650 - RNA, 64 nt, hsa
cuugcaaagacuucauaguucccaagaauuaaaaaaaaaaaaaaaagaauuccacuugaucaac

SEQ ID NO: 26651 - RNA, 64 nt, hsa
uugcaaagacuucauaguucccaagaauuaaaaaaaaaaaaaaaagaauuccacuugaucaacu

SEQ ID NO: 26652 - RNA, 64 nt, hsa
ugcaaagacuucauaguucccaagaauuaaaaaaaaaaaaaaaagaauuccacuugaucaacuu

SEQ ID NO: 26653 - RNA, 64 nt, hsa
gcaaagacuucauaguucccaagaauuaaaaaaaaaaaaaaaagaauuccacuugaucaacuua

SEQ ID NO: 26654 - RNA, 64 nt, hsa
caaagacuucauaguucccaagaauuaaaaaaaaaaaaaaaagaauuccacuugaucaacuuaa

SEQ ID NO: 26655 - RNA, 59 nt, hsa
agacucuuguuuuaaaaugacuugacuauaaaaaaaaauuaaaaaauaaaaauaaauga

SEQ ID NO: 26656 - RNA, 60 nt, hsa
agacucuuguuuuaaaaugacuugacuauaaaaaaaaauuaaaaaauaaaaauaaaugac

SEQ ID NO: 26657 - RNA, 64 nt, hsa
ucucaguuacuguaggcaucaaaaggcaaaaaucaaaaaaaaaaaaaacaaaaacaaaaaaaaa

SEQ ID NO: 26658 - RNA, 64 nt, hsa
cucaguuacuguaggcaucaaaaggcaaaaaucaaaaaaaaaaaaaacaaaaacaaaaaaaaag

SEQ ID NO: 26659 - RNA, 64 nt, hsa
ucaguuacuguaggcaucaaaaggcaaaaaucaaaaaaaaaaaaaacaaaaacaaaaaaaaaga

SEQ ID NO: 26660 - RNA, 64 nt, hsa
caguuacuguaggcaucaaaaggcaaaaaucaaaaaaaaaaaaaacaaaaacaaaaaaaaagau

SEQ ID NO: 26661 - RNA, 64 nt, hsa
aguuacuguaggcaucaaaaggcaaaaaucaaaaaaaaaaaaaacaaaaacaaaaaaaaagaug

SEQ ID NO: 26662 - RNA, 64 nt, hsa
guuacuguaggcaucaaaaggcaaaaaucaaaaaaaaaaaaaacaaaaacaaaaaaaaagauga

SEQ ID NO: 26663 - RNA, 64 nt, hsa
uuacuguaggcaucaaaaggcaaaaaucaaaaaaaaaaaaaacaaaaacaaaaaaaaagaugaa

SEQ ID NO: 26664 - RNA, 64 nt, hsa
aaaggcaaaaaucaaaaaaaaaaaaaacaaaaacaaaaaaaaagaugaaccuaggucuguguaa

SEQ ID NO: 26665 - RNA, 64 nt, hsa
aaggcaaaaaucaaaaaaaaaaaaaacaaaaacaaaaaaaaagaugaaccuaggucuguguaaa

SEQ ID NO: 26666 - RNA, 64 nt, hsa
uauuccuuuguuacuucucuaauucuuccuuuguaaaaaaaaaaaaaagcaacacuuuuuaugu

SEQ ID NO: 26667 - RNA, 64 nt, hsa
auuccuuuguuacuucucuaauucuuccuuuguaaaaaaaaaaaaaagcaacacuuuuuauguu

SEQ ID NO: 26668 - RNA, 64 nt, hsa
uuccuuuguuacuucucuaauucuuccuuuguaaaaaaaaaaaaaagcaacacuuuuuauguua

SEQ ID NO: 26669 - RNA, 64 nt, hsa
uccuuuguuacuucucuaauucuuccuuuguaaaaaaaaaaaaaagcaacacuuuuuauguuau

SEQ ID NO: 26670 - RNA, 64 nt, hsa
ccuuuguuacuucucuaauucuuccuuuguaaaaaaaaaaaaaagcaacacuuuuuauguuaua

SEQ ID NO: 26671 - RNA, 64 nt, hsa
cuuuguuacuucucuaauucuuccuuuguaaaaaaaaaaaaaagcaacacuuuuuauguuauau

SEQ ID NO: 26672 - RNA, 64 nt, hsa
uuuguuacuucucuaauucuuccuuuguaaaaaaaaaaaaaagcaacacuuuuuauguuauaug

SEQ ID NO: 26673 - RNA, 64 nt, hsa
caggcacuguacuaaccuacagagaugcuaagagaaaaaaaagacuuguuucugaucuaauauc

SEQ ID NO: 26674 - RNA, 64 nt, hsa
aaagcugaucauguuuugcuacaguuugcaggugaaaaaaaauaaauauuauaaaauaugcuau

SEQ ID NO: 26675 - RNA, 64 nt, hsa
ugcaaaaggccuauuuuaacuauugauuuuuuuuaaaaaaaauugucuuugaauguauuggaag

SEQ ID NO: 26676 - RNA, 64 nt, hsa
uuguucuguuaacugaaugccacucuguaauugcaaaaaaaaaaaacaguugcagcuguuuugu

SEQ ID NO: 26677 - RNA, 64 nt, hsa
uguucuguuaacugaaugccacucuguaauugcaaaaaaaaaaaacaguugcagcuguuuuguu

SEQ ID NO: 26678 - RNA, 64 nt, hsa
guucuguuaacugaaugccacucuguaauugcaaaaaaaaaaaacaguugcagcuguuuuguug

SEQ ID NO: 26679 - RNA, 64 nt, hsa
uucuguuaacugaaugccacucuguaauugcaaaaaaaaaaaacaguugcagcuguuuuguuga

SEQ ID NO: 26680 - RNA, 64 nt, hsa
ucuguuaacugaaugccacucuguaauugcaaaaaaaaaaaacaguugcagcuguuuuguugac

SEQ ID NO: 26681 - RNA, 64 nt, hsa
aaucugugugaaauaaggcaaucuagucuccuugaaaaaaaaaucucuuggauguuuaggaagg

SEQ ID NO: 26682 - RNA, 64 nt, hsa
aucugugugaaauaaggcaaucuagucuccuugaaaaaaaaaucucuuggauguuuaggaagga

SEQ ID NO: 26683 - RNA, 64 nt, hsa
gaugacuagacagcaaaaaaggaaaaguuaaacuaaaaaaaaaaaggccgccgugaccuauuca

SEQ ID NO: 26684 - RNA, 64 nt, hsa
augacuagacagcaaaaaaggaaaaguuaaacuaaaaaaaaaaaggccgccgugaccuauucac

SEQ ID NO: 26685 - RNA, 64 nt, hsa
ugacuagacagcaaaaaaggaaaaguuaaacuaaaaaaaaaaaggccgccgugaccuauucacc

SEQ ID NO: 26686 - RNA, 64 nt, hsa
gacuagacagcaaaaaaggaaaaguuaaacuaaaaaaaaaaaggccgccgugaccuauucaccc

SEQ ID NO: 26687 - RNA, 64 nt, hsa
uggugugaccauguucauuauaaucucaaaggagaaaaaaaaccuuguaaaaaaagcaaaaaug

SEQ ID NO: 26688 - RNA, 64 nt, hsa
uccagucuuguugauuguaauuugacgugaagagaaaaaaaaauuccuccugcgugagccaagg

SEQ ID NO: 26689 - RNA, 64 nt, hsa
ccagucuuguugauuguaauuugacgugaagagaaaaaaaaauuccuccugcgugagccaaggc

SEQ ID NO: 26690 - RNA, 64 nt, hsa
ugaaauaaaaaaaagauggguuuuguaaaaauaaaaaaaaaauauuuuuagcagaacaggacuu

SEQ ID NO: 26691 - RNA, 64 nt, hsa
augaaauaaaaaaaagauggguuuuguaaaaauaaaaaaaaaauauuuuuagcagaacaggacu

SEQ ID NO: 26692 - RNA, 64 nt, hsa
uaugaaauaaaaaaaagauggguuuuguaaaaauaaaaaaaaaauauuuuuagcagaacaggac

SEQ ID NO: 26693 - RNA, 64 nt, hsa
aguacagacguacuuuaaauuuuuguuaugaaauaaaaaaaagauggguuuuguaaaaauaaaa

SEQ ID NO: 26694 - RNA, 64 nt, hsa
uggggaaggaucauaagaaaggaaauacuuuuuaaaaaaaaauuuggaaacauguaacaaagca

SEQ ID NO: 26695 - RNA, 64 nt, hsa
cuggggaaggaucauaagaaaggaaauacuuuuuaaaaaaaaauuuggaaacauguaacaaagc

SEQ ID NO: 26696 - RNA, 64 nt, hsa
ccaacuuuucuaagugagcuuagcaaugagaagaaaaaaaaacaugaauucuuuuucuggaaaa

SEQ ID NO: 26697 - RNA, 64 nt, hsa
cccaacuuuucuaagugagcuuagcaaugagaagaaaaaaaaacaugaauucuuuuucuggaaa

SEQ ID NO: 26698 - RNA, 64 nt, hsa
caugccagggcucugcgccgucaugugagacuuaaaaaaaaaguugaaugacuucgugauacuu

SEQ ID NO: 26699 - RNA, 64 nt, hsa
ccaugccagggcucugcgccgucaugugagacuuaaaaaaaaaguugaaugacuucgugauacu

SEQ ID NO: 26700 - RNA, 64 nt, hsa
gcaggcuggcacauccauauuuguauggaaaaaaaaaaaaaagacccuacgcuaccacuucaaa

SEQ ID NO: 26701 - RNA, 64 nt, hsa
ggcaggcuggcacauccauauuuguauggaaaaaaaaaaaaaagacccuacgcuaccacuucaa

SEQ ID NO: 26702 - RNA, 64 nt, hsa
uggcaggcuggcacauccauauuuguauggaaaaaaaaaaaaaagacccuacgcuaccacuuca

SEQ ID NO: 26703 - RNA, 64 nt, hsa
cuggcaggcuggcacauccauauuuguauggaaaaaaaaaaaaaagacccuacgcuaccacuuc

SEQ ID NO: 26704 - RNA, 64 nt, hsa
ccuggcaggcuggcacauccauauuuguauggaaaaaaaaaaaaaagacccuacgcuaccacuu

SEQ ID NO: 26705 - RNA, 64 nt, hsa
gccuggcaggcuggcacauccauauuuguauggaaaaaaaaaaaaaagacccuacgcuaccacu

SEQ ID NO: 26706 - RNA, 64 nt, hsa
ggccuggcaggcuggcacauccauauuuguauggaaaaaaaaaaaaaagacccuacgcuaccac

SEQ ID NO: 26707 - RNA, 64 nt, hsa
agcucugaaucaguuuuuuaaaaaaaagaaaaaaaaaaaaaaggagcugugccccauugaacaa

SEQ ID NO: 26708 - RNA, 64 nt, hsa
aagcucugaaucaguuuuuuaaaaaaaagaaaaaaaaaaaaaaggagcugugccccauugaaca

SEQ ID NO: 26709 - RNA, 64 nt, hsa
caagcucugaaucaguuuuuuaaaaaaaagaaaaaaaaaaaaaaggagcugugccccauugaac

SEQ ID NO: 26710 - RNA, 64 nt, hsa
gcaagcucugaaucaguuuuuuaaaaaaaagaaaaaaaaaaaaaaggagcugugccccauugaa

SEQ ID NO: 26711 - RNA, 64 nt, hsa
ugcaagcucugaaucaguuuuuuaaaaaaaagaaaaaaaaaaaaaaggagcugugccccauuga

SEQ ID NO: 26712 - RNA, 64 nt, hsa
cugcaagcucugaaucaguuuuuuaaaaaaaagaaaaaaaaaaaaaaggagcugugccccauug

SEQ ID NO: 26713 - RNA, 64 nt, hsa
acugcaagcucugaaucaguuuuuuaaaaaaaagaaaaaaaaaaaaaaggagcugugccccauu

SEQ ID NO: 26714 - RNA, 64 nt, hsa
uaagcagccacugcaagcucugaaucaguuuuuuaaaaaaaagaaaaaaaaaaaaaaggagcug

SEQ ID NO: 26715 - RNA, 64 nt, hsa
ggcaacauaguaagaucuugucucuuaaagaaaaaaaaaaaagguacuuagaggucgcacuuaa

SEQ ID NO: 26716 - RNA, 64 nt, hsa
gggcaacauaguaagaucuugucucuuaaagaaaaaaaaaaaagguacuuagaggucgcacuua

SEQ ID NO: 26717 - RNA, 64 nt, hsa
ugggcaacauaguaagaucuugucucuuaaagaaaaaaaaaaaagguacuuagaggucgcacuu

SEQ ID NO: 26718 - RNA, 64 nt, hsa
cugggcaacauaguaagaucuugucucuuaaagaaaaaaaaaaaagguacuuagaggucgcacu

SEQ ID NO: 26719 - RNA, 64 nt, hsa
ccugggcaacauaguaagaucuugucucuuaaagaaaaaaaaaaaagguacuuagaggucgcac

SEQ ID NO: 26720 - RNA, 64 nt, hsa
ucuagguaucucaagugauaaguaaauuucuacaaaaaaaaaugguuaauguucauugacuggc

SEQ ID NO: 26721 - RNA, 64 nt, hsa
cucuagguaucucaagugauaaguaaauuucuacaaaaaaaaaugguuaauguucauugacugg

SEQ ID NO: 26722 - RNA, 64 nt, hsa
ccagcuggagaaauaugguacucauuaaaaaaaaaaaaaaaagugauguacaaccacuucggaa

SEQ ID NO: 26723 - RNA, 64 nt, hsa
gccagcuggagaaauaugguacucauuaaaaaaaaaaaaaaaagugauguacaaccacuucgga

SEQ ID NO: 26724 - RNA, 64 nt, hsa
agccagcuggagaaauaugguacucauuaaaaaaaaaaaaaaaagugauguacaaccacuucgg

SEQ ID NO: 26725 - RNA, 64 nt, hsa
aagccagcuggagaaauaugguacucauuaaaaaaaaaaaaaaaagugauguacaaccacuucg

SEQ ID NO: 26726 - RNA, 64 nt, hsa
caagccagcuggagaaauaugguacucauuaaaaaaaaaaaaaaaagugauguacaaccacuuc

SEQ ID NO: 26727 - RNA, 64 nt, hsa
acaagccagcuggagaaauaugguacucauuaaaaaaaaaaaaaaaagugauguacaaccacuu

SEQ ID NO: 26728 - RNA, 64 nt, hsa
uacaagccagcuggagaaauaugguacucauuaaaaaaaaaaaaaaaagugauguacaaccacu

SEQ ID NO: 26729 - RNA, 64 nt, hsa
uuacaagccagcuggagaaauaugguacucauuaaaaaaaaaaaaaaaagugauguacaaccac

SEQ ID NO: 26730 - RNA, 64 nt, hsa
cuuacaagccagcuggagaaauaugguacucauuaaaaaaaaaaaaaaaagugauguacaacca

SEQ ID NO: 26731 - RNA, 64 nt, hsa
aaaaacacugauuuuuuuuuaaccugccaaaaauaaaaaaaagcucauuuuauaauuuucuacu

SEQ ID NO: 26732 - RNA, 64 nt, hsa
uagaagcuucaaagauuaaaucaaauuaauuuucaaaaaaaauuuuuuuuuagaaauguuauuu

SEQ ID NO: 26733 - RNA, 64 nt, hsa
acuaucguugcccaccgaauuugagguagcaaaaaaaaaaaagaauguucugguacaugaacag

SEQ ID NO: 26734 - RNA, 64 nt, hsa
aacuaucguugcccaccgaauuugagguagcaaaaaaaaaaaagaauguucugguacaugaaca

SEQ ID NO: 26735 - RNA, 64 nt, hsa
uaacuaucguugcccaccgaauuugagguagcaaaaaaaaaaaagaauguucugguacaugaac

SEQ ID NO: 26736 - RNA, 64 nt, hsa
uuaacuaucguugcccaccgaauuugagguagcaaaaaaaaaaaagaauguucugguacaugaa

SEQ ID NO: 26737 - RNA, 64 nt, hsa
guuaacuaucguugcccaccgaauuugagguagcaaaaaaaaaaaagaauguucugguacauga

SEQ ID NO: 26738 - RNA, 64 nt, hsa
aaaauaaaaauagaaaauugcaaaaaaaaaaaaaaaaaaaaaucucagacuguuuuaagaaagu

SEQ ID NO: 26739 - RNA, 64 nt, hsa
aaaaauaaaaauagaaaauugcaaaaaaaaaaaaaaaaaaaaaucucagacuguuuuaagaaag

SEQ ID NO: 26740 - RNA, 64 nt, hsa
aaaaaauaaaaauagaaaauugcaaaaaaaaaaaaaaaaaaaaaucucagacuguuuuaagaaa

SEQ ID NO: 26741 - RNA, 64 nt, hsa
aaaaaaauaaaaauagaaaauugcaaaaaaaaaaaaaaaaaaaaaucucagacuguuuuaagaa

SEQ ID NO: 26742 - RNA, 64 nt, hsa
uaaaaaaauaaaaauagaaaauugcaaaaaaaaaaaaaaaaaaaaaucucagacuguuuuaaga

SEQ ID NO: 26743 - RNA, 64 nt, hsa
uuaaaaaaauaaaaauagaaaauugcaaaaaaaaaaaaaaaaaaaaaucucagacuguuuuaag

SEQ ID NO: 26744 - RNA, 64 nt, hsa
cuuaaaaaaauaaaaauagaaaauugcaaaaaaaaaaaaaaaaaaaaaucucagacuguuuuaa

SEQ ID NO: 26745 - RNA, 64 nt, hsa
gcuuaaaaaaauaaaaauagaaaauugcaaaaaaaaaaaaaaaaaaaaaucucagacuguuuua

SEQ ID NO: 26746 - RNA, 64 nt, hsa
agcuuaaaaaaauaaaaauagaaaauugcaaaaaaaaaaaaaaaaaaaaaucucagacuguuuu

SEQ ID NO: 26747 - RNA, 64 nt, hsa
gagcuuaaaaaaauaaaaauagaaaauugcaaaaaaaaaaaaaaaaaaaaaucucagacuguuu

SEQ ID NO: 26748 - RNA, 64 nt, hsa
ugagcuuaaaaaaauaaaaauagaaaauugcaaaaaaaaaaaaaaaaaaaaaucucagacuguu

SEQ ID NO: 26749 - RNA, 64 nt, hsa
augagcuuaaaaaaauaaaaauagaaaauugcaaaaaaaaaaaaaaaaaaaaaucucagacugu

SEQ ID NO: 26750 - RNA, 64 nt, hsa
gaugagcuuaaaaaaauaaaaauagaaaauugcaaaaaaaaaaaaaaaaaaaaaucucagacug

SEQ ID NO: 26751 - RNA, 64 nt, hsa
ugaugagcuuaaaaaaauaaaaauagaaaauugcaaaaaaaaaaaaaaaaaaaaaucucagacu

SEQ ID NO: 26752 - RNA, 64 nt, hsa
auauguagccuuuacuguuugauauaccaaauuaaaaaaaaauuguaucucauuacuuauacug

SEQ ID NO: 26753 - RNA, 64 nt, hsa
uauauguagccuuuacuguuugauauaccaaauuaaaaaaaaauuguaucucauuacuuauacu

SEQ ID NO: 26754 - RNA, 64 nt, hsa
uaauguacugauuucaguaagucucauagguuaaaaaaaaaagucaccaaauagugugaaauau

SEQ ID NO: 26755 - RNA, 64 nt, hsa
auaauguacugauuucaguaagucucauagguuaaaaaaaaaagucaccaaauagugugaaaua

SEQ ID NO: 26756 - RNA, 64 nt, hsa
cauaauguacugauuucaguaagucucauagguuaaaaaaaaaagucaccaaauagugugaaau

SEQ ID NO: 26757 - RNA, 64 nt, hsa
caaaguacagaauuugaauuaucagcaaagaaaaaaaaaaaagccagccaagcuuuaaauuaug

SEQ ID NO: 26758 - RNA, 64 nt, hsa
ccaaaguacagaauuugaauuaucagcaaagaaaaaaaaaaaagccagccaagcuuuaaauuau

SEQ ID NO: 26759 - RNA, 64 nt, hsa
gccaaaguacagaauuugaauuaucagcaaagaaaaaaaaaaaagccagccaagcuuuaaauua

SEQ ID NO: 26760 - RNA, 64 nt, hsa
ugccaaaguacagaauuugaauuaucagcaaagaaaaaaaaaaaagccagccaagcuuuaaauu

SEQ ID NO: 26761 - RNA, 64 nt, hsa
uugccaaaguacagaauuugaauuaucagcaaagaaaaaaaaaaaagccagccaagcuuuaaau

SEQ ID NO: 26762 - RNA, 64 nt, hsa
accuuuauuacaauuucaaagcuacacuucauuaaaaaaaaaucuaaaaugguugaucucaugu

SEQ ID NO: 26763 - RNA, 64 nt, hsa
caccuuuauuacaauuucaaagcuacacuucauuaaaaaaaaaucuaaaaugguugaucucaug

SEQ ID NO: 26764 - RNA, 64 nt, hsa
uuuuaccaggcauucucuagccuugguacaaaaaaaaaaaaaccugcugguugcgcagauaccu

SEQ ID NO: 26765 - RNA, 64 nt, hsa
cuuuuaccaggcauucucuagccuugguacaaaaaaaaaaaaaccugcugguugcgcagauacc

SEQ ID NO: 26766 - RNA, 64 nt, hsa
gcuuuuaccaggcauucucuagccuugguacaaaaaaaaaaaaaccugcugguugcgcagauac

SEQ ID NO: 26767 - RNA, 64 nt, hsa
agcuuuuaccaggcauucucuagccuugguacaaaaaaaaaaaaaccugcugguugcgcagaua

SEQ ID NO: 26768 - RNA, 64 nt, hsa
aagcuuuuaccaggcauucucuagccuugguacaaaaaaaaaaaaaccugcugguugcgcagau

SEQ ID NO: 26769 - RNA, 64 nt, hsa
caagcuuuuaccaggcauucucuagccuugguacaaaaaaaaaaaaaccugcugguugcgcaga

SEQ ID NO: 26770 - RNA, 64 nt, hsa
cagggcaguugugauacgaauagaacaaaaaaaaaaaaaaaacacuuaaacuuuguuaggacuc

SEQ ID NO: 26771 - RNA, 64 nt, hsa
acagggcaguugugauacgaauagaacaaaaaaaaaaaaaaaacacuuaaacuuuguuaggacu

SEQ ID NO: 26772 - RNA, 64 nt, hsa
aacagggcaguugugauacgaauagaacaaaaaaaaaaaaaaaacacuuaaacuuuguuaggac

SEQ ID NO: 26773 - RNA, 64 nt, hsa
caacagggcaguugugauacgaauagaacaaaaaaaaaaaaaaaacacuuaaacuuuguuagga

SEQ ID NO: 26774 - RNA, 64 nt, hsa
acaacagggcaguugugauacgaauagaacaaaaaaaaaaaaaaaacacuuaaacuuuguuagg

SEQ ID NO: 26775 - RNA, 64 nt, hsa
cacaacagggcaguugugauacgaauagaacaaaaaaaaaaaaaaaacacuuaaacuuuguuag

SEQ ID NO: 26776 - RNA, 64 nt, hsa
ucacaacagggcaguugugauacgaauagaacaaaaaaaaaaaaaaaacacuuaaacuuuguua

SEQ ID NO: 26777 - RNA, 64 nt, hsa
uucacaacagggcaguugugauacgaauagaacaaaaaaaaaaaaaaaacacuuaaacuuuguu

SEQ ID NO: 26778 - RNA, 64 nt, hsa
auucacaacagggcaguugugauacgaauagaacaaaaaaaaaaaaaaaacacuuaaacuuugu

SEQ ID NO: 26779 - RNA, 64 nt, hsa
uauuucauagucuuacuuccaauugaguuagcaaaaaaaaaauuaauaacuugagacuuuuaag

SEQ ID NO: 26780 - RNA, 64 nt, hsa
auauuucauagucuuacuuccaauugaguuagcaaaaaaaaaauuaauaacuugagacuuuuaa

SEQ ID NO: 26781 - RNA, 64 nt, hsa
aauauuucauagucuuacuuccaauugaguuagcaaaaaaaaaauuaauaacuugagacuuuua

SEQ ID NO: 26782 - RNA, 64 nt, hsa
guaacugcauuauugaauuguucuuaaaccuguaaaaaaaaauuaccuguaccaguaauuuuaa

SEQ ID NO: 26783 - RNA, 64 nt, hsa
aguaacugcauuauugaauuguucuuaaaccuguaaaaaaaaauuaccuguaccaguaauuuua

SEQ ID NO: 26784 - RNA, 64 nt, hsa
aacuagccuucccaguaaaaaaaaaaaaaaaaaaaaaaaaaauuguaaacaucacuuauauuac

SEQ ID NO: 26785 - RNA, 64 nt, hsa
caacuagccuucccaguaaaaaaaaaaaaaaaaaaaaaaaaaauuguaaacaucacuuauauua

SEQ ID NO: 26786 - RNA, 64 nt, hsa
acaacuagccuucccaguaaaaaaaaaaaaaaaaaaaaaaaaaauuguaaacaucacuuauauu

SEQ ID NO: 26787 - RNA, 64 nt, hsa
uacaacuagccuucccaguaaaaaaaaaaaaaaaaaaaaaaaaaauuguaaacaucacuuauau

SEQ ID NO: 26788 - RNA, 64 nt, hsa
uuacaacuagccuucccaguaaaaaaaaaaaaaaaaaaaaaaaaaauuguaaacaucacuuaua

SEQ ID NO: 26789 - RNA, 64 nt, hsa
uuuacaacuagccuucccaguaaaaaaaaaaaaaaaaaaaaaaaaaauuguaaacaucacuuau

SEQ ID NO: 26790 - RNA, 64 nt, hsa
guuuacaacuagccuucccaguaaaaaaaaaaaaaaaaaaaaaaaaaauuguaaacaucacuua

SEQ ID NO: 26791 - RNA, 64 nt, hsa
uguuuacaacuagccuucccaguaaaaaaaaaaaaaaaaaaaaaaaaaauuguaaacaucacuu

SEQ ID NO: 26792 - RNA, 64 nt, hsa
auguuuacaacuagccuucccaguaaaaaaaaaaaaaaaaaaaaaaaaaauuguaaacaucacu

SEQ ID NO: 26793 - RNA, 64 nt, hsa
uauguuuacaacuagccuucccaguaaaaaaaaaaaaaaaaaaaaaaaaaauuguaaacaucac

SEQ ID NO: 26794 - RNA, 64 nt, hsa
uuauguuuacaacuagccuucccaguaaaaaaaaaaaaaaaaaaaaaaaaaauuguaaacauca

SEQ ID NO: 26795 - RNA, 64 nt, hsa
uuuauguuuacaacuagccuucccaguaaaaaaaaaaaaaaaaaaaaaaaaaauuguaaacauc

SEQ ID NO: 26796 - RNA, 64 nt, hsa
guuuauguuuacaacuagccuucccaguaaaaaaaaaaaaaaaaaaaaaaaaaauuguaaacau

SEQ ID NO: 26797 - RNA, 64 nt, hsa
uguuuauguuuacaacuagccuucccaguaaaaaaaaaaaaaaaaaaaaaaaaaauuguaaaca

SEQ ID NO: 26798 - RNA, 64 nt, hsa
auguuuauguuuacaacuagccuucccaguaaaaaaaaaaaaaaaaaaaaaaaaaauuguaaac

SEQ ID NO: 26799 - RNA, 64 nt, hsa
aauguuuauguuuacaacuagccuucccaguaaaaaaaaaaaaaaaaaaaaaaaaaauuguaaa

SEQ ID NO: 26800 - RNA, 64 nt, hsa
gaauguuuauguuuacaacuagccuucccaguaaaaaaaaaaaaaaaaaaaaaaaaaauuguaa

SEQ ID NO: 26801 - RNA, 64 nt, hsa
agaauguuuauguuuacaacuagccuucccaguaaaaaaaaaaaaaaaaaaaaaaaaaauugua

SEQ ID NO: 26802 - RNA, 64 nt, hsa
gagaauguuuauguuuacaacuagccuucccaguaaaaaaaaaaaaaaaaaaaaaaaaaauugu

SEQ ID NO: 26803 - RNA, 64 nt, hsa
gcaaguugcagagaugguggagcuagaaaaaaaaaaaaaaaagcccuuuucaguuugugcacug

SEQ ID NO: 26804 - RNA, 64 nt, hsa
ggcaaguugcagagaugguggagcuagaaaaaaaaaaaaaaaagcccuuuucaguuugugcacu

SEQ ID NO: 26805 - RNA, 64 nt, hsa
uggcaaguugcagagaugguggagcuagaaaaaaaaaaaaaaaagcccuuuucaguuugugcac

SEQ ID NO: 26806 - RNA, 64 nt, hsa
uuggcaaguugcagagaugguggagcuagaaaaaaaaaaaaaaaagcccuuuucaguuugugca

SEQ ID NO: 26807 - RNA, 64 nt, hsa
cuuggcaaguugcagagaugguggagcuagaaaaaaaaaaaaaaaagcccuuuucaguuugugc

SEQ ID NO: 26808 - RNA, 64 nt, hsa
ucuuggcaaguugcagagaugguggagcuagaaaaaaaaaaaaaaaagcccuuuucaguuugug

SEQ ID NO: 26809 - RNA, 64 nt, hsa
aucuuggcaaguugcagagaugguggagcuagaaaaaaaaaaaaaaaagcccuuuucaguuugu

SEQ ID NO: 26810 - RNA, 64 nt, hsa
caucuuggcaaguugcagagaugguggagcuagaaaaaaaaaaaaaaaagcccuuuucaguuug

SEQ ID NO: 26811 - RNA, 64 nt, hsa
gcaucuuggcaaguugcagagaugguggagcuagaaaaaaaaaaaaaaaagcccuuuucaguuu

SEQ ID NO: 26812 - RNA, 64 nt, hsa
ucauacacccauuuugucccuuuauugaaaaaauaaaaaaaauuaaaguacacauuguaagcuu

SEQ ID NO: 26813 - RNA, 64 nt, hsa
aguaaaagaaagaaagaaaaaaaaaggaaaaaaaaaaaaaaaccaauguuuugcaguuuuuuuc

SEQ ID NO: 26814 - RNA, 64 nt, hsa
caguaaaagaaagaaagaaaaaaaaaggaaaaaaaaaaaaaaaccaauguuuugcaguuuuuuu

SEQ ID NO: 26815 - RNA, 64 nt, hsa
gcaguaaaagaaagaaagaaaaaaaaaggaaaaaaaaaaaaaaaccaauguuuugcaguuuuuu

SEQ ID NO: 26816 - RNA, 64 nt, hsa
ugcaguaaaagaaagaaagaaaaaaaaaggaaaaaaaaaaaaaaaccaauguuuugcaguuuuu

SEQ ID NO: 26817 - RNA, 64 nt, hsa
augcaguaaaagaaagaaagaaaaaaaaaggaaaaaaaaaaaaaaaccaauguuuugcaguuuu

SEQ ID NO: 26818 - RNA, 64 nt, hsa
uaugcaguaaaagaaagaaagaaaaaaaaaggaaaaaaaaaaaaaaaccaauguuuugcaguuu

SEQ ID NO: 26819 - RNA, 64 nt, hsa
auaugcaguaaaagaaagaaagaaaaaaaaaggaaaaaaaaaaaaaaaccaauguuuugcaguu

SEQ ID NO: 26820 - RNA, 64 nt, hsa
cauaugcaguaaaagaaagaaagaaaaaaaaaggaaaaaaaaaaaaaaaccaauguuuugcagu

SEQ ID NO: 26821 - RNA, 64 nt, hsa
aucuuaccuucauaugcaguaaaagaaagaaagaaaaaaaaaggaaaaaaaaaaaaaaaccaau

SEQ ID NO: 26822 - RNA, 64 nt, hsa
caucuuaccuucauaugcaguaaaagaaagaaagaaaaaaaaaggaaaaaaaaaaaaaaaccaa

SEQ ID NO: 26823 - RNA, 64 nt, hsa
aauauagugcaaauuauuuguaugcuucaaaaaaaaaaaaaagagagaaacaaaaaagugugac

SEQ ID NO: 26824 - RNA, 64 nt, hsa
uaauauagugcaaauuauuuguaugcuucaaaaaaaaaaaaaagagagaaacaaaaaaguguga

SEQ ID NO: 26825 - RNA, 64 nt, hsa
auaauauagugcaaauuauuuguaugcuucaaaaaaaaaaaaaagagagaaacaaaaaagugug

SEQ ID NO: 26826 - RNA, 64 nt, hsa
gauaauauagugcaaauuauuuguaugcuucaaaaaaaaaaaaaagagagaaacaaaaaagugu

SEQ ID NO: 26827 - RNA, 64 nt, hsa
ggauaauauagugcaaauuauuuguaugcuucaaaaaaaaaaaaaagagagaaacaaaaaagug

SEQ ID NO: 26828 - RNA, 64 nt, hsa
aggauaauauagugcaaauuauuuguaugcuucaaaaaaaaaaaaaagagagaaacaaaaaagu

SEQ ID NO: 26829 - RNA, 64 nt, hsa
caggauaauauagugcaaauuauuuguaugcuucaaaaaaaaaaaaaagagagaaacaaaaaag

SEQ ID NO: 26830 - RNA, 64 nt, hsa
aaaagguaucaauguaccuuuuuugguaguggaaaaaaaaaagacaggcugccacaguauauuu

SEQ ID NO: 26831 - RNA, 64 nt, hsa
uaaaagguaucaauguaccuuuuuugguaguggaaaaaaaaaagacaggcugccacaguauauu

SEQ ID NO: 26832 - RNA, 64 nt, hsa
uuaaaagguaucaauguaccuuuuuugguaguggaaaaaaaaaagacaggcugccacaguauau

SEQ ID NO: 26833 - RNA, 64 nt, hsa
gccuuggauacacaccgcucuucagguuguaaaaaaaaaaaacauacauuggggaaagguuuaa

SEQ ID NO: 26834 - RNA, 64 nt, hsa
ugccuuggauacacaccgcucuucagguuguaaaaaaaaaaaacauacauuggggaaagguuua

SEQ ID NO: 26835 - RNA, 64 nt, hsa
augccuuggauacacaccgcucuucagguuguaaaaaaaaaaaacauacauuggggaaagguuu

SEQ ID NO: 26836 - RNA, 64 nt, hsa
uaugccuuggauacacaccgcucuucagguuguaaaaaaaaaaaacauacauuggggaaagguu

SEQ ID NO: 26837 - RNA, 64 nt, hsa
cuaugccuuggauacacaccgcucuucagguuguaaaaaaaaaaaacauacauuggggaaaggu

SEQ ID NO: 26838 - RNA, 64 nt, hsa
aucucauugaggagcauuuuuuaaaaacuaaaaaaaaaaaaacuuugccagccauuuacuugac

SEQ ID NO: 26839 - RNA, 64 nt, hsa
aaucucauugaggagcauuuuuuaaaaacuaaaaaaaaaaaaacuuugccagccauuuacuuga

SEQ ID NO: 26840 - RNA, 64 nt, hsa
caaucucauugaggagcauuuuuuaaaaacuaaaaaaaaaaaaacuuugccagccauuuacuug

SEQ ID NO: 26841 - RNA, 64 nt, hsa
acaaucucauugaggagcauuuuuuaaaaacuaaaaaaaaaaaaacuuugccagccauuuacuu

SEQ ID NO: 26842 - RNA, 64 nt, hsa
cacaaucucauugaggagcauuuuuuaaaaacuaaaaaaaaaaaaacuuugccagccauuuacu

SEQ ID NO: 26843 - RNA, 64 nt, hsa
acacaaucucauugaggagcauuuuuuaaaaacuaaaaaaaaaaaaacuuugccagccauuuac

SEQ ID NO: 26844 - RNA, 64 nt, hsa
gucuauacuuaagggaaaaguugcaagaaugcugaaaaaaaauugaacacaaucucauugagga

SEQ ID NO: 26845 - RNA, 64 nt, hsa
gauuaacccucuauagacagaauagauagcacugaaaaaaaaucucuaugagcuaaaugucugu

SEQ ID NO: 26846 - RNA, 64 nt, hsa
agacuuaagccuuuuuuuaaguaauuaauacuuaaaaaaaaagauccuggcaucuauuuaugca

SEQ ID NO: 26847 - RNA, 64 nt, hsa
aagacuuaagccuuuuuuuaaguaauuaauacuuaaaaaaaaagauccuggcaucuauuuaugc

SEQ ID NO: 26848 - RNA, 64 nt, hsa
gcagccuucuuaaaugacaaauguaaaaaaaaaaaaaaaaaagacucuacuucgugcagcaauu

SEQ ID NO: 26849 - RNA, 64 nt, hsa
ggcagccuucuuaaaugacaaauguaaaaaaaaaaaaaaaaaagacucuacuucgugcagcaau

SEQ ID NO: 26850 - RNA, 64 nt, hsa
gggcagccuucuuaaaugacaaauguaaaaaaaaaaaaaaaaaagacucuacuucgugcagcaa

SEQ ID NO: 26851 - RNA, 64 nt, hsa
agggcagccuucuuaaaugacaaauguaaaaaaaaaaaaaaaaaagacucuacuucgugcagca

SEQ ID NO: 26852 - RNA, 64 nt, hsa
cagggcagccuucuuaaaugacaaauguaaaaaaaaaaaaaaaaaagacucuacuucgugcagc

SEQ ID NO: 26853 - RNA, 64 nt, hsa
gcagggcagccuucuuaaaugacaaauguaaaaaaaaaaaaaaaaaagacucuacuucgugcag

SEQ ID NO: 26854 - RNA, 64 nt, hsa
cgcagggcagccuucuuaaaugacaaauguaaaaaaaaaaaaaaaaaagacucuacuucgugca

SEQ ID NO: 26855 - RNA, 64 nt, hsa
ccgcagggcagccuucuuaaaugacaaauguaaaaaaaaaaaaaaaaaagacucuacuucgugc

SEQ ID NO: 26856 - RNA, 64 nt, hsa
accgcagggcagccuucuuaaaugacaaauguaaaaaaaaaaaaaaaaaagacucuacuucgug

SEQ ID NO: 26857 - RNA, 64 nt, hsa
uaccgcagggcagccuucuuaaaugacaaauguaaaaaaaaaaaaaaaaaagacucuacuucgu

SEQ ID NO: 26858 - RNA, 64 nt, hsa
auaccgcagggcagccuucuuaaaugacaaauguaaaaaaaaaaaaaaaaaagacucuacuucg

SEQ ID NO: 26859 - RNA, 64 nt, hsa
uaugauuuaaaacauguaauauaaagauguuaaaaaaaaaaaccaaaacugugcagagucuaga

SEQ ID NO: 26860 - RNA, 64 nt, hsa
auaugauuuaaaacauguaauauaaagauguuaaaaaaaaaaaccaaaacugugcagagucuag

SEQ ID NO: 26861 - RNA, 64 nt, hsa
gauaugauuuaaaacauguaauauaaagauguuaaaaaaaaaaaccaaaacugugcagagucua

SEQ ID NO: 26862 - RNA, 64 nt, hsa
ugauaugauuuaaaacauguaauauaaagauguuaaaaaaaaaaaccaaaacugugcagagucu

SEQ ID NO: 26863 - RNA, 55 nt, hsa
aaaagaggaagaugcuaugaaagaaaaaaaaaauuccuaaaacuguggaauggau

SEQ ID NO: 26864 - RNA, 54 nt, hsa
aaaagaggaagaugcuaugaaagaaaaaaaaaauuccuaaaacuguggaaugga

SEQ ID NO: 26865 - RNA, 53 nt, hsa
aaaagaggaagaugcuaugaaagaaaaaaaaaauuccuaaaacuguggaaugg

SEQ ID NO: 26866 - RNA, 64 nt, hsa
gccaauagagcgagacuccgucucaaaaaaaaaaaaaaaaaagaaagaaauagcauugaagaaa

SEQ ID NO: 26867 - RNA, 64 nt, hsa
ugccaauagagcgagacuccgucucaaaaaaaaaaaaaaaaaagaaagaaauagcauugaagaa

SEQ ID NO: 26868 - RNA, 64 nt, hsa
cugccaauagagcgagacuccgucucaaaaaaaaaaaaaaaaaagaaagaaauagcauugaaga

SEQ ID NO: 26869 - RNA, 64 nt, hsa
ccugccaauagagcgagacuccgucucaaaaaaaaaaaaaaaaaagaaagaaauagcauugaag

SEQ ID NO: 26870 - RNA, 64 nt, hsa
accugccaauagagcgagacuccgucucaaaaaaaaaaaaaaaaaagaaagaaauagcauugaa

SEQ ID NO: 26871 - RNA, 64 nt, hsa
aaccugccaauagagcgagacuccgucucaaaaaaaaaaaaaaaaaagaaagaaauagcauuga

SEQ ID NO: 26872 - RNA, 64 nt, hsa
caaccugccaauagagcgagacuccgucucaaaaaaaaaaaaaaaaaagaaagaaauagcauug

SEQ ID NO: 26873 - RNA, 64 nt, hsa
ccaaccugccaauagagcgagacuccgucucaaaaaaaaaaaaaaaaaagaaagaaauagcauu

SEQ ID NO: 26874 - RNA, 64 nt, hsa
uccaaccugccaauagagcgagacuccgucucaaaaaaaaaaaaaaaaaagaaagaaauagcau

SEQ ID NO: 26875 - RNA, 64 nt, hsa
cuccaaccugccaauagagcgagacuccgucucaaaaaaaaaaaaaaaaaagaaagaaauagca

SEQ ID NO: 26876 - RNA, 64 nt, hsa
acuccaaccugccaauagagcgagacuccgucucaaaaaaaaaaaaaaaaaagaaagaaauagc

SEQ ID NO: 26877 - RNA, 64 nt, hsa
aaagacuucagcagcaaaccaaaacagcagguuaaaaaaaaagaugcuuuuuugggugcaaguc

SEQ ID NO: 26878 - RNA, 64 nt, hsa
caaagacuucagcagcaaaccaaaacagcagguuaaaaaaaaagaugcuuuuuugggugcaagu

SEQ ID NO: 26879 - RNA, 64 nt, hsa
augaaaucuucccaguauuauaaauuguguauuuaaaaaaaagaaacuuuucugaaugccuacc

SEQ ID NO: 26880 - RNA, 64 nt, hsa
cagcucauguuuuuaacuuuuaauuuaaaaacacaaaaaaaauuuuagcucuucccacuuuuuu

SEQ ID NO: 26881 - RNA, 64 nt, hsa
aauuaucagaaacgaaugcaaaaaaaaaaaaaaaaaaaaaaagcuuacacagcuucuuagcaau

SEQ ID NO: 26882 - RNA, 64 nt, hsa
gaauuaucagaaacgaaugcaaaaaaaaaaaaaaaaaaaaaaagcuuacacagcuucuuagcaa

SEQ ID NO: 26883 - RNA, 64 nt, hsa
agaauuaucagaaacgaaugcaaaaaaaaaaaaaaaaaaaaaaagcuuacacagcuucuuagca

SEQ ID NO: 26884 - RNA, 64 nt, hsa
cagaauuaucagaaacgaaugcaaaaaaaaaaaaaaaaaaaaaaagcuuacacagcuucuuagc

SEQ ID NO: 26885 - RNA, 64 nt, hsa
ccagaauuaucagaaacgaaugcaaaaaaaaaaaaaaaaaaaaaaagcuuacacagcuucuuag

SEQ ID NO: 26886 - RNA, 64 nt, hsa
cccagaauuaucagaaacgaaugcaaaaaaaaaaaaaaaaaaaaaaagcuuacacagcuucuua

SEQ ID NO: 26887 - RNA, 64 nt, hsa
acccagaauuaucagaaacgaaugcaaaaaaaaaaaaaaaaaaaaaaagcuuacacagcuucuu

SEQ ID NO: 26888 - RNA, 64 nt, hsa
uacccagaauuaucagaaacgaaugcaaaaaaaaaaaaaaaaaaaaaaagcuuacacagcuucu

SEQ ID NO: 26889 - RNA, 64 nt, hsa
guacccagaauuaucagaaacgaaugcaaaaaaaaaaaaaaaaaaaaaaagcuuacacagcuuc

SEQ ID NO: 26890 - RNA, 64 nt, hsa
aguacccagaauuaucagaaacgaaugcaaaaaaaaaaaaaaaaaaaaaaagcuuacacagcuu

SEQ ID NO: 26891 - RNA, 64 nt, hsa
aaguacccagaauuaucagaaacgaaugcaaaaaaaaaaaaaaaaaaaaaaagcuuacacagcu

SEQ ID NO: 26892 - RNA, 64 nt, hsa
gaaguacccagaauuaucagaaacgaaugcaaaaaaaaaaaaaaaaaaaaaaagcuuacacagc

SEQ ID NO: 26893 - RNA, 64 nt, hsa
ggaaguacccagaauuaucagaaacgaaugcaaaaaaaaaaaaaaaaaaaaaaagcuuacacag

SEQ ID NO: 26894 - RNA, 64 nt, hsa
uggaaguacccagaauuaucagaaacgaaugcaaaaaaaaaaaaaaaaaaaaaaagcuuacaca

SEQ ID NO: 26895 - RNA, 64 nt, hsa
uuggaaguacccagaauuaucagaaacgaaugcaaaaaaaaaaaaaaaaaaaaaaagcuuacac

SEQ ID NO: 26896 - RNA, 64 nt, hsa
guuggaaguacccagaauuaucagaaacgaaugcaaaaaaaaaaaaaaaaaaaaaaagcuuaca

SEQ ID NO: 26897 - RNA, 64 nt, hsa
ccuuucuucccuaauccccuggcaaccacuuuaaaaaaaaaauuagguucaggggguacaugug

SEQ ID NO: 26898 - RNA, 64 nt, hsa
cccuuucuucccuaauccccuggcaaccacuuuaaaaaaaaaauuagguucaggggguacaugu

SEQ ID NO: 26899 - RNA, 64 nt, hsa
ucccuuucuucccuaauccccuggcaaccacuuuaaaaaaaaaauuagguucaggggguacaug

SEQ ID NO: 26900 - RNA, 64 nt, hsa
agauccugucucuccaaaaaaaaaaaaaaaaaaaaaaaaaaauuucauuuuugaguccagagga

SEQ ID NO: 26901 - RNA, 64 nt, hsa
aagauccugucucuccaaaaaaaaaaaaaaaaaaaaaaaaaaauuucauuuuugaguccagagg

SEQ ID NO: 26902 - RNA, 64 nt, hsa
caagauccugucucuccaaaaaaaaaaaaaaaaaaaaaaaaaaauuucauuuuugaguccagag

SEQ ID NO: 26903 - RNA, 64 nt, hsa
gcaagauccugucucuccaaaaaaaaaaaaaaaaaaaaaaaaaaauuucauuuuugaguccaga

SEQ ID NO: 26904 - RNA, 64 nt, hsa
agcaagauccugucucuccaaaaaaaaaaaaaaaaaaaaaaaaaaauuucauuuuugaguccag

SEQ ID NO: 26905 - RNA, 64 nt, hsa
uagcaagauccugucucuccaaaaaaaaaaaaaaaaaaaaaaaaaaauuucauuuuugagucca

SEQ ID NO: 26906 - RNA, 64 nt, hsa
auagcaagauccugucucuccaaaaaaaaaaaaaaaaaaaaaaaaaaauuucauuuuugagucc

SEQ ID NO: 26907 - RNA, 64 nt, hsa
cauagcaagauccugucucuccaaaaaaaaaaaaaaaaaaaaaaaaaaauuucauuuuugaguc

SEQ ID NO: 26908 - RNA, 64 nt, hsa
acauagcaagauccugucucuccaaaaaaaaaaaaaaaaaaaaaaaaaaauuucauuuuugagu

SEQ ID NO: 26909 - RNA, 64 nt, hsa
aacauagcaagauccugucucuccaaaaaaaaaaaaaaaaaaaaaaaaaaauuucauuuuugag

SEQ ID NO: 26910 - RNA, 64 nt, hsa
caacauagcaagauccugucucuccaaaaaaaaaaaaaaaaaaaaaaaaaaauuucauuuuuga

SEQ ID NO: 26911 - RNA, 64 nt, hsa
gcaacauagcaagauccugucucuccaaaaaaaaaaaaaaaaaaaaaaaaaaauuucauuuuug

SEQ ID NO: 26912 - RNA, 64 nt, hsa
ggcaacauagcaagauccugucucuccaaaaaaaaaaaaaaaaaaaaaaaaaaauuucauuuuu

SEQ ID NO: 26913 - RNA, 64 nt, hsa
gggcaacauagcaagauccugucucuccaaaaaaaaaaaaaaaaaaaaaaaaaaauuucauuuu

SEQ ID NO: 26914 - RNA, 64 nt, hsa
ugggcaacauagcaagauccugucucuccaaaaaaaaaaaaaaaaaaaaaaaaaaauuucauuu

SEQ ID NO: 26915 - RNA, 64 nt, hsa
cugggcaacauagcaagauccugucucuccaaaaaaaaaaaaaaaaaaaaaaaaaaauuucauu

SEQ ID NO: 26916 - RNA, 64 nt, hsa
ccugggcaacauagcaagauccugucucuccaaaaaaaaaaaaaaaaaaaaaaaaaaauuucau

SEQ ID NO: 26917 - RNA, 64 nt, hsa
gccugggcaacauagcaagauccugucucuccaaaaaaaaaaaaaaaaaaaaaaaaaaauuuca

SEQ ID NO: 26918 - RNA, 64 nt, hsa
agccugggcaacauagcaagauccugucucuccaaaaaaaaaaaaaaaaaaaaaaaaaaauuuc

SEQ ID NO: 26919 - RNA, 64 nt, hsa
cagccugggcaacauagcaagauccugucucuccaaaaaaaaaaaaaaaaaaaaaaaaaaauuu

SEQ ID NO: 26920 - RNA, 64 nt, hsa
ugccuggagaugauguuucuugcuuuuggaaaaaaaaaaaaagucucugaaauuugauucuuac

SEQ ID NO: 26921 - RNA, 64 nt, hsa
uugccuggagaugauguuucuugcuuuuggaaaaaaaaaaaaagucucugaaauuugauucuua

SEQ ID NO: 26922 - RNA, 64 nt, hsa
cuugccuggagaugauguuucuugcuuuuggaaaaaaaaaaaaagucucugaaauuugauucuu

SEQ ID NO: 26923 - RNA, 64 nt, hsa
gcuugccuggagaugauguuucuugcuuuuggaaaaaaaaaaaaagucucugaaauuugauucu

SEQ ID NO: 26924 - RNA, 64 nt, hsa
agcuugccuggagaugauguuucuugcuuuuggaaaaaaaaaaaaagucucugaaauuugauuc

SEQ ID NO: 26925 - RNA, 64 nt, hsa
uagcuugccuggagaugauguuucuugcuuuuggaaaaaaaaaaaaagucucugaaauuugauu

SEQ ID NO: 26926 - RNA, 64 nt, hsa
guugagaucauuguuguuucauuguuuaaggaaaaaaaaaaaugccuguaccuacaaugugauu

SEQ ID NO: 26927 - RNA, 64 nt, hsa
uguugagaucauuguuguuucauuguuuaaggaaaaaaaaaaaugccuguaccuacaaugugau

SEQ ID NO: 26928 - RNA, 64 nt, hsa
auguugagaucauuguuguuucauuguuuaaggaaaaaaaaaaaugccuguaccuacaauguga

SEQ ID NO: 26929 - RNA, 64 nt, hsa
cauguugagaucauuguuguuucauuguuuaaggaaaaaaaaaaaugccuguaccuacaaugug

SEQ ID NO: 26930 - RNA, 64 nt, hsa
cacagaaggucaucaucacaagcaaacuuuauuaaaaaaaaacuagaagugugcuuugauuuug

SEQ ID NO: 26931 - RNA, 64 nt, hsa
gcacagaaggucaucaucacaagcaaacuuuauuaaaaaaaaacuagaagugugcuuugauuuu

SEQ ID NO: 26932 - RNA, 64 nt, hsa
agacauuucuuuuugguuaaaugauauuagagaaaaaaaaaacuauccaaggcugcuaacaaau

SEQ ID NO: 26933 - RNA, 64 nt, hsa
aagacauuucuuuuugguuaaaugauauuagagaaaaaaaaaacuauccaaggcugcuaacaaa

SEQ ID NO: 26934 - RNA, 64 nt, hsa
uaagacauuucuuuuugguuaaaugauauuagagaaaaaaaaaacuauccaaggcugcuaacaa

SEQ ID NO: 26935 - RNA, 64 nt, hsa
uuaauaaugugcuaggauuugcuaaaaaagaaaaaaaaaaaacccuuuugaguuugcccuagaa

SEQ ID NO: 26936 - RNA, 64 nt, hsa
guuaauaaugugcuaggauuugcuaaaaaagaaaaaaaaaaaacccuuuugaguuugcccuaga

SEQ ID NO: 26937 - RNA, 64 nt, hsa
uguuaauaaugugcuaggauuugcuaaaaaagaaaaaaaaaaaacccuuuugaguuugcccuag

SEQ ID NO: 26938 - RNA, 64 nt, hsa
uuguuaauaaugugcuaggauuugcuaaaaaagaaaaaaaaaaaacccuuuugaguuugcccua

SEQ ID NO: 26939 - RNA, 64 nt, hsa
uuuguuaauaaugugcuaggauuugcuaaaaaagaaaaaaaaaaaacccuuuugaguuugcccu

SEQ ID NO: 26940 - RNA, 64 nt, hsa
uuuguuugcgaguaggacuugggagucauugggaaaaaaaaauaauaaauuuuccccuucauua

SEQ ID NO: 26941 - RNA, 64 nt, hsa
auuuguuugcgaguaggacuugggagucauugggaaaaaaaaauaauaaauuuuccccuucauu

SEQ ID NO: 26942 - RNA, 64 nt, hsa
aauaaaucuuaguguucaaaacaaaaugaaacaaaaaaaaaaugauaaaaacucucagaaaacg

SEQ ID NO: 26943 - RNA, 64 nt, hsa
aaauaaaucuuaguguucaaaacaaaaugaaacaaaaaaaaaaugauaaaaacucucagaaaac

SEQ ID NO: 26944 - RNA, 64 nt, hsa
aaaauaaaucuuaguguucaaaacaaaaugaaacaaaaaaaaaaugauaaaaacucucagaaaa

SEQ ID NO: 26945 - RNA, 64 nt, hsa
ugaauagaaaauuuuaaaacccgagaaauggggaaaaaaaaaucagugcacaagaauugggcug

SEQ ID NO: 26946 - RNA, 64 nt, hsa
augaauagaaaauuuuaaaacccgagaaauggggaaaaaaaaaucagugcacaagaauugggcu

SEQ ID NO: 26947 - RNA, 64 nt, hsa
augacagagcgagacccugccucaaaaaaaaaaaaaaaaaaagaaagccacacuuauucuuuuc

SEQ ID NO: 26948 - RNA, 64 nt, hsa
gaugacagagcgagacccugccucaaaaaaaaaaaaaaaaaaagaaagccacacuuauucuuuu

SEQ ID NO: 26949 - RNA, 64 nt, hsa
ggaugacagagcgagacccugccucaaaaaaaaaaaaaaaaaaagaaagccacacuuauucuuu

SEQ ID NO: 26950 - RNA, 64 nt, hsa
uggaugacagagcgagacccugccucaaaaaaaaaaaaaaaaaaagaaagccacacuuauucuu

SEQ ID NO: 26951 - RNA, 64 nt, hsa
guggaugacagagcgagacccugccucaaaaaaaaaaaaaaaaaaagaaagccacacuuauucu

SEQ ID NO: 26952 - RNA, 64 nt, hsa
uguggaugacagagcgagacccugccucaaaaaaaaaaaaaaaaaaagaaagccacacuuauuc

SEQ ID NO: 26953 - RNA, 64 nt, hsa
guguggaugacagagcgagacccugccucaaaaaaaaaaaaaaaaaaagaaagccacacuuauu

SEQ ID NO: 26954 - RNA, 64 nt, hsa
aguguggaugacagagcgagacccugccucaaaaaaaaaaaaaaaaaaagaaagccacacuuau

SEQ ID NO: 26955 - RNA, 64 nt, hsa
caguguggaugacagagcgagacccugccucaaaaaaaaaaaaaaaaaaagaaagccacacuua

SEQ ID NO: 26956 - RNA, 64 nt, hsa
ccaguguggaugacagagcgagacccugccucaaaaaaaaaaaaaaaaaaagaaagccacacuu

SEQ ID NO: 26957 - RNA, 64 nt, hsa
uccaguguggaugacagagcgagacccugccucaaaaaaaaaaaaaaaaaaagaaagccacacu

SEQ ID NO: 26958 - RNA, 64 nt, hsa
cuccaguguggaugacagagcgagacccugccucaaaaaaaaaaaaaaaaaaagaaagccacac

SEQ ID NO: 26959 - RNA, 64 nt, hsa
accucccaaaucgcugagcugcuuguuuaaaaaaaaaaaaaaggaaaaggaaaaagcaugacau

SEQ ID NO: 26960 - RNA, 64 nt, hsa
aaccucccaaaucgcugagcugcuuguuuaaaaaaaaaaaaaaggaaaaggaaaaagcaugaca

SEQ ID NO: 26961 - RNA, 64 nt, hsa
caaccucccaaaucgcugagcugcuuguuuaaaaaaaaaaaaaaggaaaaggaaaaagcaugac

SEQ ID NO: 26962 - RNA, 64 nt, hsa
ccaaccucccaaaucgcugagcugcuuguuuaaaaaaaaaaaaaaggaaaaggaaaaagcauga

SEQ ID NO: 26963 - RNA, 64 nt, hsa
accaaccucccaaaucgcugagcugcuuguuuaaaaaaaaaaaaaaggaaaaggaaaaagcaug

SEQ ID NO: 26964 - RNA, 64 nt, hsa
aaccaaccucccaaaucgcugagcugcuuguuuaaaaaaaaaaaaaaggaaaaggaaaaagcau

SEQ ID NO: 26965 - RNA, 64 nt, hsa
uaaccaaccucccaaaucgcugagcugcuuguuuaaaaaaaaaaaaaaggaaaaggaaaaagca

SEQ ID NO: 26966 - RNA, 64 nt, hsa
uuuucagacuuaccaaauguauugauagugccaaaaaaaaaaucucagaaaucuuaaugcagaa

SEQ ID NO: 26967 - RNA, 64 nt, hsa
cuuuucagacuuaccaaauguauugauagugccaaaaaaaaaaucucagaaaucuuaaugcaga

SEQ ID NO: 26968 - RNA, 64 nt, hsa
acuuuucagacuuaccaaauguauugauagugccaaaaaaaaaaucucagaaaucuuaaugcag

SEQ ID NO: 26969 - RNA, 64 nt, hsa
auguuguaaucaacugaaaaaucuggggggaaaaaaaaaaaacuaauaagaaaaucgaaauacc

SEQ ID NO: 26970 - RNA, 64 nt, hsa
cauguuguaaucaacugaaaaaucuggggggaaaaaaaaaaaacuaauaagaaaaucgaaauac

SEQ ID NO: 26971 - RNA, 64 nt, hsa
gcauguuguaaucaacugaaaaaucuggggggaaaaaaaaaaaacuaauaagaaaaucgaaaua

SEQ ID NO: 26972 - RNA, 64 nt, hsa
agcauguuguaaucaacugaaaaaucuggggggaaaaaaaaaaaacuaauaagaaaaucgaaau

SEQ ID NO: 26973 - RNA, 64 nt, hsa
gagcauguuguaaucaacugaaaaaucuggggggaaaaaaaaaaaacuaauaagaaaaucgaaa

SEQ ID NO: 26974 - RNA, 64 nt, hsa
ggcugcugucauuuuaugcuaaguaaggggcaaaaaaaaaaauuacauuaugcccuugagucua

SEQ ID NO: 26975 - RNA, 64 nt, hsa
gggcugcugucauuuuaugcuaaguaaggggcaaaaaaaaaaauuacauuaugcccuugagucu

SEQ ID NO: 26976 - RNA, 64 nt, hsa
ugggcugcugucauuuuaugcuaaguaaggggcaaaaaaaaaaauuacauuaugcccuugaguc

SEQ ID NO: 26977 - RNA, 64 nt, hsa
augggcugcugucauuuuaugcuaaguaaggggcaaaaaaaaaaauuacauuaugcccuugagu

SEQ ID NO: 26978 - RNA, 64 nt, hsa
auauuacaaauucuaaaagauaaguguguuugcaaaaaaaaagaaaauaaauacauaaaaaagg

SEQ ID NO: 26979 - RNA, 64 nt, hsa
aauauuacaaauucuaaaagauaaguguguuugcaaaaaaaaagaaaauaaauacauaaaaaag

SEQ ID NO: 26980 - RNA, 64 nt, hsa
acauacauaaugacuuucuuuuuccuuaaguauaaaaaaaaaguaucagaagaaugauaccauu

SEQ ID NO: 26981 - RNA, 64 nt, hsa
cacauacauaaugacuuucuuuuuccuuaaguauaaaaaaaaaguaucagaagaaugauaccau

SEQ ID NO: 26982 - RNA, 64 nt, hsa
aucaaauguuaugaugcaaaaaaagaaaaagaaaaaaaaaaagaaaagaaaacuucaauuuucu

SEQ ID NO: 26983 - RNA, 64 nt, hsa
uaucaaauguuaugaugcaaaaaaagaaaaagaaaaaaaaaaagaaaagaaaacuucaauuuuc

SEQ ID NO: 26984 - RNA, 64 nt, hsa
uuaucaaauguuaugaugcaaaaaaagaaaaagaaaaaaaaaaagaaaagaaaacuucaauuuu

SEQ ID NO: 26985 - RNA, 64 nt, hsa
uuuaucaaauguuaugaugcaaaaaaagaaaaagaaaaaaaaaaagaaaagaaaacuucaauuu

SEQ ID NO: 26986 - RNA, 64 nt, hsa
gcuguucccccgaacagguuuauuuuaguaaaaaaaaaaaaacaaaaaacaaaaacaaaagauu

SEQ ID NO: 26987 - RNA, 64 nt, hsa
agcuguucccccgaacagguuuauuuuaguaaaaaaaaaaaaacaaaaaacaaaaacaaaagau

SEQ ID NO: 26988 - RNA, 64 nt, hsa
uagcuguucccccgaacagguuuauuuuaguaaaaaaaaaaaaacaaaaaacaaaaacaaaaga

SEQ ID NO: 26989 - RNA, 64 nt, hsa
guagcuguucccccgaacagguuuauuuuaguaaaaaaaaaaaaacaaaaaacaaaaacaaaag

SEQ ID NO: 26990 - RNA, 64 nt, hsa
aguagcuguucccccgaacagguuuauuuuaguaaaaaaaaaaaaacaaaaaacaaaaacaaaa

SEQ ID NO: 26991 - RNA, 64 nt, hsa
uaguagcuguucccccgaacagguuuauuuuaguaaaaaaaaaaaaacaaaaaacaaaaacaaa

SEQ ID NO: 26992 - RNA, 64 nt, hsa
agggugaugggaaagcauuguaaaugugcuuuuaaaaaaaaauacugauguuccuagugaaaga

SEQ ID NO: 26993 - RNA, 64 nt, hsa
aagggugaugggaaagcauuguaaaugugcuuuuaaaaaaaaauacugauguuccuagugaaag

SEQ ID NO: 26994 - RNA, 64 nt, hsa
ucugugugacugagcaagacucuuucaaaaaaaaaaaaaaaagccuacauucuccaguugauua

SEQ ID NO: 26995 - RNA, 64 nt, hsa
gucugugugacugagcaagacucuuucaaaaaaaaaaaaaaaagccuacauucuccaguugauu

SEQ ID NO: 26996 - RNA, 64 nt, hsa
agucugugugacugagcaagacucuuucaaaaaaaaaaaaaaaagccuacauucuccaguugau

SEQ ID NO: 26997 - RNA, 64 nt, hsa
cagucugugugacugagcaagacucuuucaaaaaaaaaaaaaaaagccuacauucuccaguuga

SEQ ID NO: 26998 - RNA, 64 nt, hsa
ucagucugugugacugagcaagacucuuucaaaaaaaaaaaaaaaagccuacauucuccaguug

SEQ ID NO: 26999 - RNA, 64 nt, hsa
uucagucugugugacugagcaagacucuuucaaaaaaaaaaaaaaaagccuacauucuccaguu

SEQ ID NO: 27000 - RNA, 64 nt, hsa
cuucagucugugugacugagcaagacucuuucaaaaaaaaaaaaaaaagccuacauucuccagu

SEQ ID NO: 27001 - RNA, 64 nt, hsa
acuucagucugugugacugagcaagacucuuucaaaaaaaaaaaaaaaagccuacauucuccag

SEQ ID NO: 27002 - RNA, 64 nt, hsa
cacuucagucugugugacugagcaagacucuuucaaaaaaaaaaaaaaaagccuacauucucca

SEQ ID NO: 27003 - RNA, 64 nt, hsa
aaagcaguagugagagugagaguaacaauaaagaaaaaaaaauacaaaggaagaaaagaaagaa

SEQ ID NO: 27004 - RNA, 64 nt, hsa
gaaagcaguagugagagugagaguaacaauaaagaaaaaaaaauacaaaggaagaaaagaaaga

SEQ ID NO: 27005 - RNA, 64 nt, hsa
ucccaauuacaggaaauuagaucgacuggagaagaaaaaaaagaaaaaagauagaaaaaagaaa

SEQ ID NO: 27006 - RNA, 64 nt, hsa
gcaacguggugaaacccggucuguacuaaaaaaaaaaaaaaagaaaaagaaaaagaaaaaagaa

SEQ ID NO: 27007 - RNA, 64 nt, hsa
ggcaacguggugaaacccggucuguacuaaaaaaaaaaaaaaagaaaaagaaaaagaaaaaaga

SEQ ID NO: 27008 - RNA, 64 nt, hsa
gggcaacguggugaaacccggucuguacuaaaaaaaaaaaaaaagaaaaagaaaaagaaaaaag

SEQ ID NO: 27009 - RNA, 64 nt, hsa
cgggcaacguggugaaacccggucuguacuaaaaaaaaaaaaaaagaaaaagaaaaagaaaaaa

SEQ ID NO: 27010 - RNA, 64 nt, hsa
ccgggcaacguggugaaacccggucuguacuaaaaaaaaaaaaaaagaaaaagaaaaagaaaaa

SEQ ID NO: 27011 - RNA, 64 nt, hsa
cccgggcaacguggugaaacccggucuguacuaaaaaaaaaaaaaaagaaaaagaaaaagaaaa

SEQ ID NO: 27012 - RNA, 64 nt, hsa
gcccgggcaacguggugaaacccggucuguacuaaaaaaaaaaaaaaagaaaaagaaaaagaaa

SEQ ID NO: 27013 - RNA, 64 nt, hsa
agcccgggcaacguggugaaacccggucuguacuaaaaaaaaaaaaaaagaaaaagaaaaagaa

SEQ ID NO: 27014 - RNA, 64 nt, hsa
gguauaacaagcuuggcaaaguguuggcuuuuuaaaaaaaaauuuuuuuaaucucuagcaguuu

SEQ ID NO: 27015 - RNA, 64 nt, hsa
agguauaacaagcuuggcaaaguguuggcuuuuuaaaaaaaaauuuuuuuaaucucuagcaguu

SEQ ID NO: 27016 - RNA, 64 nt, hsa
auuuuuuauauuaaauuguuuagcucuggcaaaaaaaaaaaauuuuaagagcugguacuaauaa

SEQ ID NO: 27017 - RNA, 64 nt, hsa
cauuuuuuauauuaaauuguuuagcucuggcaaaaaaaaaaaauuuuaagagcugguacuaaua

SEQ ID NO: 27018 - RNA, 64 nt, hsa
gcauuuuuuauauuaaauuguuuagcucuggcaaaaaaaaaaaauuuuaagagcugguacuaau

SEQ ID NO: 27019 - RNA, 64 nt, hsa
ggcauuuuuuauauuaaauuguuuagcucuggcaaaaaaaaaaaauuuuaagagcugguacuaa

SEQ ID NO: 27020 - RNA, 64 nt, hsa
uggcauuuuuuauauuaaauuguuuagcucuggcaaaaaaaaaaaauuuuaagagcugguacua

SEQ ID NO: 27021 - RNA, 64 nt, hsa
uaauaagaguaggaauucucucuauuaaaaagaaaaaaaaaaguugcccuuccuccacagguga

SEQ ID NO: 27022 - RNA, 64 nt, hsa
cuaauaagaguaggaauucucucuauuaaaaagaaaaaaaaaaguugcccuuccuccacaggug

SEQ ID NO: 27023 - RNA, 64 nt, hsa
gcuaauaagaguaggaauucucucuauuaaaaagaaaaaaaaaaguugcccuuccuccacaggu

SEQ ID NO: 27024 - RNA, 64 nt, hsa
ccaauuguaaaaaaaaaaaaaaaaaaaaaaaaaaaaaaaaaauugcacaauuugagcaauucau

SEQ ID NO: 27025 - RNA, 64 nt, hsa
uccaauuguaaaaaaaaaaaaaaaaaaaaaaaaaaaaaaaaaauugcacaauuugagcaauuca

SEQ ID NO: 27026 - RNA, 64 nt, hsa
cuccaauuguaaaaaaaaaaaaaaaaaaaaaaaaaaaaaaaaaauugcacaauuugagcaauuc

SEQ ID NO: 27027 - RNA, 64 nt, hsa
ucuccaauuguaaaaaaaaaaaaaaaaaaaaaaaaaaaaaaaaaauugcacaauuugagcaauu

SEQ ID NO: 27028 - RNA, 64 nt, hsa
cucuccaauuguaaaaaaaaaaaaaaaaaaaaaaaaaaaaaaaaaauugcacaauuugagcaau

SEQ ID NO: 27029 - RNA, 64 nt, hsa
ccucuccaauuguaaaaaaaaaaaaaaaaaaaaaaaaaaaaaaaaaauugcacaauuugagcaa

SEQ ID NO: 27030 - RNA, 64 nt, hsa
uccucuccaauuguaaaaaaaaaaaaaaaaaaaaaaaaaaaaaaaaaauugcacaauuugagca

SEQ ID NO: 27031 - RNA, 64 nt, hsa
uuccucuccaauuguaaaaaaaaaaaaaaaaaaaaaaaaaaaaaaaaaauugcacaauuugagc

SEQ ID NO: 27032 - RNA, 64 nt, hsa
uuuccucuccaauuguaaaaaaaaaaaaaaaaaaaaaaaaaaaaaaaaaauugcacaauuugag

SEQ ID NO: 27033 - RNA, 64 nt, hsa
cuuuccucuccaauuguaaaaaaaaaaaaaaaaaaaaaaaaaaaaaaaaaauugcacaauuuga

SEQ ID NO: 27034 - RNA, 64 nt, hsa
ucuuuccucuccaauuguaaaaaaaaaaaaaaaaaaaaaaaaaaaaaaaaaauugcacaauuug

SEQ ID NO: 27035 - RNA, 64 nt, hsa
uucuuuccucuccaauuguaaaaaaaaaaaaaaaaaaaaaaaaaaaaaaaaaauugcacaauuu

SEQ ID NO: 27036 - RNA, 64 nt, hsa
cuucuuuccucuccaauuguaaaaaaaaaaaaaaaaaaaaaaaaaaaaaaaaaauugcacaauu

SEQ ID NO: 27037 - RNA, 64 nt, hsa
acuucuuuccucuccaauuguaaaaaaaaaaaaaaaaaaaaaaaaaaaaaaaaaauugcacaau

SEQ ID NO: 27038 - RNA, 64 nt, hsa
cacuucuuuccucuccaauuguaaaaaaaaaaaaaaaaaaaaaaaaaaaaaaaaaauugcacaa

SEQ ID NO: 27039 - RNA, 64 nt, hsa
gcacuucuuuccucuccaauuguaaaaaaaaaaaaaaaaaaaaaaaaaaaaaaaaaauugcaca

SEQ ID NO: 27040 - RNA, 64 nt, hsa
agcacuucuuuccucuccaauuguaaaaaaaaaaaaaaaaaaaaaaaaaaaaaaaaaauugcac

SEQ ID NO: 27041 - RNA, 64 nt, hsa
uagcacuucuuuccucuccaauuguaaaaaaaaaaaaaaaaaaaaaaaaaaaaaaaaaauugca

SEQ ID NO: 27042 - RNA, 64 nt, hsa
uuagcacuucuuuccucuccaauuguaaaaaaaaaaaaaaaaaaaaaaaaaaaaaaaaaauugc

SEQ ID NO: 27043 - RNA, 64 nt, hsa
cuuagcacuucuuuccucuccaauuguaaaaaaaaaaaaaaaaaaaaaaaaaaaaaaaaaauug

SEQ ID NO: 27044 - RNA, 64 nt, hsa
ccuuagcacuucuuuccucuccaauuguaaaaaaaaaaaaaaaaaaaaaaaaaaaaaaaaaauu

SEQ ID NO: 27045 - RNA, 64 nt, hsa
gccuuagcacuucuuuccucuccaauuguaaaaaaaaaaaaaaaaaaaaaaaaaaaaaaaaaau

SEQ ID NO: 27046 - RNA, 64 nt, hsa
ugccuuagcacuucuuuccucuccaauuguaaaaaaaaaaaaaaaaaaaaaaaaaaaaaaaaaa

SEQ ID NO: 27047 - RNA, 64 nt, hsa
uugccuuagcacuucuuuccucuccaauuguaaaaaaaaaaaaaaaaaaaaaaaaaaaaaaaaa

SEQ ID NO: 27048 - RNA, 64 nt, hsa
guugccuuagcacuucuuuccucuccaauuguaaaaaaaaaaaaaaaaaaaaaaaaaaaaaaaa

SEQ ID NO: 27049 - RNA, 64 nt, hsa
uguugccuuagcacuucuuuccucuccaauuguaaaaaaaaaaaaaaaaaaaaaaaaaaaaaaa

SEQ ID NO: 27050 - RNA, 64 nt, hsa
guguugccuuagcacuucuuuccucuccaauuguaaaaaaaaaaaaaaaaaaaaaaaaaaaaaa

SEQ ID NO: 27051 - RNA, 64 nt, hsa
uauaauagagacucuuuaaggagaaucuuaaaaaaaaaaaaacguuucucacugucuuaaauag

SEQ ID NO: 27052 - RNA, 64 nt, hsa
cuauaauagagacucuuuaaggagaaucuuaaaaaaaaaaaaacguuucucacugucuuaaaua

SEQ ID NO: 27053 - RNA, 64 nt, hsa
acuauaauagagacucuuuaaggagaaucuuaaaaaaaaaaaaacguuucucacugucuuaaau

SEQ ID NO: 27054 - RNA, 64 nt, hsa
aacuauaauagagacucuuuaaggagaaucuuaaaaaaaaaaaaacguuucucacugucuuaaa

SEQ ID NO: 27055 - RNA, 64 nt, hsa
uaacuauaauagagacucuuuaaggagaaucuuaaaaaaaaaaaaacguuucucacugucuuaa

SEQ ID NO: 27056 - RNA, 64 nt, hsa
guaacuauaauagagacucuuuaaggagaaucuuaaaaaaaaaaaaacguuucucacugucuua

SEQ ID NO: 27057 - RNA, 64 nt, hsa
auaacuauauacuacuuugagaaguaaacaugucaaaaaaaacaaaguucagauaugggacaaa

SEQ ID NO: 27058 - RNA, 64 nt, hsa
uggaauuaauaaguauugaaauguuuugaaacugaaaaaaaauuuuacagcuacugaauuucuu

SEQ ID NO: 27059 - RNA, 64 nt, hsa
uauauauuugaaagguauaaaagguaggaguuaaaaaaaaaaccucuauguguagauauuaacu

SEQ ID NO: 27060 - RNA, 64 nt, hsa
uuauauauuugaaagguauaaaagguaggaguuaaaaaaaaaaccucuauguguagauauuaac

SEQ ID NO: 27061 - RNA, 64 nt, hsa
uuuauauauuugaaagguauaaaagguaggaguuaaaaaaaaaaccucuauguguagauauuaa

SEQ ID NO: 27062 - RNA, 64 nt, hsa
auguauuuaacaaaauaaacgacacugccgaaaaaaaaaaaagugaagugaaaacaaucagggc

SEQ ID NO: 27063 - RNA, 64 nt, hsa
uauguauuuaacaaaauaaacgacacugccgaaaaaaaaaaaagugaagugaaaacaaucaggg

SEQ ID NO: 27064 - RNA, 64 nt, hsa
guauguauuuaacaaaauaaacgacacugccgaaaaaaaaaaaagugaagugaaaacaaucagg

SEQ ID NO: 27065 - RNA, 64 nt, hsa
gguauguauuuaacaaaauaaacgacacugccgaaaaaaaaaaaagugaagugaaaacaaucag

SEQ ID NO: 27066 - RNA, 64 nt, hsa
agguauguauuuaacaaaauaaacgacacugccgaaaaaaaaaaaagugaagugaaaacaauca

SEQ ID NO: 27067 - RNA, 64 nt, hsa
uuuuuuaaauuuguauuuuuauacaaccuccaaaaaaaaaaacaacuggguagagggugggagg

SEQ ID NO: 27068 - RNA, 64 nt, hsa
auuuuuuaaauuuguauuuuuauacaaccuccaaaaaaaaaaacaacuggguagagggugggag

SEQ ID NO: 27069 - RNA, 64 nt, hsa
cauuuuuuaaauuuguauuuuuauacaaccuccaaaaaaaaaaacaacuggguagaggguggga

SEQ ID NO: 27070 - RNA, 64 nt, hsa
ucauuuuuuaaauuuguauuuuuauacaaccuccaaaaaaaaaaacaacuggguagaggguggg

SEQ ID NO: 27071 - RNA, 64 nt, hsa
acagagcaagacuccgucucaaaaaaaaaaaaaaaaaaaaaagacauuuuaacuaaguuauuca

SEQ ID NO: 27072 - RNA, 64 nt, hsa
aacagagcaagacuccgucucaaaaaaaaaaaaaaaaaaaaaagacauuuuaacuaaguuauuc

SEQ ID NO: 27073 - RNA, 64 nt, hsa
caacagagcaagacuccgucucaaaaaaaaaaaaaaaaaaaaaagacauuuuaacuaaguuauu

SEQ ID NO: 27074 - RNA, 64 nt, hsa
gcaacagagcaagacuccgucucaaaaaaaaaaaaaaaaaaaaaagacauuuuaacuaaguuau

SEQ ID NO: 27075 - RNA, 64 nt, hsa
ggcaacagagcaagacuccgucucaaaaaaaaaaaaaaaaaaaaaagacauuuuaacuaaguua

SEQ ID NO: 27076 - RNA, 64 nt, hsa
aggcaacagagcaagacuccgucucaaaaaaaaaaaaaaaaaaaaaagacauuuuaacuaaguu

SEQ ID NO: 27077 - RNA, 64 nt, hsa
uaggcaacagagcaagacuccgucucaaaaaaaaaaaaaaaaaaaaaagacauuuuaacuaagu

SEQ ID NO: 27078 - RNA, 64 nt, hsa
cuaggcaacagagcaagacuccgucucaaaaaaaaaaaaaaaaaaaaaagacauuuuaacuaag

SEQ ID NO: 27079 - RNA, 64 nt, hsa
ccuaggcaacagagcaagacuccgucucaaaaaaaaaaaaaaaaaaaaaagacauuuuaacuaa

SEQ ID NO: 27080 - RNA, 64 nt, hsa
gccuaggcaacagagcaagacuccgucucaaaaaaaaaaaaaaaaaaaaaagacauuuuaacua

SEQ ID NO: 27081 - RNA, 64 nt, hsa
agccuaggcaacagagcaagacuccgucucaaaaaaaaaaaaaaaaaaaaaagacauuuuaacu

SEQ ID NO: 27082 - RNA, 64 nt, hsa
cagccuaggcaacagagcaagacuccgucucaaaaaaaaaaaaaaaaaaaaaagacauuuuaac

SEQ ID NO: 27083 - RNA, 64 nt, hsa
ccagccuaggcaacagagcaagacuccgucucaaaaaaaaaaaaaaaaaaaaaagacauuuuaa

SEQ ID NO: 27084 - RNA, 64 nt, hsa
uccagccuaggcaacagagcaagacuccgucucaaaaaaaaaaaaaaaaaaaaaagacauuuua

SEQ ID NO: 27085 - RNA, 64 nt, hsa
cuccagccuaggcaacagagcaagacuccgucucaaaaaaaaaaaaaaaaaaaaaagacauuuu

SEQ ID NO: 27086 - RNA, 64 nt, hsa
gugcagugauccuuuacagguuuauuucuuuguaaaaaaaaauaauaauaauuugaaucaugua

SEQ ID NO: 27087 - RNA, 64 nt, hsa
agugcagugauccuuuacagguuuauuucuuuguaaaaaaaaauaauaauaauuugaaucaugu

SEQ ID NO: 27088 - RNA, 64 nt, hsa
aggagaaccaaucauauuuucucucugucucucaaaaaaaaauugaacugagaccagugaguaa

SEQ ID NO: 27089 - RNA, 64 nt, hsa
aaggagaaccaaucauauuuucucucugucucucaaaaaaaaauugaacugagaccagugagua

SEQ ID NO: 27090 - RNA, 64 nt, hsa
caguaaagcccuaucaguauaaaauuugaaaaaaaaaaaaaagaugauuguauuucuagauuag

SEQ ID NO: 27091 - RNA, 64 nt, hsa
acaguaaagcccuaucaguauaaaauuugaaaaaaaaaaaaaagaugauuguauuucuagauua

SEQ ID NO: 27092 - RNA, 64 nt, hsa
aacaguaaagcccuaucaguauaaaauuugaaaaaaaaaaaaaagaugauuguauuucuagauu

SEQ ID NO: 27093 - RNA, 64 nt, hsa
aaacaguaaagcccuaucaguauaaaauuugaaaaaaaaaaaaaagaugauuguauuucuagau

SEQ ID NO: 27094 - RNA, 64 nt, hsa
caaacaguaaagcccuaucaguauaaaauuugaaaaaaaaaaaaaagaugauuguauuucuaga

SEQ ID NO: 27095 - RNA, 64 nt, hsa
acaaacaguaaagcccuaucaguauaaaauuugaaaaaaaaaaaaaagaugauuguauuucuag

SEQ ID NO: 27096 - RNA, 64 nt, hsa
cacaaacaguaaagcccuaucaguauaaaauuugaaaaaaaaaaaaaagaugauuguauuucua

SEQ ID NO: 27097 - RNA, 64 nt, hsa
uggcuuguuuugucucuuugcaacugauuuugcaaaaaaaaauuguagcuuuaaaauaacaggg

SEQ ID NO: 27098 - RNA, 64 nt, hsa
cuggcuuguuuugucucuuugcaacugauuuugcaaaaaaaaauuguagcuuuaaaauaacagg

SEQ ID NO: 27099 - RNA, 64 nt, hsa
gcgcagcagccucugugggggaggauaggcugaaaaaaaaaagugggcucguauuuaucuacag

SEQ ID NO: 27100 - RNA, 64 nt, hsa
agcgcagcagccucugugggggaggauaggcugaaaaaaaaaagugggcucguauuuaucuaca

SEQ ID NO: 27101 - RNA, 64 nt, hsa
uagcgcagcagccucugugggggaggauaggcugaaaaaaaaaagugggcucguauuuaucuac

SEQ ID NO: 27102 - RNA, 64 nt, hsa
augaaaauuaucugcaaacaccuaaauuaaagagaaaaaaaaguaguuuguaaacucauuugug

SEQ ID NO: 27103 - RNA, 64 nt, hsa
acuccaucucauuaaaaaaaacgaaaacaaaaacaaaaaaaacacaaaccaucaucacagaaga

SEQ ID NO: 27104 - RNA, 64 nt, hsa
cagucugagugacagagugagacuccaucucauuaaaaaaaacgaaaacaaaaacaaaaaaaac

SEQ ID NO: 27105 - RNA, 64 nt, hsa
auaagcuauaacaucaaaucagggaaaaaugaggaaaaaaaauagauucugaaccauuuauugu

SEQ ID NO: 27106 - RNA, 64 nt, hsa
uguggcuuuuagggcuugguucauaccaugggggaaaaaaaaguccuaggagaaagcgacgugg

SEQ ID NO: 27107 - RNA, 64 nt, hsa
uucgucuucgcccucugaaauuaaagaaaugaaaaaaaaaaacaauaucugcagcguugcuugg

SEQ ID NO: 27108 - RNA, 64 nt, hsa
cuucgucuucgcccucugaaauuaaagaaaugaaaaaaaaaaacaauaucugcagcguugcuug

SEQ ID NO: 27109 - RNA, 64 nt, hsa
acuucgucuucgcccucugaaauuaaagaaaugaaaaaaaaaaacaauaucugcagcguugcuu

SEQ ID NO: 27110 - RNA, 64 nt, hsa
uacuucgucuucgcccucugaaauuaaagaaaugaaaaaaaaaaacaauaucugcagcguugcu

SEQ ID NO: 27111 - RNA, 64 nt, hsa
gcagccuagauaugaagaaucugcucugaaaacaaaaaaaaauuacccuuuuguuggggggggu

SEQ ID NO: 27112 - RNA, 64 nt, hsa
cgcagccuagauaugaagaaucugcucugaaaacaaaaaaaaauuacccuuuuguugggggggg

SEQ ID NO: 27113 - RNA, 64 nt, hsa
cuuccguuauuggauaugguaucuccuaaaguguaaaaaaaaucuguuacuauauagugauaaa

SEQ ID NO: 27114 - RNA, 64 nt, hsa
cuuugcuaaucuuacuaauagauauugauuaaaaaaaaaaaaccucaguacugcaucacugugu

SEQ ID NO: 27115 - RNA, 64 nt, hsa
ucuuugcuaaucuuacuaauagauauugauuaaaaaaaaaaaaccucaguacugcaucacugug

SEQ ID NO: 27116 - RNA, 64 nt, hsa
aucuuugcuaaucuuacuaauagauauugauuaaaaaaaaaaaaccucaguacugcaucacugu

SEQ ID NO: 27117 - RNA, 64 nt, hsa
uaucuuugcuaaucuuacuaauagauauugauuaaaaaaaaaaaaccucaguacugcaucacug

SEQ ID NO: 27118 - RNA, 64 nt, hsa
guaucuuugcuaaucuuacuaauagauauugauuaaaaaaaaaaaaccucaguacugcaucacu

SEQ ID NO: 27119 - RNA, 64 nt, hsa
aaaaauguuuuaugguagcuuuuacuuuuuaugaaaaaaaaauuauuugccuuuuaaauucuuu

SEQ ID NO: 27120 - RNA, 64 nt, hsa
aaaaaauguuuuaugguagcuuuuacuuuuuaugaaaaaaaaauuauuugccuuuuaaauucuu

SEQ ID NO: 27121 - RNA, 64 nt, hsa
ggcuuuucagaagaaauuuaaucagugugacagaaaaaaaaauguuuuaugguagcuuuuacuu

SEQ ID NO: 27122 - RNA, 64 nt, hsa
cggcuuuucagaagaaauuuaaucagugugacagaaaaaaaaauguuuuaugguagcuuuuacu

SEQ ID NO: 27123 - RNA, 64 nt, hsa
cugaacugcacguucuauauugugccaagcgaaaaaaaaaaaugcacugugacaccagaauaau

SEQ ID NO: 27124 - RNA, 64 nt, hsa
acugaacugcacguucuauauugugccaagcgaaaaaaaaaaaugcacugugacaccagaauaa

SEQ ID NO: 27125 - RNA, 64 nt, hsa
gacugaacugcacguucuauauugugccaagcgaaaaaaaaaaaugcacugugacaccagaaua

SEQ ID NO: 27126 - RNA, 64 nt, hsa
ugacugaacugcacguucuauauugugccaagcgaaaaaaaaaaaugcacugugacaccagaau

SEQ ID NO: 27127 - RNA, 64 nt, hsa
cuuuggcaacccuuuugaaaaguagcaauuauggaaaaaaaauauucaauaagagauuaggagc

SEQ ID NO: 27128 - RNA, 64 nt, hsa
ugacgcaaagagagauuuuuuuuuaaagaagaaaaaaaaaaauucacacugccagcguuaacag

SEQ ID NO: 27129 - RNA, 64 nt, hsa
augacgcaaagagagauuuuuuuuuaaagaagaaaaaaaaaaauucacacugccagcguuaaca

SEQ ID NO: 27130 - RNA, 64 nt, hsa
caugacgcaaagagagauuuuuuuuuaaagaagaaaaaaaaaaauucacacugccagcguuaac

SEQ ID NO: 27131 - RNA, 64 nt, hsa
ccaugacgcaaagagagauuuuuuuuuaaagaagaaaaaaaaaaauucacacugccagcguuaa

SEQ ID NO: 27132 - RNA, 64 nt, hsa
uaaucucaaggccccuuaggcuuaugaauucaaaaaaaaaaauagaagaaaugaacaaaaacuu

SEQ ID NO: 27133 - RNA, 64 nt, hsa
cuaaucucaaggccccuuaggcuuaugaauucaaaaaaaaaaauagaagaaaugaacaaaaacu

SEQ ID NO: 27134 - RNA, 64 nt, hsa
ucuaaucucaaggccccuuaggcuuaugaauucaaaaaaaaaaauagaagaaaugaacaaaaac

SEQ ID NO: 27135 - RNA, 64 nt, hsa
uucuaaucucaaggccccuuaggcuuaugaauucaaaaaaaaaaauagaagaaaugaacaaaaa

SEQ ID NO: 27136 - RNA, 64 nt, hsa
auaauucuuauccuaagagaaagcuuucauauuuaaaaaaaagucuuuucagauaaaaucugcu

SEQ ID NO: 27137 - RNA, 64 nt, hsa
ucucaaaacaucacaucacauuagcagaacuauaaaaaaaaaucugcuacucagauccacugca

SEQ ID NO: 27138 - RNA, 64 nt, hsa
uucucaaaacaucacaucacauuagcagaacuauaaaaaaaaaucugcuacucagauccacugc

SEQ ID NO: 27139 - RNA, 64 nt, hsa
cccaucaucugaagauucuguauagaauuauuaaaaaaaaaauccaucuuucuuuauuuucuuc

SEQ ID NO: 27140 - RNA, 64 nt, hsa
ucccaucaucugaagauucuguauagaauuauuaaaaaaaaaauccaucuuucuuuauuuucuu

SEQ ID NO: 27141 - RNA, 64 nt, hsa
gucccaucaucugaagauucuguauagaauuauuaaaaaaaaaauccaucuuucuuuauuuucu

SEQ ID NO: 27142 - RNA, 64 nt, hsa
accgcgugauaauggguuuucagacaugaugaaaaaaaaaaacuuuuacaaaugaauacuuacc

SEQ ID NO: 27143 - RNA, 64 nt, hsa
aaccgcgugauaauggguuuucagacaugaugaaaaaaaaaaacuuuuacaaaugaauacuuac

SEQ ID NO: 27144 - RNA, 64 nt, hsa
uaaccgcgugauaauggguuuucagacaugaugaaaaaaaaaaacuuuuacaaaugaauacuua

SEQ ID NO: 27145 - RNA, 64 nt, hsa
cuaaccgcgugauaauggguuuucagacaugaugaaaaaaaaaaacuuuuacaaaugaauacuu

SEQ ID NO: 27146 - RNA, 64 nt, hsa
acaaagagaccaauaaaaauaaaaaaaauaaaaaaaaaaaaagacgaacuauuggagguggugg

SEQ ID NO: 27147 - RNA, 64 nt, hsa
cacaaagagaccaauaaaaauaaaaaaaauaaaaaaaaaaaaagacgaacuauuggagguggug

SEQ ID NO: 27148 - RNA, 64 nt, hsa
acacaaagagaccaauaaaaauaaaaaaaauaaaaaaaaaaaaagacgaacuauuggagguggu

SEQ ID NO: 27149 - RNA, 64 nt, hsa
cacacaaagagaccaauaaaaauaaaaaaaauaaaaaaaaaaaaagacgaacuauuggaggugg

SEQ ID NO: 27150 - RNA, 64 nt, hsa
ucacacaaagagaccaauaaaaauaaaaaaaauaaaaaaaaaaaaagacgaacuauuggaggug

SEQ ID NO: 27151 - RNA, 64 nt, hsa
aucacacaaagagaccaauaaaaauaaaaaaaauaaaaaaaaaaaaagacgaacuauuggaggu

SEQ ID NO: 27152 - RNA, 64 nt, hsa
uaggucauuaucacacaaagagaccaauaaaaauaaaaaaaauaaaaaaaaaaaaagacgaacu

SEQ ID NO: 27153 - RNA, 64 nt, hsa
acacauaugcucauguugcuuuuuuuguuuuagaaaaaaaaacaacauaguuuucugaaggggc

SEQ ID NO: 27154 - RNA, 64 nt, hsa
gacacauaugcucauguugcuuuuuuuguuuuagaaaaaaaaacaacauaguuuucugaagggg

SEQ ID NO: 27155 - RNA, 64 nt, hsa
aagaugcguucuuaauacagacuuguuugcaaagaaaaaaaaaaguauauuauuaaaauccugu

SEQ ID NO: 27156 - RNA, 64 nt, hsa
agaugcguucuuaauacagacuuguuugcaaagaaaaaaaaaaguauauuauuaaaauccugua

SEQ ID NO: 27157 - RNA, 64 nt, hsa
gaugcguucuuaauacagacuuguuugcaaagaaaaaaaaaaguauauuauuaaaauccuguaa

SEQ ID NO: 27158 - RNA, 64 nt, hsa
cuucuauguugaaauaaaauuuaaaaucacaugcaaaaaaaaaaucagcaaaauaauaaaauga

SEQ ID NO: 27159 - RNA, 64 nt, hsa
uucuauguugaaauaaaauuuaaaaucacaugcaaaaaaaaaaucagcaaaauaauaaaaugaa

SEQ ID NO: 27160 - RNA, 64 nt, hsa
ucuauguugaaauaaaauuuaaaaucacaugcaaaaaaaaaaucagcaaaauaauaaaaugaac

SEQ ID NO: 27161 - RNA, 64 nt, hsa
caaaaaaaaaaucagcaaaauaauaaaaugaacgaaaaaaaaugacacccagggaguucccaac

SEQ ID NO: 27162 - RNA, 64 nt, hsa
gcguuuccgggucgcgccagagucauuugguacuaaaaaaaaaaaaaaaaaagacugggggcug

SEQ ID NO: 27163 - RNA, 64 nt, hsa
cguuuccgggucgcgccagagucauuugguacuaaaaaaaaaaaaaaaaaagacugggggcugu

SEQ ID NO: 27164 - RNA, 64 nt, hsa
guuuccgggucgcgccagagucauuugguacuaaaaaaaaaaaaaaaaaagacugggggcuguc

SEQ ID NO: 27165 - RNA, 64 nt, hsa
uuuccgggucgcgccagagucauuugguacuaaaaaaaaaaaaaaaaaagacugggggcugucc

SEQ ID NO: 27166 - RNA, 64 nt, hsa
uuccgggucgcgccagagucauuugguacuaaaaaaaaaaaaaaaaaagacugggggcuguccc

SEQ ID NO: 27167 - RNA, 64 nt, hsa
uccgggucgcgccagagucauuugguacuaaaaaaaaaaaaaaaaaagacugggggcugucccc

SEQ ID NO: 27168 - RNA, 64 nt, hsa
ccgggucgcgccagagucauuugguacuaaaaaaaaaaaaaaaaaagacugggggcugucccca

SEQ ID NO: 27169 - RNA, 64 nt, hsa
cgggucgcgccagagucauuugguacuaaaaaaaaaaaaaaaaaagacugggggcuguccccau

SEQ ID NO: 27170 - RNA, 64 nt, hsa
gggucgcgccagagucauuugguacuaaaaaaaaaaaaaaaaaagacugggggcuguccccauu

SEQ ID NO: 27171 - RNA, 64 nt, hsa
ggucgcgccagagucauuugguacuaaaaaaaaaaaaaaaaaagacugggggcuguccccauuu

SEQ ID NO: 27172 - RNA, 64 nt, hsa
gucgcgccagagucauuugguacuaaaaaaaaaaaaaaaaaagacugggggcuguccccauuuc

SEQ ID NO: 27173 - RNA, 64 nt, hsa
aaugcaaaaucucuacugcuuuggauccugggucaaaaaaaagaaaaaaaaaagaaaugcaaaa

SEQ ID NO: 27174 - RNA, 64 nt, hsa
ucucuacugcuuuggauccugggucaaaaaaaagaaaaaaaaaagaaaugcaaaacuuuaggcc

SEQ ID NO: 27175 - RNA, 64 nt, hsa
cucuacugcuuuggauccugggucaaaaaaaagaaaaaaaaaagaaaugcaaaacuuuaggccc

SEQ ID NO: 27176 - RNA, 64 nt, hsa
ucuacugcuuuggauccugggucaaaaaaaagaaaaaaaaaagaaaugcaaaacuuuaggcccu

SEQ ID NO: 27177 - RNA, 64 nt, hsa
uuacccucagaauauuaagcacauuauuguagagaaaaaaaaauauguguacacauaugaacgc

SEQ ID NO: 27178 - RNA, 64 nt, hsa
uacccucagaauauuaagcacauuauuguagagaaaaaaaaauauguguacacauaugaacgca

SEQ ID NO: 27179 - RNA, 64 nt, hsa
cuccagccugggcaacagagcaagacucugucucaaaaaaaaaaauacaauauuuuaacaaugu

SEQ ID NO: 27180 - RNA, 64 nt, hsa
uccagccugggcaacagagcaagacucugucucaaaaaaaaaaauacaauauuuuaacaaugug

SEQ ID NO: 27181 - RNA, 64 nt, hsa
ccagccugggcaacagagcaagacucugucucaaaaaaaaaaauacaauauuuuaacaaugugc

SEQ ID NO: 27182 - RNA, 64 nt, hsa
cagccugggcaacagagcaagacucugucucaaaaaaaaaaauacaauauuuuaacaaugugcc

SEQ ID NO: 27183 - RNA, 64 nt, hsa
auuuguauuuagaaauucucaaagggcaaaaaacaaaaaaaaagguuuuauaaugucagagacu

SEQ ID NO: 27184 - RNA, 64 nt, hsa
uuuguauuuagaaauucucaaagggcaaaaaacaaaaaaaaagguuuuauaaugucagagacua

SEQ ID NO: 27185 - RNA, 64 nt, hsa
uggcgagacccuguuucuacaaaaagaaaaagggaaaaaaaaagcagggacugucauucucauc

SEQ ID NO: 27186 - RNA, 64 nt, hsa
ggcgagacccuguuucuacaaaaagaaaaagggaaaaaaaaagcagggacugucauucucaucu

SEQ ID NO: 27187 - RNA, 64 nt, hsa
uucacaccuuauuucauugacugcuggcugcuuuaaaaaaaaaaaaaaaggauccauuguaccg

SEQ ID NO: 27188 - RNA, 64 nt, hsa
ucacaccuuauuucauugacugcuggcugcuuuaaaaaaaaaaaaaaaggauccauuguaccgu

SEQ ID NO: 27189 - RNA, 64 nt, hsa
cacaccuuauuucauugacugcuggcugcuuuaaaaaaaaaaaaaaaggauccauuguaccguu

SEQ ID NO: 27190 - RNA, 64 nt, hsa
acaccuuauuucauugacugcuggcugcuuuaaaaaaaaaaaaaaaggauccauuguaccguug

SEQ ID NO: 27191 - RNA, 64 nt, hsa
caccuuauuucauugacugcuggcugcuuuaaaaaaaaaaaaaaaggauccauuguaccguugu

SEQ ID NO: 27192 - RNA, 64 nt, hsa
accuuauuucauugacugcuggcugcuuuaaaaaaaaaaaaaaaggauccauuguaccguuguc

SEQ ID NO: 27193 - RNA, 64 nt, hsa
ccuuauuucauugacugcuggcugcuuuaaaaaaaaaaaaaaaggauccauuguaccguugucu

SEQ ID NO: 27194 - RNA, 64 nt, hsa
cuuauuucauugacugcuggcugcuuuaaaaaaaaaaaaaaaggauccauuguaccguugucuu

SEQ ID NO: 27195 - RNA, 64 nt, hsa
uauaaagaaaugaauguuuucuuuucauuuugguaaaaaaaaagcuugcuguuuuaacaagaaa

SEQ ID NO: 27196 - RNA, 64 nt, hsa
auaaagaaaugaauguuuucuuuucauuuugguaaaaaaaaagcuugcuguuuuaacaagaaau

SEQ ID NO: 27197 - RNA, 64 nt, hsa
ccauuucuccacacugguacaguagucaccugugaaaaaaaaauuggaacuuacuaauuugggc

SEQ ID NO: 27198 - RNA, 64 nt, hsa
cauuucuccacacugguacaguagucaccugugaaaaaaaaauuggaacuuacuaauuugggcu

SEQ ID NO: 27199 - RNA, 64 nt, hsa
gugcaacaggcaauugaauccaaauuucaacgacaaaaaaaaaaaacauguauuuuagaguuca

SEQ ID NO: 27200 - RNA, 64 nt, hsa
ugcaacaggcaauugaauccaaauuucaacgacaaaaaaaaaaaacauguauuuuagaguucau

SEQ ID NO: 27201 - RNA, 64 nt, hsa
gcaacaggcaauugaauccaaauuucaacgacaaaaaaaaaaaacauguauuuuagaguucauc

SEQ ID NO: 27202 - RNA, 64 nt, hsa
caacaggcaauugaauccaaauuucaacgacaaaaaaaaaaaacauguauuuuagaguucaucu

SEQ ID NO: 27203 - RNA, 64 nt, hsa
aacaggcaauugaauccaaauuucaacgacaaaaaaaaaaaacauguauuuuagaguucaucuu

SEQ ID NO: 27204 - RNA, 64 nt, hsa
gacuugauuuacuguggcacuaguuaaguaaguuaaaaaaaaguuaaacccucucauuauuaaa

SEQ ID NO: 27205 - RNA, 64 nt, hsa
uuuuuuuaauuaaagaaaaaauuuccagaagaggaaaaaaaaacuacaaaaaacaaaacauuga

SEQ ID NO: 27206 - RNA, 64 nt, hsa
uuuuuuaauuaaagaaaaaauuuccagaagaggaaaaaaaaacuacaaaaaacaaaacauugaa

SEQ ID NO: 27207 - RNA, 64 nt, hsa
cuugucacauugcaaaaccuagcuuaagagcauuaaaaaaaaaaacuuaaguagauaggagcuu

SEQ ID NO: 27208 - RNA, 64 nt, hsa
uugucacauugcaaaaccuagcuuaagagcauuaaaaaaaaaaacuuaaguagauaggagcuua

SEQ ID NO: 27209 - RNA, 64 nt, hsa
ugucacauugcaaaaccuagcuuaagagcauuaaaaaaaaaaacuuaaguagauaggagcuuau

SEQ ID NO: 27210 - RNA, 64 nt, hsa
gucacauugcaaaaccuagcuuaagagcauuaaaaaaaaaaacuuaaguagauaggagcuuaug

SEQ ID NO: 27211 - RNA, 64 nt, hsa
cuuaaguagauaggagcuuauggucaaaaagugcaaaaaaaaaaacaaaaaaaaagcaauagau

SEQ ID NO: 27212 - RNA, 64 nt, hsa
uuaaguagauaggagcuuauggucaaaaagugcaaaaaaaaaaacaaaaaaaaagcaauagaua

SEQ ID NO: 27213 - RNA, 64 nt, hsa
uaaguagauaggagcuuauggucaaaaagugcaaaaaaaaaaacaaaaaaaaagcaauagauag

SEQ ID NO: 27214 - RNA, 64 nt, hsa
aaguagauaggagcuuauggucaaaaagugcaaaaaaaaaaacaaaaaaaaagcaauagauaga

SEQ ID NO: 27215 - RNA, 64 nt, hsa
ggagcuuauggucaaaaagugcaaaaaaaaaaacaaaaaaaaagcaauagauagagaaauuguu

SEQ ID NO: 27216 - RNA, 64 nt, hsa
gagcuuauggucaaaaagugcaaaaaaaaaaacaaaaaaaaagcaauagauagagaaauuguug

SEQ ID NO: 27217 - RNA, 64 nt, hsa
gaagauagagguuguuuucguuucuuuucuuuuuaaaaaaaaaaaaauuuauuugaccgacaug

SEQ ID NO: 27218 - RNA, 64 nt, hsa
aagauagagguuguuuucguuucuuuucuuuuuaaaaaaaaaaaaauuuauuugaccgacaugg

SEQ ID NO: 27219 - RNA, 64 nt, hsa
agauagagguuguuuucguuucuuuucuuuuuaaaaaaaaaaaaauuuauuugaccgacauggc

SEQ ID NO: 27220 - RNA, 64 nt, hsa
gauagagguuguuuucguuucuuuucuuuuuaaaaaaaaaaaaauuuauuugaccgacauggcc

SEQ ID NO: 27221 - RNA, 64 nt, hsa
auagagguuguuuucguuucuuuucuuuuuaaaaaaaaaaaaauuuauuugaccgacauggccg

SEQ ID NO: 27222 - RNA, 64 nt, hsa
uagagguuguuuucguuucuuuucuuuuuaaaaaaaaaaaaauuuauuugaccgacauggccgg

SEQ ID NO: 27223 - RNA, 64 nt, hsa
cauacagugauuuaccauuuugauaauuaaaaggaaaaaaaaaggaagacucucacuguaaaaa

SEQ ID NO: 27224 - RNA, 64 nt, hsa
auacagugauuuaccauuuugauaauuaaaaggaaaaaaaaaggaagacucucacuguaaaaac

SEQ ID NO: 27225 - RNA, 64 nt, hsa
accaaaauuucuauuucaaaggaaaccaaaccuuaaaaaaaaaaaacaaaaacugggcuggguc

SEQ ID NO: 27226 - RNA, 64 nt, hsa
ccaaaauuucuauuucaaaggaaaccaaaccuuaaaaaaaaaaaacaaaaacugggcugggucu

SEQ ID NO: 27227 - RNA, 64 nt, hsa
caaaauuucuauuucaaaggaaaccaaaccuuaaaaaaaaaaaacaaaaacugggcugggucuu

SEQ ID NO: 27228 - RNA, 64 nt, hsa
aaaauuucuauuucaaaggaaaccaaaccuuaaaaaaaaaaaacaaaaacugggcugggucuuc

SEQ ID NO: 27229 - RNA, 64 nt, hsa
aaauuucuauuucaaaggaaaccaaaccuuaaaaaaaaaaaacaaaaacugggcugggucuucc

SEQ ID NO: 27230 - RNA, 64 nt, hsa
uuuucuuaaaacauaccaaaaaagaaaaaaauagaaaaaaaaaaaaaaaaagcuugaucucuau

SEQ ID NO: 27231 - RNA, 64 nt, hsa
uuucuuaaaacauaccaaaaaagaaaaaaauagaaaaaaaaaaaaaaaaagcuugaucucuauc

SEQ ID NO: 27232 - RNA, 64 nt, hsa
uucuuaaaacauaccaaaaaagaaaaaaauagaaaaaaaaaaaaaaaaagcuugaucucuauca

SEQ ID NO: 27233 - RNA, 64 nt, hsa
ucuuaaaacauaccaaaaaagaaaaaaauagaaaaaaaaaaaaaaaaagcuugaucucuaucag

SEQ ID NO: 27234 - RNA, 64 nt, hsa
cuuaaaacauaccaaaaaagaaaaaaauagaaaaaaaaaaaaaaaaagcuugaucucuaucaga

SEQ ID NO: 27235 - RNA, 64 nt, hsa
uuaaaacauaccaaaaaagaaaaaaauagaaaaaaaaaaaaaaaaagcuugaucucuaucagac

SEQ ID NO: 27236 - RNA, 64 nt, hsa
uaaaacauaccaaaaaagaaaaaaauagaaaaaaaaaaaaaaaaagcuugaucucuaucagacu

SEQ ID NO: 27237 - RNA, 64 nt, hsa
aaaacauaccaaaaaagaaaaaaauagaaaaaaaaaaaaaaaaagcuugaucucuaucagacuu

SEQ ID NO: 27238 - RNA, 64 nt, hsa
aaacauaccaaaaaagaaaaaaauagaaaaaaaaaaaaaaaaagcuugaucucuaucagacuuc

SEQ ID NO: 27239 - RNA, 64 nt, hsa
aacauaccaaaaaagaaaaaaauagaaaaaaaaaaaaaaaaagcuugaucucuaucagacuucc

SEQ ID NO: 27240 - RNA, 64 nt, hsa
uugucaugguugcagcauuugaacuuuugguguuaaaaaaaaaaaccuguaagucuguaaccug

SEQ ID NO: 27241 - RNA, 64 nt, hsa
ugucaugguugcagcauuugaacuuuugguguuaaaaaaaaaaaccuguaagucuguaaccugg

SEQ ID NO: 27242 - RNA, 64 nt, hsa
gucaugguugcagcauuugaacuuuugguguuaaaaaaaaaaaccuguaagucuguaaccuggc

SEQ ID NO: 27243 - RNA, 64 nt, hsa
ucaugguugcagcauuugaacuuuugguguuaaaaaaaaaaaccuguaagucuguaaccuggca

SEQ ID NO: 27244 - RNA, 64 nt, hsa
agugguaacuuuaaaggauucuguaugccaagugaaaaaaaaagaugucugaccuccuuacaua

SEQ ID NO: 27245 - RNA, 64 nt, hsa
gugguaacuuuaaaggauucuguaugccaagugaaaaaaaaagaugucugaccuccuuacauau

SEQ ID NO: 27246 - RNA, 64 nt, hsa
cugaagauacaugucuuucuccagggacauguggaaaaaaaaaagauguuauacaaccaucaaa

SEQ ID NO: 27247 - RNA, 64 nt, hsa
ugaagauacaugucuuucuccagggacauguggaaaaaaaaaagauguuauacaaccaucaaag

SEQ ID NO: 27248 - RNA, 64 nt, hsa
gaagauacaugucuuucuccagggacauguggaaaaaaaaaagauguuauacaaccaucaaagu

SEQ ID NO: 27249 - RNA, 64 nt, hsa
aaagauguuauacaaccaucaaaguggcaaaaauaaaaaaaaucaaguauuggcaaagaugugg

SEQ ID NO: 27250 - RNA, 64 nt, hsa
aaaggguaucccaaaaauaaaacuauccuuuuggaaaaaaaaagauuuaaaauaauuccugguu

SEQ ID NO: 27251 - RNA, 64 nt, hsa
aaggguaucccaaaaauaaaacuauccuuuuggaaaaaaaaagauuuaaaauaauuccugguuu

SEQ ID NO: 27252 - RNA, 64 nt, hsa
uuguauuaaaccauguacguugcagcuuaacaauaaaaaaaaaucuaugaaucuuugugagcaa

SEQ ID NO: 27253 - RNA, 64 nt, hsa
uguauuaaaccauguacguugcagcuuaacaauaaaaaaaaaucuaugaaucuuugugagcaau

SEQ ID NO: 27254 - RNA, 64 nt, hsa
gcccgcccaauauggugaaaccccgucucuccugaaaaaaaaaaacacaaaaauuagccaggca

SEQ ID NO: 27255 - RNA, 64 nt, hsa
cccgcccaauauggugaaaccccgucucuccugaaaaaaaaaaacacaaaaauuagccaggcau

SEQ ID NO: 27256 - RNA, 64 nt, hsa
ccgcccaauauggugaaaccccgucucuccugaaaaaaaaaaacacaaaaauuagccaggcaug

SEQ ID NO: 27257 - RNA, 64 nt, hsa
cgcccaauauggugaaaccccgucucuccugaaaaaaaaaaacacaaaaauuagccaggcaugg

SEQ ID NO: 27258 - RNA, 64 nt, hsa
acaucugugaaaaagauaaugugaaauaaacaguaaaaaaaaaaaguauguugauggcagugag

SEQ ID NO: 27259 - RNA, 64 nt, hsa
caucugugaaaaagauaaugugaaauaaacaguaaaaaaaaaaaguauguugauggcagugaga

SEQ ID NO: 27260 - RNA, 64 nt, hsa
aucugugaaaaagauaaugugaaauaaacaguaaaaaaaaaaaguauguugauggcagugagag

SEQ ID NO: 27261 - RNA, 64 nt, hsa
ucugugaaaaagauaaugugaaauaaacaguaaaaaaaaaaaguauguugauggcagugagagu

SEQ ID NO: 27262 - RNA, 64 nt, hsa
gcaaaaaacaaacuccccaaacccaaguugaaacaaaaaaaacccccagacuguaauaguauua

SEQ ID NO: 27263 - RNA, 64 nt, hsa
agggaucuuuaaagugggagcaggaaaggcugcuaaaaaaaaaaaaaaaaaaaaaagugggcuu

SEQ ID NO: 27264 - RNA, 64 nt, hsa
gggaucuuuaaagugggagcaggaaaggcugcuaaaaaaaaaaaaaaaaaaaaaagugggcuuu

SEQ ID NO: 27265 - RNA, 64 nt, hsa
ggaucuuuaaagugggagcaggaaaggcugcuaaaaaaaaaaaaaaaaaaaaaagugggcuuuu

SEQ ID NO: 27266 - RNA, 64 nt, hsa
gaucuuuaaagugggagcaggaaaggcugcuaaaaaaaaaaaaaaaaaaaaaagugggcuuuug

SEQ ID NO: 27267 - RNA, 64 nt, hsa
aucuuuaaagugggagcaggaaaggcugcuaaaaaaaaaaaaaaaaaaaaaagugggcuuuugg

SEQ ID NO: 27268 - RNA, 64 nt, hsa
ucuuuaaagugggagcaggaaaggcugcuaaaaaaaaaaaaaaaaaaaaaagugggcuuuuggg

SEQ ID NO: 27269 - RNA, 64 nt, hsa
cuuuaaagugggagcaggaaaggcugcuaaaaaaaaaaaaaaaaaaaaaagugggcuuuugggu

SEQ ID NO: 27270 - RNA, 64 nt, hsa
uuuaaagugggagcaggaaaggcugcuaaaaaaaaaaaaaaaaaaaaaagugggcuuuuggguc

SEQ ID NO: 27271 - RNA, 64 nt, hsa
uuaaagugggagcaggaaaggcugcuaaaaaaaaaaaaaaaaaaaaaagugggcuuuugggucc

SEQ ID NO: 27272 - RNA, 64 nt, hsa
uaaagugggagcaggaaaggcugcuaaaaaaaaaaaaaaaaaaaaaagugggcuuuuggguccc

SEQ ID NO: 27273 - RNA, 64 nt, hsa
aaagugggagcaggaaaggcugcuaaaaaaaaaaaaaaaaaaaaaagugggcuuuugggucccu

SEQ ID NO: 27274 - RNA, 64 nt, hsa
aagugggagcaggaaaggcugcuaaaaaaaaaaaaaaaaaaaaaagugggcuuuugggucccug

SEQ ID NO: 27275 - RNA, 64 nt, hsa
agugggagcaggaaaggcugcuaaaaaaaaaaaaaaaaaaaaaagugggcuuuugggucccuga

SEQ ID NO: 27276 - RNA, 64 nt, hsa
gugggagcaggaaaggcugcuaaaaaaaaaaaaaaaaaaaaaagugggcuuuugggucccugaa

SEQ ID NO: 27277 - RNA, 64 nt, hsa
ugggagcaggaaaggcugcuaaaaaaaaaaaaaaaaaaaaaagugggcuuuugggucccugaaa

SEQ ID NO: 27278 - RNA, 64 nt, hsa
aaggcgagcuaagaggagacuuagauccagugggaaaaaaaauagcguuucacauaaaaagcau

SEQ ID NO: 27279 - RNA, 64 nt, hsa
aaaaauccaagucugaacgggaaugcccucauucaaaaaaaagaacuuugaaagagaaucuuuc

SEQ ID NO: 27280 - RNA, 64 nt, hsa
aaggggcugucaaaggcagaaagaaaugaagaacaaaaaaaaagauugauuuuuuuuuuuuuga

SEQ ID NO: 27281 - RNA, 64 nt, hsa
aggggcugucaaaggcagaaagaaaugaagaacaaaaaaaaagauugauuuuuuuuuuuuugag

SEQ ID NO: 27282 - RNA, 64 nt, hsa
uccugugaaaaggagacagaaacaaguaagagccaaaaaaaaaaaaaaaaaaaauccauaucca

SEQ ID NO: 27283 - RNA, 64 nt, hsa
ccugugaaaaggagacagaaacaaguaagagccaaaaaaaaaaaaaaaaaaaauccauauccau

SEQ ID NO: 27284 - RNA, 64 nt, hsa
cugugaaaaggagacagaaacaaguaagagccaaaaaaaaaaaaaaaaaaaauccauauccauu

SEQ ID NO: 27285 - RNA, 64 nt, hsa
ugugaaaaggagacagaaacaaguaagagccaaaaaaaaaaaaaaaaaaaauccauauccauuc

SEQ ID NO: 27286 - RNA, 64 nt, hsa
gugaaaaggagacagaaacaaguaagagccaaaaaaaaaaaaaaaaaaaauccauauccauuca

SEQ ID NO: 27287 - RNA, 64 nt, hsa
ugaaaaggagacagaaacaaguaagagccaaaaaaaaaaaaaaaaaaaauccauauccauucau

SEQ ID NO: 27288 - RNA, 64 nt, hsa
gaaaaggagacagaaacaaguaagagccaaaaaaaaaaaaaaaaaaaauccauauccauucauu

SEQ ID NO: 27289 - RNA, 64 nt, hsa
aaaaggagacagaaacaaguaagagccaaaaaaaaaaaaaaaaaaaauccauauccauucauua

SEQ ID NO: 27290 - RNA, 64 nt, hsa
aaaggagacagaaacaaguaagagccaaaaaaaaaaaaaaaaaaaauccauauccauucauuaa

SEQ ID NO: 27291 - RNA, 64 nt, hsa
aaggagacagaaacaaguaagagccaaaaaaaaaaaaaaaaaaaauccauauccauucauuaaa

SEQ ID NO: 27292 - RNA, 64 nt, hsa
aggagacagaaacaaguaagagccaaaaaaaaaaaaaaaaaaaauccauauccauucauuaaaa

SEQ ID NO: 27293 - RNA, 64 nt, hsa
ggagacagaaacaaguaagagccaaaaaaaaaaaaaaaaaaaauccauauccauucauuaaaaa

SEQ ID NO: 27294 - RNA, 64 nt, hsa
gagacagaaacaaguaagagccaaaaaaaaaaaaaaaaaaaauccauauccauucauuaaaaaa

SEQ ID NO: 27295 - RNA, 64 nt, hsa
ggcuggggccaagaggaaaaacagggaaaaaaagaaaaaaaaaagaaaaaggaaaaggaagcgg

SEQ ID NO: 27296 - RNA, 64 nt, hsa
gcuggggccaagaggaaaaacagggaaaaaaagaaaaaaaaaagaaaaaggaaaaggaagcggu

SEQ ID NO: 27297 - RNA, 64 nt, hsa
cuggggccaagaggaaaaacagggaaaaaaagaaaaaaaaaagaaaaaggaaaaggaagcggug

SEQ ID NO: 27298 - RNA, 64 nt, hsa
acuuauguaacuuucaaagguuguacaauuauacaaaaaaaaaaaaaaggcaaacuauaggaua

SEQ ID NO: 27299 - RNA, 64 nt, hsa
cuuauguaacuuucaaagguuguacaauuauacaaaaaaaaaaaaaaggcaaacuauaggauaa

SEQ ID NO: 27300 - RNA, 64 nt, hsa
uuauguaacuuucaaagguuguacaauuauacaaaaaaaaaaaaaaggcaaacuauaggauaac

SEQ ID NO: 27301 - RNA, 64 nt, hsa
uauguaacuuucaaagguuguacaauuauacaaaaaaaaaaaaaaggcaaacuauaggauaaca

SEQ ID NO: 27302 - RNA, 64 nt, hsa
auguaacuuucaaagguuguacaauuauacaaaaaaaaaaaaaaggcaaacuauaggauaacac

SEQ ID NO: 27303 - RNA, 64 nt, hsa
uguaacuuucaaagguuguacaauuauacaaaaaaaaaaaaaaggcaaacuauaggauaacaca

SEQ ID NO: 27304 - RNA, 64 nt, hsa
guaacuuucaaagguuguacaauuauacaaaaaaaaaaaaaaggcaaacuauaggauaacacag

SEQ ID NO: 27305 - RNA, 64 nt, hsa
acuccagccugggcaacagagcaagacccaucucaaaaaaaaaauuuuuuuccugagaggaagc

SEQ ID NO: 27306 - RNA, 64 nt, hsa
cuccagccugggcaacagagcaagacccaucucaaaaaaaaaauuuuuuuccugagaggaagcc

SEQ ID NO: 27307 - RNA, 64 nt, hsa
uccagccugggcaacagagcaagacccaucucaaaaaaaaaauuuuuuuccugagaggaagccu

SEQ ID NO: 27308 - RNA, 64 nt, hsa
uucucguagcuuuuuaaaaaaaugaaaguaaaggaaaaaaaaaaaacugcaaaucuagaaaacu

SEQ ID NO: 27309 - RNA, 64 nt, hsa
ucucguagcuuuuuaaaaaaaugaaaguaaaggaaaaaaaaaaaacugcaaaucuagaaaacuu

SEQ ID NO: 27310 - RNA, 64 nt, hsa
cucguagcuuuuuaaaaaaaugaaaguaaaggaaaaaaaaaaaacugcaaaucuagaaaacuuu

SEQ ID NO: 27311 - RNA, 64 nt, hsa
ucguagcuuuuuaaaaaaaugaaaguaaaggaaaaaaaaaaaacugcaaaucuagaaaacuuuu

SEQ ID NO: 27312 - RNA, 64 nt, hsa
cguagcuuuuuaaaaaaaugaaaguaaaggaaaaaaaaaaaacugcaaaucuagaaaacuuuuu

SEQ ID NO: 27313 - RNA, 63 nt, hsa
guucaccugguuugaaauaauaaaauguagaaagaaaaaaaauaccgagaacugauggguauu

SEQ ID NO: 27314 - RNA, 64 nt, hsa
auguugaucuuuuucaaaaaaauauauauaugacaaaaaaaaaaaaaaaggagcacaagcuguu

SEQ ID NO: 27315 - RNA, 64 nt, hsa
uguugaucuuuuucaaaaaaauauauauaugacaaaaaaaaaaaaaaaggagcacaagcuguuu

SEQ ID NO: 27316 - RNA, 64 nt, hsa
guugaucuuuuucaaaaaaauauauauaugacaaaaaaaaaaaaaaaggagcacaagcuguuug

SEQ ID NO: 27317 - RNA, 64 nt, hsa
uugaucuuuuucaaaaaaauauauauaugacaaaaaaaaaaaaaaaggagcacaagcuguuuga

SEQ ID NO: 27318 - RNA, 64 nt, hsa
ugaucuuuuucaaaaaaauauauauaugacaaaaaaaaaaaaaaaggagcacaagcuguuugaa

SEQ ID NO: 27319 - RNA, 64 nt, hsa
gaucuuuuucaaaaaaauauauauaugacaaaaaaaaaaaaaaaggagcacaagcuguuugaac

SEQ ID NO: 27320 - RNA, 64 nt, hsa
aucuuuuucaaaaaaauauauauaugacaaaaaaaaaaaaaaaggagcacaagcuguuugaacc

SEQ ID NO: 27321 - RNA, 64 nt, hsa
ucuuuuucaaaaaaauauauauaugacaaaaaaaaaaaaaaaggagcacaagcuguuugaacca

SEQ ID NO: 27322 - RNA, 64 nt, hsa
cuuuauauuugcuuauuuguuguagcuacauuuuaaaaaaaagauugaacuugaugacuuaggu

SEQ ID NO: 27323 - RNA, 64 nt, hsa
aguauguuguaaaaccugccaccugaauaaaaugaaaaaaaaaguguuuuuuugagacagaguc

SEQ ID NO: 27324 - RNA, 64 nt, hsa
guauguuguaaaaccugccaccugaauaaaaugaaaaaaaaaguguuuuuuugagacagagucu

SEQ ID NO: 27325 - RNA, 64 nt, hsa
gugcaguauaauucccaaguguacugucuaccagaaaaaaaaaacaaaacuaauaaaaaaugaa

SEQ ID NO: 27326 - RNA, 64 nt, hsa
ugcaguauaauucccaaguguacugucuaccagaaaaaaaaaacaaaacuaauaaaaaaugaaa

SEQ ID NO: 27327 - RNA, 64 nt, hsa
gcaguauaauucccaaguguacugucuaccagaaaaaaaaaacaaaacuaauaaaaaaugaaau

SEQ ID NO: 27328 - RNA, 64 nt, hsa
gggaaauggaucacacgauuucuuuaagggaauuaaaaaaaauaaaagaauuacggcuuuuaca

SEQ ID NO: 27329 - RNA, 64 nt, hsa
ggcuuuuacagcaacaauacgauuaucuuauaggaaaaaaaaaaucauuguaaaguaucaagac

SEQ ID NO: 27330 - RNA, 64 nt, hsa
gcuuuuacagcaacaauacgauuaucuuauaggaaaaaaaaaaucauuguaaaguaucaagaca

SEQ ID NO: 27331 - RNA, 64 nt, hsa
cuuuuacagcaacaauacgauuaucuuauaggaaaaaaaaaaucauuguaaaguaucaagacaa

SEQ ID NO: 27332 - RNA, 64 nt, hsa
aguuuaauugaaagaauguaaagcaaccaaaaagaaaaaaaaaaagaaagaaagaggaaaagaa

SEQ ID NO: 27333 - RNA, 64 nt, hsa
guuuaauugaaagaauguaaagcaaccaaaaagaaaaaaaaaaagaaagaaagaggaaaagaaa

SEQ ID NO: 27334 - RNA, 64 nt, hsa
uuuaauugaaagaauguaaagcaaccaaaaagaaaaaaaaaaagaaagaaagaggaaaagaaau

SEQ ID NO: 27335 - RNA, 64 nt, hsa
uuaauugaaagaauguaaagcaaccaaaaagaaaaaaaaaaagaaagaaagaggaaaagaaauc

SEQ ID NO: 27336 - RNA, 64 nt, hsa
caaacuauuuaaagaaauauguauucuguaaaagaaaaaaaaaaugcggccuuuucaugaggau

SEQ ID NO: 27337 - RNA, 64 nt, hsa
aaacuauuuaaagaaauauguauucuguaaaagaaaaaaaaaaugcggccuuuucaugaggauc

SEQ ID NO: 27338 - RNA, 64 nt, hsa
aacuauuuaaagaaauauguauucuguaaaagaaaaaaaaaaugcggccuuuucaugaggaucg

SEQ ID NO: 27339 - RNA, 64 nt, hsa
cuuuggaaacauauguccuagaaaacauaaaauuaaaaaaaaacacuauaguguaguuuuugga

SEQ ID NO: 27340 - RNA, 64 nt, hsa
uuuggaaacauauguccuagaaaacauaaaauuaaaaaaaaacacuauaguguaguuuuuggaa

SEQ ID NO: 27341 - RNA, 64 nt, hsa
auugacaacacagccuauaggccaaugcaugaguaaaaaaaaaaacaauuacuggcucacuggc

SEQ ID NO: 27342 - RNA, 64 nt, hsa
uugacaacacagccuauaggccaaugcaugaguaaaaaaaaaaacaauuacuggcucacuggcu

SEQ ID NO: 27343 - RNA, 64 nt, hsa
ugacaacacagccuauaggccaaugcaugaguaaaaaaaaaaacaauuacuggcucacuggcuu

SEQ ID NO: 27344 - RNA, 64 nt, hsa
gacaacacagccuauaggccaaugcaugaguaaaaaaaaaaacaauuacuggcucacuggcuuu

SEQ ID NO: 27345 - RNA, 64 nt, hsa
uggcuguuuuuauuuuuuaaaagguauaaacaccaaaaaaaaaauuaacauuguaugaagaugg

SEQ ID NO: 27346 - RNA, 64 nt, hsa
ggcuguuuuuauuuuuuaaaagguauaaacaccaaaaaaaaaauuaacauuguaugaagaugga

SEQ ID NO: 27347 - RNA, 64 nt, hsa
gcuguuuuuauuuuuuaaaagguauaaacaccaaaaaaaaaauuaacauuguaugaagauggaa

SEQ ID NO: 27348 - RNA, 64 nt, hsa
aauaaauuugacucauuaaaaaccuuuuuuuuuuaaaaaaaaaaaaaaagaaaaucucauuagu

SEQ ID NO: 27349 - RNA, 64 nt, hsa
auaaauuugacucauuaaaaaccuuuuuuuuuuaaaaaaaaaaaaaaagaaaaucucauuagug

SEQ ID NO: 27350 - RNA, 64 nt, hsa
uaaauuugacucauuaaaaaccuuuuuuuuuuaaaaaaaaaaaaaaagaaaaucucauuaguga

SEQ ID NO: 27351 - RNA, 64 nt, hsa
aaauuugacucauuaaaaaccuuuuuuuuuuaaaaaaaaaaaaaaagaaaaucucauuagugaa

SEQ ID NO: 27352 - RNA, 64 nt, hsa
aauuugacucauuaaaaaccuuuuuuuuuuaaaaaaaaaaaaaaagaaaaucucauuagugaac

SEQ ID NO: 27353 - RNA, 64 nt, hsa
auuugacucauuaaaaaccuuuuuuuuuuaaaaaaaaaaaaaaagaaaaucucauuagugaacu

SEQ ID NO: 27354 - RNA, 64 nt, hsa
uuugacucauuaaaaaccuuuuuuuuuuaaaaaaaaaaaaaaagaaaaucucauuagugaacuu

SEQ ID NO: 27355 - RNA, 64 nt, hsa
uugacucauuaaaaaccuuuuuuuuuuaaaaaaaaaaaaaaagaaaaucucauuagugaacuua

SEQ ID NO: 27356 - RNA, 64 nt, hsa
uuauguaagaaguacauauuagucugccaucuuuaaaaaaaaauacaguauuuucauuuaaauu

SEQ ID NO: 27357 - RNA, 64 nt, hsa
uauguaagaaguacauauuagucugccaucuuuaaaaaaaaauacaguauuuucauuuaaauuc

SEQ ID NO: 27358 - RNA, 64 nt, hsa
cuccaaucugggugaaagaccgagacuccgccucaaaaaaaaaaaaaaaagaaagaaagaaaga

SEQ ID NO: 27359 - RNA, 64 nt, hsa
uccaaucugggugaaagaccgagacuccgccucaaaaaaaaaaaaaaaagaaagaaagaaagaa

SEQ ID NO: 27360 - RNA, 64 nt, hsa
ccaaucugggugaaagaccgagacuccgccucaaaaaaaaaaaaaaaagaaagaaagaaagaaa

SEQ ID NO: 27361 - RNA, 64 nt, hsa
caaucugggugaaagaccgagacuccgccucaaaaaaaaaaaaaaaagaaagaaagaaagaaag

SEQ ID NO: 27362 - RNA, 64 nt, hsa
aaucugggugaaagaccgagacuccgccucaaaaaaaaaaaaaaaagaaagaaagaaagaaaga

SEQ ID NO: 27363 - RNA, 64 nt, hsa
aucugggugaaagaccgagacuccgccucaaaaaaaaaaaaaaaagaaagaaagaaagaaagaa

SEQ ID NO: 27364 - RNA, 64 nt, hsa
ucugggugaaagaccgagacuccgccucaaaaaaaaaaaaaaaagaaagaaagaaagaaagaaa

SEQ ID NO: 27365 - RNA, 64 nt, hsa
cugggugaaagaccgagacuccgccucaaaaaaaaaaaaaaaagaaagaaagaaagaaagaaag

SEQ ID NO: 27366 - RNA, 64 nt, hsa
ugggugaaagaccgagacuccgccucaaaaaaaaaaaaaaaagaaagaaagaaagaaagaaaga

SEQ ID NO: 27367 - RNA, 64 nt, hsa
uagcucuaaaacuuaauuuaaaauguaauuccagaaaaaaaaagggaauaagcaaagggggaag

SEQ ID NO: 27368 - RNA, 64 nt, hsa
agcucuaaaacuuaauuuaaaauguaauuccagaaaaaaaaagggaauaagcaaagggggaaga

SEQ ID NO: 27369 - RNA, 64 nt, hsa
cuugacuaaugguucccgguuuagcugaagauucaaaaaaaaaaaaaaaagcuuuaugcuaacu

SEQ ID NO: 27370 - RNA, 64 nt, hsa
uugacuaaugguucccgguuuagcugaagauucaaaaaaaaaaaaaaaagcuuuaugcuaacug

SEQ ID NO: 27371 - RNA, 64 nt, hsa
ugacuaaugguucccgguuuagcugaagauucaaaaaaaaaaaaaaaagcuuuaugcuaacugg

SEQ ID NO: 27372 - RNA, 64 nt, hsa
gacuaaugguucccgguuuagcugaagauucaaaaaaaaaaaaaaaagcuuuaugcuaacugga

SEQ ID NO: 27373 - RNA, 64 nt, hsa
acuaaugguucccgguuuagcugaagauucaaaaaaaaaaaaaaaagcuuuaugcuaacuggag

SEQ ID NO: 27374 - RNA, 64 nt, hsa
cuaaugguucccgguuuagcugaagauucaaaaaaaaaaaaaaaagcuuuaugcuaacuggagu

SEQ ID NO: 27375 - RNA, 64 nt, hsa
uaaugguucccgguuuagcugaagauucaaaaaaaaaaaaaaaagcuuuaugcuaacuggaguu

SEQ ID NO: 27376 - RNA, 64 nt, hsa
aaugguucccgguuuagcugaagauucaaaaaaaaaaaaaaaagcuuuaugcuaacuggaguua

SEQ ID NO: 27377 - RNA, 64 nt, hsa
augguucccgguuuagcugaagauucaaaaaaaaaaaaaaaagcuuuaugcuaacuggaguuaa

SEQ ID NO: 27378 - RNA, 64 nt, hsa
auaucccagaaagacuauauauuguuuuuuuuuuaaaaaaaaaaagaagaaaaaagagacagag

SEQ ID NO: 27379 - RNA, 64 nt, hsa
uaucccagaaagacuauauauuguuuuuuuuuuaaaaaaaaaaagaagaaaaaagagacagaga

SEQ ID NO: 27380 - RNA, 64 nt, hsa
aucccagaaagacuauauauuguuuuuuuuuuaaaaaaaaaaagaagaaaaaagagacagagaa

SEQ ID NO: 27381 - RNA, 64 nt, hsa
ucccagaaagacuauauauuguuuuuuuuuuaaaaaaaaaaagaagaaaaaagagacagagaaa

SEQ ID NO: 27382 - RNA, 64 nt, hsa
cacaauauaugaaauaguacccucuaaaaaagagaaaaaaaaaaucaggcggucaaacuuagag

SEQ ID NO: 27383 - RNA, 64 nt, hsa
acaauauaugaaauaguacccucuaaaaaagagaaaaaaaaaaucaggcggucaaacuuagagc

SEQ ID NO: 27384 - RNA, 64 nt, hsa
caauauaugaaauaguacccucuaaaaaagagaaaaaaaaaaucaggcggucaaacuuagagca

SEQ ID NO: 27385 - RNA, 64 nt, hsa
uuguaucuacugauaacagaaucugggucacaugaaaaaaaaucauuuuauccgucuuuuaagu

SEQ ID NO: 27386 - RNA, 64 nt, hsa
acuagcccucuuucucucuguguggcaaacauuuaaaaaaaaaaaaaaaaagcaggaaagaucc

SEQ ID NO: 27387 - RNA, 64 nt, hsa
cuagcccucuuucucucuguguggcaaacauuuaaaaaaaaaaaaaaaaagcaggaaagauccc

SEQ ID NO: 27388 - RNA, 64 nt, hsa
uagcccucuuucucucuguguggcaaacauuuaaaaaaaaaaaaaaaaagcaggaaagauccca

SEQ ID NO: 27389 - RNA, 64 nt, hsa
agcccucuuucucucuguguggcaaacauuuaaaaaaaaaaaaaaaaagcaggaaagaucccaa

SEQ ID NO: 27390 - RNA, 64 nt, hsa
gcccucuuucucucuguguggcaaacauuuaaaaaaaaaaaaaaaaagcaggaaagaucccaag

SEQ ID NO: 27391 - RNA, 64 nt, hsa
cccucuuucucucuguguggcaaacauuuaaaaaaaaaaaaaaaaagcaggaaagaucccaagu

SEQ ID NO: 27392 - RNA, 64 nt, hsa
ccucuuucucucuguguggcaaacauuuaaaaaaaaaaaaaaaaagcaggaaagaucccaaguc

SEQ ID NO: 27393 - RNA, 64 nt, hsa
cucuuucucucuguguggcaaacauuuaaaaaaaaaaaaaaaaagcaggaaagaucccaaguca

SEQ ID NO: 27394 - RNA, 64 nt, hsa
ucuuucucucuguguggcaaacauuuaaaaaaaaaaaaaaaaagcaggaaagaucccaagucaa

SEQ ID NO: 27395 - RNA, 64 nt, hsa
cuuucucucuguguggcaaacauuuaaaaaaaaaaaaaaaaagcaggaaagaucccaagucaaa

SEQ ID NO: 27396 - RNA, 64 nt, hsa
uucaugcccuacuucuuaaugccucucuaaagccaaaaaaaaaaaaaaagacaaagccucuuaa

SEQ ID NO: 27397 - RNA, 64 nt, hsa
ucaugcccuacuucuuaaugccucucuaaagccaaaaaaaaaaaaaaagacaaagccucuuaau

SEQ ID NO: 27398 - RNA, 64 nt, hsa
caugcccuacuucuuaaugccucucuaaagccaaaaaaaaaaaaaaagacaaagccucuuaaua

SEQ ID NO: 27399 - RNA, 64 nt, hsa
augcccuacuucuuaaugccucucuaaagccaaaaaaaaaaaaaaagacaaagccucuuaauaa

SEQ ID NO: 27400 - RNA, 64 nt, hsa
ugcccuacuucuuaaugccucucuaaagccaaaaaaaaaaaaaaagacaaagccucuuaauaaa

SEQ ID NO: 27401 - RNA, 64 nt, hsa
gcccuacuucuuaaugccucucuaaagccaaaaaaaaaaaaaaagacaaagccucuuaauaaau

SEQ ID NO: 27402 - RNA, 64 nt, hsa
cccuacuucuuaaugccucucuaaagccaaaaaaaaaaaaaaagacaaagccucuuaauaaauu

SEQ ID NO: 27403 - RNA, 64 nt, hsa
ccuacuucuuaaugccucucuaaagccaaaaaaaaaaaaaaagacaaagccucuuaauaaauuu

SEQ ID NO: 27404 - RNA, 64 nt, hsa
uaacauggugaaaucccgucucuacuaaaaauacaaaaaaaaaaaaaaaaaaaagccaggcaug

SEQ ID NO: 27405 - RNA, 64 nt, hsa
aacauggugaaaucccgucucuacuaaaaauacaaaaaaaaaaaaaaaaaaaagccaggcaugg

SEQ ID NO: 27406 - RNA, 64 nt, hsa
acauggugaaaucccgucucuacuaaaaauacaaaaaaaaaaaaaaaaaaaagccaggcauggu

SEQ ID NO: 27407 - RNA, 64 nt, hsa
cauggugaaaucccgucucuacuaaaaauacaaaaaaaaaaaaaaaaaaaagccaggcauggug

SEQ ID NO: 27408 - RNA, 64 nt, hsa
auggugaaaucccgucucuacuaaaaauacaaaaaaaaaaaaaaaaaaaagccaggcauggugg

SEQ ID NO: 27409 - RNA, 64 nt, hsa
uggugaaaucccgucucuacuaaaaauacaaaaaaaaaaaaaaaaaaaagccaggcaugguggc

SEQ ID NO: 27410 - RNA, 64 nt, hsa
ggugaaaucccgucucuacuaaaaauacaaaaaaaaaaaaaaaaaaaagccaggcaugguggca

SEQ ID NO: 27411 - RNA, 64 nt, hsa
gugaaaucccgucucuacuaaaaauacaaaaaaaaaaaaaaaaaaaagccaggcaugguggcac

SEQ ID NO: 27412 - RNA, 64 nt, hsa
ugaaaucccgucucuacuaaaaauacaaaaaaaaaaaaaaaaaaaagccaggcaugguggcaca

SEQ ID NO: 27413 - RNA, 64 nt, hsa
gaaaucccgucucuacuaaaaauacaaaaaaaaaaaaaaaaaaaagccaggcaugguggcacac

SEQ ID NO: 27414 - RNA, 64 nt, hsa
aaaucccgucucuacuaaaaauacaaaaaaaaaaaaaaaaaaaagccaggcaugguggcacaca

SEQ ID NO: 27415 - RNA, 64 nt, hsa
aaucccgucucuacuaaaaauacaaaaaaaaaaaaaaaaaaaagccaggcaugguggcacacac

SEQ ID NO: 27416 - RNA, 64 nt, hsa
aucccgucucuacuaaaaauacaaaaaaaaaaaaaaaaaaaagccaggcaugguggcacacacc

SEQ ID NO: 27417 - RNA, 64 nt, hsa
cuccagccuggacaacagagcaagacucugucucaaaaaaaaaauaaaaaauaaaaaauaaaaa

SEQ ID NO: 27418 - RNA, 64 nt, hsa
uccagccuggacaacagagcaagacucugucucaaaaaaaaaauaaaaaauaaaaaauaaaaaa

SEQ ID NO: 27419 - RNA, 64 nt, hsa
ccagccuggacaacagagcaagacucugucucaaaaaaaaaauaaaaaauaaaaaauaaaaaau

SEQ ID NO: 27420 - RNA, 64 nt, hsa
caacauggugaaauccugccucuacuaaaaauacaaaaaaaaaaaaaaauuagcugggcauggu

SEQ ID NO: 27421 - RNA, 64 nt, hsa
aacauggugaaauccugccucuacuaaaaauacaaaaaaaaaaaaaaauuagcugggcauggug

SEQ ID NO: 27422 - RNA, 64 nt, hsa
acauggugaaauccugccucuacuaaaaauacaaaaaaaaaaaaaaauuagcugggcauggugg

SEQ ID NO: 27423 - RNA, 64 nt, hsa
cauggugaaauccugccucuacuaaaaauacaaaaaaaaaaaaaaauuagcugggcaugguggc

SEQ ID NO: 27424 - RNA, 64 nt, hsa
auggugaaauccugccucuacuaaaaauacaaaaaaaaaaaaaaauuagcugggcaugguggca

SEQ ID NO: 27425 - RNA, 64 nt, hsa
uggugaaauccugccucuacuaaaaauacaaaaaaaaaaaaaaauuagcugggcaugguggcac

SEQ ID NO: 27426 - RNA, 64 nt, hsa
ggugaaauccugccucuacuaaaaauacaaaaaaaaaaaaaaauuagcugggcaugguggcaca

SEQ ID NO: 27427 - RNA, 64 nt, hsa
gugaaauccugccucuacuaaaaauacaaaaaaaaaaaaaaauuagcugggcaugguggcacac

SEQ ID NO: 27428 - RNA, 64 nt, hsa
aauaaaugaaauagagaauagaaaagcaauacagaaaaaaaauuaugaaaucaaaagcugguuc

SEQ ID NO: 27429 - RNA, 64 nt, hsa
cuguucuuuaaaugucugaaauggaacagauuucaaaaaaaaaccccacaaucuaggaugggaa

SEQ ID NO: 27430 - RNA, 64 nt, hsa
uguucuuuaaaugucugaaauggaacagauuucaaaaaaaaaccccacaaucuaggaugggaac

SEQ ID NO: 27431 - RNA, 64 nt, hsa
gugaauuuauaauaauuucaaaauaaaacaaguuaaaaaaaaacccacuaugcuauaaguuagg

SEQ ID NO: 27432 - RNA, 64 nt, hsa
ugaauuuauaauaauuucaaaauaaaacaaguuaaaaaaaaacccacuaugcuauaaguuaggc

SEQ ID NO: 27433 - RNA, 64 nt, hsa
auuuuauaaaauccaccuccuccaaaaaagcaauaaaaaaaaaacaaacuauaauaagcuuuuc

SEQ ID NO: 27434 - RNA, 64 nt, hsa
uuuuauaaaauccaccuccuccaaaaaagcaauaaaaaaaaaacaaacuauaauaagcuuuucu

SEQ ID NO: 27435 - RNA, 64 nt, hsa
uuuauaaaauccaccuccuccaaaaaagcaauaaaaaaaaaacaaacuauaauaagcuuuucug

SEQ ID NO: 27436 - RNA, 64 nt, hsa
uauuucucauguuaaagccucuucccuugaaauuaaaaaaaaauuuuaacugauaaaacuuagg

SEQ ID NO: 27437 - RNA, 64 nt, hsa
auuucucauguuaaagccucuucccuugaaauuaaaaaaaaauuuuaacugauaaaacuuaggg

SEQ ID NO: 27438 - RNA, 64 nt, hsa
uagauuucugaagugcauauucauugaugccaagaaaaaaaaaaaguugccuuuuugaagugau

SEQ ID NO: 27439 - RNA, 64 nt, hsa
agauuucugaagugcauauucauugaugccaagaaaaaaaaaaaguugccuuuuugaagugaug

SEQ ID NO: 27440 - RNA, 64 nt, hsa
gauuucugaagugcauauucauugaugccaagaaaaaaaaaaaguugccuuuuugaagugaugu

SEQ ID NO: 27441 - RNA, 64 nt, hsa
auuucugaagugcauauucauugaugccaagaaaaaaaaaaaguugccuuuuugaagugauguu

SEQ ID NO: 27442 - RNA, 64 nt, hsa
ucugcaaaaaggaaaaagaaaccacaaauuggggaaaaaaaaagaagaaaaaccuguuuccgug

SEQ ID NO: 27443 - RNA, 64 nt, hsa
cugcaaaaaggaaaaagaaaccacaaauuggggaaaaaaaaagaagaaaaaccuguuuccgugu

SEQ ID NO: 27444 - RNA, 64 nt, hsa
gaagagaggagagggagaaaaauaaaaugaaaggaaaaaaaaaaguuugcaaauucagacagga

SEQ ID NO: 27445 - RNA, 64 nt, hsa
aagagaggagagggagaaaaauaaaaugaaaggaaaaaaaaaaguuugcaaauucagacaggaa

SEQ ID NO: 27446 - RNA, 64 nt, hsa
agagaggagagggagaaaaauaaaaugaaaggaaaaaaaaaaguuugcaaauucagacaggaaa

SEQ ID NO: 27447 - RNA, 64 nt, hsa
agaaaagcaauuauuucauuucagauagaaauacaaaaaaaaaaaaaauacuuuucuuagaagc

SEQ ID NO: 27448 - RNA, 64 nt, hsa
gaaaagcaauuauuucauuucagauagaaauacaaaaaaaaaaaaaauacuuuucuuagaagcc

SEQ ID NO: 27449 - RNA, 64 nt, hsa
aaaagcaauuauuucauuucagauagaaauacaaaaaaaaaaaaaauacuuuucuuagaagcca

SEQ ID NO: 27450 - RNA, 64 nt, hsa
aaagcaauuauuucauuucagauagaaauacaaaaaaaaaaaaaauacuuuucuuagaagccag

SEQ ID NO: 27451 - RNA, 64 nt, hsa
aagcaauuauuucauuucagauagaaauacaaaaaaaaaaaaaauacuuuucuuagaagccaga

SEQ ID NO: 27452 - RNA, 64 nt, hsa
agcaauuauuucauuucagauagaaauacaaaaaaaaaaaaaauacuuuucuuagaagccagau

SEQ ID NO: 27453 - RNA, 64 nt, hsa
gcaauuauuucauuucagauagaaauacaaaaaaaaaaaaaauacuuuucuuagaagccagaua

SEQ ID NO: 27454 - RNA, 64 nt, hsa
caaguccuaggaaguagguuaaaacuaauucuuuaaaaaaaaaaaaaaguugagccugaauuaa

SEQ ID NO: 27455 - RNA, 64 nt, hsa
aaguccuaggaaguagguuaaaacuaauucuuuaaaaaaaaaaaaaaguugagccugaauuaaa

SEQ ID NO: 27456 - RNA, 64 nt, hsa
aguccuaggaaguagguuaaaacuaauucuuuaaaaaaaaaaaaaaguugagccugaauuaaau

SEQ ID NO: 27457 - RNA, 64 nt, hsa
guccuaggaaguagguuaaaacuaauucuuuaaaaaaaaaaaaaaguugagccugaauuaaaug

SEQ ID NO: 27458 - RNA, 64 nt, hsa
uccuaggaaguagguuaaaacuaauucuuuaaaaaaaaaaaaaaguugagccugaauuaaaugu

SEQ ID NO: 27459 - RNA, 64 nt, hsa
ccuaggaaguagguuaaaacuaauucuuuaaaaaaaaaaaaaaguugagccugaauuaaaugua

SEQ ID NO: 27460 - RNA, 64 nt, hsa
cuaggaaguagguuaaaacuaauucuuuaaaaaaaaaaaaaaguugagccugaauuaaauguaa

SEQ ID NO: 27461 - RNA, 64 nt, hsa
auuaagagcacaaacuuuuuuuuguaaaacauguaaaaaaaaaaacugggauuaauuuuuagug

SEQ ID NO: 27462 - RNA, 64 nt, hsa
uuaagagcacaaacuuuuuuuuguaaaacauguaaaaaaaaaaacugggauuaauuuuuagugu

SEQ ID NO: 27463 - RNA, 64 nt, hsa
uaagagcacaaacuuuuuuuuguaaaacauguaaaaaaaaaaacugggauuaauuuuuaguguu

SEQ ID NO: 27464 - RNA, 64 nt, hsa
aagagcacaaacuuuuuuuuguaaaacauguaaaaaaaaaaacugggauuaauuuuuaguguug

SEQ ID NO: 27465 - RNA, 64 nt, hsa
cugagguacauuuugaaugacagcauauuguaagaaaaaaaaaggugaauaaaauuugacauua

SEQ ID NO: 27466 - RNA, 64 nt, hsa
ugagguacauuuugaaugacagcauauuguaagaaaaaaaaaggugaauaaaauuugacauuag

SEQ ID NO: 27467 - RNA, 64 nt, hsa
cucuucuuuuggaaugaaaguauagccaaaacauaaaaaaaaaaaaauccucaguauagcuugc

SEQ ID NO: 27468 - RNA, 64 nt, hsa
ucuucuuuuggaaugaaaguauagccaaaacauaaaaaaaaaaaaauccucaguauagcuugca

SEQ ID NO: 27469 - RNA, 64 nt, hsa
cuucuuuuggaaugaaaguauagccaaaacauaaaaaaaaaaaaauccucaguauagcuugcaa

SEQ ID NO: 27470 - RNA, 64 nt, hsa
uucuuuuggaaugaaaguauagccaaaacauaaaaaaaaaaaaauccucaguauagcuugcaau

SEQ ID NO: 27471 - RNA, 64 nt, hsa
ucuuuuggaaugaaaguauagccaaaacauaaaaaaaaaaaaauccucaguauagcuugcaauu

SEQ ID NO: 27472 - RNA, 64 nt, hsa
cuuuuggaaugaaaguauagccaaaacauaaaaaaaaaaaaauccucaguauagcuugcaauua

SEQ ID NO: 27473 - RNA, 64 nt, hsa
cugcuuauagccuuagaaagccuuuuacaaaauuaaaaaaaaaauagaugugcauucaguuuuu

SEQ ID NO: 27474 - RNA, 64 nt, hsa
ugcuuauagccuuagaaagccuuuuacaaaauuaaaaaaaaaauagaugugcauucaguuuuua

SEQ ID NO: 27475 - RNA, 64 nt, hsa
gcuuauagccuuagaaagccuuuuacaaaauuaaaaaaaaaauagaugugcauucaguuuuuaa

SEQ ID NO: 27476 - RNA, 64 nt, hsa
uuauuagauuuuaccaaugaauuuuucaaaauacaaaaaaaaguaguuuuuccuucauaacaua

SEQ ID NO: 27477 - RNA, 64 nt, hsa
gcuugacacccaccaagcaaaaguuucagccuggaaaaaaaaugggggggaaggguggaugaaa

SEQ ID NO: 27478 - RNA, 64 nt, hsa
uggggugccagaaagugucugcugauauuuguggaaaaaaaaucuauuuuguuuaccuacugua

SEQ ID NO: 27479 - RNA, 64 nt, hsa
gaaggaaaguagaaagccuuacuuuaggauuuuuaaaaaaaaauccaucucaccccauauuguu

SEQ ID NO: 27480 - RNA, 64 nt, hsa
aaggaaaguagaaagccuuacuuuaggauuuuuaaaaaaaaauccaucucaccccauauuguuc

SEQ ID NO: 27481 - RNA, 64 nt, hsa
uucccugucucuugaaaaaugcccauuugccuuuaaaaaaaaaaguuacagaaauacuauaaca

SEQ ID NO: 27482 - RNA, 64 nt, hsa
ucccugucucuugaaaaaugcccauuugccuuuaaaaaaaaaaguuacagaaauacuauaacau

SEQ ID NO: 27483 - RNA, 64 nt, hsa
cccugucucuugaaaaaugcccauuugccuuuaaaaaaaaaaguuacagaaauacuauaacaua

SEQ ID NO: 27484 - RNA, 64 nt, hsa
uaaguaaauaguuauuaaaaauauaucucacugcaaaaaaaaaaaagcaguaucuucacucaaa

SEQ ID NO: 27485 - RNA, 64 nt, hsa
aaguaaauaguuauuaaaaauauaucucacugcaaaaaaaaaaaagcaguaucuucacucaaaa

SEQ ID NO: 27486 - RNA, 64 nt, hsa
aguaaauaguuauuaaaaauauaucucacugcaaaaaaaaaaaagcaguaucuucacucaaaag

SEQ ID NO: 27487 - RNA, 64 nt, hsa
guaaauaguuauuaaaaauauaucucacugcaaaaaaaaaaaagcaguaucuucacucaaaagu

SEQ ID NO: 27488 - RNA, 64 nt, hsa
uaaauaguuauuaaaaauauaucucacugcaaaaaaaaaaaagcaguaucuucacucaaaaguc

SEQ ID NO: 27489 - RNA, 64 nt, hsa
cccauuuuuuaaagugcuagaaaaugcuuuuuuuaaaaaaaaaauacaaguuuuaaaaugacca

SEQ ID NO: 27490 - RNA, 64 nt, hsa
ccauuuuuuaaagugcuagaaaaugcuuuuuuuaaaaaaaaaauacaaguuuuaaaaugaccac

SEQ ID NO: 27491 - RNA, 64 nt, hsa
cauuuuuuaaagugcuagaaaaugcuuuuuuuaaaaaaaaaauacaaguuuuaaaaugaccacu

SEQ ID NO: 27492 - RNA, 64 nt, hsa
uagggauacagccuuuucuuuaucuuauagcaggaaaaaaaaacuuuugagggaaauagaaggg

SEQ ID NO: 27493 - RNA, 64 nt, hsa
agggauacagccuuuucuuuaucuuauagcaggaaaaaaaaacuuuugagggaaauagaagggc

SEQ ID NO: 27494 - RNA, 64 nt, hsa
uauaugaaucaauuauuacaucuguuuuacuaugaaaaaaaaauuaauacuacuagcuuccaga

SEQ ID NO: 27495 - RNA, 64 nt, hsa
auaugaaucaauuauuacaucuguuuuacuaugaaaaaaaaauuaauacuacuagcuuccagac

SEQ ID NO: 27496 - RNA, 64 nt, hsa
cuacagaugaguaaugaaguuaucuuuuuuguuuaaaaaaaaaaaaaacacugcauuaaaaaag

SEQ ID NO: 27497 - RNA, 64 nt, hsa
uacagaugaguaaugaaguuaucuuuuuuguuuaaaaaaaaaaaaaacacugcauuaaaaaagu

SEQ ID NO: 27498 - RNA, 64 nt, hsa
acagaugaguaaugaaguuaucuuuuuuguuuaaaaaaaaaaaaaacacugcauuaaaaaagua

SEQ ID NO: 27499 - RNA, 64 nt, hsa
cagaugaguaaugaaguuaucuuuuuuguuuaaaaaaaaaaaaaacacugcauuaaaaaaguau

SEQ ID NO: 27500 - RNA, 64 nt, hsa
agaugaguaaugaaguuaucuuuuuuguuuaaaaaaaaaaaaaacacugcauuaaaaaaguauc

SEQ ID NO: 27501 - RNA, 64 nt, hsa
gaugaguaaugaaguuaucuuuuuuguuuaaaaaaaaaaaaaacacugcauuaaaaaaguaucu

SEQ ID NO: 27502 - RNA, 64 nt, hsa
augaguaaugaaguuaucuuuuuuguuuaaaaaaaaaaaaaacacugcauuaaaaaaguaucug

SEQ ID NO: 27503 - RNA, 64 nt, hsa
ugauuuauauacucuguuuuacagauuuagcuagaaaaaaaaugucaguguuuuggugcaccuu

SEQ ID NO: 27504 - RNA, 64 nt, hsa
aacuaggaaaagguuaaacuggauuuuuuuuuuuaaaaaaaagaaaaaaaaagaagaaaaguau

SEQ ID NO: 27505 - RNA, 64 nt, hsa
aagguuaaacuggauuuuuuuuuuuaaaaaaaagaaaaaaaaagaagaaaaguauaccagauac

SEQ ID NO: 27506 - RNA, 64 nt, hsa
agguuaaacuggauuuuuuuuuuuaaaaaaaagaaaaaaaaagaagaaaaguauaccagauacc

SEQ ID NO: 27507 - RNA, 64 nt, hsa
uaaaaagauaagagcaucuagugcauuaaaugccaaaaaaaaaauacauuaucagugauugaaa

SEQ ID NO: 27508 - RNA, 64 nt, hsa
aaaaagauaagagcaucuagugcauuaaaugccaaaaaaaaaauacauuaucagugauugaaac

SEQ ID NO: 27509 - RNA, 64 nt, hsa
aaaagauaagagcaucuagugcauuaaaugccaaaaaaaaaauacauuaucagugauugaaacg

SEQ ID NO: 27510 - RNA, 64 nt, hsa
aaaagauuugguuuucauggcagucuguuuuuuuaaaaaaaaauuuuugagccacuaucuauug

SEQ ID NO: 27511 - RNA, 64 nt, hsa
aaagauuugguuuucauggcagucuguuuuuuuaaaaaaaaauuuuugagccacuaucuauugu

SEQ ID NO: 27512 - RNA, 64 nt, hsa
uggagaaaacccgguacgcucaaaaagaaaaaggaaaaaaaaaaaucccaucacccacagcaaa

SEQ ID NO: 27513 - RNA, 64 nt, hsa
ggagaaaacccgguacgcucaaaaagaaaaaggaaaaaaaaaaaucccaucacccacagcaaau

SEQ ID NO: 27514 - RNA, 64 nt, hsa
gagaaaacccgguacgcucaaaaagaaaaaggaaaaaaaaaaaucccaucacccacagcaaaug

SEQ ID NO: 27515 - RNA, 64 nt, hsa
agaaaacccgguacgcucaaaaagaaaaaggaaaaaaaaaaaucccaucacccacagcaaauga

SEQ ID NO: 27516 - RNA, 64 nt, hsa
uuuguucgaucccaacuuuccauuuuguucagauaaaaaaaaccaugaaauuacuguguuugaa

SEQ ID NO: 27517 - RNA, 64 nt, hsa
cuauauaugagauagagagacaauaauuucuugcaaaaaaaaaaagagauaaaagaaagaacag

SEQ ID NO: 27518 - RNA, 64 nt, hsa
uauauaugagauagagagacaauaauuucuugcaaaaaaaaaaagagauaaaagaaagaacaga

SEQ ID NO: 27519 - RNA, 64 nt, hsa
auauaugagauagagagacaauaauuucuugcaaaaaaaaaaagagauaaaagaaagaacagaa

SEQ ID NO: 27520 - RNA, 64 nt, hsa
uauaugagauagagagacaauaauuucuugcaaaaaaaaaaagagauaaaagaaagaacagaaa

SEQ ID NO: 27521 - RNA, 64 nt, hsa
cuuuagauaggguuccauuuaagauuuuuguaccaaaaaaaaaaaaaaaaaaaguuuaacuacu

SEQ ID NO: 27522 - RNA, 64 nt, hsa
uuuagauaggguuccauuuaagauuuuuguaccaaaaaaaaaaaaaaaaaaaguuuaacuacuu

SEQ ID NO: 27523 - RNA, 64 nt, hsa
uuagauaggguuccauuuaagauuuuuguaccaaaaaaaaaaaaaaaaaaaguuuaacuacuuu

SEQ ID NO: 27524 - RNA, 64 nt, hsa
uagauaggguuccauuuaagauuuuuguaccaaaaaaaaaaaaaaaaaaaguuuaacuacuuuu

SEQ ID NO: 27525 - RNA, 64 nt, hsa
agauaggguuccauuuaagauuuuuguaccaaaaaaaaaaaaaaaaaaaguuuaacuacuuuua

SEQ ID NO: 27526 - RNA, 64 nt, hsa
gauaggguuccauuuaagauuuuuguaccaaaaaaaaaaaaaaaaaaaguuuaacuacuuuuaa

SEQ ID NO: 27527 - RNA, 64 nt, hsa
auaggguuccauuuaagauuuuuguaccaaaaaaaaaaaaaaaaaaaguuuaacuacuuuuaaa

SEQ ID NO: 27528 - RNA, 64 nt, hsa
uaggguuccauuuaagauuuuuguaccaaaaaaaaaaaaaaaaaaaguuuaacuacuuuuaaaa

SEQ ID NO: 27529 - RNA, 64 nt, hsa
aggguuccauuuaagauuuuuguaccaaaaaaaaaaaaaaaaaaaguuuaacuacuuuuaaaaa

SEQ ID NO: 27530 - RNA, 64 nt, hsa
ggguuccauuuaagauuuuuguaccaaaaaaaaaaaaaaaaaaaguuuaacuacuuuuaaaaag

SEQ ID NO: 27531 - RNA, 64 nt, hsa
gguuccauuuaagauuuuuguaccaaaaaaaaaaaaaaaaaaaguuuaacuacuuuuaaaaagu

SEQ ID NO: 27532 - RNA, 64 nt, hsa
guuccauuuaagauuuuuguaccaaaaaaaaaaaaaaaaaaaguuuaacuacuuuuaaaaaguu

SEQ ID NO: 27533 - RNA, 64 nt, hsa
gggagcggcccugcgcugucacugacaucucauuaaaaaaaaaaaaaaauuugcucucaaggug

SEQ ID NO: 27534 - RNA, 64 nt, hsa
ggagcggcccugcgcugucacugacaucucauuaaaaaaaaaaaaaaauuugcucucaaggugu

SEQ ID NO: 27535 - RNA, 64 nt, hsa
gagcggcccugcgcugucacugacaucucauuaaaaaaaaaaaaaaauuugcucucaagguguu

SEQ ID NO: 27536 - RNA, 64 nt, hsa
agcggcccugcgcugucacugacaucucauuaaaaaaaaaaaaaaauuugcucucaagguguuu

SEQ ID NO: 27537 - RNA, 64 nt, hsa
gcggcccugcgcugucacugacaucucauuaaaaaaaaaaaaaaauuugcucucaagguguuug

SEQ ID NO: 27538 - RNA, 64 nt, hsa
cggcccugcgcugucacugacaucucauuaaaaaaaaaaaaaaauuugcucucaagguguuuga

SEQ ID NO: 27539 - RNA, 64 nt, hsa
ggcccugcgcugucacugacaucucauuaaaaaaaaaaaaaaauuugcucucaagguguuugag

SEQ ID NO: 27540 - RNA, 64 nt, hsa
gcccugcgcugucacugacaucucauuaaaaaaaaaaaaaaauuugcucucaagguguuugagg

SEQ ID NO: 27541 - RNA, 64 nt, hsa
augcauauagacagagcaugcagugaagaguauuaaaaaaaaaagcuuaguagauuuggugcag

SEQ ID NO: 27542 - RNA, 64 nt, hsa
ugcauauagacagagcaugcagugaagaguauuaaaaaaaaaagcuuaguagauuuggugcagc

SEQ ID NO: 27543 - RNA, 64 nt, hsa
gcauauagacagagcaugcagugaagaguauuaaaaaaaaaagcuuaguagauuuggugcagcu

SEQ ID NO: 27544 - RNA, 64 nt, hsa
acucuuauuuuuauuuuugaagguuuuuuuuuuuaaaaaaaaaaacguauaaaauaaugcccug

SEQ ID NO: 27545 - RNA, 64 nt, hsa
cucuuauuuuuauuuuugaagguuuuuuuuuuuaaaaaaaaaaacguauaaaauaaugcccuga

SEQ ID NO: 27546 - RNA, 64 nt, hsa
ucuuauuuuuauuuuugaagguuuuuuuuuuuaaaaaaaaaaacguauaaaauaaugcccugaa

SEQ ID NO: 27547 - RNA, 64 nt, hsa
cuuauuuuuauuuuugaagguuuuuuuuuuuaaaaaaaaaaacguauaaaauaaugcccugaaa

SEQ ID NO: 27548 - RNA, 64 nt, hsa
caaaaacaaaaauauacuuguauaugucacagagaaaaaaaaugcaaaauuuauaauagaguua

SEQ ID NO: 27549 - RNA, 64 nt, hsa
uggaaaugaugagauuauuuccuguguuaaaaaaaaaaaaaaucuuaaauuccuacaaugugaa

SEQ ID NO: 27550 - RNA, 64 nt, hsa
uuggaaaugaugagauuauuuccuguguuaaaaaaaaaaaaaaucuuaaauuccuacaauguga

SEQ ID NO: 27551 - RNA, 64 nt, hsa
uuuggaaaugaugagauuauuuccuguguuaaaaaaaaaaaaaaucuuaaauuccuacaaugug

SEQ ID NO: 27552 - RNA, 64 nt, hsa
cuuuggaaaugaugagauuauuuccuguguuaaaaaaaaaaaaaaucuuaaauuccuacaaugu

SEQ ID NO: 27553 - RNA, 64 nt, hsa
ucuuuggaaaugaugagauuauuuccuguguuaaaaaaaaaaaaaaucuuaaauuccuacaaug

SEQ ID NO: 27554 - RNA, 64 nt, hsa
aucuuuggaaaugaugagauuauuuccuguguuaaaaaaaaaaaaaaucuuaaauuccuacaau

SEQ ID NO: 27555 - RNA, 64 nt, hsa
caucuuuggaaaugaugagauuauuuccuguguuaaaaaaaaaaaaaaucuuaaauuccuacaa

SEQ ID NO: 27556 - RNA, 64 nt, hsa
aacaagagugaaacugcaucucaaaaaaaaaaagaaaaaaaauuuacgcuucuuaaccauuuuu

SEQ ID NO: 27557 - RNA, 64 nt, hsa
agccugggcaacaagagugaaacugcaucucaaaaaaaaaaagaaaaaaaauuuacgcuucuua

SEQ ID NO: 27558 - RNA, 64 nt, hsa
cagccugggcaacaagagugaaacugcaucucaaaaaaaaaaagaaaaaaaauuuacgcuucuu

SEQ ID NO: 27559 - RNA, 64 nt, hsa
ccagccugggcaacaagagugaaacugcaucucaaaaaaaaaaagaaaaaaaauuuacgcuucu

SEQ ID NO: 27560 - RNA, 64 nt, hsa
uccagccugggcaacaagagugaaacugcaucucaaaaaaaaaaagaaaaaaaauuuacgcuuc

SEQ ID NO: 27561 - RNA, 64 nt, hsa
ccauucucuguggccuguuuuuccuggaagaagaaaaaaaaagguuuggcaggccaucuuuuuu

SEQ ID NO: 27562 - RNA, 64 nt, hsa
accauucucuguggccuguuuuuccuggaagaagaaaaaaaaagguuuggcaggccaucuuuuu

SEQ ID NO: 27563 - RNA, 64 nt, hsa
cuauuguaaucauucauuuuuuuuguuguucggaaaaaaaaaguugaucuuuuuuuuugucgua

SEQ ID NO: 27564 - RNA, 64 nt, hsa
ccuauuguaaucauucauuuuuuuuguuguucggaaaaaaaaaguugaucuuuuuuuuugucgu

SEQ ID NO: 27565 - RNA, 64 nt, hsa
uuugccugagcuuugaacagucaguacuuaaaaaaaaaaaaaucauggggguggggugggggga

SEQ ID NO: 27566 - RNA, 64 nt, hsa
guuugccugagcuuugaacagucaguacuuaaaaaaaaaaaaaucauggggguggggugggggg

SEQ ID NO: 27567 - RNA, 64 nt, hsa
gguuugccugagcuuugaacagucaguacuuaaaaaaaaaaaaaucaugggggugggguggggg

SEQ ID NO: 27568 - RNA, 64 nt, hsa
ugguuugccugagcuuugaacagucaguacuuaaaaaaaaaaaaaucauggggguggggugggg

SEQ ID NO: 27569 - RNA, 64 nt, hsa
augguuugccugagcuuugaacagucaguacuuaaaaaaaaaaaaaucaugggggugggguggg

SEQ ID NO: 27570 - RNA, 64 nt, hsa
caugguuugccugagcuuugaacagucaguacuuaaaaaaaaaaaaaucauggggguggggugg

SEQ ID NO: 27571 - RNA, 64 nt, hsa
cagagcaagaucguuucucuaaaauuaaaaaaaaaaaaaaaagacaaauaaaaauugcauguau

SEQ ID NO: 27572 - RNA, 64 nt, hsa
acagagcaagaucguuucucuaaaauuaaaaaaaaaaaaaaaagacaaauaaaaauugcaugua

SEQ ID NO: 27573 - RNA, 64 nt, hsa
gacagagcaagaucguuucucuaaaauuaaaaaaaaaaaaaaaagacaaauaaaaauugcaugu

SEQ ID NO: 27574 - RNA, 64 nt, hsa
cgacagagcaagaucguuucucuaaaauuaaaaaaaaaaaaaaaagacaaauaaaaauugcaug

SEQ ID NO: 27575 - RNA, 64 nt, hsa
gcgacagagcaagaucguuucucuaaaauuaaaaaaaaaaaaaaaagacaaauaaaaauugcau

SEQ ID NO: 27576 - RNA, 64 nt, hsa
ggcgacagagcaagaucguuucucuaaaauuaaaaaaaaaaaaaaaagacaaauaaaaauugca

SEQ ID NO: 27577 - RNA, 64 nt, hsa
gggcgacagagcaagaucguuucucuaaaauuaaaaaaaaaaaaaaaagacaaauaaaaauugc

SEQ ID NO: 27578 - RNA, 64 nt, hsa
ugggcgacagagcaagaucguuucucuaaaauuaaaaaaaaaaaaaaaagacaaauaaaaauug

SEQ ID NO: 27579 - RNA, 64 nt, hsa
cugggcgacagagcaagaucguuucucuaaaauuaaaaaaaaaaaaaaaagacaaauaaaaauu

SEQ ID NO: 27580 - RNA, 64 nt, hsa
augcugaggacuaaaaccauuuuuuuugcacccaaaaaaaaaggcaggaaaaugaucaucagaa

SEQ ID NO: 27581 - RNA, 64 nt, hsa
gaugcugaggacuaaaaccauuuuuuuugcacccaaaaaaaaaggcaggaaaaugaucaucaga

SEQ ID NO: 27582 - RNA, 64 nt, hsa
agcacauauuuuugacccaguggaggcuuaaaaaaaaaaaaauccaagaacacaauucauuuuc

SEQ ID NO: 27583 - RNA, 64 nt, hsa
gagcacauauuuuugacccaguggaggcuuaaaaaaaaaaaaauccaagaacacaauucauuuu

SEQ ID NO: 27584 - RNA, 64 nt, hsa
agagcacauauuuuugacccaguggaggcuuaaaaaaaaaaaaauccaagaacacaauucauuu

SEQ ID NO: 27585 - RNA, 64 nt, hsa
aagagcacauauuuuugacccaguggaggcuuaaaaaaaaaaaaauccaagaacacaauucauu

SEQ ID NO: 27586 - RNA, 64 nt, hsa
uaagagcacauauuuuugacccaguggaggcuuaaaaaaaaaaaaauccaagaacacaauucau

SEQ ID NO: 27587 - RNA, 64 nt, hsa
uuaagagcacauauuuuugacccaguggaggcuuaaaaaaaaaaaaauccaagaacacaauuca

SEQ ID NO: 27588 - RNA, 64 nt, hsa
aaccagaacuaguggauuccagggcugggggaaaaaaaaaaagaaaaaaccucauuacugaccu

SEQ ID NO: 27589 - RNA, 64 nt, hsa
gaaccagaacuaguggauuccagggcugggggaaaaaaaaaaagaaaaaaccucauuacugacc

SEQ ID NO: 27590 - RNA, 64 nt, hsa
ugaaccagaacuaguggauuccagggcugggggaaaaaaaaaaagaaaaaaccucauuacugac

SEQ ID NO: 27591 - RNA, 64 nt, hsa
augaaccagaacuaguggauuccagggcugggggaaaaaaaaaaagaaaaaaccucauuacuga

SEQ ID NO: 27592 - RNA, 64 nt, hsa
uuggaaacuugccccuuauuuaaaaaaaaaaaagaaaaaaaagaguuuguuacucuauuguaug

SEQ ID NO: 27593 - RNA, 64 nt, hsa
cacugaucuuuggaaacuugccccuuauuuaaaaaaaaaaaagaaaaaaaagaguuuguuacuc

SEQ ID NO: 27594 - RNA, 64 nt, hsa
acacugaucuuuggaaacuugccccuuauuuaaaaaaaaaaaagaaaaaaaagaguuuguuacu

SEQ ID NO: 27595 - RNA, 64 nt, hsa
cacacugaucuuuggaaacuugccccuuauuuaaaaaaaaaaaagaaaaaaaagaguuuguuac

SEQ ID NO: 27596 - RNA, 64 nt, hsa
ccacacugaucuuuggaaacuugccccuuauuuaaaaaaaaaaaagaaaaaaaagaguuuguua

SEQ ID NO: 27597 - RNA, 64 nt, hsa
uccacacugaucuuuggaaacuugccccuuauuuaaaaaaaaaaaagaaaaaaaagaguuuguu

SEQ ID NO: 27598 - RNA, 64 nt, hsa
gguucuuaacuauucaaauauuuauucuguuagaaaaaaaaauuuucuguuuugcaauagaagg

SEQ ID NO: 27599 - RNA, 64 nt, hsa
ugguucuuaacuauucaaauauuuauucuguuagaaaaaaaaauuuucuguuuugcaauagaag

SEQ ID NO: 27600 - RNA, 64 nt, hsa
gcacauuccuuaaguccuaauugggaaaaaaaaaaaaaaaaaugaaauaguugaaaaacucugg

SEQ ID NO: 27601 - RNA, 64 nt, hsa
agcacauuccuuaaguccuaauugggaaaaaaaaaaaaaaaaaugaaauaguugaaaaacucug

SEQ ID NO: 27602 - RNA, 64 nt, hsa
cagcacauuccuuaaguccuaauugggaaaaaaaaaaaaaaaaaugaaauaguugaaaaacucu

SEQ ID NO: 27603 - RNA, 64 nt, hsa
ccagcacauuccuuaaguccuaauugggaaaaaaaaaaaaaaaaaugaaauaguugaaaaacuc

SEQ ID NO: 27604 - RNA, 64 nt, hsa
cccagcacauuccuuaaguccuaauugggaaaaaaaaaaaaaaaaaugaaauaguugaaaaacu

SEQ ID NO: 27605 - RNA, 64 nt, hsa
ucccagcacauuccuuaaguccuaauugggaaaaaaaaaaaaaaaaaugaaauaguugaaaaac

SEQ ID NO: 27606 - RNA, 64 nt, hsa
gucccagcacauuccuuaaguccuaauugggaaaaaaaaaaaaaaaaaugaaauaguugaaaaa

SEQ ID NO: 27607 - RNA, 64 nt, hsa
ugucccagcacauuccuuaaguccuaauugggaaaaaaaaaaaaaaaaaugaaauaguugaaaa

SEQ ID NO: 27608 - RNA, 64 nt, hsa
uugucccagcacauuccuuaaguccuaauugggaaaaaaaaaaaaaaaaaugaaauaguugaaa

SEQ ID NO: 27609 - RNA, 64 nt, hsa
uuugucccagcacauuccuuaaguccuaauugggaaaaaaaaaaaaaaaaaugaaauaguugaa

SEQ ID NO: 27610 - RNA, 64 nt, hsa
gggcauuacuguugcuaaaagaagaaaguuuaaaaaaaaaaaugauuuucucaaggaaugcccc

SEQ ID NO: 27611 - RNA, 64 nt, hsa
ugggcauuacuguugcuaaaagaagaaaguuuaaaaaaaaaaaugauuuucucaaggaaugccc

SEQ ID NO: 27612 - RNA, 64 nt, hsa
cugggcauuacuguugcuaaaagaagaaaguuuaaaaaaaaaaaugauuuucucaaggaaugcc

SEQ ID NO: 27613 - RNA, 64 nt, hsa
ccugggcauuacuguugcuaaaagaagaaaguuuaaaaaaaaaaaugauuuucucaaggaaugc

SEQ ID NO: 27614 - RNA, 64 nt, hsa
auugcucuaguuugucuuuggcaaaaaaaaaaaaaaaaaaaaguaaauauccagggaacccugc

SEQ ID NO: 27615 - RNA, 64 nt, hsa
cauugcucuaguuugucuuuggcaaaaaaaaaaaaaaaaaaaaguaaauauccagggaacccug

SEQ ID NO: 27616 - RNA, 64 nt, hsa
gcauugcucuaguuugucuuuggcaaaaaaaaaaaaaaaaaaaaguaaauauccagggaacccu

SEQ ID NO: 27617 - RNA, 64 nt, hsa
ggcauugcucuaguuugucuuuggcaaaaaaaaaaaaaaaaaaaaguaaauauccagggaaccc

SEQ ID NO: 27618 - RNA, 64 nt, hsa
aggcauugcucuaguuugucuuuggcaaaaaaaaaaaaaaaaaaaaguaaauauccagggaacc

SEQ ID NO: 27619 - RNA, 64 nt, hsa
uaggcauugcucuaguuugucuuuggcaaaaaaaaaaaaaaaaaaaaguaaauauccagggaac

SEQ ID NO: 27620 - RNA, 64 nt, hsa
auaggcauugcucuaguuugucuuuggcaaaaaaaaaaaaaaaaaaaaguaaauauccagggaa

SEQ ID NO: 27621 - RNA, 64 nt, hsa
cauaggcauugcucuaguuugucuuuggcaaaaaaaaaaaaaaaaaaaaguaaauauccaggga

SEQ ID NO: 27622 - RNA, 64 nt, hsa
acauaggcauugcucuaguuugucuuuggcaaaaaaaaaaaaaaaaaaaaguaaauauccaggg

SEQ ID NO: 27623 - RNA, 64 nt, hsa
uacauaggcauugcucuaguuugucuuuggcaaaaaaaaaaaaaaaaaaaaguaaauauccagg

SEQ ID NO: 27624 - RNA, 64 nt, hsa
uuacauaggcauugcucuaguuugucuuuggcaaaaaaaaaaaaaaaaaaaaguaaauauccag

SEQ ID NO: 27625 - RNA, 64 nt, hsa
cuuacauaggcauugcucuaguuugucuuuggcaaaaaaaaaaaaaaaaaaaaguaaauaucca

SEQ ID NO: 27626 - RNA, 64 nt, hsa
ucuuacauaggcauugcucuaguuugucuuuggcaaaaaaaaaaaaaaaaaaaaguaaauaucc

SEQ ID NO: 27627 - RNA, 64 nt, hsa
uguuuauacugcaccuugguuguugaugucaaguaaaaaaaagauuguuuuguaacacauaaaa

SEQ ID NO: 27628 - RNA, 64 nt, hsa
ugugucagucaccacaaaguaggccagauaaguuaaaaaaaauuuuuuuuuaaauaauaauuga

SEQ ID NO: 27629 - RNA, 64 nt, hsa
guagcagugaauauaguuaaaauacguacauuaaaaaaaaaauuauuagguccuuaccaguuac

SEQ ID NO: 27630 - RNA, 64 nt, hsa
uguagcagugaauauaguuaaaauacguacauuaaaaaaaaaauuauuagguccuuaccaguua

SEQ ID NO: 27631 - RNA, 64 nt, hsa
uuguagcagugaauauaguuaaaauacguacauuaaaaaaaaaauuauuagguccuuaccaguu

SEQ ID NO: 27632 - RNA, 64 nt, hsa
ugcuauaagcuagucuuguuuguaaaaaaaaaaaaaaaaaaagaaaaagaaaaaaguguauuuu

SEQ ID NO: 27633 - RNA, 64 nt, hsa
uugcuauaagcuagucuuguuuguaaaaaaaaaaaaaaaaaaagaaaaagaaaaaaguguauuu

SEQ ID NO: 27634 - RNA, 64 nt, hsa
uuugcuauaagcuagucuuguuuguaaaaaaaaaaaaaaaaaaagaaaaagaaaaaaguguauu

SEQ ID NO: 27635 - RNA, 64 nt, hsa
auuugcuauaagcuagucuuguuuguaaaaaaaaaaaaaaaaaaagaaaaagaaaaaaguguau

SEQ ID NO: 27636 - RNA, 64 nt, hsa
aauuugcuauaagcuagucuuguuuguaaaaaaaaaaaaaaaaaaagaaaaagaaaaaagugua

SEQ ID NO: 27637 - RNA, 64 nt, hsa
gaauuugcuauaagcuagucuuguuuguaaaaaaaaaaaaaaaaaaagaaaaagaaaaaagugu

SEQ ID NO: 27638 - RNA, 64 nt, hsa
agaauuugcuauaagcuagucuuguuuguaaaaaaaaaaaaaaaaaaagaaaaagaaaaaagug

SEQ ID NO: 27639 - RNA, 64 nt, hsa
gagaauuugcuauaagcuagucuuguuuguaaaaaaaaaaaaaaaaaaagaaaaagaaaaaagu

SEQ ID NO: 27640 - RNA, 64 nt, hsa
agagaauuugcuauaagcuagucuuguuuguaaaaaaaaaaaaaaaaaaagaaaaagaaaaaag

SEQ ID NO: 27641 - RNA, 64 nt, hsa
uagagaauuugcuauaagcuagucuuguuuguaaaaaaaaaaaaaaaaaaagaaaaagaaaaaa

SEQ ID NO: 27642 - RNA, 64 nt, hsa
auagagaauuugcuauaagcuagucuuguuuguaaaaaaaaaaaaaaaaaaagaaaaagaaaaa

SEQ ID NO: 27643 - RNA, 64 nt, hsa
uauagagaauuugcuauaagcuagucuuguuuguaaaaaaaaaaaaaaaaaaagaaaaagaaaa

SEQ ID NO: 27644 - RNA, 64 nt, hsa
auaucuagagaaacaacauaguggaaaaccgaaaaaaaaaaacagaaaaaucuaccgguaauuu

SEQ ID NO: 27645 - RNA, 64 nt, hsa
cauaucuagagaaacaacauaguggaaaaccgaaaaaaaaaaacagaaaaaucuaccgguaauu

SEQ ID NO: 27646 - RNA, 64 nt, hsa
acauaucuagagaaacaacauaguggaaaaccgaaaaaaaaaaacagaaaaaucuaccgguaau

SEQ ID NO: 27647 - RNA, 64 nt, hsa
uacauaucuagagaaacaacauaguggaaaaccgaaaaaaaaaaacagaaaaaucuaccgguaa

SEQ ID NO: 27648 - RNA, 64 nt, hsa
uuuccaguucaaaaugccuuauacaaucaagaggaaaaaaaauuacacaauuucaggcaagcua

SEQ ID NO: 27649 - RNA, 64 nt, hsa
ugucucaaguaaaauggcugagcauugcagagaaaaaaaaaaguccccacauuuuauuuuuuaa

SEQ ID NO: 27650 - RNA, 64 nt, hsa
augucucaaguaaaauggcugagcauugcagagaaaaaaaaaaguccccacauuuuauuuuuua

SEQ ID NO: 27651 - RNA, 64 nt, hsa
uaugucucaaguaaaauggcugagcauugcagagaaaaaaaaaaguccccacauuuuauuuuuu

SEQ ID NO: 27652 - RNA, 64 nt, hsa
gauguuuuguuuagcuugcggacucuaacacuuaaaaaaaaacccagaucagaagaucuggcca

SEQ ID NO: 27653 - RNA, 64 nt, hsa
ggauguuuuguuuagcuugcggacucuaacacuuaaaaaaaaacccagaucagaagaucuggcc

SEQ ID NO: 27654 - RNA, 64 nt, hsa
ucugggcgacagagcaagacucugacucaaaaaaaaaaaaaaguggcucugacuuucccauagg

SEQ ID NO: 27655 - RNA, 64 nt, hsa
gucugggcgacagagcaagacucugacucaaaaaaaaaaaaaaguggcucugacuuucccauag

SEQ ID NO: 27656 - RNA, 64 nt, hsa
agucugggcgacagagcaagacucugacucaaaaaaaaaaaaaaaaaaaaguggcucugacuuu

SEQ ID NO: 27657 - RNA, 64 nt, hsa
cagucugggcgacagagcaagacucugacucaaaaaaaaaaaaaaaaaaaaguggcucugacuu

SEQ ID NO: 27658 - RNA, 64 nt, hsa
ccagucugggcgacagagcaagacucugacucaaaaaaaaaaaaaaaaaaaaguggcucugacu

SEQ ID NO: 27659 - RNA, 64 nt, hsa
uccagucugggcgacagagcaagacucugacucaaaaaaaaaaaaaaaaaaaaguggcucugac

SEQ ID NO: 27660 - RNA, 64 nt, hsa
cuccagucugggcgacagagcaagacucugacucaaaaaaaaaaaaaaaaaaaaguggcucuga

SEQ ID NO: 27661 - RNA, 64 nt, hsa
aguuccgacugccaucuuggacuugucagcaaaaaaaaaaaauaauaauaauaauaaggccugc

SEQ ID NO: 27662 - RNA, 64 nt, hsa
gaguuccgacugccaucuuggacuugucagcaaaaaaaaaaaauaauaauaauaauaaggccug

SEQ ID NO: 27663 - RNA, 64 nt, hsa
agaguuccgacugccaucuuggacuugucagcaaaaaaaaaaaauaauaauaauaauaaggccu

SEQ ID NO: 27664 - RNA, 64 nt, hsa
cagaguuccgacugccaucuuggacuugucagcaaaaaaaaaaaauaauaauaauaauaaggcc

SEQ ID NO: 27665 - RNA, 64 nt, hsa
ucagaguuccgacugccaucuuggacuugucagcaaaaaaaaaaaauaauaauaauaauaaggc

SEQ ID NO: 27666 - RNA, 64 nt, hsa
cagccugggcaacagagugagacuccaucucaaaaaaaaaaagagagagagaugaaaagaguag

SEQ ID NO: 27667 - RNA, 64 nt, hsa
ccagccugggcaacagagugagacuccaucucaaaaaaaaaaagagagagagaugaaaagagua

SEQ ID NO: 27668 - RNA, 64 nt, hsa
uccagccugggcaacagagugagacuccaucucaaaaaaaaaaaaaaaaaaaaaaaaagagaga

SEQ ID NO: 27669 - RNA, 64 nt, hsa
cuccagccugggcaacagagugagacuccaucucaaaaaaaaaaaaaaaaaaaaaaaaagagag

SEQ ID NO: 27670 - RNA, 64 nt, hsa
gcaauaacaauauuauuauuguuauaacuaaaaaaaaaaaaacaaaaacaagcagcuuuuguga

SEQ ID NO: 27671 - RNA, 64 nt, hsa
agcaauaacaauauuauuauuguuauaacuaaaaaaaaaaaaacaaaaacaagcagcuuuugug

SEQ ID NO: 27672 - RNA, 64 nt, hsa
cagcaauaacaauauuauuauuguuauaacuaaaaaaaaaaaaacaaaaacaagcagcuuuugu

SEQ ID NO: 27673 - RNA, 64 nt, hsa
acagcaauaacaauauuauuauuguuauaacuaaaaaaaaaaaaacaaaaacaagcagcuuuug

SEQ ID NO: 27674 - RNA, 64 nt, hsa
aacagcaauaacaauauuauuauuguuauaacuaaaaaaaaaaaaacaaaaacaagcagcuuuu

SEQ ID NO: 27675 - RNA, 64 nt, hsa
aaacagcaauaacaauauuauuauuguuauaacuaaaaaaaaaaaaacaaaaacaagcagcuuu

SEQ ID NO: 27676 - RNA, 64 nt, hsa
cugggugacagagccagacucugucucaaaaaaaaaaaaaaagaaaagaaaaagauaaagggau

SEQ ID NO: 27677 - RNA, 64 nt, hsa
ccugggugacagagccagacucugucucaaaaaaaaaaaaaaagaaaagaaaaagauaaaggga

SEQ ID NO: 27678 - RNA, 64 nt, hsa
gccugggugacagagccagacucugucucaaaaaaaaaaaaaaagaaaagaaaaagauaaaggg

SEQ ID NO: 27679 - RNA, 64 nt, hsa
agccugggugacagagccagacucugucucaaaaaaaaaaaaaaagaaaagaaaaagauaaagg

SEQ ID NO: 27680 - RNA, 64 nt, hsa
cagccugggugacagagccagacucugucucaaaaaaaaaaaaaaagaaaagaaaaagauaaag

SEQ ID NO: 27681 - RNA, 64 nt, hsa
ccagccugggugacagagccagacucugucucaaaaaaaaaaaaaaagaaaagaaaaagauaaa

SEQ ID NO: 27682 - RNA, 64 nt, hsa
uccagccugggugacagagccagacucugucucaaaaaaaaaaaaaaagaaaagaaaaagauaa

SEQ ID NO: 27683 - RNA, 64 nt, hsa
cuccagccugggugacagagccagacucugucucaaaaaaaaaaaaaaagaaaagaaaaagaua

SEQ ID NO: 27684 - RNA, 64 nt, hsa
aggacaaagucuagaaaccacuaucauaguugcuaaaaaaaaugguuuucaaaugucaaauaca

SEQ ID NO: 27685 - RNA, 64 nt, hsa
ugucuguauauauguauauauuuugaacuuucuaaaaaaaaaucuggaaauagaaacaaguaaa

SEQ ID NO: 27686 - RNA, 64 nt, hsa
augucuguauauauguauauauuuugaacuuucuaaaaaaaaaucuggaaauagaaacaaguaa

SEQ ID NO: 27687 - RNA, 64 nt, hsa
uuuuucucccucuuuaaaaaacccuuuaaaagaaaaaaaaaaguagauagugcuaaauauuuua

SEQ ID NO: 27688 - RNA, 64 nt, hsa
uuuuuucucccucuuuaaaaaacccuuuaaaagaaaaaaaaaaguagauagugcuaaauauuuu

SEQ ID NO: 27689 - RNA, 64 nt, hsa
uuuuuuucucccucuuuaaaaaacccuuuaaaagaaaaaaaaaaguagauagugcuaaauauuu

SEQ ID NO: 27690 - RNA, 64 nt, hsa
uaucccagggacuaccucggcuuuuaauuuaaaaaaaaaaaagaaguggguaagaaaaugcaaa

SEQ ID NO: 27691 - RNA, 64 nt, hsa
uuaucccagggacuaccucggcuuuuaauuuaaaaaaaaaaaagaaguggguaagaaaaugcaa

SEQ ID NO: 27692 - RNA, 64 nt, hsa
auuaucccagggacuaccucggcuuuuaauuuaaaaaaaaaaaagaaguggguaagaaaaugca

SEQ ID NO: 27693 - RNA, 64 nt, hsa
uauuaucccagggacuaccucggcuuuuaauuuaaaaaaaaaaaagaaguggguaagaaaaugc

SEQ ID NO: 27694 - RNA, 64 nt, hsa
uuauuaucccagggacuaccucggcuuuuaauuuaaaaaaaaaaaagaaguggguaagaaaaug

SEQ ID NO: 27695 - RNA, 64 nt, hsa
auacccuucuuuuaugagcagaaggaaacaaaaaaaaaaaaagaagaccguuuaccuagaagaa

SEQ ID NO: 27696 - RNA, 64 nt, hsa
aauacccuucuuuuaugagcagaaggaaacaaaaaaaaaaaaagaagaccguuuaccuagaaga

SEQ ID NO: 27697 - RNA, 64 nt, hsa
aaauacccuucuuuuaugagcagaaggaaacaaaaaaaaaaaaagaagaccguuuaccuagaag

SEQ ID NO: 27698 - RNA, 64 nt, hsa
gaaauacccuucuuuuaugagcagaaggaaacaaaaaaaaaaaaagaagaccguuuaccuagaa

SEQ ID NO: 27699 - RNA, 64 nt, hsa
ggaaauacccuucuuuuaugagcagaaggaaacaaaaaaaaaaaaagaagaccguuuaccuaga

SEQ ID NO: 27700 - RNA, 64 nt, hsa
aggaaauacccuucuuuuaugagcagaaggaaacaaaaaaaaaaaaagaagaccguuuaccuag

SEQ ID NO: 27701 - RNA, 64 nt, hsa
cugguaugcauuaauggacuccacugaauccugaaaaaaaaauuaaacuuccuucuuacuugcc

SEQ ID NO: 27702 - RNA, 64 nt, hsa
ccugguaugcauuaauggacuccacugaauccugaaaaaaaaauuaaacuuccuucuuacuugc

SEQ ID NO: 27703 - RNA, 64 nt, hsa
ggauggaagauuuucauguaaaauaaaauuaaaaaaaaaaaacaaucucuucuuccugguucug

SEQ ID NO: 27704 - RNA, 64 nt, hsa
aggauggaagauuuucauguaaaauaaaauuaaaaaaaaaaaacaaucucuucuuccugguucu

SEQ ID NO: 27705 - RNA, 64 nt, hsa
gaggauggaagauuuucauguaaaauaaaauuaaaaaaaaaaaacaaucucuucuuccugguuc

SEQ ID NO: 27706 - RNA, 64 nt, hsa
agaggauggaagauuuucauguaaaauaaaauuaaaaaaaaaaaacaaucucuucuuccugguu

SEQ ID NO: 27707 - RNA, 64 nt, hsa
gagaggauggaagauuuucauguaaaauaaaauuaaaaaaaaaaaacaaucucuucuuccuggu

SEQ ID NO: 27708 - RNA, 64 nt, hsa
ucucuuuuccuauauauguuccuuacaaaaaaaaaaaaaaaagaaaucaagcagauggcuuaaa

SEQ ID NO: 27709 - RNA, 64 nt, hsa
uucucuuuuccuauauauguuccuuacaaaaaaaaaaaaaaaagaaaucaagcagauggcuuaa

SEQ ID NO: 27710 - RNA, 64 nt, hsa
auucucuuuuccuauauauguuccuuacaaaaaaaaaaaaaaaagaaaucaagcagauggcuua

SEQ ID NO: 27711 - RNA, 64 nt, hsa
aauucucuuuuccuauauauguuccuuacaaaaaaaaaaaaaaaagaaaucaagcagauggcuu

SEQ ID NO: 27712 - RNA, 64 nt, hsa
gaauucucuuuuccuauauauguuccuuacaaaaaaaaaaaaaaaagaaaucaagcagauggcu

SEQ ID NO: 27713 - RNA, 64 nt, hsa
ggaauucucuuuuccuauauauguuccuuacaaaaaaaaaaaaaaaagaaaucaagcagauggc

SEQ ID NO: 27714 - RNA, 64 nt, hsa
gggaauucucuuuuccuauauauguuccuuacaaaaaaaaaaaaaaaagaaaucaagcagaugg

SEQ ID NO: 27715 - RNA, 64 nt, hsa
ggggaauucucuuuuccuauauauguuccuuacaaaaaaaaaaaaaaaagaaaucaagcagaug

SEQ ID NO: 27716 - RNA, 64 nt, hsa
aggggaauucucuuuuccuauauauguuccuuacaaaaaaaaaaaaaaaagaaaucaagcagau

SEQ ID NO: 27717 - RNA, 64 nt, hsa
auccaguagggaaaauaggguccuugaaacagaaaaaaaaaaccaacccauguauagcuagcua

SEQ ID NO: 27718 - RNA, 64 nt, hsa
aauccaguagggaaaauaggguccuugaaacagaaaaaaaaaaccaacccauguauagcuagcu

SEQ ID NO: 27719 - RNA, 64 nt, hsa
aaauccaguagggaaaauaggguccuugaaacagaaaaaaaaaaccaacccauguauagcuagc

SEQ ID NO: 27720 - RNA, 64 nt, hsa
acgaugcaauucuagccaaaaaaaaaaaaaaaaaaaaaaaaauuuuuuuuuuuuacuuuuuccu

SEQ ID NO: 27721 - RNA, 64 nt, hsa
uacgaugcaauucuagccaaaaaaaaaaaaaaaaaaaaaaaaauuuuuuuuuuuuacuuuuucc

SEQ ID NO: 27722 - RNA, 64 nt, hsa
uuacgaugcaauucuagccaaaaaaaaaaaaaaaaaaaaaaaaauuuuuuuuuuuuacuuuuuc

SEQ ID NO: 27723 - RNA, 64 nt, hsa
guuacgaugcaauucuagccaaaaaaaaaaaaaaaaaaaaaaaaauuuuuuuuuuuuacuuuuu

SEQ ID NO: 27724 - RNA, 64 nt, hsa
uguuacgaugcaauucuagccaaaaaaaaaaaaaaaaaaaaaaaaauuuuuuuuuuuuacuuuu

SEQ ID NO: 27725 - RNA, 64 nt, hsa
cuguuacgaugcaauucuagccaaaaaaaaaaaaaaaaaaaaaaaaauuuuuuuuuuuuacuuu

SEQ ID NO: 27726 - RNA, 64 nt, hsa
acuguuacgaugcaauucuagccaaaaaaaaaaaaaaaaaaaaaaaaauuuuuuuuuuuuacuu

SEQ ID NO: 27727 - RNA, 64 nt, hsa
cacuguuacgaugcaauucuagccaaaaaaaaaaaaaaaaaaaaaaaaauuuuuuuuuuuuacu

SEQ ID NO: 27728 - RNA, 64 nt, hsa
acacuguuacgaugcaauucuagccaaaaaaaaaaaaaaaaaaaaaaaaauuuuuuuuuuuuac

SEQ ID NO: 27729 - RNA, 64 nt, hsa
cacacuguuacgaugcaauucuagccaaaaaaaaaaaaaaaaaaaaaaaaauuuuuuuuuuuua

SEQ ID NO: 27730 - RNA, 64 nt, hsa
ccacacuguuacgaugcaauucuagccaaaaaaaaaaaaaaaaaaaaaaaaauuuuuuuuuuuu

SEQ ID NO: 27731 - RNA, 64 nt, hsa
accacacuguuacgaugcaauucuagccaaaaaaaaaaaaaaaaaaaaaaaaauuuuuuuuuuu

SEQ ID NO: 27732 - RNA, 64 nt, hsa
gaccacacuguuacgaugcaauucuagccaaaaaaaaaaaaaaaaaaaaaaaaauuuuuuuuuu

SEQ ID NO: 27733 - RNA, 64 nt, hsa
ugaccacacuguuacgaugcaauucuagccaaaaaaaaaaaaaaaaaaaaaaaaauuuuuuuuu

SEQ ID NO: 27734 - RNA, 64 nt, hsa
gugaccacacuguuacgaugcaauucuagccaaaaaaaaaaaaaaaaaaaaaaaaauuuuuuuu

SEQ ID NO: 27735 - RNA, 64 nt, hsa
ugugaccacacuguuacgaugcaauucuagccaaaaaaaaaaaaaaaaaaaaaaaaauuuuuuu

SEQ ID NO: 27736 - RNA, 64 nt, hsa
gugugaccacacuguuacgaugcaauucuagccaaaaaaaaaaaaaaaaaaaaaaaaauuuuuu

SEQ ID NO: 27737 - RNA, 64 nt, hsa
agugugaccacacuguuacgaugcaauucuagccaaaaaaaaaaaaaaaaaaaaaaaaauuuuu

SEQ ID NO: 27738 - RNA, 64 nt, hsa
ucacacauauaaacuuauuucuaaaauuaaaagaaaaaaaaacuauagcagagaggcuaaaauc

SEQ ID NO: 27739 - RNA, 64 nt, hsa
aucacacauauaaacuuauuucuaaaauuaaaagaaaaaaaaacuauagcagagaggcuaaaau

SEQ ID NO: 27740 - RNA, 64 nt, hsa
uguuauuuugcuuuuacgucucaacuguguauguaaaaaaaaugaauauuuaaauuacaacccu

SEQ ID NO: 27741 - RNA, 64 nt, hsa
acccauccuuucauuuacucauauaauuagccaaaaaaaaaaggauggcuacauaccaauggau

SEQ ID NO: 27742 - RNA, 64 nt, hsa
aacccauccuuucauuuacucauauaauuagccaaaaaaaaaaggauggcuacauaccaaugga

SEQ ID NO: 27743 - RNA, 64 nt, hsa
uaacccauccuuucauuuacucauauaauuagccaaaaaaaaaaggauggcuacauaccaaugg

SEQ ID NO: 27744 - RNA, 64 nt, hsa
caaaaaaaaaaaaaaaaaaaaaaaaaaaaaaaaaaaaaaaaaccuuuggugccuuuucucucuu

SEQ ID NO: 27745 - RNA, 64 nt, hsa
ucaaaaaaaaaaaaaaaaaaaaaaaaaaaaaaaaaaaaaaaaaccuuuggugccuuuucucucu

SEQ ID NO: 27746 - RNA, 64 nt, hsa
cucaaaaaaaaaaaaaaaaaaaaaaaaaaaaaaaaaaaaaaaaaccuuuggugccuuuucucuc

SEQ ID NO: 27747 - RNA, 64 nt, hsa
ucucaaaaaaaaaaaaaaaaaaaaaaaaaaaaaaaaaaaaaaaaaccuuuggugccuuuucucu

SEQ ID NO: 27748 - RNA, 64 nt, hsa
aucucaaaaaaaaaaaaaaaaaaaaaaaaaaaaaaaaaaaaaaaaaccuuuggugccuuuucuc

SEQ ID NO: 27749 - RNA, 64 nt, hsa
caucucaaaaaaaaaaaaaaaaaaaaaaaaaaaaaaaaaaaaaaaaaccuuuggugccuuuucu

SEQ ID NO: 27750 - RNA, 64 nt, hsa
ccaucucaaaaaaaaaaaaaaaaaaaaaaaaaaaaaaaaaaaaaaaaaccuuuggugccuuuuc

SEQ ID NO: 27751 - RNA, 64 nt, hsa
uccaucucaaaaaaaaaaaaaaaaaaaaaaaaaaaaaaaaaaaaaaaaaccuuuggugccuuuu

SEQ ID NO: 27752 - RNA, 64 nt, hsa
cuccaucucaaaaaaaaaaaaaaaaaaaaaaaaaaaaaaaaaaaaaaaaaccuuuggugccuuu

SEQ ID NO: 27753 - RNA, 64 nt, hsa
acuccaucucaaaaaaaaaaaaaaaaaaaaaaaaaaaaaaaaaaaaaaaaaccuuuggugccuu

(The sequence listing continues in the following parts.)

The invention claimed is:

1. An isolated nucleic acid, wherein the sequence of the nucleic acid consists of:

(a) SEQ ID NO: 4277;

(b) a DNA encoding (a), wherein the DNA is identical in length to (a);

(c) a sequence at least 80% identical to (a) or (b); or (d) the complement of any one of (a)-(c), wherein the complement is identical in length to (a).

2. An isolated nucleic acid, wherein the sequence of the nucleic acid consists of:

(a) SEQ ID NO: 15666;

(b) a DNA encoding (a), wherein the DNA is identical in length to (a);

(c) a sequence at least 80% identical to (a) or (b); or (d) the complement of any one of (a)-(c), wherein the complement is identical in length to (a).

3. An isolated nucleic acid, wherein the sequence of the nucleic acid consists of:

(a) SEQ ID NO: 15667;

(b) a DNA encoding (a), wherein the DNA is identical in length to (a); or (c) the complement of (a) or (b), wherein the complement is identical in length to (a).

4. A vector comprising a heterologous sequence, wherein the heterologous sequence consists of the sequence of the nucleic acid of claim 1.

5. A vector comprising a heterologous sequence, wherein the heterologous sequence consists of the sequence of the nucleic acid of claim 2.

6. A vector comprising a heterologous sequence, wherein the heterologous sequence consists of the sequence of the nucleic acid of claim 3.

7. A probe comprising a heterologous sequence, wherein the heterologous sequence consists of the sequence of the nucleic acid of claim 1.

8. A probe comprising a heterologous sequence, wherein the heterologous sequence consists of the sequence of the nucleic acid of claim 2.

9. A probe comprising a heterologous sequence, wherein the heterologous sequence consists of the nucleic acid of claim 3.

* * * * *